US012594311B2

(12) United States Patent
Zhang et al.

(10) Patent No.: US 12,594,311 B2
(45) Date of Patent: Apr. 7, 2026

(54) *LACTOBACILLUS PLANTARUM* PDG8 AND USE IN TREATING CARDIOVASCULAR DISEASES

(71) Applicant: Pouda Biotech LLC, Radnor, PA (US)

(72) Inventors: Jun Zhang, Xian (CN); Xin Xie, Xian (CN)

(73) Assignee: Pouda Biotech LLC, Radnor, PA (US)

( * ) Notice: Subject to any disclaimer, the term of this patent is extended or adjusted under 35 U.S.C. 154(b) by 350 days.

(21) Appl. No.: 18/323,235

(22) Filed: May 24, 2023

(65) Prior Publication Data

US 2024/0024389 A1      Jan. 25, 2024

Related U.S. Application Data

(60) Provisional application No. 63/347,281, filed on May 31, 2022.

(30) Foreign Application Priority Data

May 26, 2022    (CN) .......................... 202210585567.4

(51) Int. Cl.
| | |
|---|---|
| *A61K 35/747* | (2015.01) |
| *A23L 33/135* | (2016.01) |
| *A61K 35/00* | (2006.01) |
| *A61P 3/04* | (2006.01) |
| *A61P 3/06* | (2006.01) |
| *A61P 9/10* | (2006.01) |
| *C12N 1/20* | (2006.01) |
| *C12N 1/205* | (2026.01) |
| *C12R 1/25* | (2006.01) |

(52) U.S. Cl.
CPC .......... *A61K 35/747* (2013.01); *A23L 33/135* (2016.08); *A61P 3/04* (2018.01); *A61P 3/06* (2018.01); *A61P 9/10* (2018.01); *C12N 1/205* (2021.05); *A61K 2035/115* (2013.01); *C12R 2001/25* (2021.05)

(58) Field of Classification Search
None
See application file for complete search history.

(56)      References Cited

FOREIGN PATENT DOCUMENTS

| | | |
|---|---|---|
| CN | 110714038 A | 1/2020 |
| CN | 111281897 A | 6/2020 |

OTHER PUBLICATIONS

Hassan et al. Appl. Microbiol. Biotechnol. 104: 6337-6350, May 29, 2020.*

Herrero-Fernandez et al., "Immunobiology of Atherosclerosis: A Complete Net of Interactions," *Int. J. Mol. Sci.* 20:5293, 48 pages, 2019.

Lam et al., "Intestinal microbiota determine severity of myocardial infarction in rats," *Faseb J.* 26(4):1727-1735, 2012.

Libby et al., "Progress and challenges in translating the biology of atherosclerosis," *Nature* 473:317-325, May 2011.

Liu et al., "The probiotic role of Lactobacillus plantarum in reducing risks associated with cardiovascular disease," *International Journal of Food Science and Technology* 52:127-136, 2017.

Nordström et al., "Lactiplantibacillus plantarum 299v (LP299V®): three decades of research," *Beneficial Microbes* 12(5):441-465, 2021.

* cited by examiner

*Primary Examiner* — S. Devi

(74) *Attorney, Agent, or Firm* — Seed IP Law Group LLP

(57)      ABSTRACT

Provided are a *Lactobacillus plantarum* strain, *Lactobacillus plantarum* PDG8, and a composition thereof. Also provided are methods using *Lactobacillus plantarum* PDG8 or a composition thereof for treating a cardiovascular disease such as atherosclerosis.

22 Claims, 10 Drawing Sheets

Specification includes a Sequence Listing.

LACTOBACILLUS PLANTARUM PDG8 AND USE IN TREATING CARDIOVASCULAR DISEASES

REFERENCE TO AN ELECTRONIC SEQUENCE LISTING

The contents of the electronic sequence listing (760288_402_SEQUENCE_LISTING.xml; Size: 3,263,391 bytes; and Date of Creation: May 22, 2023) is herein incorporated by reference in its entirety.

TECHNICAL FIELD

The present disclosure relates to a *Lactobacillus plantarum* strain useful in treating a cardiovascular disease, *Lactobacillus plantarum* PDG8. Specifically, the present disclosure relates to a composition, including a pharmaceutical composition, which includes *Lactobacillus plantarum* PDG8 and a culture thereof. The present disclosure also relates to a method of using *Lactobacillus plantarum* PDG8 or a composition containing *Lactobacillus plantarum* PDG8 in treating cardiovascular diseases such as atherosclerosis.

BACKGROUND

Atherosclerosis is a global chronic cardiovascular disease, which is one of the main causes of human disability and even death. The current mainstream strategy for clinical treatment of atherosclerosis is to take statins. Although statins reducing cholesterol synthesis, long-term use can also cause great damage to the liver, and may even increase the risk of heart disease. In more recent proposed treatments, stem cells are used to promote tissue repair and angiogenesis, but the survival rate of stem cells after transplantation is low, the tropism is also relatively poor, and the therapeutic effect is not ideal. The formation of atherosclerotic plaques can also be inhibited by injecting various antibodies and vaccines. However, these treatment options are costly, the operation process is complicated, and the side effects after treatment are difficult to predict and control, and further research is needed to solve them. Accordingly, other treatments for atherosclerosis are needed.

SUMMARY

The present disclosure provides a novel *Lactobacillus plantarum* strain having neurological effects, *Lactobacillus plantarum* PDG8. In addition, the present disclosure provides a composition comprising *Lactobacillus plantarum* PDG8 and a culture thereof. The present disclosure further discloses methods using *Lactobacillus plantarum* PDG8 or a composition containing *Lactobacillus plantarum* PDG8 for treating cardiovascular diseases such as atherosclerosis.

In one aspect, the present disclosure provides an isolated *Lactobacillus plantarum* PDG8 strain deposited at Guangdong Microbial Culture Collection Center (GDMCC) under Accession No. 62261.

In another aspect, the present disclosure provides a composition comprising *Lactobacillus plantarum* PDG8 or a culture thereof and an excipient.

In another aspect, the present disclosure provides a method of treating cardiovascular diseases (e.g., atherosclerosis), comprising administering to a subject in need thereof a therapeutically effective amount of the isolated *Lactobacillus plantarum* PDG8 strain or a composition thereof.

In a related aspect, the present disclosure provides an isolated *Lactobacillus plantarum* PDG8 strain or a composition thereof for use in a method of treating the human or animal body by therapy.

In another related aspect, the present disclosure provides an isolated *Lactobacillus plantarum* PDG8 strain or a composition thereof for use in a method of treating a cardiovascular disease (e.g., atherosclerosis).

BRIEF DESCRIPTION OF THE DRAWINGS

In order to more clearly describe the technical solutions in the embodiments of the present invention, the appended drawings used in embodiments are briefly described below.

FIG. 3A is oil red staining of mouse aortic arch and thoracic aorta. FIG. 3B is the statistical result of the proportion of the lesion area of mouse aortic arch and thoracic aorta.

FIG. 4A is the statistical result of mouse serum total cholesterol, FIG. 4B is the statistical result of mouse serum triglyceride, and FIG. 4C is the statistical result of mouse serum low-density lipoprotein.

FIG. 5A is the statistical result of the level of pro-inflammatory factor IL-6, and FIG. 5B is the statistical result of the level of tumor necrosis factor TNF-α.

DETAILED DESCRIPTION

Figure 1:
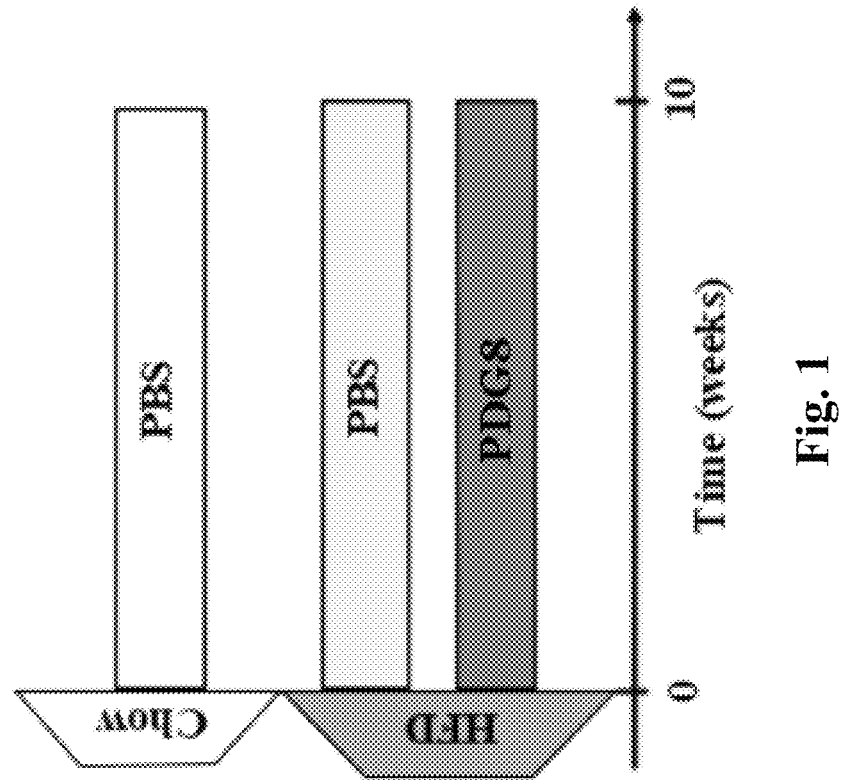
FIG. 1 shows the establishment of the $ApoE^{-/-}$ male mouse model of atherosclerosis as described in Example 1.

Additional aspects and advantages of the present disclosure will become apparent to those skilled in this art from the following detailed description, wherein illustrative aspects of the present disclosure are shown and described. As will be appreciated, the present disclosure is capable of other and different aspects, and its several details are capable of modifications in various respects, all without departing from the disclosure. Accordingly, the descriptions are to be regarded as illustrative in nature, and not as restrictive.

Where values are described as ranges, it will be understood that such disclosure includes the disclosure of all possible sub-ranges within such ranges, as well as specific numerical values that fall within such ranges irrespective of whether a specific numerical value or specific sub-range is expressly stated.

The present disclosure provides a *Lactobacillus plantarum* strain having neurological effects, *Lactobacillus plantarum* PDG8. In addition, the present disclosure provides a composition, such as a pharmaceutical composition or a nutraceutical composition, which includes *Lactobacillus plantarum* PDG8 and a culture thereof. The present disclosure further discloses methods using *Lactobacillus plantarum* PDG8 or a composition containing *Lactobacillus plantarum* PDG8 for treating cardiovascular diseases (e.g., atherosclerosis).

*Lactobacillus plantarum* PDG8 disclosed herein has one or more of the following characteristics:

a) acid resistance, b) bile resistance, c) no hemolytic activity against red blood cells, d) weak or no antibiotic resistance, e) capable of reducing number or sizes of atherosclerotic plaques when administered to a subject, f) capable of relieving inflammation (e.g., reducing the expression levels of pro-inflammatory factors including IL-6 and INF-$\alpha$ in serum) when administered to a subject, g) capable of reducing blood lipid content (e.g., total cholesterol, triglyceride, and/or low-density lipoprotein cholesterol) when administered to a subject, h) capable of treating a cardiovascular disease (e.g., atherosclerosis) in a subject in need thereof, i) capable of reducing body fat (e.g., abdominal fat) when administered to a subject, j) capable of maintaining or improving the integrity of the intestinal barrier when administered to a subject, k) useful as an active ingredient in a pharmaceutical or nutraceutical composition.

*Lactobacillus plantarum* PDG8

In one aspect, the present disclosure provides a *Lactobacillus plantarum* strain, *Lactobacillus plantarum* PDG8.

As used herein, the term "*Lactobacillus*" refers to a microorganism belonging to the genus of aerobic or facultative anaerobic gram-positive *bacillus* widely distributed in nature. Microorganisms belonging to the genus *Lactobacillus* include *Lactobacillus plantarum*, etc.

The *Lactobacillus plantarum* PDG8 of the present disclosure was obtained by isolation from the fermented vegetables. After isolation and purification, whole genomic sequencing confirmed that the strain is *Lactobacillus plantarum*, belonging to Firmicutes Lactobacillales, Lactiplantibacillus, *Lactobacillus plantarum*. The novel isolated *Lactobacillus plantarum* PDG8 was deposited at Guangdong Microbial Culture Collection Center (GDMCC), Institute of Microbiology, Guangdong Academy of Sciences, No. 59 Building, No. 100 Xianliezhong Road, Yuexiu District, Guangzhou 510075, China, under Accession No. 62261 on Mar. 4, 2022.

The term "isolated" refers to the state of a substance or microorganism separating from its naturally occurring environment. In certain embodiment, at least 50%, such as at least 60%, 70%, 80%, 90%, 95%, 97%, 98%, or 99%, of the materials in the naturally occurring environment other than the substance or microorganism of interest have been removed to generate an isolated substance or microorganism. In certain embodiments, an isolated substance or microorganism is at least 50%, such as at least 60%, 70%, 80%, 90%, 95%, 97%, 98%, or 99% pure. In other words, at least 50%, such as at least 60%, 70%, 80%, 90%, 95%, 97%, 98%, or 99% (by weight) of the isolated substance or microorganism is the substance or microorganism of interest.

The invention further provides a mutant, a variant, and/or a progeny of the deposited *Lactobacillus plantarum* PDG8 strain.

As used herein, the term "mutant" refers to any bacterium resulting from modification of the parent (i.e., deposited) strain. For example, a mutant may be a bacterium resulting from genetically modifying the deposited strain.

As used herein, the term "variant" refers to a naturally occurring bacterium derived from the parent (i.e., deposited)

strain. For example, a variant may be a bacterium resulting from adaption to particular cell culture conditions.

As used herein, the term "progeny" means any bacterium resulting from the reproduction or multiplication of the deposited strain. Therefore, "progeny" means any direct descendant of the deposited strain. As such, the progeny strain may itself be identified as the same strain as the parent (i.e., deposited) strain. It will be apparent to one skilled in the art that due to the process of asexual reproduction, a progeny strain will be genetically virtually identical to the parent strain. Accordingly, in one embodiment, the progeny may be genetically identical to the parent strain and may be considered to be a "clone" of the parent strain. Alternatively, the progeny may be substantially genetically identical to the parent strain.

The mutant, variant or progeny may have at least 90, 95, 98, 99, 99.5 or 99.9% sequence identity over the entire length of the bacterial genome with their parent strain. Furthermore, the mutant, variant or progeny will retain the same phenotype as the deposited parent strain.

As used herein, "identical" or "identity" refers to the similarity between a DNA, RNA, nucleotide, amino acid, or protein sequence to another DNA, RNA, nucleotide, amino acid, or protein sequence. Identity can be expressed in terms of a percentage of sequence identity of a first sequence to a second sequence. Percent (%) sequence identity with respect to a reference DNA sequence can be the percentage of DNA nucleotides in a candidate sequence that are identical with the DNA nucleotides in the reference DNA sequence after aligning the sequences. Percent (%) sequence identity with respect to a reference amino acid sequence can be the percentage of amino acid residues in a candidate sequence that are identical with the amino acid residues in the reference amino acid sequence after aligning the sequences and introducing gaps, if necessary, to achieve the maximum percent sequence identity, and not considering any conservative substitutions as part of the sequence identity. The algorithm used herein for determining percent sequence identity is the BLAST 2.0 algorithm, as described in Altschul et al. "Gapped BLAST and PSI-BLAST: a new generation of protein database search programs," Nucleic Acids Res. 2007, 25, 3389-3402, with the parameters set to default values.

As shown in the Examples below, the *Lactobacillus plantarum* PDG8 is capable of reducing accumulation of fat (e.g., abdominal fat), formation, number and/or sizes of atherosclerotic plaques, amount of blood lipid (e.g., total cholesterol, triglyceride and low-density lipoprotein cholesterol), and expression of pro-inflammatory factors (e.g., TNF-$\alpha$, IL-6) as well as improving the intestinal barrier.

In some embodiments, the *Lactobacillus plantarum* PDG8 may cause fewer side effects or less intense side effects in a patient than a conventional drug for treating a cardiovascular disease (e.g., atherosclerosis), such as a statin. Side effects include headache, dizziness, feeling sick, unusually tired or physically weak, digestive system problems, muscle pain, sleep problems, low blood platelet count, or the like.

In some embodiments, the *Lactobacillus plantarum* PDG8 may be able to colonize the intestine of a patient, and may have resistance to acid and bile salts.

As used herein, the term "acid resistance" refers to the property of withstanding high acidity. If probiotics are acid-resistant, they can be prevented from being degraded or damaged even when exposed to strong acidic conditions in the stomach, by consumption through oral administration.

As used herein, the term "bile resistance" refers to the resistance to digestive enzymes in bile. Bile is made in the liver and stored in the gallbladder, and is a weak alkaline greenish-brown liquid that helps the digestion of fat in the duodenum of the small intestine, and contains various enzymes that help digestion and absorption by emulsifying fat. Bile is one of the major causes of reducing the effect of probiotic administration as it acts on probiotics ingested through oral administration.

The *Lactobacillus plantarum* PDG8 of the present disclosure may not exhibit a hemolytic activity against red blood cells. Hemolysis refers to the destruction of red blood cells and the release of hemoglobin to the surrounding area, and is an action by which the red blood cells are hemolyzed by enzymes produced from harmful bacteria in vivo. Therefore, the *Lactobacillus plantarum* PDG8 is recognized as a stable microorganism that does not cause hemolysis in the blood vessels even if it is administered in vivo.

In addition, the *Lactobacillus plantarum* PDG8 of the present disclosure may have a weak resistance or no resistance to antibiotics. No drug resistant genes were identified in the genome of *Lactobacillus plantarum* PDG8 using AMRFinderPlus, NCBI. Accordingly, when the *Lactobacillus plantarum* PDG8 is used in pharmaceuticals, health functional foods, feed additives, etc., it has little or no resistance to antibiotics, and thus, the probability of causing related pharmacological effects or environmental problems is low.

In some embodiments, the *Lactobacillus plantarum* PDG8 bacteria may be modified using recombinant techniques to contain an antibiotic susceptibility gene or other gene that facilitates destruction of the bacteria after introduction into a patient.

In more specific embodiments, the *Lactobacillus plantarum* PDG8 may be provided as a probiotic.

In order to stably maintain the *Lactobacillus plantarum* PDG8 of the present disclosure for a long period of time, the strain may be stored by dissolving the cells in a storage solution prepared by mixing a certain amount of glycerol in water at −70° C., or may be freeze-dried by for example suspending the cells in sterilized 10% skim milk, but methods of maintaining the strain are not limited thereto.
Compositions Containing *Lactobacillus plantarum* PDG8

In another aspect of the present disclosure, there is provided a composition (e.g., a pharmaceutical composition or a nutraceutical composition) including the *Lactobacillus plantarum* PDG8 bacteria, a culture thereof, a concentrate thereof, or a dried form thereof and optionally an excipient.

In certain embodiments, the composition may comprise, consist essentially of, or consist of isolated *Lactobacillus plantarum* PDG8 bacteria. In other embodiments, the composition may be in a formulation for administration to a patient. In certain embodiments, the composition and/or the excipient is not naturally occurring.

The term "excipient" refers to an inactive substance that serves as the vehicle, carrier or medium for an active substance (e.g., *Lactobacillus plantarum* PDG8 bacteria or culture thereof). An excipient may be included in a composition for the purpose of long-term stabilization, bulking up solid formulations that contain potent active ingredients in small amounts, or to confer a therapeutic enhancement on the active ingredient in the final dosage form, such as facilitating drug absorption, reducing viscosity, or enhancing solubility. Excipients can also be useful in the manufacturing process, to aid in the handling of the active substance concerns such as by facilitating powder flowability or non-stick properties, in addition to aiding in vitro stability such as prevention of denaturation or aggregation over the expected shelf life.

Exemplary excipients including cryoprotectants (e.g., glycerol, trehalose, maltodextrin, skim milk powder, and starch), bulking agents, fillers, diluents, anti-adherents (e.g., magnesium stearate), binders (e.g., saccharides including sucrose, lactose, starches, cellulose, microcrystalline cellulose, hydroxypropyl cellulose, xylitol, sorbitol, or mannitol; proteins including gelatin; and synthetic polymers including polyvinylpyrrolidone (PVP) and polyethylene glycol (PEG)), coatings (e.g., hydroxypropyl methylcellulose, fatty acids, waxes, shellac, and plant fibers), disintegrants (e.g., crosslinked polymers including crosslinked polyvinylpyrrolidone, crosslinked sodium caboxymethyl cellulose, and sodium starch glycolate), flavoring agents (e.g., fruit extract), glidants (e.g., silica gel, fumed silica, talc and magnesium carbonate), lubricants (e.g., talc, silica, fats), preservatives (e.g., antioxidants like vitamin A, vitamin E, vitamin C, retinyl palmitate and selenium; amino acids cysteine and methionine; citric acid and sodium citrate; and synthetic preservatives like the parabens (e.g., methyl paraben and propyl paraben), sorbents, sweeteners, and vehicles (e.g., dimethyl suloxide) for liquid and gel formulations.

In some embodiments, the composition is in the form of a liquid, a suspension, a dried (e.g., lyophilized) powder, a tablet, a capsule, a suppository, or an enema fluid, or a frozen liquid, suspension, or enema fluid. Dried compositions may be produced by air drying, natural drying, spray drying, freeze drying, lyophilization, and any combinations thereof. Compositions in the freeze dried state may include a protectant, such as a cryoprotectant, which may include ethylene glycol, dimethyl sulfoxide (DMSO), glycerol, and any combinations thereof. Such compositions may be reconstituted with a solution, such as a buffer, prior to oral, nasogastrical, or rectal administration.

In a liquid or suspension composition, the concentration of *Lactobacillus plantarum* PDG8 bacteria may be $10^3$ CFU/mL to $10^8$ CFU/mL, $10^4$ CFU/mL to $10^8$ CFU/mL, $10^5$ CFU/mL to $10^8$ CFU/mL, $10^6$ CFU/mL to $10^8$ CFU/mL, $10^3$ CFU/mL to $10^7$ CFU/mL, $10^4$ CFU/mL to $10^7$ CFU/mL, $10^5$ CFU/mL to $10^7$ CFU/mL, $10^6$ CFU/mL to $10^7$ CFU/mL, but is not limited thereto. In a solid composition, the amount of *Lactobacillus plantarum* PDG8 bacteria may be $10^5$ CFU/g to $10^{13}$ CFU/g, $10^6$ CFU/g to $10^{13}$ CFU/g, $10^7$ CFU/g to $10^{13}$ CFU/g, $10^8$ CFU/g to $10^{13}$ CFU/g, $10^5$ CFU/g to $10^{12}$ CFU/g, $10^6$ CFU/g to $10^{12}$ CFU/g, $10^7$ CFU/g to $10^{12}$ CFU/g, $10^8$ CFU/g to $10^{12}$ CFU/g, $10^5$ CFU/g to $10^{11}$ CFU/g, $10^6$ CFU/g to $10^{11}$ CFU/g, $10^7$ CFU/g to $10^{11}$ CFU/g, $10^8$ CFU/g to $10^{11}$ CFU/g, $10^5$ CFU/g to $10^{10}$ CFU/g, $10^6$ CFU/g to $10^{10}$ CFU/g, $10^7$ CFU/g to $10^{10}$ CFU/g, $10^8$ CFU/g to $10^{10}$ CFU/g, $10^5$ CFU/g to $10^9$ CFU/g, $10^6$ CFU/g to $10^9$ CFU/g, $10^7$ CFU/g to $10^9$ CFU/g, $10^5$ CFU/g to $10^8$ CFU/g, or $10^6$ CFU/g to $10^8$ CFU/g by weight of the composition.

In certain embodiments, the composition is provided in unit dosage form. The composition may comprise *Lactobacillus plantarum* PDG8 bacteria in an amount ranging $10^5$ CFU to $10^{13}$ CFU, $10^6$ CFU to $10^{13}$ CFU, $10^7$ CFU to $10^{13}$ CFU, $10^8$ CFU to $10^{13}$ CFU, $10^5$ CFU to $10^{12}$ CFU, $10^6$ CFU to $10^{12}$ CFU, $10^7$ CFU to $10^{12}$ CFU, $10^8$ CFU to $10^{12}$ CFU, $10^5$ CFU to $10^{11}$ CFU, $10^6$ CFU to $10^{11}$ CFU, $10^7$ CFU to $10^{11}$ CFU, $10^8$ CFU to $10^{11}$ CFU, $10^5$ CFU to $10^{10}$ CFU, $10^6$ CFU to $10^{10}$ CFU, $10^7$ CFU to $10^{10}$ CFU, $10^8$ CFU to $10^{10}$ CFU, $10^5$ CFU to $10^9$ CFU, $10^6$ CFU to $10^9$ CFU, $10^7$ CFU to $10^9$ CFU, $10^5$ CFU to $10^8$ CFU, or $10^6$ CFU to $10^8$ CFU per unit dosage form.

The composition provided herein preferably contains *Lactobacillus plantarum* PDG8 bacteria or culture thereof in an amount sufficient to colonize the intestine of a subject when administered to the subject.

In certain embodiments, the present disclosure provides a pharmaceutical composition comprising isolated *Lactobacillus plantarum* PDG8 bacteria and a pharmaceutically acceptable excipient.

A pharmaceutically acceptable excipient includes pharmaceutically acceptable cryoprotectants, bulking agents, fillers, diluents, anti-adherents, binders, coatings, disintegrants flavoring agents, glidants, lubricants, preservatives, sorbents, sweeteners, and vehicles or carriers.

In certain embodiments, the pharmaceutical composition includes at least one cryoprotectant selected from the group consisting of glycerol, trehalose, maltodextrin, skim milk powder, and starch. The cryoprotectant of the present disclosure may be contained in an amount of 0.01% to 20% by weight or 0.01% to 10% by weight based on the total weight of the composition. Specifically, based on the total weight of the composition, the glycerol may be contained in an amount of 5% to 20% by weight, the trehalose may be contained in an amount of 2% to 10% by weight, the maltodextrin may be contained in an amount of 2% to 10% by weight, the skim milk powder may be contained in an amount of 0.5% to 2% by weight, and the starch may be contained in an amount of 0.1% to 1% by weight in the composition.

In certain embodiments, the excipient may include at least one or any combination of diluent (Tris, citrate, acetate or phosphate buffers) having various pH values and ionic strengths, solubilizer such as Tween® or polysorbate, carriers such as human serum albumin or gelatin, preservatives such as thimerosal, parabens, benzylalconium chloride or benzyl alcohol, antioxidants such as ascorbic acid or sodium metabisulfite, and other components such as lysine, glycine, glucose, dextrin, skim milk, mannitol or succinylated β-lactoglobulin. In addition, the excipient may be contained in an amount of 50% to 95% by weight, 75% to 95% by weight or 85% to 95% by weight based on the total weight of the composition.

Selection of a particular pharmaceutical composition will depend upon a number of factors, including the condition being treated, the route of administration and the pharmacokinetic parameters desired. A more extensive survey of components suitable for pharmaceutical compositions is found in Remington's Pharmaceutical Sciences, 18th ed. A. R. Gennaro, ed. Mack, Easton, Pa. (1980).

The route of administration of a pharmaceutical composition eventually chosen will depend upon a number of factors and can be ascertained by one skilled in the art. In certain embodiments, the compositions can be further formulated using pharmaceutically acceptable carriers well known in the art in dosages suitable for oral, nasogastric, or rectal administration. Such carriers enable the pharmaceutical compositions to be formulated as tablets, pills, capsules, liquids, gels, syrups, slurries, suspensions, enema formulations, and the like, for oral, rectal or nasogastric administration to a patient to be treated. Formulations can include, for example, polyethylene glycol, cocoa butter, glycerol and the like.

In some embodiments, the pharmaceutical composition may further include one or more additional therapeutic agents, such as anti-atherosclerosis agents.

The pharmaceutical composition can be administered in any sterile, biocompatible pharmaceutical carrier, including saline, buffered saline, dextrose, and water.

In certain embodiments, the present disclosure provides a nutraceutical composition comprising isolated *Lactobacillus plantarum* PDG8 bacteria or a culture thereof as an active ingredient. A "nutraceutical composition" refers to a food product or a food supplement capable of providing not only a nutritional effect and/or a taste satisfaction, but is also capable of delivering a therapeutic (or other beneficial) effect to a subject who consumes the composition. The nutraceutical composition may be in form of a probiotic composition, synbiotic composition, functional food, food supplement, or food product, including beverage.

The content of *Lactobacillus plantarum* PDG8 or cultures thereof in the nutraceutical composition may be based on the age or weight of the subject, desired effects, etc., and may be, for example, used in an amount of 0.0001% to 1% of the weight of the subject, such as 0.0001% to 0.001%, 0.0001% to 0.01%, 0.0001% to 0.1%, 0.001% to 0.01%, 0.001% to 0.1%, 0.01% to 0.10%, 0.010% to 10%, or 0.1 to 10% of the weight of the subject.

A nutraceutical composition of the present disclosure may further include a mixture of one or more of an organic acid such as citric acid, fumaric acid, adipic acid, lactic acid, etc.; a phosphate such as potassium phosphate, sodium phosphate, polyphosphate, etc.; or a natural antioxidant such as polyphenol, catechin, tocopherol, vitamin C, green tea extract, chitosan, tannic acid, etc.

In certain embodiments, isolated *Lactobacillus plantarum* PDG8, its culture, or a composition thereof may be used as a probiotic or probiotic composition. As used herein, the term "probiotics" refers to live bacteria that enter the body and provide a healthy benefit, such as improving the microbial balance of the body via, for example, ecological interactions with the resident flora in the digestive tract and/or reducing or eliminating symptoms or severity of a disorder (e.g., atherosclerosis) via, for example, influencing the host physiology and immune system in a positive manner.

The probiotic composition provided herein may further comprise one or more other probiotics, such as other *Lactobacillus*, *Bifidobacterium* and *Enterococcus* in the form of fermented milk, granules, powder, etc.

In certain embodiments, the present disclosure provides a symbiotic composition comprising isolated *Lactobacillus plantarum* PDG8 or a culture thereof and one or more prebiotics. A "prebiotic" refers to a substance having a beneficial effect on a probiotic, such as food for *Lactobacillus plantarum* PDG8. Exemplary prebiotics include inulin, pectin and resistant starches.

In certain embodiments, the present disclosure provides a food supplement comprising isolated *Lactobacillus plantarum* PDG8 or a culture thereof and one or more prebiotics. As used herein, a "food supplement," "supplement composition," or "dietary supplement" refers to a composition that contains a dietary ingredient (e.g., isolated *Lactobacillus plantarum* PDG8 or a culture thereof) intended to add nutritional value or health benefits to supplement the diet. A food supplement may be added to a food, but that is not itself a food or intended to be a food, or that may be ingested independently of a food. The food supplement disclosed herein may comprise, in addition to isolated *Lactobacillus plantarum* PDG8 or a culture thereof, one or more dietary ingredients such as a vitamin, a mineral, a herb or other botanical, and an amino acid.

A food supplement of the present disclosure may be an immediate-release or sustained-release formulation, and may further include a carrier, such as an edible carrier. The edible carrier may include corn starch, lactose, sucrose, or propylene glycol. A solid carrier may be used for tablets, powders, troches, etc., and a liquid carrier may include syrups, liquid suspensions, emulsions, solutions, etc. Further, the food supplement may include a preservative, a lubricant, a solution accelerator, or a stabilizer.

The disclosure further provides a functional food that contains *Lactobacillus plantarum* PDG8 or a culture thereof. As used herein, the term "functional food" refers to a human food that has a beneficial effect (e.g., medical or physiological benefit other than a purely nutritional effect) in addition to providing nutrition.

In certain embodiments, the present disclosure provides a food product comprising isolated *Lactobacillus plantarum* PDG8 or a culture thereof and one or more prebiotics. A "food product" means a product or composition that is intended for consumption by a human or a non-human animal. Such food products include any food, feed, snack, food supplement, liquid, beverage, treat, toy (chewable and/or consumable toys), meal substitute or meal replacement.

In a functional food or a food product of the present disclosure, the *Lactobacillus plantarum* PDG8 or cultures thereof may be present in an amount of 0.0001% to 1% by weight, specifically 0.001% to 0.1% by weight, based on a raw material composition including the *Lactobacillus plantarum* PDG8. However, in the case of long-term administration, the amount may be less than the above-described range, such as 0.001% to 0.01% by weight based on a raw material composition including the *Lactobacillus plantarum* PDG8.

There is no particular limitation on the type of the food to which *Lactobacillus plantarum* PDG8 or cultures thereof may be included. Examples of foods to which *Lactobacillus plantarum* PDG8 or cultures thereof can be added include meats, sausages, breads, chocolates, candies, snacks, confectionaries, pizzas, instant noodles, other noodles, gums, dairy products including ice creams, yoghurt, curdled milk, and whole milk, various kinds of soup, beverages, teas, drinks, alcoholic drinks, vitamin complexes, etc., and all functional foods.

A beverage or drink comprising *Lactobacillus plantarum* PDG8 or cultures thereof may further contain various flavoring agents or natural carbohydrates, as in conventional drinks. The aforementioned natural carbohydrates may include monosaccharides such as glucose, fructose, etc.; disaccharides such as maltose, sucrose, etc.; polysaccharides such as dextrin, cyclodextrin, etc.; and sugar alcohols such as xylitol, sorbitol, erythritol, etc. Natural sweetening agents such as thaumatin, a *stevia* extract, etc.; and synthetic sweetening agents such as saccharin, aspartame, etc. may be used as the sweetening agent. A ratio of the additional components may be in a range of 0.01 to 0.04 parts by weight, specifically 0.02 to 0.03 parts by weight, based on 100 parts by weight of the *Lactobacillus plantarum* PDG8 or cultures thereof.

The present disclosure further includes a method of preparing a composition as described herein, which may include a step of mixing an additive with the *Lactobacillus plantarum* PDG8, a culture thereof, a concentrate thereof, or a dried form thereof. The additive may be the above-described excipient, such as a cryoprotectant, or a carrier.

The *Lactobacillus plantarum* PDG8 may be cultured by a conventional method for culturing *Lactobacillus* strains. As the medium, a natural medium or a synthetic medium may be used. As the carbon source of the medium, for example, glucose, sucrose, dextrin, glycerol, starch, etc. may be used. As the nitrogen source, peptone, meat extracts, yeast extracts, dried yeasts, soybean, ammonium salts, nitrate, and other organic or inorganic nitrogen-containing compounds may be used, but the nitrogen source is not limited thereto. As the inorganic salts included in the medium, magnesium, manganese, calcium, iron, potassium, etc. may be used, but the inorganic salts are not limited thereto. Amino acids, vitamins, nucleic acids, and related compounds may be added to the medium in addition to the carbon source, the nitrogen source, and the components of the inorganic salts. The *Lactobacillus plantarum* PDG8 may be cultured for 12 hours to 4 days in a temperature range of 20° C. to 40° C.

Specifically, the culture broth of the *Lactobacillus plantarum* PDG8 may be a crude culture broth containing cells, and may also be cells from which a culture supernatant is removed, or concentrated cells. The composition of the culture broth may additionally contain not only components required for conventional culture of *Lactobacillus*, but also components that act synergistically to the growth of *Lactobacillus*, and the compositions thereof may be readily selected by those skilled in the art.

Methods of Treatment Using *Lactobacillus plantarum* PDG8

In another aspect, the present disclosure provides a method for treating a cardiovascular disease (e.g., atherosclerosis) comprising administering to a subject in need thereof a therapeutically effective amount of the isolated *Lactobacillus plantarum* PDG8 strain or a composition (e.g., a pharmaceutical composition) comprising the isolated *Lactobacillus plantarum* PDG8 strain or a culture thereof provided herein.

In related aspects, the present disclosure provides the isolated *Lactobacillus plantarum* PDG8 strain or a composition (e.g., a pharmaceutical composition) comprising the isolated *Lactobacillus plantarum* PDG8 strain or a culture thereof as described above for use in a method of treating the human or animal body by therapy, such as in a method for treating a cardiovascular disease (e.g., atherosclerosis).

Cardiovascular diseases (heart and blood vessel diseases) that may be treated by administering *Lactobacillus plantarum* PDG8 or a composition thereof include but are not limited to atherosclerosis, aorta disease, coronary artery disease, peripheral arterial disease, and rheumatic heart disease.

As used herein, "atherosclerosis" refers to an arterial disease characterized by the formation of fatty deposits, called "atherosclerotic plaques" on artery walls. Atherosclerosis, including the number and size of plaques, may be detected by imaging, but often has no symptoms until plaques are sufficiently large to impede blood flow. At that time, depending on the location and severity of the plaques, blood clots, carotid artery disease, chronic kidney disease, coronary artery disease, heart attack, peripheral artery disease, stroke, or other cardiovascular-related incidents may occur.

Atherosclerosis is characterized by endothelial dysfunction, large accumulation of low density lipoprotein (LDL), endothelial space necrosis debris and the presence of immune cells. The pathogenesis is complex and may be related to the injury of endothelial cells caused by harmful external stimuli. If the concentration of LDL in the blood is too high, it may be deposited in the endothelial space. After oxidative modification, the LDL becomes oxLDL and activates endothelial cells. The activated endothelial cells start to secrete leukocyte adhesion molecules to capture monocytes in the blood and trigger a series of the immune response, including the maturation of monocytes into macrophages, and then the scavenger receptor on the surface of macrophages recognizes oxLDL and activates the NF-κB signaling pathway, which enhances the release of pro-inflammatory factors such as IL-1β and TNF-α. Meanwhile, this process promotes the further differentiation of macro-phages into foam cells, and finally forms an atherosclerotic plaque (Herrero-Fernandez, B., et al. (2019). "Immunobiol-ogy of Atherosclerosis: A Complex Net of Interactions." *Int J Mol Sci* 20(21).)

This pathological process also develops with the migra-tion of smooth muscle cells from the arterial media to the intima, an increase in the synthesis of extracellular matrix macromolecules such as collagen, elastin, and proteoglycan, and an increase in a fibrous cap covering the necrotic core. (Libby, P., et al. (2011). "Progress and challenges in trans-lating the biology of atherosclerosis." *Nature* 473(7347): 317-325.) In addition, the complications of atherosclerosis also seriously endanger human health. Pro-inflammatory cytokines stimulate the production of connective tissue enzymes while accumulating in the plaques, causing the plaques to rupture, thereby triggering acute cardiovascular diseases.

An "individual," "subject," or "patient" herein is a ver-tebrate, such as a human or non-human animal, for example, a mammal. Mammals include, but are not limited to, humans, non-primates, farm animals, sport animals, rodents and pets. Examples of non-human animal subjects include rodents such as mice, rats, hamsters, and guinea pigs; rabbits; dogs; cats; sheep; pigs; goats; cattle; horses; and non-human primates such as apes and monkeys.

A "therapeutically effective amount" of a substance as used herein is that amount sufficient to effect beneficial or desired results, including clinical results, and, as such, an "effective amount" depends upon the context in which it is being applied. In some embodiments, in the context of administering a composition to treat a cardiovascular dis-ease, the severity, frequency, or duration of at least one symptom of the cardiovascular disease may be reduced when a therapeutically effective amount is administered.

As used herein, and as understood in the art, "treatment" or "treating" is an approach for obtaining beneficial or desired results, including clinical results. For purposes of this subject matter, beneficial or desired clinical results include, but are not limited to, prevention, alleviation or amelioration of one or more symptoms, diminishment of extent of disease, stabilized (i.e., not worsening) state of disease, prevention of disease, delay or slowing of disease progression, reduced risk of recurrence of disease, and/or amelioration or palliation of the disease state.

*Lactobacillus plantarum* PDG8, a composition, or a food or supplement composition as described herein may be administered to a subject. In particular, a therapeutically effective amount of the *Lactobacillus plantarum* PDG8, a composition, or a food or supplement composition as described herein may be administered to a subject having a cardiovascular disease (e.g., atherosclerosis). The therapeu-tically effective amount of the composition, or food or supplement composition may depend on many factors, such as the age, weight, and severity of the cardiovascular disease in the subject, the length of treatment, other therapeutics concurrently administered to the subject, and gastrointesti-nal conditions of the subject.

In some embodiments, the *Lactobacillus plantarum* PDG8, a composition, or a food or supplement composition may be administered in an amount sufficient for detectable colonization of the intestine of the subject with *Lactobacil-lus plantarum* PDG8. Colonization may be tested a set period of time after administration of the *Lactobacillus plantarum* PDG8 or a composition comprising the *Lacto-*

*bacillus plantarum* PDG8 bacteria or a culture thereof, such as after one day, one week, two weeks, three weeks, or one month.

In specific embodiments, *Lactobacillus plantarum* PDG8 or a composition thereof may be administered with another therapeutic for treating a cardiovascular disease (e.g., ath-erosclerosis). The administration of the other therapeutic may be at the same time as, prior to, or subsequent to the administration of *Lactobacillus plantarum* PDG8 or a com-position thereof. Dosage of the other therapeutic may be reduced over time as the *Lactobacillus plantarum* PDG8 colonizes the intestine of the subject.

The *Lactobacillus plantarum* PDG8 or a composition thereof may be administered to a subject once, or multiple times, such as daily, weekly, biweekly, every three weeks, monthly, every two months, every six months, every year, or whenever the *Lactobacillus plantarum* PDG8 is not detect-able in the intestine of the subject.

The subject may be a human, but, in some embodiments, it may be another animal susceptible to a cardiovascular disease (e.g., atherosclerosis), such as a dog, cat, cow, goat, or horse.

The *Lactobacillus plantarum* PDG8 or a composition thereof may be administered to a subject orally, nasogas-tricly or rectally. Preferably, the administration is oral administration.

In some embodiments, the *Lactobacillus plantarum* PDG8 or a composition thereof may be administered so that the *Lactobacillus plantarum* PDG8 dose is an amount of $10^5$ CFU/day or more, $10^6$ CFU/day or more, $10^7$ CFU/day or more, $10^8$ CFU/day or more, $10^9$ CFU/day or more, $10^{10}$ CFU/day or more, $10^{11}$ CFU/day or more, $10^{12}$ CFU/day or more, or $10^{13}$ CFU/day or more, or in a range between any of these amounts (e.g., $10^5$ CFU to $10^{13}$ CFU per day).

The *Lactobacillus plantarum* PDG8 or a composition thereof may be administered repeatedly until at least one symptom of a cardiovascular disease (e.g., atherosclerosis) in the subject improves.

In certain embodiments, the administration of *Lactoba-cillus plantarum* PDG8 or a composition thereof to a subject may reduce the formation of atherosclerotic plaques, body fat inflammation, and/or blood lipid. Specifically, the admin-istration of *Lactobacillus plantarum* PDG8 or a composition thereof may result in one or more of the following: reducing accumulation of fat (e.g., abdominal fat), reducing forma-tion, number and/or sizes of atherosclerotic plaques, reduc-ing amount of blood lipid (e.g., total cholesterol, triglyceride and low-density lipoprotein cholesterol), reducing expres-sion of pro-inflammatory factors (e.g., TNF-α, IL-6), and improving the integrity of the intestinal barrier. Methods for measuring accumulation of fat formation, number and/or sizes of atherosclerotic plaques, amount of blood lipid (e.g., total cholesterol, triglyceride and low-density lipoprotein cholesterol), expression levels of pro-inflammatory factors (e.g., TNF-α, IL-6), and the integrity of the intestinal barrier are known, examples of which are described in Examples 3-7.

EXAMPLES

The presently disclosed subject matter will be better understood by reference to the following Examples, which are provided as exemplary of the invention, and not by way of limitation.

Example 1: Identification of *Lactobacillus plantarum* PDG8

The bacterial strain from home-made fermented veg-etables was separated and purified to form isolated *Lacto-*

13

14

*bacillus plantarum* PDG8. Specifically, the slurry juice was diluted to $10^{-3}$ or $10^{-4}$, and inoculated in modified MRS medium, then cultured anaerobically at 30° C. for 48 h. Colonies were counted, then picked. Each colony picked was inoculated in MRS liquid medium and cultured in anaerobic conditions for 48 h. Strains were purified by repeated streaking. The isolated and purified strains were cultured anaerobically at 30° C. for 48 h, and the cells were collected by centrifugation.

A Biospin Bacteria Genomic DNA Extraction Kit was used to extract DNA from the isolated bacteria. Purity and concentration of DNA was determined. Covaris M220 was used to fragment genomic DNA, and an Invitrogen Qubit 4.0 fluorescence quantifier was used for concentration quantification. A KAPA Hyper Prep Kit was used for library construction and the Illumina NovaSeq was used for sequencing. 42 contigs (SEQ ID NOS: 1-42) were obtained.

The original sequences obtained were classified and the genome was assembled and compared with the 63,400 assembled gene sequences of NCBI by MASH (version: 2.2). Identification was based on mash distance information. Similarity to *Lactobacillus plantarum* was 99.68%. Therefore, the newly isolated strain was named *Lactobacillus plantarum* PDG8.

Example 2: Establishment of ApoE$^{-/-}$ Mouse Atherosclerosis Model

As shown in FIG. 1, 6-week-old ApoE$^{-/-}$ male mice were prepared for one week (12/12 light and dark alternate, free drinking and eating) and then randomly divided into 3 groups: a control group, a model group, and a probiotics group. 4 ApoE$^{-/-}$ mice in the control group ("Chow") received a normal diet and gavage PBS. 6 ApoE$^{-/-}$ mice in the model group ("Model") received a high-fat diet and gavage PBS. 6 ApoE$^{-/-}$ mice in the probiotic group ("G8") were received a high-fat diet and gavage with *Lactobacillus plantarum* PDG8 at 1×$10^8$ CFU/day/mouse. The test was conducted for 10 weeks, and results were obtained as set forth in Examples 3-7.

Figure 2:
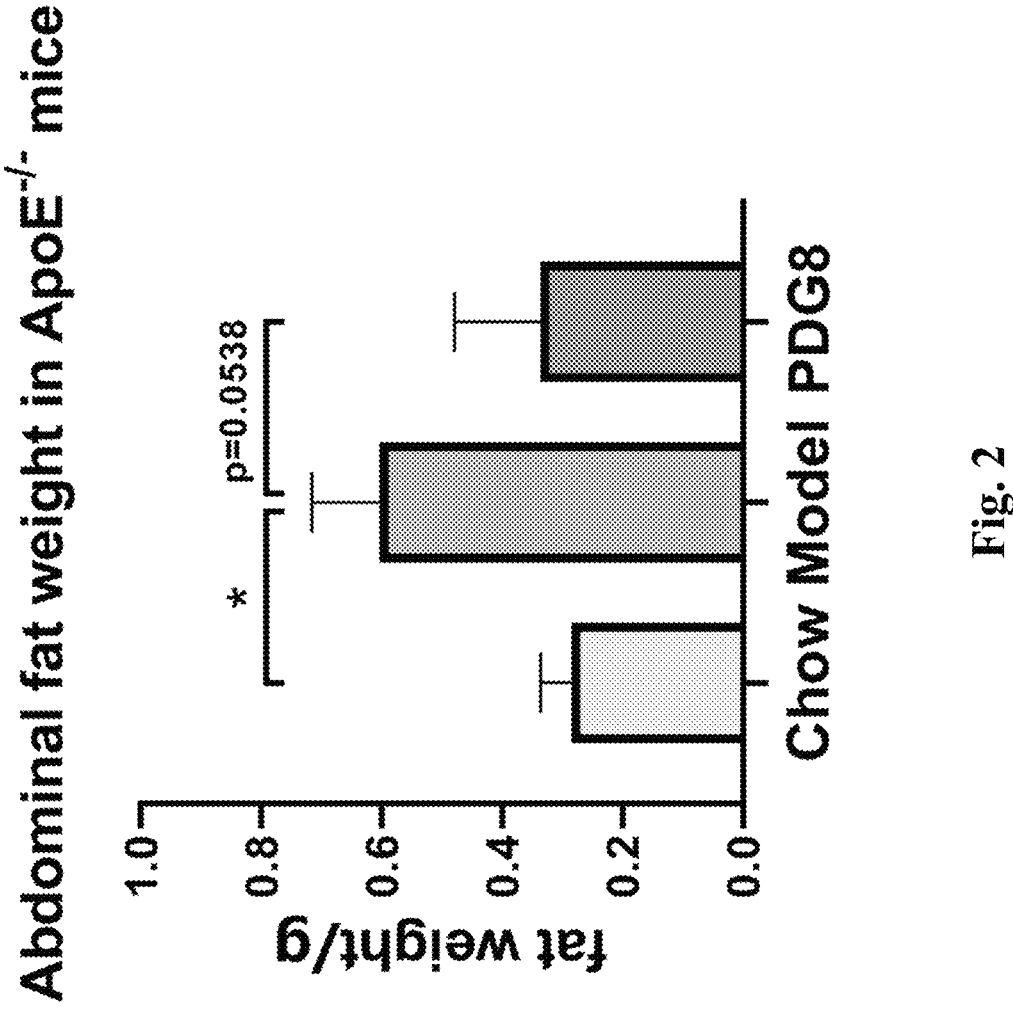
FIG. 2 shows the result of the effect of *Lactobacillus plantarum* PDG8 on the weight of abdominal fat in $ApoE^{-/-}$ male mice.

Example 3: *Lactobacillus plantarum* PDG8 Reduces Abdominal Fat Weight in ApoE$^{-/-}$ Male Mice At the end of the 10 week period and after the other experiments were completed, the animals were sacrificed and fixed on a dissecting board. The abdominal cavity was opened to separate white adipose tissue, which was then weighed. As shown in FIG. 2, the weight of abdominal fat accumulation in the model group was significantly higher than that of the control group ($p<0.05$). Compared with the model group, the weight of abdominal fat decreased after 10 weeks of treatment with *Lactobacillus plantarum* PDG8 ($p=0.0538$). These results demonstrate that the high-fat diet caused the weight of fat in the mice to increase, but *Lactobacillus plantarum* PDG8 reduced the weight of fat increase to a level similar to that in the mice not fed with a high-fat diet.

Example 4: *Lactobacillus plantarum* PDG8 Reduces Atherosclerosis in ApoE$^{-/-}$ Male Mice In the scarified animals, the front chest skin was cut open and the sternum and the entire rib cage removed to expose the entire abdominal cavity and thoracic cavity. 10 ml of 4° C. pre-cooled PBS solution (autoclaved) was placed in a 50 mL infusion needle/syringe. A small opening was cut in the right atrial appendage, the left ventricle (apex) was pierced with the infusion needle. The PBS was injected slowly and evenly until the liquid flowing out was clear. After the perfusion, the lungs were cut out from the pedicle leaf by leaf, leaving only the heart, thymus, and aorta in the thoracic cavity. The entire aortic tree was removed from the heart and the blood vessels were cut open and fixed in 4% paraformaldehyde. After fixing for more than 24 hours, oil red O staining was performed.

Figure 3A:
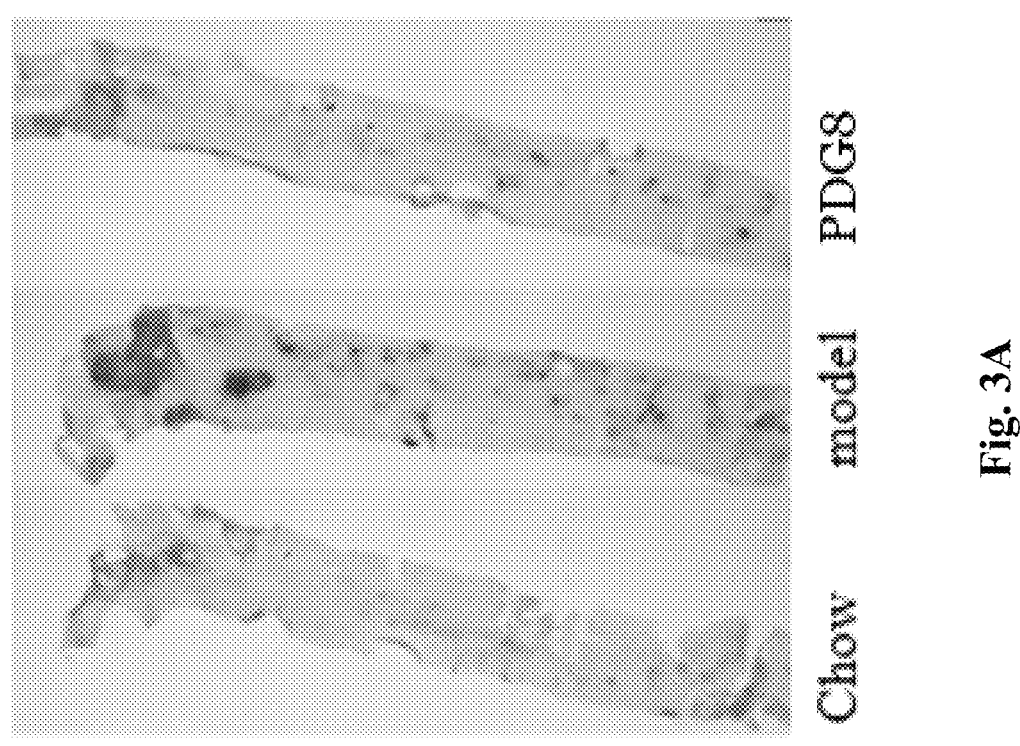
FIGS. 3A and 3B show the effects of *Lactobacillus plantarum* PDG8 on the formation of atherosclerotic lesions in $ApoE^{-/-}$ male mice.

After staining, pictures were taken with a general microscope, and image J software was used to measure the area of aortic lesions. Results are shown in FIG. 3A. Compared with the model group, *Lactobacillus plantarum* PDG8 significantly reduced the formation of atherosclerotic plaques.

Figure 3B:
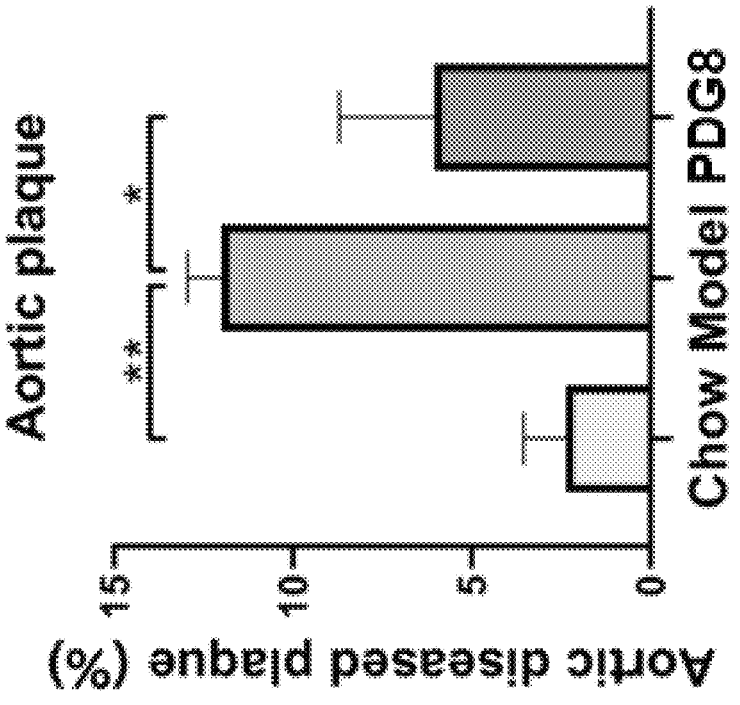

As shown in FIG. 3B, compared with the control group, the aortic lesions in the model group increased significantly ($p<0.01$). Although the *Lactobacillus plantarum* PDG8-treated group did not have aortic lesions at as low a level as the control group, it still exhibited a significantly reduction compared with the model group ($p<0.05$). This demonstrates that *Lactobacillus plantarum* PDG8 could treat aortic diseases such as atherosclerosis induced by high-fat diet.

Figure 4A:
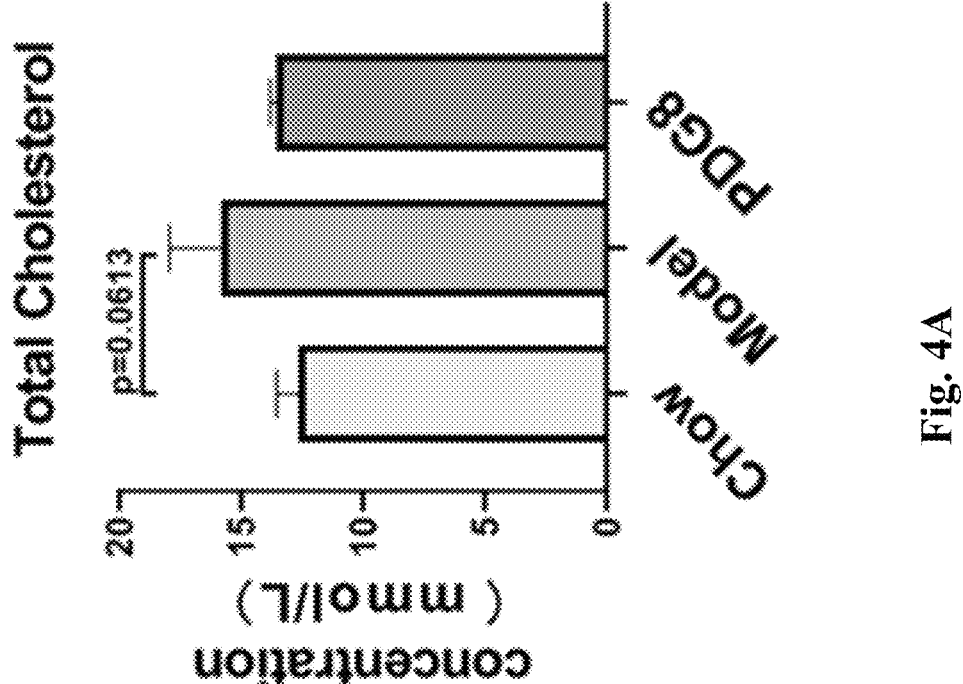
FIGS. 4A-4C show the effect of *Lactobacillus plantarum* PDG8 on the blood lipid levels of the aorta of $ApoE^{-/-}$ male mice.
Figure 4B:
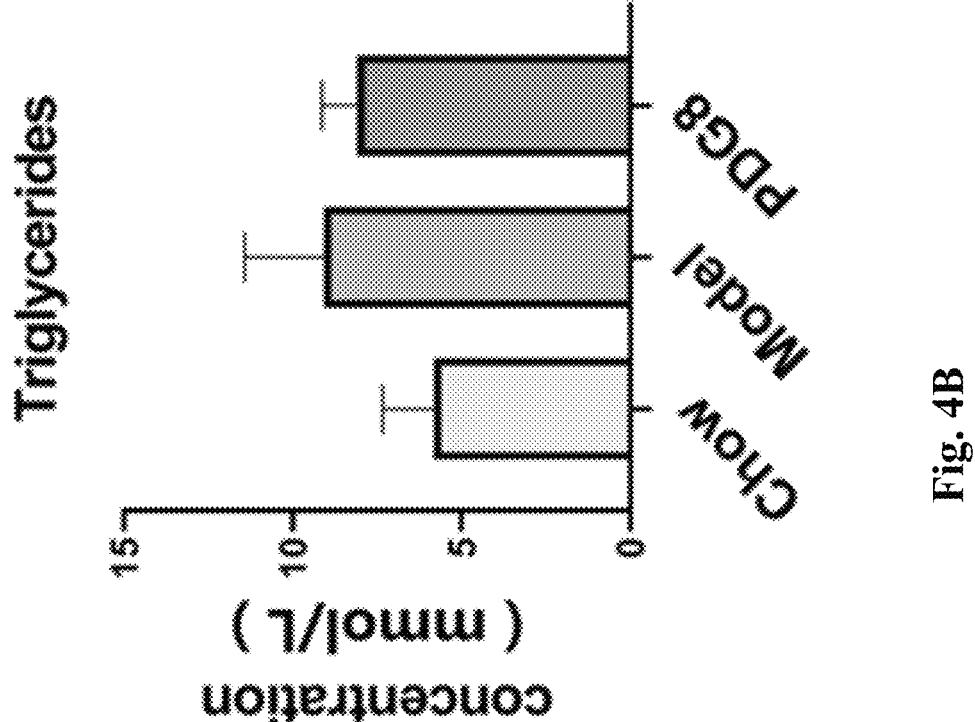
Figure 4C:
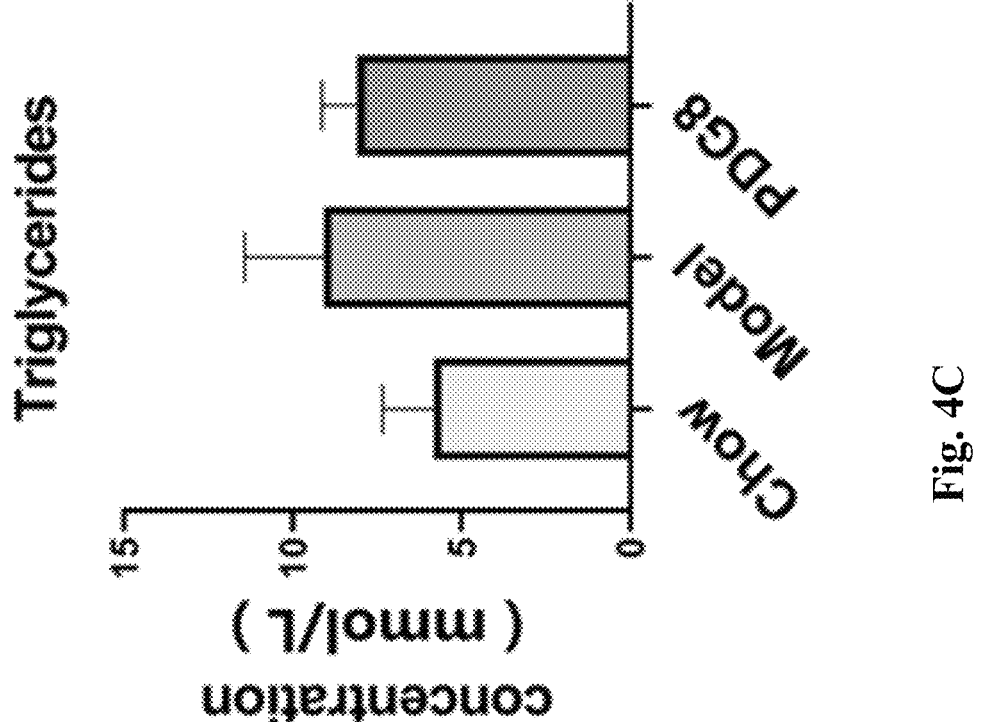

Example 5: Effect of *Lactobacillus plantarum* PDG8 on Blood Lipid Levels in ApoE$^{-/-}$ Male Mice Mouse orbital whole blood was collected, and the content of total cholesterol (FIG. 4A), triglyceride (FIG. 4B) and low-density lipoprotein cholesterol (FIG. 4C) in the serum were measured. As shown in FIGS. 4A-4C, the high-fat diet increased the blood lipid levels of mice in the model group, but after 10 weeks of treatment with *Lactobacillus plantarum* PDG8, all levels of the tested types of blood lipids dropped. This indicates that *Lactobacillus plantarum* PDG8 improved the imbalance of blood lipid levels induced by high-fat diet.

Figure 5A:
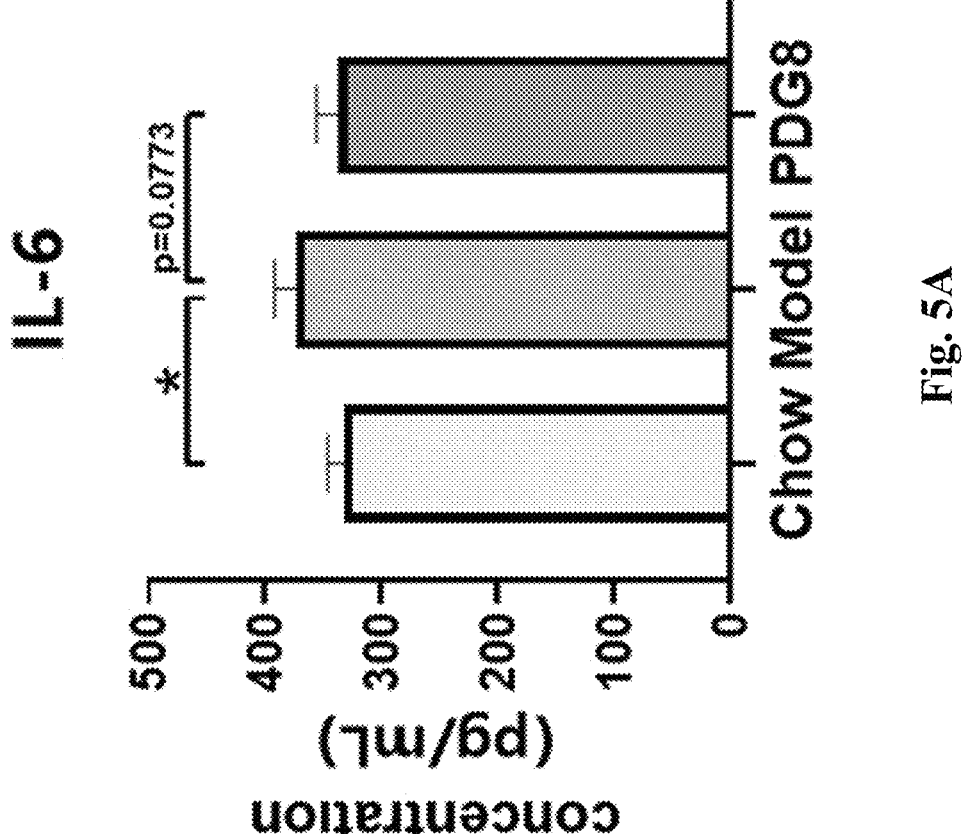
FIGS. 5A and 5B show the results of the effect of *Lactobacillus plantarum* PDG8 on the levels of inflammatory cytokines in $ApoE^{-/-}$ male mice.
Figure 5B:
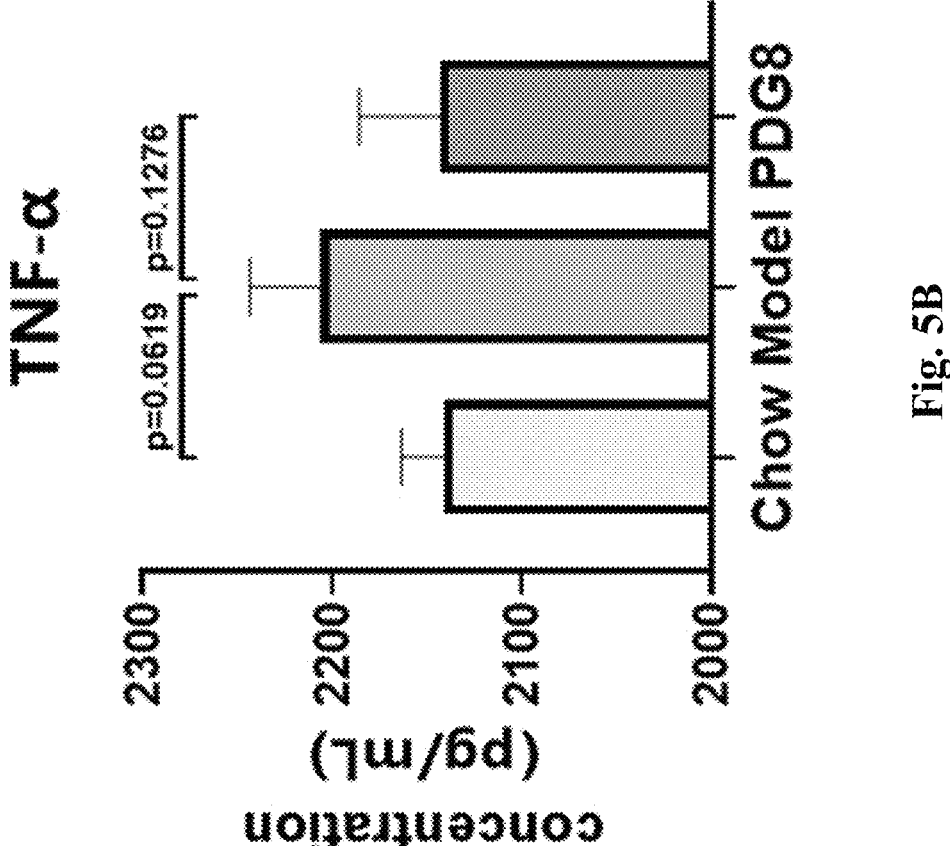

Example 6: Effect of *Lactobacillus plantarum* PDG8 on Inflammatory Factor Levels in ApoE$^{-/-}$ Male Mice Orbital whole blood was collected, and the expression levels of TNF-α and IL-6 in serum were measured. As shown in FIGS. 5A and 5B, a high-fat diet increased the levels of the inflammatory factors TL-6 (FIG. 5A) and TNF-α (FIG. 5B) in the model group. After 10 weeks of treatment with *Lactobacillus plantarum* PDG8, the levels of both inflammatory factors dropped. This indicates that *Lactobacillus plantarum* PDG8 alleviated the inflammation caused by atherosclerosis in mice.

Figure 6:
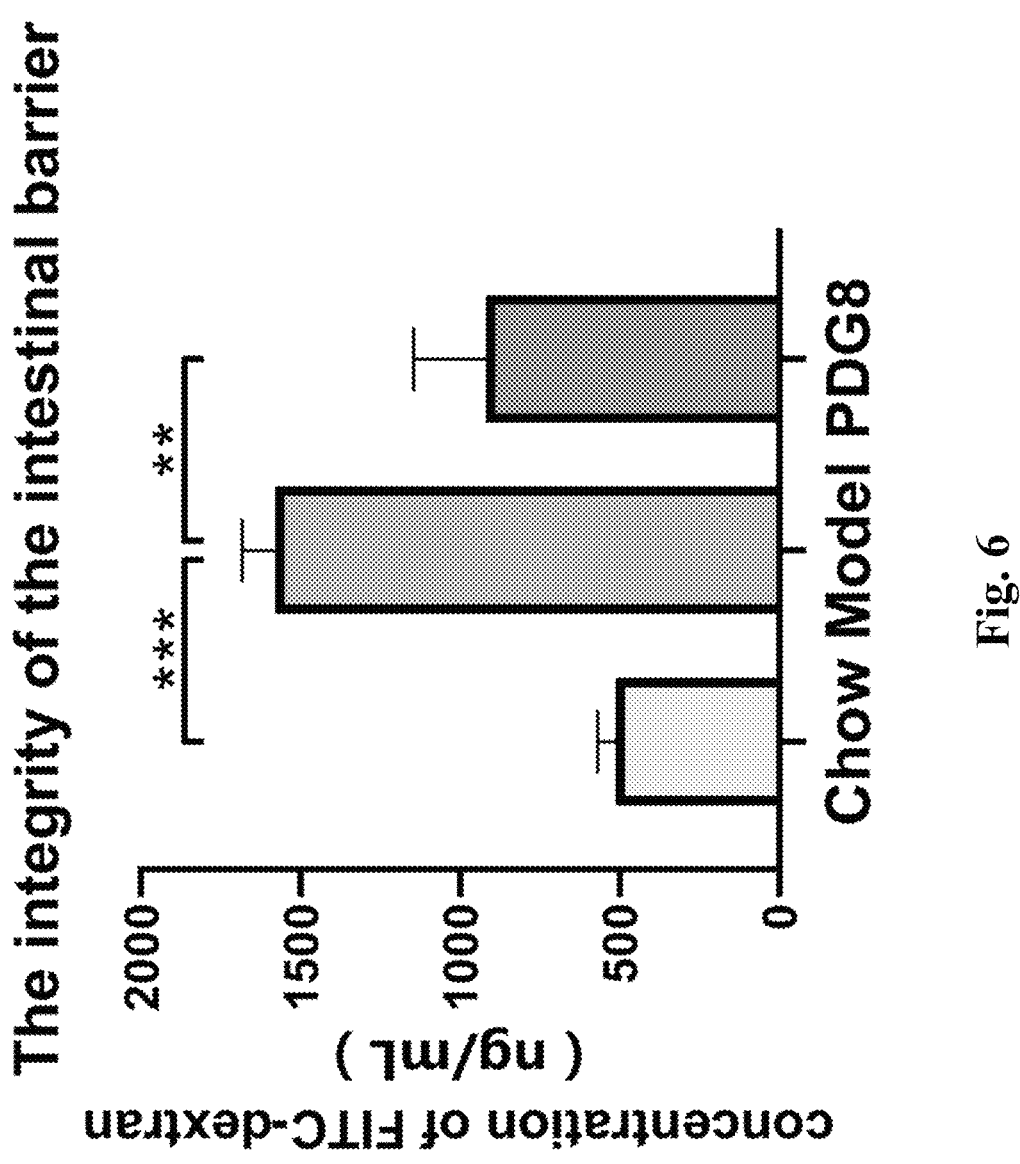
FIG. 6 shows the effect of *Lactobacillus plantarum* on the integrity of the intestinal barrier of $ApoE^{-/-}$ mice.

Example 7: Effect of *Lactobacillus plantarum* PDG8 on Integrity of the Intestinal Barrier in ApoE$^{-/-}$ Male Mice Four hours before the mice were sacrificed, the mice were given intragastrically a dose of 0.6 mg/g FITC-dextran. After the mice were sacrificed, a serum sample was obtained and the FITC content in the serum was measured with a fluorescence spectrophotometer. The results are shown in FIG. 6. Compared with the control group, the concentration of dextran in the serum of the model group increased significantly ($p<0.001$), while prior treatment with *Lactobacillus plantarum* PDG8 significantly reduced the concentration of dextran in the serum of mice. ($P<0.01$). This indicates that *Lactobacillus plantarum* PDG8 reduced the intestinal barrier damage induced by a high-fat diet.

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (42 sequences)

SEQ ID NO: 1 - DNA, 464914 bp, synthetic construct
  source 1..464914: mol_type = other DNA; note = Lactobacillus plantarum PDG8 - Contig 1
actcggttcactcggttcactcggttcactcggttcactcggttcactcggttcactcggttcactcggttcactcggttcactcggttcactcggttcactcggttcgcttggttcgctcggttcacttggttcgacctcatcggcaaaaactaattggccttgataagcgctttgctcattcaacacaagcacttgcgcctgtgtattgatcaagtaaccgtccggtgcttgaatttcgctaaccgtataagcaccttgcgttagacctgtaagctgtgcttgaccagtcgcatccgttgtcaactgagcaaccagcgttccggcagcatttttcacggcaaaaaccgccccggccaagcgattggcgccactcgaatccgtcttaaccaccgtcaatttcccggtttgatacgtattcgttaatgtcaccgtctcaccactagttgtttgactactgatatagccagcaatggccgtttcaatcaccgtataagtgtacgcattgccataaacatccgtcacatccaaatcactgaaagtgcccgtatagccatttgctgacgttaattgcaaggtctgataagcttgaccattgcgttgcaacgtcacttcaacggtcggcgtttgcactccagctggcacgtcagcccaaactttgttaacagtcagcgccgtcttagccattcgtttgtcaaccacactacctgtgaccacgttagccgttgcttgcactgcggataccgtgaagacgtgcttggccgtgtcgatctggtagccactcggagccgccgtctcaactagcatgtacgtcccagccgacaagttaccgatgcgtaactgtccaactgaatcagtcaccaaatcggtccgaagtaccgtacccgtactatcctctaactgataagtggcaccagcaactgactggccgtcaccatcagttttattaatgaccaaactgtaactctgaatgtcatcactagcagttccggaaccaccaaatctaacggccacgttcgattgttcactttttggttcgcctgtcgaactgccctcatttggatcagtcgcatctccaatgacaggtgcatacgttacacccgcattattggtgtacgtatgtcctactgtcagaccaacttcataaaatatattgaccgctacatctaattggtcaatattaattgtcatctgctgacccacaaccgtcacggttacttgtggtgttgataccccatcagcgtaggtaaactgctgcgttgcaaaatcataagtgcccagtgccgcgtctttaacaaaggcaccgtcagtataatgaccagtttccatcgtcatggtaccttcgtgcgtttgataaaggcctagctgatcaacaatcgcaacttgctgccacttttcactattaatgtttgcgacaacttgccagatcattttggtgggattaccatcagcatctaaactattactatcggcccagccaaccttattaatccagtcgtactactgccagtggttgcgctagtcccagtaacataaaacgttaagtctccttgacgattataacgatcactagtcgcataataatcattaaaagttagtgttccggtttgactaccggtctcggccgtaaaagtcccgacgaccgttccatctgatttttggacatcaatatgctgcgtaccattggtaaagacaacattctctggtaaggtcaccgttgctgtactgccagcagttacgctaacatcatcggctattgaccaatgatacttcgcgatatagttcgcatacagactcaatacatccgtagcgctatacgtaacaccatcatcgtcagtcaccgttgcgtcagtagcatcgagcccctgaaccgcaaccgttgcccgttgtgctaaactgcgaagactggcccggctcattctggacagtgtcgcgacagacgcagttgcttgatccgtcgtagttgccgttctcgccgagtctttttgactggtaacgacaccactgtacatattagtcgtttgttgctgattctgggtcgttgcttgctcgttgttcgccttcgcactagccgctcgttgatccgctttggcattagccgtcgcccgggacgtcgctgtcgtatcagtactgtccgttgttgcttgagcggctgtcacacctgaagtcgtttggctagtagccgttgtgctagatgattgggttgatgactcagacgcggtgaccgctttgctagtcgccgtttcggtcgcagcaccagttgccgatgctttcgtgctactgctactgctactgctactgctactgctactgctactgctactgctactgctactgctcgtagtttgtcgcaacaccacttgattagcaagtgtactcgagccagaagtctgcgtcgtttcagtggcagtggtagccgtgtccgccgcactcactgtttgatttgtcacaatcaatgtcaacatggcggccgttcccattatccaagttttgaaatcgattaatcgcatgatatccccccctttcttatataagttaaaacttttaaaccgattacacgccttaattataaaccacattccgcaaatttgaagacactttttgtcaaaattcgtcgctcacagatagcagttacataccagcaatatttgttcaaaaggctcattacgtctatataatttttatttatgtacacttaattaatttaccgatatatcaacattttaaagacattaatcataattagtattataatattttatacaaaagttgtatgccatcaattttgacgagttcgtgacagttgttagctaattaaaataatttatgctgattaatatagatttaactaattgcaatcagtaaaaatgatgtcattcgtttcatttataatttaaacccattaactgctttagttgcttgtcaactaattacgtcgaaaaacggggcagactggcgctaccgatggcacgtagaccaattattgatttatcgagcgatatataacagcaccttaactgataagtattttttatagctttattactaatagtttgccattaacttgtatgcttcttaatctgcataatgtttacttatcgctttaacactttaacctttatttctaacgactcccacttaagcaatgcaactttttttccggtgattaatcagactaaccgacacgtcatgataatcaaaacgatgcggcagccctttaactgataaaattatataatgactcaaaacttaatttaccagcaacactacatctgtaccaatcagcactaacattcttattaataatcattatagtttaagcacgttaactattttgtaaattaattttcactaattatcctgacactattcgttataacaatggtatgattaacatgacgtataataaccagctttaatcaatcagtcggagcctgcttacctgcgactattaattgcgcaaccaacattaatattttatggaggctacatttttcatgaacattaaagacttgtattacttccaacgcttaatcagcactcagagttatacgcaaacggctgctgattttcacgttagccaacccacaatctcccaagcaattaaacgactagaacgtcatttccaagtgacactgttctttcgccaagcaaagaccaaggcgctggtgttaacacctagtggccagcaactattgctcgcagccaacgacattatcaacaactggcagcatgtcaatgaatcaatcagtcatttgcgtcaacatacactgcggtttggtatcgaaccatccgtcagtgaacattatttaccggcattaacaaaaccaatcatcgagcaagatttgcttagtagcgtccacactgttgaaatgggggctaatcaacttgtcaaacaggttttagccggccaactcgacttagccatcagtggtaacttggatcaaacattggatgaacggcttgcagtaacgccattacggccctttaaatttcgcattctcgctaatgctgcacaccccttagcaaaggctgagcatccgacttttgcagaagcgctaaaatcgccttttgtactgcttaatgcaacttacttaaataaactagtcttccggcaacttgctgaacaactttcgattgaaccccaagttctcttcgaatctgatagcagcaccttgatcaagggattagttaaggagaacctggcactaggcttcatttccgacatcacgacccccaacgatggtctcgttgagattccgttcgacgacgttcaggttcctagcgtgcatatcaacttgattcgtcgggcccaccaatttccaattggcttagtcaaacaggttatcgacattattgaaaaaacatttgcggctgacaatgccgaacaaaaatcttaaccacaaacttgatcataatcacacatgcgctccaataaaaatacccaacttatctagaatgataggttgggcgttcttattggggcgcatttttggttaagtcatcacgattaaatttacacgaccaactcgtgctcgtaatcacacaaccgccgttaaaaatcacattcacgactccagcagcgaagctaattgtgacctaaaactggtaaacttttgcttcgtacgctcgtaatacgtcttgatgatcttcatcgtagttactgatcaacagatgcgcatcagcgggtaattctgcaaagtgtcgcgtctgggttgccgcagtaaagttacaaattactagcaggtgctgcgaccccatatgccgcatataggcataaacggccgcatcatcaggtgataataggtgataagttcccgtcgttatgactggtaaatggtgccggagcttaatcaaccgctgataatagctcagaactgaaccgggcgttcgttgcgcgagttgcgcgttgatccgcggataattggtattaaccgctagccacggtgttgccgttgaaaacccagcattctgactatcatcccactgcatcggtgtacgcgcattatcccgcgacatatgggcgagataacctaacatctgttcaggttgaacgacctgttcgtcatcaacaaagtgatgatacgcattcagtgattccaagtcttgatagtcggttaacttggtaaaatgggcattcgtcatgcctagctcctcaccttcgtagatgtagggtgtcccttgaagaaagtgcaatagggtcgctagcattttggctgaacgttcccgataagctggccgttcatccccgaatcgtgacacaattcgcggttggtcatgattattccaatagagactattccaggctgtcccttgtaagcccatttgccacttagacaagctctgctttaggtcaaccagtcggacgggctggtcattccacttacctagcgccggatctggattaccatccaggcccatgtgttcaaattcaaacaccatgtttaattcctgaccttggctgcttgccagttgcttagcatcagcaaccgtagccccaggcgtttcgccgaccgtcatcagttgatggcctgcaaacacttgctgattcatttcttgtaagtattcatggagatgcggaccattggcaataattccgccgattgccgcgtatggttccccagcttctggctgcccatctgcaaagctatcaggcttggaaatcaagttaatgacatccaagcggaaaccgtccacgcccttattgacccagaaattcatcatgtcatagactgcttgccgtagttgcggattatcccagttcaaatctggctgttcaaccgcaaatgaatgtaagtaatactgatcacggctggcaacatatttccaagcagagccaccgaaaaagccaccccagttgtttggttcatgcccatcaacaggatcacgccaaatataatagtccgcgtacggattatccttactttgcgcactcgtcgtaaaccacttattttgatcagatgaatggttgacaacaatgtccatcatgatttttaaccctttcgcatgggccgttgttaataattgatcaaaatcagccatcgtcccgaattctggattaatatcgtaataatcactaatatcatagccattatcgacaccgggtgaacggtaaattgggttgagccaaatcacatccgcgccgagctgtttaatataatctaaccgttgtgtaattcctggcaaatcaccgattccatcaccatttgaatcctgaaacgaccgtggataaacctgataaacaaccgctgattgccaccattgattagccatatatgattatccccctaaaaaagtttgctttaaaaaacttgtcacggtcaaccataaaaggcaccgcttacaacactaaccattctaccattgtcggtcatttgagcgtacccacttatcgctatttatttgttagcctaacacgtttctagccatatcttagttgacgaatcaaaaacgccatgctattatcgcttatattcaaataacgaacgataatcttactttcaagtagcgaattaactgtgcgtcaggaagtcggtgggtgctgcgaaccgatcaggttaatctcgatgaaatacggtaggagaggtccgggtacgcccggcggataacaactagagccgttaactgctagtgagtggagtcatattgtggctcaagctgggtggtaccacggtctaatcaatcgtccctgttgcattattatgcaacagggacgattttttatattcacccactattatcggcgtacaaccgctgttgaagcagtccgtgtcgggctattcactgctggtttaacgacctcaaaggagttaattattatgcctaattcaaagaaatggcgttcagttcagttaccagaagccctactcgttttactcattatgcttgcaattatgggacttggcgttattaagttcggcctgtcaccacagacccccgttattctcgttatcgccctcatcattttatgggcccgaattcgcggtgcccactgggatgacattcacggtggcatcatcgatggtattaaaactgggattatcccaatttttatttttctactcatcggggcactcatcagcgtttggattgcagctggcatcattccttcaatgatggtctttgggtttcatctgatctctgcgcagtggttcgttccatccgtttttctcgtttgtgcaattattggaacttccatcgggagtgccttcacgattatctcaacgattgggattgccctctttggaatcgggacaacgatgggcatcaacccagctttgattgccggagctatcatctcaggagccatttttggagataagacttcaccgttgtcagattcgaccaacctggccgcagccattgccgaagcagatttattcgaccacattcgtaatctgatgtggtctacgattcctgcttttgtcgtatcactagtactctacgccgttttaggtgccggagccgcaacacaaagccatttgggcaagattcaaacgacgttgaccgtcctcaataataactttaccatcagctggtgggcggccttgccactcgtcgtcatgtttgcctgtgccctacttaaaattccagccattgcaaccttgttgatgaatatcggtcttgccatcgtcatgatttttatcgagcaacctcatattgccttaactaagatcgccacgatgatcgaaaccggctttgtagccaaaactggcaacgccggggtggacgccttactctcacgtggcggtatcagtgccatgatgagcacggtctccttaatcctattaaccctgtcgttaggcggtttactaatgaaattcaacctcattcagacagcaatggtgccgctaactaagcgattgaaaggtgccggggcaactgttacggctgcgattttagcgggaatcggtgtcaacatctttgtcggtgaacagtacctttccgttatcttgcctggtaaagcgttcaaaacgaccttcaatcagcgaggattggctaacttagccctcagtcgagtccttgaagacggtggaactgtcatcaattacctgattccgtggggcgttgccggggcctttgccgctaacacgctcggggtatcaaccttagcttacctgccattttgtttcttcagcttactatcaccggtattctcaattatcagtggtttcactggctggggcctgaagcatcagccagccaacgaagccggttaatttaaaactaggttgtttaatttaatcggtgaccgaaccaatcccggaatataattgttactgcttgtgattcgcccccactgctggctacaattagacaagagcatgttttggatcaatctaacaattcgtcaattgatactgcatgatttatttactaataagtcacatcccggcaccacgtcaactaacgaacttagatatgaggagggggattacaatgcttgcatacgggtatcaaaaatttgggggacctaccgtatttgaagaactaccacaatcacagctgattccaacagataatcaattattaatcaaaactttagccgttaacctaaccgagggagaccgcttagaacggctaggtactatccaaagcgtcgcactaccgcatattcctgggcatgatgtcattgggaaaatcattcaagttggcgccgctgtcactgacttggacgttgggacagtggtggctgcccgcacgaaccatacttacgcggaccaggtttgtttagatagtgatctagcggtgaccatgccaactaatcttgatccggtcaccgccgtcagcttagtcactccagggattgtcgcttacaaaacggtgcgctactttgcggacatccaggccgaccaaacggtgattgtcaaaggcgctggcagcccagtcggcttgttaattattcagttagccaaacgattaggtgcccacgttatcgcgattgctagtgaccgttatgctaaattgattgcgacactgggagtcgaccaattcgtcgactatcagcatcaaaatccagttcacgtgttagccgaccgcggtgacgtcgtaatcaatgtcgctatcgatagcgttggtggcaaagatgacttagcaatggccaaatttgatgcgaccatcgcttcatttgcccgtcacttgccagccaccagtaaatcaattcgtttccaagcaatccaaccgaccgaagtgatttctgatcaggccgccttacaattgctattcaagttgctagatactggtcaattgaccacgacgatcaatgaacaactaccgtttaacctcacgggcttcattcaaggtcaccaacgactagatgagcctcacgtgggtcaagtggtcgtcgcgcgctaaaaaaactgctttcaaaaggataacttttgaaagcagttttttagtcaggtggtcgcttattaagaccatcgcagaattttgagcaacccaattcacactaatcgtaacgattgggtatatttcaaagaccgcctcaattagccaagtcccggatacctatgcgagtcggtagacccaagcctcataaggccgtaatttatttggctgctgctcgccataattactaatcaagcatttggccgtgggcgtcagatattgatccagtggtcgggacagtgtctcggctgtgaaattgcaacaaactagccaggtccgcccttcccattgccgttcatataagaatacctgcggatcatcggcccacaagagctcaaacgaacctaacgtcactaaggggtattgatgtcgtaattgaatcaagtgctggtaatagtaccacactgaatccagatcagccaaagctgcggcagcattgatttgacgatagttgggatttgaccgtgagccatggcgccgcgtcactaaaacccgcgttaacctccgtgtcccattgcatcggcgttcgcgagttgtcccgagaacgcgccgctaatcgggccatcatatctgccggtgatagtagttggcgctcagtcactaaatcacgataggcattgagcgattcaatatctcggtaactggttaattcagtaaaatgagcgtcagtcatccccagttcttcaccttgataaatatacggggttccctgcaagaggtgtaaacacgttgcgagcatttcagccgaacgtacccgatatgctggtcggtcatcaccaaaacgtgagaccgctcgtggcgtatcatgattgttccaaaacaggctgttccaagcccgcccttcaagtccgacttgccagtcactaatgactttctttagcgccactaacggtgtcttacgcgtactccacttaccaagaccatgctgactattatcaagtcgcagatgttgaaattcaaagaccatatctaattcgtgccgatcagcgcccgcatacttcagcgcatccgctggtgtcaccccgtgggtctcaccaaccgtcatgatatcaaactgtgacaacacttcttggttcatttcttgcaagaattcatgaactcgcggtccgttcgttactcgagcatcgccaaactgactgtgcggtttcagtggaccatttggtaacccgggtaacttagagatttggttaatgacgtccattcgaaaaccgtcaacacccttgttcagccaccaggtcatcatcgtataaactgactctcgtaaggtcggattctcccagtttaaatcaggttgttttgttgaaaacgtgtgtaaataatactgctgggtctgctcatcatattgccatgctgaaccaccaaaagccgcatcccaattattgggcgcctttttgccgttacctgagcgccaaaagtagaaatcacgatattgattggtgcggtcctggcgactgcgtttgaaccatggatgctcatcagaggtatggttaacaaccaagtccatgatgatctttaagccccggtcatgggcggcttgcaataattcatcaaaatcagccatagtgccaaagtcggccgcaatttgttgataatcactaatatcataaccattatcatcgttgggtgaacgataaatgggattgagccaaatgacgtcgattcctaattgctttaagtagtctaggtgggccgtgatcccctttaagtcaccaataccatcatgattggtatcttgaaaactccgtggatagacctgatagacaacggcttgttgccaccacttgattgttgctgccataattacgattaactccttagttacgcggtaaggcccttgatgagcttaactggtaacgtatattttgattccagtgtacaattcgcatcctcaatccgctgcaatagtagagaaaccagtaacgtgctaatatccgctaacggttgttctactgttgttaattcagaatgataatcacgtatgagcgccgtgccatcataaccaacaacgcgtaattgctcaggaaccgttaatgacagttgtcgcgcgacgttgagcactagtaaagcggtcaaatcatcactacaaaaaataccatcatactgatgttgtgtcataatcgtcttaatttccatcatcttcagcgcgggggtcaattcaaacggtaattcgtggacatggggtgttagctgttgggcagtcaagtaggcttcatatccttcacggcgaccattcgttggcgaaccagcgtgtgacttaccagtaaaaatagccacgttagtcgcccccgcctgatgcaatgtctgggttgctagccagcccccctggtaattatccgaactaacgatgggaatattgtcggataagtaccggtcaaatgaaataatcggaaggccgtattgttgatattcttcaatacctaaattgtgggcaccagcaataatcccatcgacctgattagccatcaacatttgtaagtagtcgcgttctttttgcggatcatccgcactattacataaaatcaccttataatttttagcaaataagattttttcaatccgggacaccagttcaccaaagaacggattactaatatctgaaaagatgacgccaattaagcgcgtattctttccttgcagtgagcgtgccatattattcggctgataatgcagttctcgcatcgccgcgaaaactttttctttagtctgactactcaggtagccatggttattaataacccgagaaacggttgtcgctgagacccccgctagcttcgcaacatcatttaattttggtttcattgttatcgactccagtatgctctgattggcgccattcccagactttaccggtgactgccgtagtgtcaccttgaacgttaaggcgactcggggtagcgtttaagaagaaacggccggtcattacggaatagccattatcaatatagcattcaaagactgacacatctatgattagccggatttttatcgtcttatgggccgttaactcaacttgacgagtctgaccataatcttcagcaaacgaattccccgtatgccgccgatcaatcataacctggccatggttggcatcaacagtcacctgcagctggccactttcctgctgatcagcaatgttaaccgtgaccgttttatcagcgggaaccgtcagtaagagttcaaagctgccattcaaagcggccaccgtcgcccgttgttgctcaaagactaggtcatgcgccgtcatccgcaaatcatccaccgctgccactggattttgatagaggtgcccatctttaagcgttagttccttaactaagctcaaacaatgggcccaattttcacgatcagttggataggcaatttcaggtaacccaatccagctgacggctaacgcgcggccatccggcgcattgattgcctgcgtggcatacacgtcaaagccatcatctaattgcgtcagggcgtggggttcagtgaattgtgcctgagccagatccaattgatcggcaactaggtacatgttcggataaatattctgatacggggtcgttgtttgtgataacccttggggacagaacaataagacgggctgttgatcgatccagaccagatttggacactcaatcatataaccccgcgcatttgcgggaacgttcaactcgccttgacacgtccaggtggtcagatcctttgagaaataaaccaagatagcaccgatctcagtagtcgtctgcgcaccgatcagcgcgtagtagccgtggtcagtccggatcaagtccggatcacgaaacgaactcgtgtacccagccggagcatgcgcaattagtggccgggacagctttttaatgtgattatccgtgtccatccaggcacctaattgatacgattcacgttgccagtcggcagtgcggacattacccgtatacataataaataactgatcatcaattggtagtgctgtacccgtgtacgcgccgtgtgagtcgtacggcgtatctggtcgaatcgctaagccctcatcatgccaatccaccaagttcttagaggtcacgtgttgccatgacttcagtccgtgtaccggaccgaacggaaagacttggtagaacaggtgccactgaccatcaaagtatgaaaagccattggggtcatttaacaaacctgatgtaggctgaatatgatgttgcatccgccacttagactggcgtgcctgggcaacgagctgtggtagcttagttgctggccactgttcataaggggtataacgggttttacgattccatatcatgacgatgagctcctttttaacgttcgacttaattgtcactattataaaaccgcttacaccgatatgtcaatcgtttgacatttttatattatattttcatgtcagcgtttcaaattcggctttttaacaagattatcaagcaattcaattttgtatcaaacgcttgacatattttccaaacttgttattattgggtctgtaaagcgcttgcattattaaattaaaaataattttagactcagggagtgaattattatgaatcatcaagaagttgccgaccgcgtacttaatgcaattggtaaaaacaacattcaagccgccgcccactgtgcgacacgccttcgtttggtcatcaaggatgaatccaagattgatcaacaagccttagatgacgacgcggacgttaaggggaccttcgaaactaacggccaatatcaaatcattattggccctggcgatgtcgataaagtctatgacgccttaatcgccaaaacaggtcttaaagaagcgacccccgatgacatcaaggcagttgccgctgcgggtcaaaagaaaaatccattaatggacttcctcaaagtcttatctgatatttttattccaatcgtccctgcactagttgctgggggtctattaatggcactaaacaacgttttgactgccgagcatctttttatggcgaagtcagttgttgaagtttaccccggtctcaaaggtatcgccgaaatgattaacgcgatggctagtgccccgttcactttcttgccaattctcttaggattttcagcaacgaagcgcttcggcggcaacccctatctgggtgctacgatgggcatgatcatggtcttaccatcacttgttaacggctatagcgttgcaacgaccatggccgccggcaagatggtttactggaacgtctttggtttacacgttgcacaagcaggctatcaaggccaagtgctccctgttttggccgttgcttatattttggctactctggagaagttcttccacaaacatatcaagggtgcatttgactttacgttcacgccaatgtttgcaattgtcatcactggcttcctaactttcacaatcgtcggtcctgtcttacgaacggtgagcgacgcattaactaacggtttagtaggcttatataacacgactggttggattggcatgggcatctttggccttctctactcggccattgtcattactgggctccaccaaaccttcccggctattgaaacccagttattggctaacgtcgccaaaacgggaggttcttttatcttcccagtcgcctcgatggccaacattgggcaaggtgccgccactttagctattttctttgccactaagagccaaaagcaaaaagccctgacttcttcagccggggtctcagcgttactcggaattacggaacctgctatttttggggtcaacctcaagatgaaatttccatttgtctttgcagcgattgcctcaggaattgcttcagctttcttaggactattccacgttctgtctgtggcgatgggtcccgcatcagtcatcgggttcatttcgattgcttcaaagtcgattccagcattcatgctcagtgctgtcatctcgttcgtcgtcgcatttattccaacttttatctatgccaaacgaacactcggtgacgatcgtgatcaagtaaaatcaccagcaccaacgagtaccgtcatcaatgttaatgatgagattatcagtgcaccagtaacggggactagcgaaagtctcaaacaagttaacgaccaagttttctcagccgaaatcatgggtaaaggcgccgcaatcgtgccaagcgctgatcaggtcgtcgcaccagctgacggggtcatcactgtcacttatgatagccatcatgcttatggcatcaaaacaactgctggtgccgaaattctgattcacttaggattagatacggtcaatttaaatggtgaacacttcactactaacgttcagaagggcgataccgttcatcaaggtgatctactcggaacgtttgacgtcgctgccttaaaagccgctaactatgatccaaccgtcatgctagtcgtcacaaatacggccaattacgctaatgttgaacgactcaaagtcacgaatgtccaagctagtgaacagctcgttgcgctgactgaaccggcagctagctcagttgctgctacaactgtctaaactttattaggaggacgtcatgcctgttgaatatgaccccaaaaccggcttaatcaatcttcataatgaccaaattagctatgttattcaaattttagcccatcgttacccagtgcatcgatattttggacgttacttttcaaaacaaccgtactttgagccgatgccatccggtagccatgcttttgctaatgacccaacagaacgctttccatattccgtgacttcactgccactcgaatattccactattggcagtggtgactatcgccagccagcttacgttattaaggatgctaacaatcaattactgccaattttagaatataccggtttttctgtgaatgatcagccaatcaactcgcgccaattgccacccaccgttagcaaacacacgcctgtaacaaccctagtcattcatttggccgattcagtgaccaagttacagatggatcttaactacactatttttgaaaatcagccgcttatcttgcgaagcacaactctgcgccatcacggcactactaatttgcaagtaacagccctatccagcgctcaactagatctaccaactgaccaatatactgcgctgacattaagcggtacccatgcacatgaagctaatccatcgtttaaccgtttacacccagggttacaaacggttcgcagtctgcgcgacactagtggaccacaacaccaaccgttcatggctctagcagaacctaacacgacagaattagctgggactgttattggttgtgcactagcatggagtggtaacttcgacagtactgtcgaagttgaccaatatcaacatagccgcctaacaatcggtcttgaaccagatacattcgaatggcagctcaaaccaaatagcagttttcagactcctgaagccgtgctaacttggacaaatactggttttaacggcatgtcacaagtatttcacgactttagccatcagctgatgccctcccagactaacattccaagtgtgcttaacacttgggaaacactgacatttgccgtttcagagtctaaagttcaacacttaatcgaacacgcccaccagttaggcttacaaatgcttgtcttagacgacggctggtttgtcaaccgtaacggtgaaaatgggcaattaggtgactggtatgttgaccccattaagtttcctaatggtctgaaaccccttgcccaacaagcccatcatcatcgaatgaaattcggtctctgggtggaaccagaaatgatcaccactaacagccagctttaccaacaacatcctgactgggtattacaatatgttgatcggacacccatcacagctcgccaccagctagtcttagatctttcgcaggctgctgtccgtgaccacttagtcactactctgacgaacttggttcaaaataaccaactcgattattttaaatgggatatgaatcgccatcttacacaggttggcagcacacgcttaccggctgcacaacagggggaactgtattatcgctacgtctgtggaatttatgatattctcacacgcttgaagcgcgcctgccccaagctgattatcgaaaattgttcagctggtggtggccggtttgattttggtatgctaccatacaccaatcagacgtggataagcgatttgactgatccagtcgaccgagcaaccatcgagaacggatttagttatctatttccaccacggatattcagcaaccatataaccgcatcacccaatgcgcaaaatggccgaataacaccatttgaaactcgattacaattagcctgcatcgggcaactaggattggaacttaatcctaaacaacttgctcctagtgaacagcaacttcttcgaggagccttgattaaatatcagcaactgaaatctacttttatcaaggcccacttttatcgtctaccgacaacaagacacgttgttgcgtggttgttagtaacggcagataaaaagcaggcaatttgctgttacttaaatgggcttaattctgctgtcaaaactcagcacccattaccattacactatctcgatgctgaattaacttatagcgattcatcaggtaatagctatacggggcatcagttaaacacgatgggaattccacttaaacccaccaacgctgatttcactagtcagctaatttatttacgtcaaagttaatgtaatcgttaacaaaatttctgattaagagtatactattaataaataggactacatttttaactacaggaggcacactatgcttttaggtgcaattgaagctggtggtacaaaatttgtttgtgccacgggcgctgaaaacgggcaagttagcgaccgaatttcgatccccacgacaacccccgctgaaaccatgactgcggtagacgactattttacgactcatcccgttgacgcgattggtatcggttcatttggccccatcggcgttaatcccgatgatccgaaatatggttacattaccacgactcccaaacccggctggggtgacttcgattttttaggccatcttaaaagtcgcttcaacatcccactctactggaccactgatgttaacgaagccgcttatggcgaatcaatgattggaatcgctaaggacgtccctaacagcatctacatgacgattggtaccggtgttggcgctggcgtcattagtcagaaccacatttttaatggtcgcactcatactgagcttggtcacatgcgactcaaccggttacctggggacgatttcaagtccaactgcccctaccatgacatctgtttagaaggtttagctgctgggccagcagttggaaaacgaacggggaaagctgggaaagatattcccgtcgacgatccagtctggccaatcatcgctgactacatcgcacaggcatgtgtcaacctcaccgtcgccttcgcacctgataaaattattcttaacggtggtgttatgaatcaacggcagctctttcccatgattcgtgaaaagtttgccgcctatctaaatggctacgaagaagtcccaccactggatgactatatcgttcccgctggactgggtaacaattctggcattgccggtggcctattgttagctcaggctgctttaaagaacgcttaacaccttgcaaaaaagtccgccgatacgcgtttaaacgtatcagcggacttttagtttacagtcaatttgtcattcggttaatgaatatatacggttaaaacagtgataaatccaaaaaccaccccgggacatttgaaataataacgggccaatccttataagtcttgaaccagccgtaaccagtccatagtatcccattaatcattgccacgagtggttgtagcggcgatactgggtcacctgagaaattcgaaatgatttgtggaatatacgacacgtacatcgcaatacacgtaaatgtcgctaacttactaatcaatttcagatatttaactcgcttgggatccacagcgtccttaccactgggatattcaccattatcaactttatacttaataaataatcaccttcctagctagttattatactacataccactcatcacgcaaaaattcgcgttcgttaaattgtatcggcaccgcaacaatcctcaactattcgcacgttgcgcgcaagttgaaacccagcattccccttacatcaaaattgattgaccctatcaattagtttaatttgtggaagaattcccttaatttagctatactcatctgtcactgaaaccgatatcatacataccagcaatatatagatttttgtattttacgcgttgtgctagctaatttgtcatgagtcatgattaaagtaggcaaaataattaacgtcaaaagcagtcagcttaggctcgctggaaagagttcgggttagcgtaaacatgcttagttcaccctacaccgacctccaggcatttctgccaattgccagagcgcggtagtcaaaaatctaagtcgaggccacgttttaattacgattcatgcaatcatcgctcacataacgcggatatgtcaattttgcttagttcacaggaggatatcgctatgagacatggacaatatcgctacattgttggcacactagctttgataacgactgctgtaggtttagtagcttgttcgaaacagtcagctaatcagcagatcagttaccgtcaaacggctgaggccacccttgataaggggatggataatcaacccgaagcaccgtactggtttccaaaacaactgctgaaatggcagttgagcaaggataaagcagccaagtacaacaccgcctcggttccactagccaaacggatcgataaatggcaactgccgacggttaacaagacccaggacccaaagatgaaggtcgtcgcgttatccattatgaatagttcaactagtggcaacgcgcctcgcgggattaatacgttcgatgcgaatgtcttctccaactggcagtatattgaccaactcgtctactggggcggttcggcaggcgaaggtttgattgtgccaccgaccgcagatgtcatcgattctgctcataaaaacggcgtgcccgttcttggaaccgttttctttccacaagtggttagtggtgggaagttaaagtggctcaatgacttcttaaaacaagatgctgacggacattttccgatggctgataaactagtcgcggttgcgaaagcttacgggtttgacggctggttcatcaaccaagagaccgaccccgaagttaaaagttttgattcggcttccaccggaaagaccgcaaccagctcaactagtaatgggctgagcaaaaagcacgcccaactaatgcaacagttaatcaaagaatacaaacaaaaggccggctccaagctagacctgatgtggtatgactcgatgacgaaggatggtaaaatggattggcaaaacgcattgaccaaagaaaaccaatcttatctagtcgatgccaatatgaaaccagttgctgactcgatgtttcttaacttctggtggacgaagaagcgtctcgccagtcaagaattactcaaaaagtcacacgaacgcgccgaaaagcttgggattagtccttacaacctctttgcaggaatcgatgttcaagctgacggaaccgctacccccgttcgttggaatctattcgctaataaacaacatgtgccatacacgtcgctaggattgtacgcaccggactggacacacgcttcttccgatacggttgacgaatttcaagccaaagaaggtgctctgtgggtcaatgatcaaaatgatccgtcccgtagcattccgtcaactacttcaacacattggccgggtgtttcaacatacgcggttgaacaaagtgccattacgaaacagccctttgtcactaatttcagcttaggcaatggctataactacttcattaaggggaaaaatgtttcgctacgtgattggaacaatcgctcactgcaagcagtcaatccgacttaccgctggttaatcaataatggcaatggtaatgcgttaaaggccagctttgactacactgacgcctacgaaggtggcaatgatatcaagttagccggcaaaatgcgtaaggacaccgctagcacaatcaaactctacaccacggacctagacgtcactgccgatacccaggttagtttaaccgctaaggcatctggtaaatctacagctaaactagtggtgaccttaaaggacggccgcactaagaccatcgcgggtgaccggacactcagcaagcactggacgaccgttagctatgacgttagtcagttaacaaaaaaaacaatcaaaggccttagcctcaaaatcagtgccgccgagactgatgctagctacagcgttcaattaggtcgcctcgcaattaccggcaagcagcaggccgcgccgaaaaaggtcaaccaggtcaccattgataatcggaccttcgacgaagaaggcaagtacgccggtgtcaacctgagttggcaagccaccactaaaaataagctggatcattacgaaatttatcaggttaacaatgacggttctcgctcatttctgggggccactaacacgactaatttctatttaaacgcgttgaaacggaatgggcagcacaacgagaccaatctgatggtcgttccagttgatatttggaaccaacgtggcgatgcttctgaccaagttaccttaaaatggccggataatcgtaaacctaaagcggcatttacggttaaccgcaccctggcagctcccggtaacacgatcaagtttacaaatgcctcatccaaaaacgcaaccagctataaatgggaatttgacggtgccacaaagacgaccagcaccgccaaaaaccccacggtcacttaccgtaaggctggcacttataacgtcacattaaccgctaaaaataaggatggccaacggcacgttacaatgaaaaagctcattacgattacaccgaaagctcaaggcgctttaaccttactatccaagaacgccaagaccagtgcctccggatacacgaatagtagtgaagcacctaaaatggcggtggatgggaaactcgatactaaatggtgtgcaaccggtaaggcaccgcataccttgacgctggatttaggccgtcaaacgactgtgagtgcggttaaattagcgcatgccaaagctggtggcgaaggtgctgatatgaacacccgcgcttggaccattcaggtcagcactgatggcaaacgctacacggacgttgcccggacctacaataacacgcaagccactagtctcaatactttcgcggctacttcggcgcgctacgtccggttagtcgtcgataaaccaacccaagttgctgacaccgccgttcggatttacgaaatggacgtgctaggattgacgcaaacactcaaataaccctaccgatgctatttgaatagaacagccgagcccctcacttggaaatcgatatttccaagtgagggactcttttatgtccagacactaaaaaggcccgtatcagctgatacggaccgatttagaagttaggttggaatgaattgagctcattcttaggttggaaacttgattgtggccaggtacggtcagaccacaatcaagcgttcatatttacttagttgttacggtgctagcgacctcgatagcttgcccattaagttcgatagtcagtggttccccactaaccagttcaacggtcgtaccctgttgatcgacatccactttaatcaagcgaccgcggaagttaacgtggaattgataatgggtccacgctttaggcacaaacggtgcaaaggctaaggtatcatccttaactcgcataccagcaaagccttgaacgattgcgagccatgaaccggtcatcgacgtaatatgcaagccgtcgaccgtatcattattataattatcaagatcaagacgggctgtccgttcatacatttccacggccttatcctcataatgcaagtccgctgctagaatggcatggacggctggtgaaagactggattcatggacggtcaacggttcatagaaatcaaagttacgtttcttctgttccgccgtgaatttatccatgaagtaatagattccttgcaagacatccgcctgcttgatatacggtgaccgtagaatatgatcccatgaccagtgttgattgattggccgttgatcagcaggaatacttgaaactggcttgacgtccttatcaaggaagccatcttgttgaacgaagattcccaatttttcatcatacgggaagtacatccggtcaacaatatcttgccactttgcaagctcagcatccgtgatttgaagtgctgcacgcttagcggcatccactttcttcaaactcgctaacgtgtattctaacgtccagcgcgccataaagttcgtataccaattgttattcacgttgttctcatactcattaggaccagtgacaccgtgaatcatatactgttgtttccgttctgagaagtggacccgatcagcccaaaaacgtgaaatccccgtcaaaacgtcgattcctttagtcttcaagtagatctcatcaccggtataacgtgtgtaattgaagatggcatacgcaatagacccatttcgatgaatctcttcgaacgtaatctcccattcgttatggcactcaattccgttgaaggtcaccatcgggtacaaggcaccagccaagccctgcattttagcattatggaaagctccagcaagctgattataccggtattccagtaagttctccgttacttctggtttcgccaatgaaaggtagaacggtactccgaacgcttcggtatcccaatacgtcgcaccaccatacttttcaccagtaaagccttttggccccaggttcaggcgcttatcttcgccatagtaggtcgagaataactggaataagttgaagcgaatgccttgttgtgccgcatcgtcaccgtcaatcaacacgtcagataactgccagcgtttagcccaaccatcaacatgggcctgccgtaagtcctcatatgactgtgtgctgaccgtttcacttaattcggctaagccagtccgcatcgccgccatatccgcgtaatcccgtgaagtcaccacgaggactcgtttttcaaaattcttggtttcatccggtgctaacgttccccggaagatatttgtaactgccttttcggtttctggggcgttaatacctcgaaaagccgtttcatgaagcatctgcatgccgagcgtaaagcgcggtgttccgaagttattcggcttcgtttctgcaaacatgctgccaccagtaatcgcatgactcttgtctagcacttgccagaactgctcatcatagttcgcatcttcattgaagacgtccgcatcaatttgcgaaataaatccaatttggaccggttccgcatccaaattgtgaacactatagtgcacatcaaataactctttttgtgcaacgctgacgaaccgatcaatcatgaattggacgcgcttttcacccttggtaataataaatgaacgccgtaaaattcccgtatgcatatcaagatccaacgtaaagtcactgactgtgtccttcgccaaatcaacttgatcaccatcaatcgtgatattgactttgatgaaattgaccgaattgatcaccttaccgaaataatcgggataaccgttcttccaccagccgacccgggttttatcgggataccagaccccaccgatataaatccctttgagggtatcgttagaatagtgctcttcaaacattccccgcatacccatgtagccgttaccaatactggtcatgctttcctgcaatcgcttatccgtcggtacgagtttatgactaatgacgtgccacggatctacttcaaaaatacgtttcattgttgttgctcctccgtcgttcgaaattaccgaataacatctttagtttcagaatcaaagaagtgggccttcggcatttcaaaagcaacttccacattctcacccgggttatgataatcacgtgcatccacttgggcagtaaatttagatttgccagctgtacaatataacatgctttcggcacctaagaattcagaaacgacgaccttcgtcttaacaattgaatctgacatcgcttcaagcgcaatttgctcagcatgaatgtcctctggtcggatacccacaatcatctttttctggtcatagccttgagcctttaaaactttcaattgaccttccgggacagctacgtcgagtccctcaccatcagttacccgaccatcatgtaaggtggcattgaagaagttcattgaaggtgatcccatgaagccagccacaaattgattaaccggttcgttatacaattcgtgcggtgtcccaacttgcatgatcttaccgtcattcataatgacgatccgatcagccatcgtcatcgcttcaatttgatcatgggtgacatagatcatgttggtcttcaagcgttgatgcatttgagcaatcgtagtccgcatatcgacccgtagcttagcatccaagttagataacggttcgtccaataggaacgtccccgcgtcccggacgatggcccgtcctaaagcaacccgttgccgttgaccaccagataaattggctggtttccgttgtagataatcggttaagcccaattgctcagcagcgttatccactcgctttttgatttcagtattactgtaagttttccgaatcttcaatccaaaggccatattgtcaaagactgacatgttcgggtatagtgcataagtttggaaaaccatcgcgatatcacgattttttggttctacgtcattcatgacttgaccgttcatcttgaagtcacccttagtgatgtcttccaagccagcaatcatccgtaatgtcgttgacttaccacagccagatgggccaatgaagaagatgaactccccatctttaatatcaagattcatatcggtaactgaatatttatcgttaccctcatattttttgtaaatgtgatcgagattcatttcaaccatcgaaatccactcccttgttttctcacttctaaactactattacacgtgcaatcgcccgcaaacggttgctttttgatcgattactcaaagctattaatcagctaattggactggtcagcaactttagttaccgccgtattagtggcatatttaattaatactggttgaccatcaactgtcagcttgccatccacaacttcagtaggaccatctgttaacagattttgatagctaccagctgctagcttagtcgcaactgctgtgacctgaccttttaacggaatccaggctgttaacgcttcgccagccgcacggtaagtaatcttaacgataccttcttctacgactgccaattggtagtccgcagcacgcagtaatggtagttgcttaatagtcactagcttttgaatcagtgatgtcacgtccccatgacgatctgcaaccatggtgtcccgatcgaacaatgatggttggtgttcggccaaaaattcttgcccgttatagattaacggaataccacgttgcatgaagatccaggtcaagttattaacggcttcagctttgctgtgcatcaagctcatcatgcgtgcattatcatgattttccaagaagcgcatcttgacataattaccagggaaagtggcatcttggcgttgtaacaagtcaacataccgttcgaccgtactgcgtccttgccagtaatctttaaaatcaccgaagacgtcgtaatcgtatgtcacatcaaaagcttgataaagttcactgtcagacagacccgtgtagccttgtgaccgcagttcctcaataaaaccactgccggctgactccgctaaccataacgtttccgggtacttcgcattaacctgtttccgcgcttcaagccagaaatcaagtggcactaatggcgcaacatcacaacggtaaccgtccacaaactggctccaatacaagagtgtgtcgatttgatactgccacaactcatggtgaccatagtctaagtctttaacgtcactccagtcgccgaccttattcgtcaactgaccatccgcgtcgtgataaaaccactctggatgttcggttgctaagactgaatcaggcgaagtgtgattatagacaatgtctaacatcactttcattcctaattcatgcgccctatccgtgagtgctttaaagtcagctaaagtcccgtattccggattgatcccacggtagtccttgattgcatatggcgaaccaagtgtccccttacggttgacctcaccgatcggattgattggcagtagccacaaaatatcggttcctaaatccttaattcgttgtaagtcagcagttacgccagcaaaattaccagcttctgagtagtttctaacaaagactgagtaaatcatctcattgcgtaattgcgtttgcgtatcgcgtgccattaatcttcctcatttctatgcttactaattgacctaaagcaacatggtttggtcaacttccggatctttgaattttgttttcagatatacccacaacacaacgaaggccaagctgagggactgcacggtcaattcgatggtgacatcaaaatgaattaagccaatccccatcgctaacagactcccaatccccatcatcatcaacgttaagttaacgccttcgcggaaattccgaatatgcgtgatcttattatgtcgtgacaagaataagaagaacgccgccccatttacgaggatcaggttgacccccacaataattaatccaagtgccatgagcataaatagaccaatcatcactttattgctttgataccaagaattaaccagaaacgcatgagcgtttgtctttaagttatggcctggcacatacttggctttaaattcactaccgaccgatttcacttgaaacgtactagcatgtaaattaatgacattcttgcgtcctgccatatcatcgttcgtgagatcgaagccagcaacattatccttagttttaataatgatttgatgtttgacatccttgaaccgctgatcacggtagttcgcagttttcattgccgtttgcatctgatcactggccatcattttatcaatgtgtggtaaaaatggtgacagattaaaattcgtttggtgattatagtaaaacggaatcggcatgaccattaccgcggtcaaaaagataaataaaacaataatctgtaaccaattaaactgatcacggttggcaaacattcttcgaggtgagaagaggctgccaaaaaaccggaccggaaaggcggttgttttgtttttcgtactctgcatctaatttcacccctactaatatttgagttaacccttgctgccaccagcgagcaatcctgaaacgaagaaccgttgtaagtagaagaacaaggcagcaattggtaacgcgactaagattgcccccgctgagaagagcacaacttgttgattttgagcgttattaatgaatgtctggagccctacggcaaccgtataatgtgattcagacgtcaataagaacttcgccatcaggtaatcttgaactggtgacatgaaggcccataacgcttgaaccgcaatcattggtttaactaatggtaagacaattgaccagaaaatcttgaaattaccagcaccatccaacttagctgattcatccaaatcatacggaacattgtcaaagtaacctttcatcagccaagtgttctgtgggatcccaccaccaatgtaaattgcggtcaagaaccagtaatggtccaaagcgttcaacatgttagctaagacgtagtaagcagtcaaagcggccatggttggtaccatttgaattacgatgaaaaacgttagactgaactttttaccagcaaaacggtaacgactataaacatagccggctaacgtcacaacgatgacttgaatgaccatacatgagactgaaataatcatggtattcaaataccagctaccatacagggtttgcgtaaataagttcttaaagttaaccaacgtccacttaccaccaaaatcaaggacgaaggcttgcacgttagcatccttaaacgccgtgatgaatgtgatcaaaacgggataaataataataattccgagaatgaccatatacagatacgtaaagaattctttccagaaacggtgccgacgcgcgctattttgctttgaattggcattcttaggtgccactgcttgtgcattatccataacactagtcccccatttcaaacgcgtgggtcttcttgaagacaatcaatgagatcccgataactaagacggaaataatcaacgtaacggccgcggccaatgaatactgtggtgacgtccccgttgttaacttgtagatccatgagatcaggatatccgtcccaccggcgttagcaccgacatcaccagggccaccttggttaaacagatagatcatcgagaagttattgaagttaaacgtatactgcgtcacaaagattggcgctgcaatagcaaaaatcgttggcaacgtaatcttgttgaacttttgcattactgtcgcaccatctagcgttgcggcttcgtagagatcttctggaatcgcttgcaggataccagtaatcataacgtaaatgtacgggaatcctaaccaaccttgaatcataataatagcaactttagtccagaacgtatccgtcatccagtggatcggcgcaatgtgagcaaatggaactaacgtattccataagccgatgacctgcacattgatcgcaccagctgaatcattaaaaatgtttgaaaaactcataattgatacaaacgctggaatcgcccaaggaagcaagaagatcactccgaagaagcgcttacctttgatgaagttttggttagcaattactgcggtggcaatcccaataataatttgtaacgtggttgcacatacggtccaaataacggtccaaccaaaaacagcgttgaaggttgcccggtaactactcaagaagaacattgatgtgaagtttttgaacccaatccaatccaataacatagctggtggaatatgcgcaaaatcatagttcgtaaaagccatcagtagtgtaaccaatactgggaacacaatcgtaaaaaccattaaaatataggccggtgtggttaataaataagcaaagccaccatctactaaactcgcacctaactctttaaacgtatgggagacctttttaccattattaattaactgtgcaacgtgtttcgcatcgtaaaggtttgcaatataaaatacgataaacacaattgtcaatagaatctgcaacgtcccatagatcatcatgaacaaagagttgtcttccattgagactgaacccaatgtgactaaattggcaaatgcgctaaagcccccgaagatgaactcagcaataaatgccaatagaataataatgaagccaacaccttttatggtctgaccgttatacagctgaccgagcccgggaataattgacaggcgttgcgctttctttacatccttgacttgcatgtcgcccgcacccctttcctaaataaattctaaatatcgtgcatttttccttttaaaaaggctgagacaaaacgaattttgtttcagcccccttaaattacaattttaattacttatcatacttttgtgagatattagttaagatcgtcttttgcgctttattagcagcttgctttggtgtcatcttgccgctagcagcattggtaaccatcgtttgtgctggtgtccaaacttctgacatttgtggtaagttgatcaaaggaacatccttgtcgtattgctttgaaacggccgtagccatgtcatcgccagtacttacagcttccttacgagcagctgtgtttgctggaatttcactagcagacttgtaaagcttgttttggttagtcttgttagagatgaagtctaaccaagcttgtgcagcagtcttatgcttagagtagtttgagattgcccaagctttaccaccggcaaacgcttgataatctttgccgttattcaacttaggtaaaacagcaacaccataatcgatattagacttcttgtaagttgcagccatccaagggccatcaataacagcagcagtcttattagacgtaaattgtgaggtcacaaagttttcgttagaagtgacattttgcatcccacttggccagtacttcgtaaaccacttcgtcatgtaagttaaaccttcaacggcgccagaattgttcaagcccatcttcttggcgttcgtattgccatcagcaaagacgtaaccaccataacctttgatgacaccaaaggcattgtagaagtttgtccattgagtcaagaaggcaactgacttagtcttatcattagcgtaagcatacttcttgtcagaagctaacttttcaagttccttgaagttcttaggtgcagtcttgattagcttcttgttgtagtacagaacgtcagattcgatcgttacaggcgctgcataaaccttattcttataagtaacagatttcttccccgttgcgttgtaacgaccactggtcaacttgactgttgatagttgaccttgtgacgccatttgaccaacccggtcgtatggtgccattaaaacatcaggacccttgccggaaggaccatccagcttcaaagcatcgtcttcatcaagcatggccttgtatgaaaccttaaccttaacgttgtacttcttttcaaactttggaatcaccgatttcatgtatgacttatatgaaggatccgctgaaacctttaacgtcttgtccatctttgaactactagatgaagatttactattaccacaacctacgagcgtgagtgctaaaccagtggctaggacacccatccccaactttttccaagtactcatagtgcttcctccttgcgaagtatcttaattcatttaccataatttattatgcaactgtgcaaacgctttcgcaagcgttttcgtaatgttaacgttaacagaatcataccaaaaataaatcctaacgcttaaaaacgttaggatttattggtccatcaacctttataccaatttatataaagattgataagttaattaaaatacatcacatgatttatatataccaattttaggataatcatgcactcacattgcttatgccgatttaacgactaagctactccaagctggtaacgtcacttggcgtcccctatatgttgcaccaccctgtacaagcaacactttaccaccaacaaacggcaacagatacgtttgcgcttgcgcacttaaattacaaactatcgctgcttgtttttgaccatcatcaatgaggtaggtaaagagttgttcagcacttccgagcataatgaactgaccattagtaaagggtgcgcactgctttagctgcagcaactgttgataatagtgataaatactgtcggggtcagcgatttctgcttgcgcattcatgtcatcagtatcaccatgtttccatggtaagtggtcagagaaaccatgataaaccgtattgtcccattgcatggggccgcgccccgccattttatgagtttgattcaacatccgcatgatttccaccttagacttaccagcggcttgagcgctcgcaacaaaggtgggtaccgtctggtcttcaaagtccgcaatatcatgataacggatatttgttaatcctaattcttccccataataaataatgggaatgccacgctgcaaatacagggccgtcgctaacgccttggcacttgcttgcggataatcaggatcaccgtaacgcgtggcgacccgagccatatcatgattattccagtaaagtgttggtagactggtgtctgctaaagccgcttgaataccgaccgtattttgcttataggccgtcacatccatcgttcggggctgaaatgtgtcggagaagctcggatcatcctgggtattgtcgtccgcaaaagttctgaacgtaatcacttgatcacactcatccgtacctagtgtcgtatagtcgaccatcaaatgggggtcagcggatgacgcttcaccgacgacgtacgtatccgggtgcttatctttgattgcggcgacaaagtcgtgtaagtactgatgcactttcggtaagtgggcataaaacatatcgctaatgatgggtgtcgaatcaccagtccgatttggataagtttggcgaaaatctgctttagccagatgaataaacgcatctaaccggagaccatcaatccccttttcaacccaaaactcagcaacatcacgcatcgcctgttgcactgccggattcttccaattgaggtccggcatccgtttatcaaacaagtggaaataatactgtgagccgcctgccggatccttcgcccaaacactgccaccgaaaaatgagccccagttgtttgggcgcccaccatcggctgcgggatcttgccataaatagtagtcccgatacttactctgtggatcagcgagagcttgcttgaaccatggatgctgatctgaagtatgattcaagacaaagtcaaagataagatacatgccgtgctcatggaccgttttaatgagcgtctcaacgtccgtcatggtccctaagctcgaatcaacttggtagtaatccgaaacatcgtagccattatcaacctggggtgattgataaattgggtttaaccatatcgtggtaatcccaagttgcttcaaatagggaatcttcgcggtaattcccggaatatcaccaatgccatcgtgattactatcgttaaaactcttaggatatatttgataaatcgtttgttgatcataccaatgcttgctcatctatccagactcctctttaacgggtcgattcagccaccgacaaccgtgaattaatgatgattttttcttgatcatgccgcccgcgagaacgatcagtatggttgatattagccaataatagccgtgcagcagctcgtcccattgcttcaagcggttgcttcatcgttgtcaaccgtttggctgcaatctgatttaataacacgccatcaaaaccgataatgccatattctatgggaacgcgaccaccttgattaataattgccgtttcaacgccgatcgccaaccgatcacttgcacaaataaacgccgtattacgtggaaaaccagaccaatggctcttcacatacgcagttgcaacgtgtgaatgattggctaatcgaataatctgagcgctaatatgatgtgtcgtgacgtactctcgaaaacctcgttcacgatctagctcaaacggttcggcaatagcgataccaataaagacaagatgcgtatagccctgttccgcggcataacgtgtactttcccagaccgcctgataattattagtatcaacgtagtcgtatccctgacgattgctaccaacaaagacgactggctgattaagacgttcgacccatgcgtaatcggcttgccgaataccagtcaaaatatagccatcacattcgccaacctcatagctattgcgcgtcgcaatctgcaaggcgtattgatgttgattcaattcattcgcaatccccgcgagcaacatcatgtaatagggttccgtcgtgtccatgtcttcaaaaatcgttaattttacaacccgggttctccgccctactagggctcgcgctgccgcattcggatgatagtctagctgtgtcatcacatttaaaatcatctctcgaagctcaggacgaacctgttccggatgattaatgactcgtgaaactgtcatttttgagacattagcttttttcgcgacatcgtttagcgttatcataatcaaaatacccccctaacttactactgtaaggacttgatttggtggacggaatggcgtttaacaatttgatgaggcacaattactgccgttgataattcatcagcaggatggtcagccatcgcaatcttggccgcttcttcacctaaacgctgtggaaagaccgcaatcgatgtcagcatcgggtgcgctaaatcagaaaaaatggagttattaaaaccaatcagtgagaattgtttaactttccagttcggatcattatggagaacctgttgtaatttcaacgccaacatatcatctacggccacaaacccggtaacatctggatactgttcaaaaaacttatgtagtgttttaacacccgccgcatgagtctcaaaccgttcttccaacataatatttggtaactgattttgcatcattacacgttgatagccaagcatccgatcactttgcaccatccgtgataaatccgaatacaaaaacccaatgcgccggtgtccatgatcaattagatattgggctgcatccgttccggcttggatattatcattatcaacatacgatgttttattgacgtcttggtaaggtttaccaatcacaacgtattggacatcaaattgcttcaagcgctcaacaactgggtcatttttttcagaatacagtaaaataaaagttttgatatggccttgtgcaatcatgacatcaatattatgcaccagttcatcacttgaaatccccgttgctagcgttgtcattgcgccattcttactacaaacttcattgataccccgaatcatctctaagaaaaatgggttagaaaagatttcgtgatgatctactggtagtaccaccccgattgtattactagccttagttgctaaattctgcgcattaaaatccggcgcgtaatttaactcccgcgccgctttaatgaccttgtcacgtgttggcttactgataatcttgctaccatgcattgcacgtgacgctgttgaaggcgaaacacctgcgcgctgggcaacatctttgatcgttgccatcatgatccccccgatctatttgaatccatctcattaaatataaaacgttttcatcgttattgcaagcgattgcataaacttgcattatttatttaattatactttataacaaaaaactgtgcccaacaaaatcggcacagttgtgagtatttaactaataattgtttccagaccagctgccaaaataccaccaagcaatggaccaaacattggaacccaggcataaccccaattagccaaccctttattaggaaccgggagaatcgtgtaggctaatcgtggcgcccaatcacgcgccggattaatcgcaaagcctgtggttccacccaaggtctgaccaacgacaacaatgagcagccccaccatcaatggctttaatccctgggtaaagttaccgagattcaacaacacgaagataaagaagaaggtcgcaatcgtttcgcttagaaaattaaataccgggttactgatggctggaccagttgcaaaaatgccaacttgattgccatctgccgccgttttggcagcttgaaagtgtgggtagtactgaataataacgattaccgcgccgataaaggcccctaagaactggcctaataagtacggccaaacgttagccattggcaaataaccgaataacgcaaaaccaactgtcaccgctggatttagatgaccatccgaaccaaattgtccggcaacatagaccccaaacgtaacggctaggccccacgccaagcaaataaacgtccaattctgatggcgtgcataattaccctttaaattcatggcggcaccactaccaaccccaaatacaattaacaccatggtacctaaaaattcacctaaaaaaccgtgcatgtttcgtcaccatcctacttgatttttaatggcgctaattgagcttcgacatccgcaagtggcacagccgcctgtaatagcgatgcggccgtgtaggcactctcaatgagtgccgtatcatataaatggaccgttttatcactcatttcaatggccatttccagattcattttggcactaccaagatcataaaaggccaagagttcatccgcatgatttgcatcaaacgcttgtgtaattttggtcaggctggttccgacttgattgtcttccgtaccaccagcaatcgtaatcgaaacgtcctgggcaacttgccctaacaaacgctgaatacctgcggcaatttctgggacgtgtgaaacaactacaattcctaaactcataagattccctccgtatccagtaacgttgtaaataaataaccactcgagacagcacctggatcaaggtgtcccactgaacgttcacctagataggatgctcgcccttttttagccaccatcggttcggtgctagcaactgcatcatcgataacatcctgcgtcaattcgcccgcttggaccgcctgaacaaccggcgcccacacatcaatcagcgtcttatcgccggttgtcgcgccaccccgcttttcaatcccagctaatgcagcggccaacaatccacctaaatcgctatcaatcttactttgctttgccatttctaagaaagctgttccgtacaatggtccagaagcaccaccgactttgctaatcaatgccatcgccgttgcttgaaatagtttagttatgtctgctggttgcgtggcaagtgctgccttaactgctgctaggccccgagccatattacccccatggtcaccatcgccaatcggcgtatctaattcacttaggtaactttggtgttgttcaatctgatcagcaaacttattcagccatactgttgtgttctcaactgttaacattctcaattcctccttatgaccacgcgattgttttgaccgggtactgtaagtaatctagccattgagattcagcaacatcgaatatcgtcagtgaaataccggccatatcaatcgaagtcatataattaccaaccttcataaaggccggttgaatgtgccgtgttgccagttcatccaacaagtcatggcaaaagacatactgatccatcaatggcgtcgctcccataccattaaccaagaacgcatactgatgatctgactgtaggtgtaattcatcatctaatttacctagcaattcctgaacaagttgtttggatggcttgattttttcgcgccgataacctggttcgctatggattccgacgccaaactcgatttcatcatctgccaattcaaagccaggtttgccgacttccggcaccgtcgctgcggataatgcgaccgcaatcgttttaatccgtggtaaaacatgcgttgctaaactttctaaatcatccaaatcagcgccttgatccgcggccgccccaagtatcttatgcataaagatagtgccggcaaccccgcgacgaccctgagtatataaactatccttaacagcaatgtcatcatcaacgacaatcgatttaacttgaatatcatctaattcagccatatctttcgccatatcgaaattcatgacatcaccagaataattcttcacgactaagaaaacgcccttaccttgatcgacagccttaattgccgcataaatttggtctggcgtcggtgaggtgaaaacctgtcctgccacggcagcgctgagcatgccaggaccaacaaagccggcgtgggcgggctcatgaccactcccgccaccactaacaattccaacttttccccgcattgaatcttgatcactacgaaccattgcttcggtatccggtaatttagttaaatattgaggataggcacgtactaacccatcaaccatttcgtcgacgacattcttgggatcattaattatttttttcatttttgttgtccttcctttctcgaattaacaagttaattgtaaatgaatccgctttcaaaaataatggacagttttgttattttgtccgccagcttccgacaagcatggtcattcgaatgcgttataataaaatcaaactaacaatataagaaggtgttcccatgcaaatcattaatgaacctcaaaatgccctgagtcaagcaactcagggcattcaatgggcctatccaaatttaacatgggtaccaaatacattcggatgttacgacagcaactttcaagatgatcagattccgttaattgctggtgggggcagcggtcacgatccggcacactggggttatgttgggcctggtatgttaactgccgcaatcatgggaacggtttttcaaccccctacatctcaagaaatcgttaaagtcacaaaacaggtgacacgccagcgtcgcgtttttttcattgttaaaaattttccagcagatgttagtgcgtttacggctgctcaacaacaactgaaaaaggaacattggcaaactggtctatgtattgtggcagacgatatttccgtggatcatgaatctttaaaacagcgccgacgaggagttgctggcacgattttagtgcataaaattcttggtgccgctgcagctcagggggcctctatcgctgaattgacccacatcgctgccgccctagtgccaaacattcacacgattggggttgctgctagcggtgcccgcattccaggacagtcaacggcatcgtttaacttgaatcctggtgaaatttattacggtatcggtattcacggggaacccggttatcggcgtgaaccttttcaatcgtcagaacgactcgcacaggaattaattagtaaattacgtctcaactttaagtggcatgctgacgaccattacgccgttttcgttaactccctcggtgggacaacgcccatggaactcatggtgttcaataatgatgttcacgaattactcaccttagccgcactaacaatcgacttcaacaaagtgggaacttttttaactgctaacgggatgcatgggttgtcattaaccttactcagcctagccgaccctgactggttaactgctctaaaccgacccgtcaaaactgctgcttggcctaactagttcaaaatttcgagtgtcatttcgatggccgcaatagcgtgctgagaaagcacctcataatcttcaggatgattcgcaacgatattatgcgttaacgattgtgcgattcccaagcacagcaaccagattagggccgccgtttctgttgtattggcgtgcgttagttcagtcaataacgtggctaagtggttaccgacaagtgccgtcacgtcaatttcatgctgcgtgttaatacattctgcataaaattgacgattcgcatctaactcgtaacaaactagtttaataatgtcgatccaaggcaaataattcagattatgttcaaccgtttcagtcagggtgtcatcaataaaccaggttaataattcatatttatcttgaaaataatcataaaatgtttgccgtctaaaatcggcggtgctcataattgccgtcacggaagttcggctaaagcccctcactaggacgacgtcatgaaaggcttgtgcaattttcttttttgtaatgtatgccattcaaacgcctccatactgccttttatcaacattgtagcgataactgcaacccatgtccaacggaagccatattccggattaattgaccactaggagaaacgctacataatgtcatagcgtttctcctagtgatatttttatattacttataaccaataatttcaggtctagtaattctcaacaaattcccctaaaatacattcaacacacttagggggcttcaattattatgacatcatcactcacggttcggcgtatcccgttactcggtgctttaattgccatgcaacttatcttaggaagtttactgtcaattcaactattgctaaccaagatatccttcgcgtttattattattggtttaacggtccgtttattttcaccactagttacagccggcagtagcgcgatttcctccctactcggaatgctgctcttcccaaagttcaccttttttcctggttttatcctaaccgcttttctgaccgggttagtctttggatacgcctttcaacatcaaacttcactgacacgcgttctcgtcgctaactttatcgtcgtctttattctcaatttgtttctaaacagcctctggcttcatctcatgtacttaacaccatggtccgttttgctaacaacgcgcatgatacaagaagtcataacctacgtctgctactcagttatcttgatcgccctatttaagattccgattctgaaccagctcaccgcacgctttaagtgacggtggtcattaattatttcgttaattaagtaatgactggtggtacttaatttaaagctaagtaaaaaaccaagggccacagtacattgctgtgacccttagtttttgtgcaaacaattgattgtcatacgaccccgtcagacctaccaacagtgccgaactcgacttcgtattaatttaatgctgccaccattccggccaaaaattcagcggcaccgcccacgaaaatttgttgtgaatgcttgaagattggcgcttgttcatccgtattcacagaaagaacgtgttgcgcaccagccatgccagccaagtaatcatcatcaccagcgacgccaatgttgatcaagacttctggtgcaaccgtcactgctgaggcaccaatttgttgctcaatgctaaattgttccatagccgttagcggctgggtaacagccaatgctgcaccaatccacttggccaattgttgggcttgaagcaatactgccggttccatcgcgcctcgacctaatgccacgacgcgtttcgccgtagcaatactgccgacattgactggcacatccctagtcaaattcaagcgttttacgacccgatgtaggtcggccacgactaggtgctcaggagctgtgtggggtcccgttgtcgggacatcggccacttcgtcattcaggctcgtcgtggcaaaagtcaacgccaattgcgtatccgtgccaacaatcaacggtagtgtcgccacgtcattttgcaaggcacttaacggcgagtgttgcgtataggctagatcaccgatcaatggcatcaaaattttaaacggcgccaaggcattttggctggcaaacattgccgccaattgcgctgcgtctgtaaatgggcgctcatcatcggcctgttgggccgcattgtagacactagtctgtaaggcggccgtaatcgccattgctggcgccaaggcagttaacggcggctgttctgtcagcgctaactgtcgtgcctggtctgtggcatgttgccatattcccgctgtaatcgccccggcaaataattgccccaagctttgcgcccgttgcatcactcgttgtccttgtcccaattgaccgatttgatcagcggccgtaaccgggacatcggtgagttgaacatccgcgatggtcaatccgtgtaaccctaaaggggttattggttggctgaccgtgacgcctggctgatcagcactaataacaaaggcccctgtagcattcggtggtgtctgtgcgagaactaaatactcagttgcctgtgtaacattcaataccgttttaaccgcaccggacagttgccagccagctgttaccggcgttgctttgacggtactactagccatgacttgttccggtaatgccgcgagtccaaaaacacctgattgtgcacaataccgttggcgttgttgcggggttccaaacgttaatattgcatcctcaacttgccaactactggcaaaactcatagcgagcccagctgaactttgcgccagcgctaatgtactcaaaacccgttggctcaggcggtcatctggtagtggatcgtccaaagccaattgctgggcaagcgttgtcagtgtcggtcgatcgactttcccagtcgactccatctgcatggcgagtcccatcaattgctcacgtgccagtgccatcaaccgttgccacaatcccgtctgtcgtgccgttaaatgtaattccattccgatccctcacttcatccgtcatctattaagtctaacttaccacatttttagcctgctaacgaaaaaagcgaataaacattatcactattgaacgctgccgaatccaccggtcgaaaaacagtcgtccggattaaacatccgtcgactgttgaaatacgtattattactgctggtcatctaaatctgccgccataaacccatgttctaaaatcgccatgtaggtttttgcgcgactgaccacccattcgatatcggccatcgattcaacttgatgattctcacgcatataggtctgaaattccataaaaatctgattgtaaacacccataatcaaagcaatcgttgcatcacgatcaacatccgcacgcagcgtcattttatccagcacctgactgatcatttcccgggaaatagtcatcgacttagtatacaggatcttcatttgtgcctgtatctttaccggcaagcgctccagcgcgccatacgcgtcaatcaagaccttcatttcatccgggtggtctttaccaaacgccgccttgtaacgcgcactccgcaccatcaacgtgactaggtcatctggaacatcaaaaacttgttgattaatggtggcaataatcgtgtcagtagcaagctgaacagtggccaaatacaagcgctgtttgctaccgtaataatgaaataataggcccttagacaccgttgccgcggacgcaatcacatccgttttagcatctcgatagccactgacggcaaaggtgtgcatggccgcgtgcataatacgctcgaccttcgccgggtctttaggaacaggttgttttactgccatgtcacgcactcctttcgtttactgagctagatcacgccgccgataacttagtgctgctactactaatattagcacagttaataacaggcaccagctacttgtcgttccatctaagggcttgattggtaccttgttaacaaagccaaggggcgttaaacggcgtgcccattttggcaaatcaatcaaattaccaagatacaatgagaagaaggcgtaaaatacccagatccacgcagcataccgccatttaggtcgccagcccgctaaggcactcgtcaccgctaccatcactaacatcgccggtgcataggccgcaaacacgtgccaataggtcacccaactgatgggcttgaccatactcgtcaggcccatcaaatacataccacttagaccggcaagtaaaacgagcagtcccgttacgattgcccagccggtatagcttgcccacacgtgccaccgtgatgtggccgtcgcataaacttgatgtagatagcctttttgttcatcattgaccagtttgagcattaactgtactgctggaaccagtgcaacgatcaccatgacgatagccaacacagcaatgaaatttttgacgatcaagcgattcgctgctgctaaagctaacgcacctagcagttgtttgatcattggattgctctttgccagatcgccaatcgtattaaagacggacgcatacgcggcacctaagataaagttccctagtagccatgcaataatcagaccatgtgcctgccgccataatagggtcacgggaccccgcaacaaaccgctagcctgtcgccgaccgcgccgtgattcgactaagcccgcgcccaagtcccgataagcattaagagctgcagccaaacttaaacaaccaagacccagtaatacatacagaccgattggtaaccaatcattggtttgatacgcatctaatttttcaatccaaccaaaggggatccaccaagtcaggtctggacggttaacatccgtgcccattcgtgcaacgtacatgacgcccagtagcaaatagctcagcatcgtcgtaccactcgcactagtcattacctgtgcaagtaacagcgtcaacattccaaaagcccagcctaagccccctaagcccagaccaattaaccaattacctggcgtcgtcgctcccggaagcttggcgacggtcagcccgagggcaaaaagaaaaccaatcaaaccatttagcgccgttaactcagctgccccggcgaatagtggtgctaaccgaccgaccgcgtgggcacgcactagctctagcaggccatcatcttcatccccgcgcgtcgtaaccacggccaccatgatattcatcacaatcatgacgatggccataaaaaccatcatttcagttgcaaacaccttggccgtcgtatatggcgatttggccgaaaacgcaccaaataaggaaatcatcgcgggcgttttaagcgttttgacaatttcattcagtgccatctgagtgccataaataccatcaaacttcgcggcgatggccgtgaatagccccgtcaacacgacgacccaaatgagcaactttttccaatctcgtcgtaagttgaaccgtatcagtaatccggtacgagcaaatagttgtgttgccatcagcatcacttccccttcaccggttgttgttcggtcgtgtaatagcgcatgaataaatcttttaacgttggtggggtcgttgttaagctgatcagtttccgactcgccaagtactgcactaccggcgtcaactggtcagcatcgacggctagactgacgtggttatctccgtggcgcgctgtgaccccgtgaacaccagctagggtggtcaagtcagccaaaggcagtcgtgtttgcacatcgaccgtggttcgggttaagtgccgcatctcagctaacgaccccgtttcaacaatctgtccctcacggataataccgatgcgatcacacattttttccacttctgacagaatatggctagataacaggacgctcttctctcgccgttttaaagccaatacttcattttgaaacgtctgctcatttagcggatccagtccggacgttggttcgtcaaaaatatatagatcagcatccgttgagagtgccgcaatcaaggccaccttttgccgattacctttagaataagtgcgcgcttttttacgcggatccagttcgaattgtttaattagcgcgtccgtcttagccgtatgctgaccaccgtttagtttaagaaacaagtcaataatttccccaccacttagattaggccataaataaacatcgcctggcacataagcaattcgcttatgaatcgccacactatcctgccagacatcgcgaccaaaaatcgtcgcctgcccaccactagcttttaaaattccaagtagtacccgaatagtagttgatttaccagcaccattcggaccgataaatccaaaaacttcccccgcgttgatttcaaaattaatatccttgagagcctgaaacttcccgaaatgcttttgcaagtgactaatccttaataacggttctttatccatatgactcactcccatccttcaaattcgagcatcttattgttgatgctgcaatcataggcgccgttgactagtaagtcaatgactagccagtcaatcagttaaaaatttcattttaaacatctaatccgcttgaaactggcttctgaggctagtcaagtcaacaaaaaaactgttttggcgataaactttactcgctaaaacagttttttgacatctgaatttctatggcagaaccagaaagatatatcgtcttcattagccactagaagatagttgggactaacccaccatccgcccgcaatgcttcaccagaaaaactgctagcaaacggactagcgataaacactgctaaccgaccaatttcttccggccgaatcaaacgctgaatttgtgatagtggtcgatgattaatcataaagtcatgctcccactgatcctttggcaaatctgaatcagcatacatatcatctaacattttctgaacaccttctgttaatgtcgagccgggcataaccgtgttaaccgttacgtggctaccaactgttaacttcgacagactcttcgctaaagaaaggttcatcgatttagtcatcgaatattggggcatttcccccgaaggcataactgcttcttcactcgcaataaagataatgcgtccaaaatcttgggctaacattgcaggtaaataatgttttgccaaccgattgccagacaacacgttcactttaaagaagcgttcccaagttgcatcgtcaatctcatcgtaagccattggcccaaagattcccatattgttgaccaatacgtcaaccgttggaatttgttgaaacattttgtcagcttgctgcggatcactaatatcatacggtgccgccactggatgagttgttgggtatgccgctgcgagttcatccacaaccgctgccaccgtatctgtgcggcgaccattaatgaccacatccgcgccttccttggcaaatgctaccgcaattgcccgtccgattcccttagtcgaaccagtgaccaagacccgtttccctgctaatcccatttccatgctcaaagttcctccgttctaatttaaattgctcgttaagtctaactagtttgatcaataaacacaaataatcggtcctcacgggtattaatctaactcgtttatttcccgggtaataatcgcaaaaaaagcacaccagtctcctggcatgctaattatgtacgcatcttaatccgcgcttgatttcgcatattcttctaacactggcataacgtagcgttgttctgcttgcttacgtgccatgatggcatcatccatatcagcaaactgctgattcaaaactaagcggccccgatacattaaccgtgcgacccacttctgtgagcatcggtcaaaggaaacaccaatgaccccgctccgattccggctattcggtttcaatcgatcgaccgaagttccttgataaagcggtaagttatcactacgtcccatatttttacgggtttgcggattttcaaaaatattctttcgactaacatctgcccgtaaacagccacagctcttcgtaatccctttccgtaaccgataactatcgacaactacttgtcgtccacatgaacactgacacaaccaccgtgcattaccattcggcgcactttcagcccgttcgataacggtcaaacggctgaaagtctcaccagttaaatccttaagtcgcatcaaaatcacctcactaagctttctgtgtaatcagctcaattgtcttcaacacaatcgagcttgtactatttaagttaacccgattatatgaaatatttgtgacgaataaaaaaacttttatagtaaaattcgcgcaatatccattaatttccagctgattaactaacactcaacctattccagctttgtcttttatttagaatactactattatgattatatgtcactttttatcatttatattatcatcagaccggtaaacacaaaaaaacgttagtctcagaatagtctaacgttttatatgttaattgtacaaacaattattgccaatcacacaaaccagcccagtggcgcgagccctaaccagctcagaacgttaacgttagtgtcagtcgcaacaaatggtcgtaaagtctgcttaatttctgtcgcattggctagcgtttgcagatcataccaatactggccctttttactatgacctactaaggtccaccgacctaacgactttaatgccggtttctcggtgtcaagatcagcagtcaatgcactcacaaaaacgtgcatcgtcggcatccaggccccgtcgtactgttcagtgtcacgccgtaactggctgatttgattctgcaaacgatgcgccgtccgatacagtcctaataccgcgagaagtcctactaacagcattagcatccagacgcctattaaatctgtatcaccccgatgaaggatcagaatcaaaaacaatccccataccacaacccctgcataaagactgaggttgatcgtattcatcgcccgatcacgtaactgcaaagctacttgcaaacgaatcttaggatcagttggtgccattgtcgtttgctgtaatgctggttggtcgctgccggtatacacaatctgaatatctggttgctgtacttgcacttgggcgagaacttgaaacgcgctgttactgttgctcatgtcagccgcgattgcttgcggcacatactcactaaagacccgataaatcgtcggcacttttttaaactgataccaatttccatgaatagccatcaataaatagcgtcgctgcgcttgcgcattcagccatgccaactcctgttcagaacctttgatcaaaaatcgatgccgccacatacctaccacttccattttaaaagtttaaacaaatccaattggtgccaatcccagccaacttacaatcgatacagaaacgctatcttccacaattagctgtagcgattgcttgatttccgcagcacttgccagcgtcttcaagtcataccagtacatcccgtgatgatcttgaccgacgtaagcccacgcccctagacctgccactttttctgtatccagctcagtggacatgtttttcaagaaaacgtgcatcgttggccgccaagcatcatcatattgttgcgtaatgactcgcagcgcattcgcctgtttatgcagccgacttgcttgccatgcaggatagaaggtaaatagcaaccatgctagcattccccaactggccacgttatcactcacattcaggctaatcacgatcacggccagtatcagaccaaccactaacctaatattcatgacatttaacaagtgtccccgttgcgccagtgcaattttcaactgcaacggtgcgtcctgacgatccactcgtgccccctgcaactcagtctgagccgtgcccgtataaatcacctgtacggctggtttcgtcaattgtagccgtgctaacaatttgaacggtgtgtgctggtcgtcgatttcagttgcaacattaccgctcacatattcactaaagacttgataccgcgtcgtcgttttttgaaattgataccagttccccctgatacgccgcagtaattgcccgcgttgtacctgctgattgagccatcgcaattcctgctctgagcctttgactgccatttgataacgccacatatactcacttccccgttaaattaacccattacaatcccgcctgctcacaaatctgattcaataattgcagtcgttttcgttcagccgccaaaaccgattcaccactccccgtgatttcataggtatgcacgtcattttcatcgactcgttccgtcattaaataatccttagtcatggcatgcaaattcgtaaataaggttcccaatcctagctgtagttgattattggtcatttcagcgatctttgccggaatcgcttcactggtaattggctggcgaacactgactaacactaagaacgctgcttccgtcattggttcatacttatcaattaatcgttgataaaagttagctggcatattttcatcccccttaatcagattattgaagcgctttctttttcaatcaatttaattatgggccaccgttttcttgaatgcaactccccagaataatttccacaaaaaatcggtagccactgattaacgcggttaccgattgctttaatgaatttgaacatccgctacgaccgtacttgtctcgtatgggaaatgtgattcggagacttcaaagggttgaccatcatccatgtaactaatctgattaatgaccaacacgggatcattcagagtcgcgcccattgcggcaacgtcatcagccgtcactcgggctgccgagataatacggtgtgaacccgcgattttcttgccactatgttgctctaagtaaccgtagaccgagccttcgaggacttgcttcgtcaacgtcacgatactcgttggcataatcgtatgctcatacgcccacaccttaccatcaacgtagcgggtccgccgaataacgtacaccggatccatctcatcgattaacaactgttccgcttcccgcttagtaggcaagcgagcttgtaattccaacaccttactcgtcacctttttaccggcattcgtttgcgttgttcccaggggcttgtctaccagcgtttcttggcgccgttcagtcaaaccaaagtccttgcgaacaaaggtccccgcgccacgcttggagtaaaccatcccttcaataatcagtaattgaatggccttgtgaatcgtaattcgtgtcgtatcaaaagtttcagctaatttattctggtcgggcatcaattcgcccggcgtatatttaccggattttatgtcttgtcgcagactatccgcaatcgtttcatacttataagccaaactactcacatccccttcatcatttggtcttgtcaactagtttaccccttttagtagctaattgaaatcatttgtatatacttttattggctttgtttaattaacgaccaatccaactaatcatcagcatccgtcactgaccgtatagccgaatgaatcagcgcatttgaccaccatttaatcagctgttcccgattttcccgttcaatctcgatgtaaccggctacatccgttcggttttacttgcacccccacagactttggcgtatgctttaatagttaaattcagattagaaaaagctgtgacaagatgagtaagctaattctcgtgcttagagagtcgtatttttggtgcaaaacgatgacgtggttagttgaagatggtcttgaagaagctactggggccatctcagtcggagcgatccgttacgatcatgataagtccctgtgggaaaatctcggtggtaacacgcaaacgcgtcctagaaagcattcgcttttaggcgcgtttttttatgaccataactgatctgaaattaacgcctgttcgcttttattaatggttattagaacttattcattctcaatacttaaggagtgttacactatgcaaaacaagcaatccaattcaattcgtaccgtcgtggctaccgggatcggcgccgccgttatttttgttctcatgaaatttgtcgccattccaacgggtgtgccgaatacccaggttaacgtcgcgatggggtttttagccttactaggagccatctttggtcccgttgcagctggtttagccgtgttcatcggtcacgccttaaacgacttcgtaacttatggttcgccttggtggacctgggtcatcgttgatggtctgattggggttgccttcggactagctaaaaatcggctcaagattgaaaatggcgtactaggaacggcaaaattagtctggtttaacatttaccaaatcatcgtcaactttattggttgggtgcttttagcaccaactggtgatattattatttatcatgaaccggccaacaaagtttaccttcaaggtgtcattacttggatcgccgattccatctcagttgccatcattgggaccatcctactagtcttgtacgcccggacgcggacccaacgtgggagcttaacaaaggaacgttaataacatgagcgcacccatcattagctttaaaaatttctcttttcaatataatagccaaacggaaccaactttacgtgatattaatctggatatttaccccggtgaaaaagtgttgattgctggaccttctggctccggtaaatctacattaggccggtgtttgaacggcttgattccgcagtcctatccaggaacagtgacgggccaagcaaggattgctggtcaaaccattactgagagctccatttttgcattatcccaagacgtcggtacggtactgcaagatcctgatagtcagttcgtcggtttgactgtcatcgaagatatggctttctcattggaaaatgatcagcagacccaaccggccatgcgacaagcaactgaacagtgggcccaaactttaaacctccaggacttattgactcaccgcccgcaggaattatctggtgggcaaaagcaacgggtcgccatggctggtgttctgatcgacaatagtaaaatcctattatttgatgaaccgctagcgagtcttgatccggcatcgggtaaagcctcgatggcactcattgatcagctgactcatacgcaggacctgactgtcatcattattgagcaccgcatcgaggacgtgttacagcaaccaatcgaccggctgattgtcatgcaagacggcgcgatcgtcgctaacgaccggccggaaacgattttgcggcaatcactcatgactcaactcgggctacgcgaaccattatacctttcagcgctcaaactagccggtgttgatctagcaacttgccaacacttggataacctccaagccttacaagtacccgacctcaccgcgacgttgcaaaactggaccgccggcgtacaactacagtcgcccaccgttcatgaccaaccgttactcgcaattgagcatctgacattcgggtacgatcccgccaaaccaatcatcaacgatatcaccgtcacacttcatcagggtgaaatgattagtctagtgggtcaaaacgggactggtaagtcaacattaagcaatctgattactgggtttttgatgccacagtccggcaaaatgcgatttaacggtcattccctagctgaccaatcagtcaaagaacgtgccgaccaaattggttatatccttcaggaccccaatcaaatgatctctaaaacgatgatttttgatgaagttgctgccggtttggtcctccgaggtgtcgctgacgatgaagtaaagcgccgtgtccaggccgttctgaaggtctgtggtctctatgagtttcgccactggcctatttctgcgctcagtttcggtcaaaagaaacgggtcacgattgcggccatcctcgtattagaaccggccatgctaattcttgatgagcctactgcgggccaagacttgcaacactatactgaaatgatgaccttcttaactaagatcaatcaggaacaacacatgacgattatgttgatcacgcatgatatgcacctaatgctagaatacacggatcgcacgattgtgttgggccacggcaacattttgatggatgctcgcccagccgatgtgttgaccaacgcatccattattcagcaagcttccttagccaagacaagtttatacaccctggcagaagcgcaccatttaaacccgacagaattcgtcgcaaaatttgttcaggctgaacgggaggcgcgctaagatgcaacatgaattattgatcgggtacaacgaccgtcatacttttttaaaccgacttagcggtagcactaaactactctgctttgttggcttatcagttatcgggatgatgacttacgacacgcgttacttaatcggggtgatgattttttcactgattctattccgcttttcaaaaattcattaccgcgatatcgcgttcgtgcttaacgttattattggtttttccgttttaaacttagtgatggtgtacgtctttgcgcctcattacggcgtctcgatttatggtaccgaacacttactactgggatctgctgatcactactttaacttgacagccgaacaacttttttatgaatttaatttgttattaaagtacacgtttgccgtgccactcgccctgatttttctcatgacgactaatcccagcgaatttgctgcgagtctcaataagattggaatttcttatcgtatcagctattccgtagcgattgcactacgttacattccagacgttcaagctgattaccgtactatcagtctggcacaacaggctcgggggtttgaaatgtcgaaaaaagcgcattttatgacccgtattcgtggcggcatccaaattctgcttccattgattttttcaagcttagatcgaatcgaaaccattagtcaggcgatggaattgcggcgcttcggtaagggaaaacatcgcacatggtacatggcccaacgctttaaacgtaacgactatctggcgttaacgttagttgctctgctgatcatcctcggcatcgccctctttaaggtcaacggtggccgtttctggaatccgtttaaggcataacgttgcatcataattttccaaaaaacttcgtcgaccatgcttatcgatgaagttttttgtttgcatctacctatcaagcctcacctgacttaacaacagcaacaatccccttattccacacgcaccatcctgttatgccaagattaactaaaaccagcgactttaaaattgaaaaaacaaatttcaaccgctaaactgaaactagatcttacaaaaagtaagcaaaactagcttgaaaggatgttttattgtgactagttttaacgaaccactcaaattcaaatctggcgttacactacgcaaccgcctaatgatgtcgcccatgacgacgactcaaagcttttacaatggtagtatcacccatgacgaaatcgactactacacacaacgagctactggcttaggtgccgtgattacgggtgctgccaacgtcgaagatctcggtaagggttggcatggcgagcttagtatcgcgcatgacacgatgctgcccggtctaagtgcacttgctcatggcattcaaagtcaaggtgccaaagctatcgttcaaatcttccacgccggtcgaatgacgcatcgagccgtcttaaatggcgaacagattgtctctgccagtgccgttgcggcccttcgtgacgatgcggaaacaccgcgagcaatgtcgattgacgagatccacgcaacaatttcagcattcggtgaagcaactcggcgcgcgattcaagccggctttgatgggattgaattacacggtgccaatacctatttgatccaacagttcttctcaccacatagtaatcgccgcaccgatgaatacggtggtcgcacgccgcaagaacggttccgctttattgatgaattattaaaggccgtctttgcagctgttgaccaatatgcggaccggcccttcatcgttggctatcgtttctcaccagaagaattcgaagaaccaggtattcggcttgaagataccctttggttactctcacaactacgggaaagtcgattagattacgttcatgtctcactcaacaactatgaccgtgtttcacgagacccgcagtatcaagataaatccatcatgacctacgtgcacgaagcgttacaaggtaaattgccactagttggtgttggttgcgtccggacccgcgacgatgtcaagactgtgttacaaactgccgaactagtcgcagtgggccaacaattactttatgatccaacttgggccgtcaaactcgctaaaaacgctgacaacaccatggttacggcaccatttgaagaagccgttgaggtcacaccacttagccggccgctgtatgaatttgcagcctcgcgctatcacagcgtcattaatagttaacctgtcagccgaattaaaaacgtccactgaaaaaatcagtgggcgtttttatgtttcacgtgaaacatttagactttcaataaccaattcagttgttgtaacgcacgctgatggtcaccttgatattgacgcgcaatatagtaataggctaacgtttcatgggccgttgcttgccggtcgacgggcaattgatactgttggtcaaagacctgttcaaatgcttctaatgtcggcgcagctggctgttcacgcaaacaaaactgtcgtaattccgatctagtcatccggtcacgggcaatcggttggcggtcttcatgcgcagccaaacgttgctgtagtgctgcttgcataccggcatccgcattgtccgcaagccactgttgagtttgtggcattgtcgtttgcatggctaattgttcaaaccaagccagcgacaatgattggccccaccgggtcgtcaataagtgctcccaatccgcacgttgggtcgcctgctgatgatactgccagccccaacaactattgaagacatcgtcataaaaacgcgtcgtttgttgttcatctagctgttgagtcacctgattaagtgcggcaacgaactgatgatcaagcatggctaggcgccgaacttgaatcttcccagtctgtcgatattcagtcaccatttgcccgaattgataagagttcaccaaagggcgttcggtcgctggtggcgtgattttttcaaactgttgcttcgccatcggtcgttccggacgcatcacaataatggccgccagctgctgtaaataacattgataggcgtgactctggcgcaaggtttgctcggccttcacagcactttgctgcgcttgtgcctggcgttgttgttgattagtcacaattgcttgacgggccgcccgctcagccgcttcaatcaccgtttgttcatcatggactaaccgctgataggtttgttcagcgggctttagttcctgtaatggtagctgcttggtacgacgttttaggtacgtcgtgacggtttgcgtcgttgtttgtcgcaacttgcgcgcttggggcgcttgctcagccggtaattgtggtagccacggctgagcaaacatgatcgttggcactgttggtacagcggtagtcagcgtctgatactgggccaccgcataaaagttatcttctgttgtaatcaccatcaagtaacgcgtttcggcgttcatgaactttttgacgcattcagaaccgacaatcaactcacgatgattatgcttgttttgaacatggtactcataacgaaccggcttatgacacaattcgcaatgatgccatgcttgtcggctttcattcgggttaacaacgtacggcagactcgccaaaagttgccactcatgactacagtcggtcaaccactgtgcatgatcttgtaaaatcaagttacgaacagtcgttttcaagaaatcactgtcagcctttaccgttacgtgtgcgcgtaataacgcactaatttgttggagcgtggtccgccgtcgagctcgttcacttaacagaaagaaacgattttcagcgggggttattaaagttgttgctgccggcaatgccgcccacccctttcagtaaaaataccgttctagcataccataactttcccattcagtgcgaacgttagttctaaaatctcggtcactctcattaacccaacggttactcccatcgcggttcgtttgttatcaagcctttattgattgcattcaaattcacccactttttgataattttattgatattacgattgttacaaagcagtcaaggtgctaaactatcttcgaatcaaaaaagattcactttaagggggattttgaaatgaaaaaattaacatcagtcgttgcaacacttgctttggcattaccattggctgccagcccgtttgctatgactaccacggctaatgccgccacggtaaccccaaaagccactacccatgcacttactaaagcgacccactttcccgccatcacaatgcacgcgaaggccgccacgactttgaatacaattcactttgccgccgatcgggcaatcgcctttgttagcccggccaaagcaaaactcagcactaaaaagacttacacggtaactaagacgattactttagcaaccggcaagcatacgtcggccacatattatctcattagtgaacacggtaaggccctcggctgggctaaagccaccacgatgattaaagggaacgccccgaccgctaaattaaaagcgaccaagaaaaccccgaagactaagttgacgattgctaagaagaccaccaaagtaaaatcaacgaagctaacgatcaagcaccctaaggcaagtatcaaaccaactaaaaaggtaacgactctcgccactaaaaaaacgttagcccaaccaacgaaaactaagaaaatggcaccaaaattaatcaaaaagaccgccaagcaaaacgctaaaaaggcgcccaaacttgcaaccaaaaagcatctcacggtcaaaaccactactaaacacacaccgtctaaattaacacctaaagcagctgctaaaatttgatcaaccactaaattgcttagcaacctgatcctgttaatgacggcgtctcaacgagccgttactactgatcgtgatgcacactaaaacgctccctatgaaagtcatctttcatggggagcgtttttaaatcatgccatcatcagtattaaccactgacaggccagcatttaattaatcaaacatcttcttagttgccttgagcaaggtctttggatccttatcgtaccgtggtgtcttgaccaagttatccattgggaccccagcaaagtgataagcggcaatctcaccagagcggaccgcactctgttccgtgaagatcatctggtatggttgttccgcaaattcacccgtaaaggctaggttcgttgagtgctttggtaagacttctggccgatcagacttagcccggttattaaagagtgcggaagcatatggcatgtataccggaatattgttcacaatactgtccaaaatttccttttccttgtccttaatattgcctggacccggatctactttggaaagttgaccaattaattcttgagccatttccttacccgtcatcttgatatacggcttgttaacaaactcaccttgacgccgtggatacaagaagtagccccacagaactgtttcgtttggttgctgtgtcgtaaagtgtggttggtggtgcaccacgatcgacatattaacatccttttggttcaacggcgtaattggcgtagttgataagaaggagttcaacgcattcccgggttcctgggtggtgatccgaacgatttcatttaagaataaatgattcttagtcgtcaacgtgaagctgacccattcgctagcattccgatcgttgaagaacttatctggcgtccctaagttatagaaccgctcagtagccttcttccacaaactagcactaacaccataatccatattttcaggagcaggcgtgttgtaatcacccatcgttgcagaatcggtaattgaaccgttagtgaagatcaccgctgtgtcctcatcaacttcaacttcttccgtttcgccagtctgcgcatcctcaatgactaagccagtcaccgtaatttcgtcttgcattggcgtgtctttaaattgccaatccttaacaatcttattatcaatgaaagtcacaccttgcccttgcaagtacttaattaatggcaaaatcatgctttcgaattgattgtaacgcgtccggttgacaccaactaagtgttcaatttgtgtaaattcataaatcatttgatgcatgtaacgccgcagttcttgagcagagctttgcgttctaaaggcaaaggttgtttcccacatataccagaaattcgtttggaacatatgcggatcatccttgaagtactcagcaatcgaaacgttgtcgagcttcgtttcttcactatctggcatcataatcaacttagtcagcaaagtccgatccttattattgaatcctaacttaccagcattaataatgcctttaccaccctgcatcaagcgggcaatatcatacgtccgatgtttcgcatcaaaatcacgcgtatcttcggccgccgtcatccccggttcagttaccgatggaatccggtccaataaatccattaagtcaacgtacgtccggtaattcagcatccgaccaccccgggcaacatacccagtcgtgttagccatcggatgattcttattccaatactcattggtaaaatcagtcgtggcaccaccatcattggcaccgtgcatatcaacaccatagaatgtgatgtccttaccatcccaatgaccctcttgaatcaagtagaccgccgcagccatatttgatagcccggcaccaatcataattgctttacttttaaccataaataacgcccccaaaataggtaattaggttctgataacgcttacaagtacattatacaacttggatagtgattgtctagtttgaactgaacttttttgttttcttgccgctttcttaatatttgcgctagtcaaccaatttctgcccatagcgtaacaccatttgatgacttttctccaattaaacacattgcctttaacaaatattacattttttcaagcggctcattcccaccacaagttctgccatttatgtatgcaaaaagcgagccttaacaaatgcagacggctcactttttattttgactaaccgttcaaattaacgaatagttcctgtatattgaaaatcatcggcagtgggatcttgtagaaaagccttcaaatcagtcatgttctcaataaccgctttgccggacttagccagcatcacattaaacgtgccatcagctaacgtttcactatagtaagcaacggggatatctaaaccatatgctgttccagtttcccaaatagttcccgtgtcaaagccatcaaccacggcgacaactaacttggcccgttttaaatggtccacattgtccgtaaataccgcgtttcgatcagcttcggtcgcatccggcgtcaaatcgatgccgtctagccgtggactgtaataagtcaattctaactcgtccattaatttttcgatcttagctagccgttctggttggccctcagtaaaccaaggtcctgctaaataaattgttggctcatcactcatcaaacgcgtactcatttgctcaatcctctttctcattcaatgtttattcattttaaccgtcaaccccatgaatttcaagcgtcgtttagctcgttttaggcaaacaaaaaggtcgggaattcccgacctaaatactcatttaacacttaattgacttaatccattaaaatcggccgttgttaaatcaacgttggcggctgccacattgtcccgtaaatgctcaatagaacttgttcctggaatcggtatgatattatcagaccgcttcaatagccaagccaaggcaatttgcgctgggctcacctgatacttttgggccatcgtgctgaggacactcccagcctgagccagttcacccgttgctaatgggaaccatggcagaaaagccatcttttgtgaggccgcgtagtcaacaacgtcatcatcaccgtgattggcgacattatagagattttcaatggcatcaatcttagcgacttgctgcgcctccttgatttgatcaacagttacttgactcagaccgatatgcttgattttaccttcatcctgaagctttttgagttcaccgacttgatccgcaatcgagtaatgagggtcaattcgatgtaagaatactaggtcttcatggtcaatccccagtgtcatcattgaaacttctacttgctgacgcagataccgtggctcaccaagtggcgtccacacattcggtccttgccgcgtttgaccgaccttatcagaaatgaagatctgatcacgattagcggcatccttcaagcccgccgctaagtaccggtcagcaaaccatggaccgtatgaatcagccgtatcaaagaaattaacgccatattccagtgctttcttaactaccttgaccccattttcaggatcagcgtatggtccccatgtcccaggacccgttaactgcatgacgccataacccatccggttaactttgaattgatcatcaaacgcgtaagtacccgcgttagctgcattaatcgttgtcatcaaatcgctccttatcgtttattaattatgttcagtttactcctatcgacccaagtgcggtcaaacattttgttcgttaaccttgggttgggttgtgcatgtatgaaccagccgcatctggcaagtcgtttaaggcttgcatatcggccacactaattgcgaagtccaattgcgtattcgcctcaatatgggctggattaacagccttgggcaatggcaagaccccattttgtaaaacgaagcgtaacgctaactgcgccacactgacgccgtatttatcagcataggcctgtacttgcggattatcgaggaccccgcccgtcgctaacggcgagtatgcttctacaagcatggcatgttcctcagaaaacttggtgatcttaggttccgtgaagcccaagtaatattgaatttgattgaccattggtggtatcgtcgcctggttaagaatattcttcaaatcccgaacagcaaagttagagacaccaatcgctttcgcccggccactttgataaatagcttccattgcctgccaaacatcgaggttagcttcatcgtaaactcgaccgacttgcccccatggccaaggtgcgtgtaccaaatagagatccacgtagtctaagcccaaatttttcagtgagcgatcgaaatcatttagtgcaccttgatatgacttcgtttcggccggtaatttagtcgtcacaaagatttgctcacgcggaatgccagaatcacgaatcgcctggccaacgcttgcttcattttgataggccagtgcagtatcaatatgccgatatcccgctgctaaggccgcacgaacggcttgatacgttgcctcaccaccaggtatctgccaagttccgaatgcgactttgggaatgttgacaccatttgctagttgatacatcgttgttaacactgtcatcttatttttgctcctttactggttttgactgtcgttgctgagtgggatcacctacaaggcttgccccgatgatcgccacgccgacgaccgttagaatttgaataaccgccatattactgtggcctccttaattgaatagagattagtgtaatcccttagagtaactctaaggcaaagataaagtttcaaaaaaagaacgaaattgacttgggccaatctcgttctgcattattgtgatattaattactcataaatcgttgcatgctggaaaatgatgctgccggataatgctagtaacgcggaaagaatgatagctaaccagagtactggtccccagcctaattgaccgcctaaccagccgaatagtacgggccccactgcagctaacaaatagcccgcggattgggccataccagataagtcagccgtttcaaacccattggtcgttttttgcgtaaagaagacgactgccaaactgaaggctgctccagagcctaatcctagtaagacgcaggacagtgctgccacccaaaaattcgttccggaaagtaagataccaccaattcccgcaataaaaccgacacctaccaccataatcattgcccaaacgccgcgccgatgaccagaagtcgctggcactaaatatgacatcggtaggccgctcaattgcatgaccgtaactaaattgccagccacaatcaaggagaagccgtgggcaacaaataccgttggtaaccaagtcagtaatgaatagtagactagtgcttgcaagccgaaaaaggccgtaacgacccacgctaacggccgccgccaaacactcccgtgagttgccgttgactgcccatcactcgcggtcatcgcaactgttggtgcgcgatgattgtatttcaagtttggcaaccagacaaccaaattaattagtccaatcaccgatagcaccgccatcgttagtggtaacgaccagtgtgccgccaacactcccgaaagtcccgttcccagtgaaccgactaatagcattgagagcgtgtattgactagttgcgactggaatcttcgtcggaaaattatctttaataatcgctggaatcaagacattgccaccgtccgcgccaatcccgactagtaacgtcccaatgaaaagggcagcaatcgttgggatgacccgcagataactcccaacggctagaaagatcaacatgacataaattgtcagttcgttgccaaatcgccgcccccaatgtgcaatcaatggggacataatggcaaacgtcaataatgggatcgtggtcagtaatcccgccatcgagctcggcaaacccagtgtccgtttcaaagaactgattaatcccggcatcattgtaattggtaaacgcatattcgttgccgctaacatcattccaagtgttaaatagcggctatgttgatgtgttgtggtcataagtagttgacatcttctttccaagattttagttcgataattgtcgaactaaaaagcaaaaaaactaaagcgttgctaagaaccccggtaaaaaccggtcaaaggtcgctaattgtaaggatagatacttcgtctgtgcctttcgtcgcgtattggtgagacccactaaccgcaaggtcttaaagtgataagagacggttgacttgctgatatttaattgcgcccccacttcgctgcaagtcatttcccgttgtgcttgatagagcacccggataatccgtaatcggttagcatcggccagtgctttgaaaatcgccactcgttgctgatcagcctgatcttgtttgcttatttcgatattcatgaaactaacaatacactgaattaacatcatgttcaaggacaagtaacaaaaaaggcagctagccaatttaatagactaactaccaaacacctaggaaactgcccgtttgccgttcttccaaatatcaggaactaaccacaaaattaaacctaggttaattaacaaaagtaacgccgtcataatgaataccgcgttgtaattgaaccaaccagccaccaaacccccgagcaaggcgccgaacatattgccaatagcttgaaaagattgattatagctaaaaatcgttgaggtaagatgtactggcgtattcttagtcaaaaccgtttgaatctctggatatagtgcgccatcggaaatcccaatggcaaaccgcaaaataccgagggccacgacgctcgtaacaatgccttgtgggaaatacataatcaccgcaaaaatatagccaaataacaataccttaccagaaccgtgctgatcaccataacgtccaaggcgcggtgctgaaaagatgtttgaaatacccggtaaagctgcgataattccggccacaaccgtaatcgggccacggtaatgcatcaattcacgaacgtataaactaatgattggtgcaatcgaggcgtttccaaattggacgatggccgtcgaacataacatcacaataatcaagcgcggattttgaaacgctgctaaaggattgcgactgtcacctggttcacgatgatgtgcgactggtttgaagtgttcctgtacaaagaacagactcaacaaaaacgccaccattaataatccggccgtaataaaaaacgtgtttcgaatcgaaaacaattgggctagcaagcccccaatcactgggccaaacaattgaccactaacggcaccagtgatcaaagtgctcaacgcccgtccactatatttacgtggcgtttgggacgcgactaaggcttgggcattagaaataaagcccgcaaacacaccttgtagcgcgcgcaaggcaactagttgccagacattcgttacaaaacccattaaccccatcgcaactgccatccctagggacgcgcgcaatagcatgatcttacgaccttttttatcagcaatgatgccccacagtggtgccgaaattgctgaaatcgcgtaatcagctgcaaaagctaacccgctataaaatgtaatctgggccttcgtgaaatcacccaactgactaacaaataatgaaagaaatggcataatttcgctaaatgccattcccgcaacgaacgtacaaaaccataaaacaatcaaattacgatgccatggtccgcgttcacgttctgcgtcatccacgctcgtcatctccatatctaactgacactaattttcagtaagtattataccgttaattagcttatcatatttagcgaccaccagtgacaattatttcccgggaaattttttgtcatatttcctgaccagttagcccgtttagttgaccaagtagcaataagcactagtgtcaagccgcatttttcactacaataagcttatcaaaatcgctatttaaggggggaatcagcgatgcacgtacagttaaccatctctgaaacgattcatcaatgtttttcaagatcgctcgctcattaagctgccacttcaatcggtgtcacgtttttacactgccaataaacgactttattgtgaaacaaccaccggtgcttacctcgttcacagccacttacacactttaatggaccaactgccaccccaccaatttctacgtatttctagtagtgaaattgtgcgaatcgcctgtgttaaaaattttaccttaaccaaatggggtagctttcaagtcaacctaacaaccggcacaacaacatacgcatcacgacgctatacccaacaaattagaaaggcggcacaattatgaaaagactttggcacacccttttgattggcgccatcggaggcatcgttatcggctacttaatggccttggggttctcaaccttctttaataccacctatttatttccttctaatcccacttttgtcagccactggtcctcgcccttagccgccacccagctttcgacattattgtggattctgattggtgaagtttgggcattcagtagctggctattcgaaattgaaacgtggtcgattacgaaacaaaccattgctcattgtctgtgttcttacctagggatgaccccacttgcgattctctgtggctggtttccattaaacgttcgctggtttggcttctataccttggtttacaccggagcctatatcggtctatggttaattgaaatggcactcgcccgcatcaaagtcatccagctaaaccaacagcttaccaaccaccggtcataattcataccgattgttgatgtcaaaaacggcccaccgatttgattatcggtgggccgctcacttgttactgatgatttaatgatttaattattgaatttcgatttgaccgtcattcgcgctcggctgggtcttaggtaacgtaatcgttaagacaccgtcagcttgggatgccgtaattttatccgccgcaacgtttggtaacatatactgccgttgcaaggtgccagtatgacgctcattcatcacaatgttttggtcttgatcttcatgatccacaaagctatctttttgaaccttgatagacaacacattgtcacgataatccaacttcacatcttgcttatcaataccagggacatcaaccttcacttgatactgatcatcagtttcgttaatgtcggtcttcaatacttgatccatgttttctaatggtgcccagaaggagcgtgccatccgttcaaacggatccaacatgccgaaatcgttccgattcattaaagtattagccatactaacaatcccctttcaaaatttcacttggctattaatactggtcagtaattcaaatccttgtttgacctttcctgaccttcgatatatatactaacaccattttgtgggaatgcaacaatttagcactcatttaaccggagtgctaaattttaatttcacgaatccgtcgcattaggctaacaaagcgtctcagttccgcgtcagaatagtcatcagcaatggcttgtgctttagcagcaatggccgcgtccagttgcgtgtgtaaatcagcgactgcttcgcccagcgtcgtcaatcgcacgagaatttctttgttattggtcaaatcccgatatttcgtggccaatttcaatcgggataatttagtcaaaccgcgagaaatcgtcgcctgtgaaagttccgttggtgccggtagcgacttagctcgactggcaccacgccgtcccagatacgcaataattttaatatccgtcgtcgatagttgttttaatgccgcttgtagttgcggatcagtcgtttgttgcatggcccagcgtttttcttgatcatcaacgctatcctgcgtcaaaaattgatttaattccgtcatcaactgactaactaatggtgttgtcatttaaatatctcctttttaattcaagtgaataaatacttgcataccaatattattaagtctatactatcattttgtattcattagaatcaataaaaatatctggaggtcccactatgtttaaaattgcaatcatcttagggagtacccggtcacaggctaacggccgcgctttatttaaccatctaaaattaatcattgaccaattaccgactcattctacgattcactaccaatttttagatttggccaactatcagcttccccttttcgatgaacccgagccaccgatggcgaacccgcaccgcgagctacctgctaaccagcagcaatggctcaccgatatggctagtgcggacggttacattatcctgacacccgaatacaatcacgcgatgccagctggattgaaaaacgccttcgattttttggcattcgaaggcgcccgtaaaccggctaagattatctcatattctgacaatatgcgcggcggtcaatttggggcggccgcactagttccagttctccaacgattaggaatggtcgtcctccctaaaccaacgcccattggtaacgtaccacaaacccttcaaagtaacggtcactttatcgataacgcgcccctgagcaaacgctacgatcatgcacttcaccaagctttgaccgaaatcacctactataccacggttcttaccactacgccgtttccaaccgattaaattagtagcgttattgaatcaaacctgctacattatagttagcattattaagggggaattaacttatgaagatcgatattcatcgttccgcaacggaccgggtgattgccggtgtcattggtggaattgccgaacattttaactggaatactaacgttacccggctattatttgttgttttagcaattacacccatgttccctggtatcatcgcttacctgattctctggttattaatgaaggaccccatcaaggattaaccactattaacgaacagtcatcgactgctcgttttttattcgctaatatgcggccaaactttccgtagctagttcaatggcaacaagaacaccgcccgcaccccaatgtcgcggatcatagtgctctagttgtgctaaggtgtctgccgtatatagtaattgtccaaaggaaacttgccgaaacgccgaacaggcagctaaggccgaacattccatttctacgacttgacaaccctgctgacgagcagctttgactttagacacagtctcacggaagaaagcatccgttgtccacgttttgaccatctgccatggcaggcaagccttcgtcaatgttgtcccgagtacctgtataacctttggatcgagtggcacccaatcagctgctgctaaataatgaaaggacgtcccttcatcacgcaaagccaccgttgggattaataattgttcctctggtagtgctgttaatgcgccacaactaccaacggctatgacggtacgagcaccaaaatcaatcaacatctctaaatacattgtcgcagctggggaaccaaggggcgcttgcgctactgccaatttttgaccacgataaccgatttgataaacccagctaactttagtaatggtattaaattggcctaaacggtgaccatgataccgagtgacgaattgttgaaaataatcatcaccagaaaatatgtagagtagcttagctggaacagtaaagcggccatccacgtctggccctaccatagccgttggatttggatcatattgcaataacgttaacttatctgtcatcttaagttctccctatttaatttacccaacaattcgaggaaaaccagtcattttcagcgacaaactagccaaaatctgatatattattgcaactaacgcaataatttgtcatgaatttgtcaaatattttaatggcgttcacctagattgttcgtatataatattatttataataacgctaattaagaaaggatgtggcgaaattggcctatttaacacgcaataaacgtcgtgattttacagaacctcaccggtaataactttatttttaaggagcgaattgaatgataaaagatgacaatcagtcgttaacctctaatgaagagcaaaacgacacccagaaccctcccgatgcggataacttatggcagcttgatgaatcagccttagccgcaaagtacgccaccgatcctgagaatggattgagcactgctgaagctgccgaacgtttacaacataacggtcgcaacgaactggagaccaagcgtacgtctcggttcgttcaattcatcaagcagtttaataacagtattatctacattttagccgcagcagcggtcttaacgttcttcatgcaccactattccgattctatcgttattggactggttattattgccaatgccatcattggttatgtccaagaacgccaagctggcaacgcgctagaacggattcgtgaaatgctgatttccaaggatttcgtcatccgtgatggaaaaaaactggaaattgacgcccgcgaattagtcgttggtgacttagtcaacttagaagccggtgacgcggttcctgccgatatgcgcttgatttcagcggataactttaacgtccaagaatccgtgctgacaggggagactaatcccgtggagaaacaagaagaaccgattactgagaccacgccagctttggctgaccgtaagaatatggtttacgcgtcaaccgcggtgactagcggttcggccgtcggaatcgtaacggctaccgccgaagataccgaaatcggtcatatccagcagtctgttagcgacgtcaaacaaaccactaccccactgatgcgtaatctgaactcactgggggttggcttatccatcgccatcgtggtggcagccgtcctattattcctattaggaatggtcatggatacctatagtttgccaactttactaattgcggttattacgatggtcgttggttctatgccagaaggactgcccgctagtacctcggtggtcttagccatgggaacccggcagatgacgaagaaaaacgtcattgtcaagtcactacccgccgtggaaactttaggtgccgtagatatcgttaacaccgataagactgggacgttgacgaaaaatgaaatgacggtcactaaggtcgtgacgcctgagcatacgtttgatgtgacgggggtcggttatgatgataatggtggcgttaacttcgatggccatctcaagctcaatggcaacaaagtcgactggcaccaagataacgcgatggaatggctcgttaagattgccggccaaacgaccgacgccgagctacacttcgaaaacaatcgctgggaactgaccggtgaaccaaccgatggtgccttgacgacgctgtatcgtaaaatgactggtcatgatcctgaggttgaagaagttgactcgctaccattcgattccgccttccgtttttctgctcgcctggccgacttagatggtcaacgcttactaatggtcaagggctcacccgcgactgtcctgcgtttaactgaccaagctaaccaaacggcatactgggatgacgccatggacgacttaaccgccgatggtttgcgcgtggtggcgctggcttaccaagaagtcgatgatgacgtgactaccattgatgcacaagccattggtgggctgcatttagctggcttagtcggaatcattgacccgcctcgtgaagaagcggctaccgcgatcgccgaattacggcaagcgggcgtgcaagttaaaatgattacgggggaccaccctgatacggcgatggcaattgccaacaagttgaacttggccgccaatgtcaaagcgattactggtcctgaaatcgacgcgatggacgatcagcagttacaagcacacatcgatgattataacgtcttcgcacgggcaacaccgaataacaaattacggattgttcgtgcccaacaggccaataatcacgtcgtttcgatgactggtgatggggtcaacgacgccccggccctcaagcaagccgatattggggttgctatgggaatcaaggggaccgaagttgctaaggaatccgccgatatggtcctggccgatgatgactttgctgatatcgtcgccgccgttcgtgaagggcgccacgtcttcgataacattcgtaagacgattcgcttcttactcccaactagtttcgcggaaggcctcgttgtcatcattagtattttaatgggccacgaacttccgctgtacccgacgcaattactgtggatcaatatggtatccgcgctgaccatccagtttgcgttcatctttgagccacccgaggccggcatcatggcccggggtccccggaatgttaagtctgggttgttgtcaaaattagattactttgaaatcggctatgtctccttcctaatttctggattggggatcttcgcctatgactacttgaccgcgcttgggttaccaaacgtcgtcggtagtaccatgtcactgaacatcatcatctttggtaagattttctacctcttcaacttgcgaaatgaccaccccgtcatttccaagtacttcttccaaaataagatggcgttctacatcattggtatcctgattctcttacaactgggaatcatttacctaccattcatgcaatccgtcttccatacgactagcatcaacttctggtatggttggggcatcccgattatctgtgggatcgtcgtcttgattgtgaccgaggtcgggaagtctattcggttccgatggatgggaaaagatggcgtgattgattagtaattagttaataaatagaaatggctcaccaacctgttttagttggtgagccattttttagtatcgtgaaactgtttttgatgtggccgctattcaagacaaacgttctatgcttcgtttcctcagcatcgttctaaacctgtttgatatgactactattcaagaccgtaaataggttgtaaacgttcaggtctgagttctaaacctgtttgatatgactactattcaagactaatacgatccattgactccgctagtgacagttctaaacctgtttgatatgactactattcaagaccagctacttcatgctggctaaaagtatctggttctaaacctgtttgatatgactactattcaagacgattgactttatcgattacttcctgcaattgttctaaacctgtttgatatgactactattcaagactattctcgtttatcgcttttagacgtgttagttctaaacctgtttgatatgactactattcaagaccgttggagtttgtgccttaacttcttcaaggttctaaacctgtttgatatgactactattcaagacgtttggactggtttatcaagcaacaagttggttctaaacctgtttgatatgactactattcaagacataccaattggagcattaacataaatcatagttctaaacctgtttgatatgactactattcaagacttgaaaatcgcatgaatacccgaacctgaagttctaaacctgtttgatatgactactattcaagacagttactttaccgttcctagcacgagaatagttctaaacctgtttgatatgactactattcaagaccagcattttaacatcatttactcattaattcatatcacgccagtctactaaatcctcgtcaacataataataacaactatttttgaacttttccattcgatttatttctgagtattcgataacaatgacagttgcgcccaaatcatgcactagttgctcaaagctcgcccattgtttttgatttaagtaatggctgacattagtcaacaccagcttctgtttcaaacctagttcaacatgcgtttgcacaagtgcctccagtattgcccttgggtcattcataagcgccgttggaaagtgaataccggtaaacttcaatatttgttctaggctaggcgattcgtcaacatctagcggtaagtctagtaagaagctggcttccattacttgcgaaactactttacgattttcatctaagaccgctacttgccgatcatcagccattaacttgataatttgggtctgcactttctttagaaaaaggcggttcaaatcgactgataacatcaagtcaccataccagttgcattggctactgatcgtctgtaattcaaggtcgtcattgcttatacgtacgctgtcgattcgatctcgaaagccttggcacacttcggcatacatgttactatttcccaaatcgagaacgttgaccttaccagcatcgatcttgaatggtggaaatggataatatgttatattcatataacaatcgtcctttcagctgaattcaaaatatcattgctaggtgtaccttgaatatagtgcattgcctgatactgcttctcagtcactgtcatcgtttgcacttttccgcctttgggtgccagtggcgcaatccgcttttccacgaattcggccgctttcttatttacacaaacccggacgtaagttgagtattgcatcatcaaaaagccctcacgcactaaagctttgtgaaagtgccgatatgcacggcgttcttccgacgtatccatgggaacatcaaacatgactattaatcgcatcactcgatacctcatttggtaatttcacctcaatctttaattcttccgtttcaccgctaagatagtgtaagcacgcggcaacatactctgtaatcgcgtggctcacaattgtttggtgcccattaaacccaatctctaggtctaataacgacactagtccaatcttaatatccggtgtgaagtccttaaaccgttgttgactgacccattgatcaacaatcggccgaaaaggctccattaaatctgagccgaggttaaattcgttttcattgttctcatgatgaataccaatgcaggtcagatagccatttaaaacaatctctcgattcaccatggataacagcacggcgtatccgtagttgagtgcagcgttaattgggctaaaatctcgacggtagaactggtcaccaaataacaatgaaaaatatttattagccacaactgcctcccgattagtcacatcattcagttctaacttatccaactcatcaacaagtgtctgggtatcgccaccgacaaagtcaatgacttgaatctggttcaaaatcttactaccaacatttttcgtccatagcgttgcaattcgtgcttcgggccaagtcacctgttgtcgtaccaaatcagctgttcgccgtgtcggataataatcgttggtctcactgattggttccccctgatgatctgtaaaaataactttgacatgagcttccgtcagcgcacaaagcgctgcgctagtaatcacagcctgagttgttccgactaacagcaattgaatatcactgattggaaccgcatatttatcagaactcgtctgaactaatatccgattcattgaataagaaactttagcatgttgagtaataatcacgtttcgccatcccataataacagctccttgattaattatatttttcgtgctactattcacttgtatcaagttctaaaccttcttgatatgactactagcgtcaagatcaaacaaggcatttattgccaagtttcaccttttgagtccgtattcggaccactacatatgtaccaagatgtcatccttatcgggatggcatcttttttcgctataaatcttttaatgcaatttttcgctcgaacaaaccagttggtgattgatatataatttcagcgtcacccgttaacttaatgccaccaggaacctgtaacttaccaaaatctgttttcacacctagcacctttaaatcaccatacgaggcattcgcatgtaagccaataaacatattggtcaaaattccttgcttccctaaaaccagcttattcttaacaaattgatttttcgcttccagcagctcaatctgatcacgagcagaattaagtatcttcttgaacttgttcatctcgtaaagtggaaagtatcggttaacctgggcaagcgttgcgtcaaaaacagtcagtaaattctgatttaattgcacttcagactcattctgcttacctaaaaatgcgcgctgtaaagttaatggtaaatacagctcttgaatgttgtgataatacgtatcagtaccaagtgcgaagcggtgcgtttgacctttaattctatctcgaaccacctgttcaaaccgtaccttcggcaataacacttcatacgtcagcatcttcttgttgttggcatcaatgagcggttcaattactttcgtcaccgcttgcttgtttgtcattccttgttgttccaactgctcaatttgtgtcaccatagttgtaggtacacctacaacttggtactggacatcctttttagtcgatactttcacgatagccatgtaagccagcgtttttcccgtataaccaccataaatagctgtatcgaaggattgttttttccgaattaatcgcttgccattatcacttgccttcaagagagtttgatcaaacattgccccatagttttcggatacctcacgcgtcaccaataatcgcttgtaatcataaagcgtctcaaaatatttaatatcggttaacttatcccacaaaacttcaccagtatcgatatccgtaattggggtatcagtcttagctagttttcggataacattgaaacgtgttaggttaaccggctgtttagcgaacttaccgtagacgaagaatcgttccagcttcggatatcgcttcaacaaataggtgccaatgaaagcagttaaggctgcgtcaaatgcatgatggtagtcattgacctcacgaatcttcggaaaatcaaacgtttgtcgaaattgatgtgtcaagttcgctttaaccgacacaatagcggtggatggatattctgcattaatcagctcttcaactagtttgataacctgacgtgtctcaaccaactgccgattaataaaaccagtcgcgtacttgctgatttcatcaggacgcatcagtaagtggtcaagcttccgtttggtcatcagccccattcggtgcatctctttccacttagcacccatctttttcccaaacttttcactagcaaacgtatcatttttctcacgattgatgcgtgcatttgtcagtactcgattatctaatgagtcatctttcaccagagattgtggcaagatgtggtcgatatcatattctgacaatcgatcgatattaatcgcatcaccggtatacaaatcgcggccattttgtaggaaataaagtacgagccgcgtattgaaattagctttgttcttgattttctcttttaattcacgttggacttgatccctgacaatggcctgagctgttccctgataggctgcaacaatttgttttgaccgtgattgtgtccgccgaccagcaacgccaccaccacgagccgcttccacaaatatccagttaggtgtttgaccatgcatcgcatctttaatgtcagctaacaccaccatcacttcgcgaatagccttcttattttgcggtgacgtatataattcattgatggtatcttgaagatccgccgttgttaggttggcctggtttgccgatttaatttgattctcaatggcaggttggcttcgtaattgcatgaaattagcgtttgtctcccacaagccgtccatgattgaacgattattatcatctttgagacctgttaataattttcgtgataattgtccccagccacgatatcgtaattgacctagttgcttaagttgggccgctgtcagccaggaaatctctgtcagtttttgcttaaaaatcgtactatcttcaaaaatagttgaccataaaatgattttttcaatatcagcttgcttacgcacgtctgacatagcttcaggcaacacctgtttcaaatcatgatacgtggataacgaactattgaatactttcggatccgcaagccccgtaattcgtggcgcagtgggaaactctcccgctgcaactaaattgtcttgaatattcttagctgttactcgtttgtgttttttaaacacttggttatatagtcgttgtttttgccggggtgttaattgcccatcatcaactcgaatattattcagctcattgagcaccataaagcattggtaaatcaagctgcgtgcgggtagcacttcctcaccgatcaaatacgtatccgtcgtctgcatccgctgaatgaaagcggtcgccgaggccacccgatcgaccttatcatcaaaattccatggcgtgattggcccatcagccttacgtaccatccatgcaaaacctgcattggcagttgctgcctgcatttctttagtaatcagcggtccaacataataaggcacccggaaaccgacaagctcatcaagtttgtatggaaacttaccgcgtcgcttgatgaccggattttcttcacccaaccacgggtagtattccttctgattactaataatttgatctagctcattttgttgaacctgataaggaatagctccattctgctttgtccgcaatttaggcatgaattgttcagagtcaatagcttgcttaatttgagctgcccaactattcaaatctacatcggcgtcaacaaattttcccaaggccttttgaaacgcttcttgcgtcacctgtttacttttcacaccatcaatatattgatcgtaggttgcccgaatagcccgtccgcgcttggcgtctgactgagagcgaatatacgctttcaataacttcaaatcttcgccatggcgtttatacttctcaaccatactctgtgagaaccgtttaccttctggaataagctgtgcaaggttgacgctggcgtataaccgaattacctcatcaataatttgttggcccacttcgctaaaacggtcttcaatgccaggaagtttgtcttgattttcctctaaactaaaggcccaatcctttgcttcagtagcgtcgatgtccgttagagtcagcacatcaatcttggttttatttccaacgagggctttcgcaaattctgttaccactgccttttggcgcttcttttccgcagtagtcgcgccagttaaaactgctaatagtggcataattaatttttggcggtcactacgcgagatatcagttcgtaccaatgtttgtttgatgctgtcaagcaacgctacatcggttgtcaggttcaagttcagctccagatcagcctgactaaacaaatgattcaaagtttcaaagtgctgctgtaaatcaagtgtcccacttcgatacgctgtcgctgcatcattacgcaaaaaattgccgcgatatttgacaatatggtgaatcgctaggtaaatttcacgcacatcaaacttgcggtgctgagtcatcagcgcctcacgtaaatgataaatcgttggataatcatgatagaaatcctgatcactccgatcattaaacaacgttttttcaagaccgttataattaggatcacgaggtgaaatatccgaatatttgcgccgcgcaaagaaattgatatccaccttgctgattggttggtcaaagaattcgcgtagtaatcgtaaccgccatttcacccgtttcaaccgacgacgcgttgttcgaaatccccgccggtctgctgcggctgccccttctttaaataaccgtacaccaatcccagtctgccccttaatttttctgacatgaccacttgcatccacaaccgtccagccaaccgagttcgtaccaatatccaagcctacaccgtatggttctttcatttatacatcctccgataaattttagattatgcactcattatcgcgcagttggataatcatttgcaacaagcaaaagttaatcctagcaacgattgtaagcgcagtcttaattattttctttaatattaatgtattaaatatataatctttgtcgtgtcgccaaaattagcgacctattactatagacaaaaatacggtgatgacacaaagaatgttatcaccaccgtactttgaaataactataattttaaaaataataatgcatcaaggaaactcactgaccacgacctagcacgtcgccaaaaattccaacaacgccttattaaatgctgccgactgttccgccatcacgatatgaccagcttccggaatgaccacactctgtcctcgtagtgccatttgagcagtcactgccgcaaagtcgggattgaagaacggtgacttggcgcccgcaatgatcaagaacggtacggtcaattggcggatcacatcccgccaatcctgaaccgcgtggttaaccaacaatggaaacattaatttcgcatcgaacggtgcctgcgcttctactgccttgacgcgcgcatacgtcgcatcatcgatgtgcttaaacgtcgagtgtcccagcggcattctaaaatagtccggaatatcctgccattgaacctgtttgaacccatattgccagtgcggtgtattgatcatccgcggcgtttgatccacgtcgatcagggccttaattcctgtatcaccatacaatgacacgtacgcaaaccaagtcgcggcccccatcgaattaccgagtaaaattggttgttcgagttgtaatttttcaatcaattcatgcgcatccaccgcgcgacgactcatacgtaagcctttcgccgtgtgctcggataaaccttggcaccgcccatctaaattaatgacccggtagcccgcctgaatcagtaccgggatttgagcgcgccaaatatccttagcgccaccaaatcccgtcaaaataacgattggctgcccctggccttcatccgtataatctaactgaacgtgatctgacgtgataaaacgcatttcaccatcctcctttttgactattcattcaacatggtcattaaaatcttgtggcgttagcttctttaatttttctagccattggcgcgttttgtcatccagcccagcttcggaaagtgtattctgggcaatcactgtcgaatcaagcaactgagcaaccttttcccaatcaatccccgtcgctgtttgaatactggtttgtagctgtcgtacttgctcagtcgttatttggcccaattgtcgtgaatcaccagttaatgctaatagggcattgattgctaattgctctgataggcaggcctgccacgtcgctggggacagtgcctcagttaacgtaatccgctcacttaacggcacagctggcacttccttgttcagaaaagccgtccagcgcgccatttcctggtcaactaaggcatacccctgccacggtaactgccgattaaaggtctgtaacgtttgcttcgtcaatgccactactgaccacgttgtctgaccattgtcgctcaattctgcttgccctgcggctaaccactgtgccataaaacgttgcatcatctgtcgcatcaccggccgctgttttgccgcttgcgtcaggtggtaacgcacttgcaaaaattcgctaaccatttctggcataatcgcccgcttctcctgggcctgacgtcgttgctttaattgtcgtaaccgtttctgtttactgacttttgcataatgtccttgcttgaccatcgtgccaccacttttcctgataattatattgatacctaattttaacgcaataaaagcccaaaataaaagcacttaccatttactggcaagtactcttgattacaacgtttcttccttgttaccggcgtatttacggaaataaatcaatgtcatgatgaccagaaatacaacaccgactaaaattgagtagcgcgtttccggattaataaacatgaagaccagtgttaacgcgaggaaggccaacgttaaataatttgaatagggtgataatggcattttaaaaggatggttcgccatcttggctgcgttttgcttacggaacgcaatttgactcactagaataacaaaccacggtaccataccgggcaagacactcgaactgtaaaccatcacgaaaatctcgctagcatccttgaaaaacattggtaacacaacattcaagacgactccaattagaatcccggtcgcaatcgcaataacggaataaaatggtactccatgacgatttaataaagtcatcttccttggtaactggtgactttccgccaacgtgtaagtcattcgactcgcactataaattccagaatttgttcccgataaggaagccgtaataaccacgaagttgataatcgaagccgcagcggtaatcccaattttggcaaatgtctgtacaaacggtgaaccgatctggcttaacttatcccaggggtaaatgctgacaattacgaagatggcacccacgtaaaagattaaaatccgggcaaccgttgaacgaatcgctttaacgatcgtgctttgtggattttcagcttcaccagctgtgactccaatcaattcaatcccttgatacgacgccaacacaattgctagtgcgaagacaaagcccttcaccccaccagtgaagaaaccaccatgggtccacaggttactgattccaattggatgaccgccgttaccaataccaaaaataatcagacctaaaccggcaataatcatcagaataatcgtcaccactttaataagtgagaaccaggtttccagcgtcccaaacattttaaccgagataaggttggccgcacataagaatacaatggcaattaggcccggaatccaatctggcaagttcggccaccaataccggcagtagccgcctagtgcaatcatttcactcatcccaacaacgacgaactgaaaaatgttgctccaagccgtcaagtatccaaaaacggggtgaatatattcagaagcaaacttggcaaacgaaccggtattcggatcgacatacagcatctcacctagtgcccgcataatcaggtatagaaaggcccctgatacgatgtacgcaattagcactgacggcccggtccacttgatcgttgagctggatcccataaataggcccactccgatcgtgccgcccagtgcaatcatttgcatctggcccgtacttaattttctctgcataaattactctcttttcataaaatcaaagaactcacactatcacggctgacagtatatagcttttatcttagctaaaaaagtgcaccgacgcaaacggatttagtaacacatagtcagtatgtacttgctctaacgcggttcgagcatgcttcgtataaatttatcaacaaacagctttcagtcagaattatcggtataataagggtaattaaactagaaacgaggtttcgtcatggcaaattacattaaagaaattcgggctttggttggtcacaaaccaatcattttgaatacggccgctggtattttagtcaacgatcagcaacaaatcttgctgaaccttcgtaccgatacgcataactggagtttacccggtggctatctagaatacggtgagacgtatgccacggcctgcgtgcgggaatataaggaagatagtggcattgatgtcgaagttgttgatcgcatcggcatctttgataaaggcgagacggcctatcctaacggcgatgtagctcaaacaatcagtgcactctttcttgtaaaacccattggcggccacgttctgacccaagccactgatgaaacactcaaactcgactactttgacttcgacaacttgccgccattgttaaatcaacaaaatgcagatatgattcacgccgcccaggaatatttacagacccattcggcaaccaaataacctaaccaaaaatcgtcattccacccatgtaagaatatgcgtaaccaatccggactttccgtctccggtgttgtttggggatgctccggatcggcaataatcgcgatacgagcaattgccgtcagcggcacctgttggatttcaaacgtttcgtaattgtaaagcgctaagcaacccactaattgtgcatcatcctcatccttagtcgtggtgctaaataattgaatcggataaataacctggtcgaccatccctacagtcggctggtaatagtgcatggtcgtcaactcatgatacgtgactgcatgaatcaacgcctgtaacaaggtctcgttgacaccttccgtactacccgcaactagctgaacatgacgctgataattcgccagcgcatgatacgtctgatcacctaacgtctgccgcaatttttctaccgttatcgttgtcacacttggttctaggcgttgaccaccctgataatttggtaatgcggagactaacaaggctgccaactcttgctgcgtaaacgtcgcgttggtgcgactaggtgttactggatggtaaggaactagcggttgtgaggagaagtgcaatgctaatttcagtgctggttgcacgcgtggatcaccaaacggcgcccagctgaccatgaagccggcctgcatatgtgcactaacctggccaactcggtaaataaccgcgggttgcacagcatcatcgaccaagttatcattcagccccgtcttggtttgagcactgataccaactacataaaagctactagcgttcgttaagaccgctgctgaaatgtgttcattttgccaccgctgaaccacgtcggccttcgccgtcacttgacaagtaatgaggctgtccggcggtacttgtgaccaatcaggcgttaatagataacgtttggtaacgtgtaattcatcagcgggcgtcaaccatggcgataacggaacctgctgatacttaatcgggtgaccattgcacatcatgacaattgttcctaacggtgtctgtaacgaatgcgttggcactgcccctaaatttgtcctcgatttagccaatcgttggcggatttgcaacgcctcaatcggactcgggactgcagtagtccgccatagcatcaattcaagatgctgtttttgctgatctaataccgtcacgatgccgtacaatcgttgtccctgatccatcagtgccgcgtacggctgattctgataccgggcaatgtagcctaacttagcatgttgcaacgtccacactgagatggcattatcatcgtattgattgccactttctcgctggagcaacaccgccatacccactctgagcgtcgttaacgttgccacaatatcatcgacataccgttcgccaacgaccgtgactgtatccaatgcgacggctgcatcgcctgttgaattttgttcagttacttgaacaactgtggtcactggaattatttcaatgtcagctgtttctggttcgtgggcgcgaactaacagttcttgcccctgattaatcacagcgataacccgataggtctgcttcttcaacgtcattacgctcatgccagcttcaattcgttccatagcggtcacccccttaacaataactttattccattatacgaaagcgttgccagtattaacagctttacgaattgttttacacgtcagcttacaatatcttggattagttatctagttgccaacaccatttcagatgtttcacgtgaaacattcattagttttgcggctgcacattaaaaacgtggttatcctacaattcagaataaccacgcccgattttatcaatttgctagtcaatgctatctacgccacacaagcccgcataaacgccgcaaacaaccgcgcctgcacggagtttacttgttgcatcatttctggatgccactggacacccaactgtagaccaccagctgtcgcctcaattgcttcaacaacctgatccgcactttgggccaccacctgaaagcccgttgccacctgtttcacggcctgatgatgaaatgaattgaccgtgattgcgtcactagtggtgcctaaatattcagctaaggtcgtacctggtacgaccttcacgtgatgcatgccgtaagcggccaattgtccttgcatatgttttaaggtaccctgaccagctggtagttcactcatatcctgataaagattgccaccatagcacacgtttaagatttgtaagccccgacagataccgagcaccggtttaccaacggcgtgggtggcacgaatcagcgcaatttcatactgatcccgttccggatctaccccacccaatttaggctggggttcctccccatacgtcaatggggccacatctgcaccaccacaaagtagtagaccatcgatcattccaacgtatcgttcaatcgtcgttgcgtcggtcgttaccggtaataccaatggcacaccgccattatccgttactgatttcaaataatcacgattcacataatcacggacccgccccgggaacatctggctgttcactgtcacaacgcctggtgcgattccaattatcggtttaaccattctgtcgccctctctcaaaaaaatcccacggtaacatgcgtattaccaatgggattatcatttactttttacatctaattgtcaatgactaagctcacgatattcgagctcggttggtttgacgataattcccgtcaaccagacggcgatgctcagcccaaccaatactaatagcgtcgtgccaccaatgaaatcaatggcctgtaactgataataggcgacaatccccacaacccaccagcaaaagttcaaccagtatggtaacgtagcgtgccgcacaaagtacgtgacgaagataatagcatatagcggtgtgaagaccgaaccaatcaaatacaggaagttctgataatacgtcatggcaaccgtcagcgcaatcaatagcccaactaccgtcacaccaacggctaatcgattaacatggcggctaccggtcagattagccaaactcgtggcggccgaataagtatctaaaaatgtcgtcgtcaccgttgagaaaacgataatcagcaatgcaaccaatcctaaaccggaccgcgtcagcaatgccgtgatatcagtttgccctgtccgtaacacaactaatagccccgtcacaaacatcactaaactgcctaacatatagccacctgcgctgactagtgcgactggtaaaggacgatcaacacgctgggtataatcaccaattagtggcaaccatgagagtgccatcgtaacgttcaattccactgcttgcccaaacgtcatactagtcgttgataccgactgactagttgtcggtgccataaataccattacgagcattaacaccgtcccgagcaccaacaagcccacaacggcattgttgattttgaacagtaactgactacccatgagcaaccacgcaataatcaaaatcgccacgatggttgccattaatagcggacttcgaaagccaaatagctttccactaatactgttcatggctaactgagcattgacgatcatcaccgccgtccagccaacgagttgcaaggcgttgagtcctgacgctagtaacactccgccgcgaccaaaagccagttgggctgacgctaacgcggactggtgtaatttagcccccaaatagccggctggaaccaagaacaggccacagccgatcatgtgccccaatacaatcgcagccaatccgcgtgtcagccccagtggtgccatcagcgtacctgttaagatttcggcaattgagatagccgcaccgagccacagtaaaaattggctccgaaaaatcccgtcatgtttcatcagtgcacctccgtagccgttagcatcgccttgaccgtggcggccatatcgggactacgcgttaacattgagatcaccgcagcgccagccgcaccagtagccgcaatagctggcaattgcgcgacagtaattccgccaatggcgacaacgggacaggttgcagtcacgactaattgtcgcaaccccgtcagaccgactactggatccgcatcggccttagatgtcgttggaaagatgggaccactaccaagataagcaatgccttccaattggttagcaatctgcacttcagctaaggttgaacaagacaaaccgacaaacatttgattagcgacccgttgaataacttgtgtcacccggtcatccttttgaccaacgtgaaccccatctgcttgcagtgcgagtgccagctcgacatcatcatcgacgataaagggaacgtgcgcttgcgcacaacgtgcccgcagctgttgccccaatgcaaaacgctcagccgtagtcaactggctattacctttatctcggtattggaatgccgtgatgcccgcatccaaggccgtttggacgaccacatttagatcctgtcccggcacgtcttgtgtcccgcacacaaaataagcacgtaattgtgtgggttcaaatttaagcgtcatgaacgatcacctgctcacttggggttgcccaatgattcagcgggccatgaccatgcccgacctggataccatcctgaatcgtcccagcaacgtacgccttagccgttttaatggccgcagccattgaccgtccttttgctaattcggcggtaatacatgccgatagggtatctcccgtgccgtgggttcgcaccgtatcaatccgtggggccgaaagccaaaaggcggtcccgtcagccaacagtacgaagtcattagctaaatcggaattatcaccatgcccacctttaataatgacattgtcagcacctaacccctgtagcgcatgtccagctgtaaccatcgcttgattactagtgattgcctgaccaattaattgttctgcttccggtaaattcggcgtcacaacagtcgctaacgggagcagttcgtcgcgaaccgttttaatcgcatccgcggctaataacgccgccccgcctttcgcaatcatgactggatcaactgtcagcggcccaaaatcaactcgtttcaagttctcaacgacggcatggacgtgtttcagcatccgcaagcatccccgttttacaagcgcgaatgtctaagtcagctgctaacgaagcaaattgttcgtcaatgatcttcgtcggcattgccataaaatcttggacccccaatgtattttgagctgtcacggcaacgactaccgcggtaccaaaaacgtgacgtgcctgcatcgtttttaaatcggccatgacaccggcaccgccaccactgtccgtaccagcaatcgttgccacttgtggaaattcattcatcaaatctcgcgacccttcattatatttaatcaactttagcaattgtttgaatttctgacactgtcactaagctcagccggtcaatcaaatcaatggcaaatgtggcgggacgatcggccgtcagctgactggcgacaagttcccccgctcccgctaagactaagcaagccacttgcgccgcctggtaaacgtcggttggactaacggctgtaaaagccgcgacgatactagaaagtaaatcgcccgagcccacgtgacgttggaagagcggggtaccattagcgactttaactacgcgctgaccatccgtaataacatcagtaggtcccgacaatatgacacagcattggaattgctgtgcacaagcttgagcaatttcaaccaggtcgccctgaccgctccccgcatcaatgcccttcgcttgccaatccatgccagccaatgccgcaatttcaccagcattgccccgaataacatcgacttgaaaatcagatagtaatgctagcgcgacttcttttcgataagggaccgccccgacggccaccggatcaagaacgactggcttatgatactgattagcaagcttaccaaccacccgcatttgatcaatctgggtggtggtcagggttcctaaattaatgcaaacagccccggcaatttggaccatcgtctccgcttcttggacttcagctgacataattggcgaggcccctaacgcgtttagcccattggcaacgtcttgaaccgtaacaaaattggcaatgttaaaaacaatcggattgtgatcccgtaaagtattcaataattgtaattccatagcaattctcctcctcattgaccgtcacaccaatcaaaaacgaccaccaatcaacatgcattgatccagtggccgctaacattagctgtgacactttcctacgcaagtttgagcttacaggttcagagggatcggcacttacagcaccatctcagcccatttttggacacccctagtgtttaaaaatattcaattactaaccttagtctaacgattgtaaccgctaacgtcaatctttccgttaaccgaatcaccctcattgctacttaattaattaggcattaaagtttaaattcaccgccgcgaccggttataataaaaagcaaatatgcctttaagaaaagagtgattgaagatgcaagcacttgttgtgccagatccatccgctcaaactatggaacagcttcaatggcaagaacggcccatgcccaacctcgggccaactgaggtgttgatcaagacccaagcagtcgggctcaatccggtagattttaaattagttgcggcgggtaacgccgcctggcaatatccacacacactaggactagacacagctggaatcgtggaggcggttggcgctgaggtcactaattttcggcctggcgaacgagtttgtgggcacgctaatctcgccaataatgggacgtttgccgaatacgtgagtttaccagcagccgtgctagctaagattccaacgactgtgagctttgaagcagccgccgctagtctctgcgctggattgacggcttatcaggccctcctgcgcaaagccaatttaaatgccgcgcaaactgtgctgatccatgcaggtgcgggcggtgtaggcagtatggctattcaactcgctaaggctgctggcaagaccgtcttcacgaccgtttcaaaggccaagcaagccttcgtggcaccgctgcatcccgatgcccaaatcgattaccatcatgaagatgtgaccacacgcattcaagacctaacgcagcagcacggtgttgatctgatcattaataccattggtcatgctgatgcggacttaccgcgcttagcttacaatggccagcttgtctgtgtattagcaactccggaccactttccaagtaatcaagttgtaactatcagtaaattggacctcggtggtgcccaccgtagcggtaacccagcgcaagttgccgatcttgggaaaatgaccgccgccttattagctttggtccaagctggcaaggtcgacccactaattactcaggtcttgcaccgtgaccaacttgtaactggtttgcaacaactccaagctggtcaagtcgttggtaaactcgtcgtgacttttgacgcctgttgatctaaaaatgaagatacgaaaaacgcagctcaagggcggccttgaactgcgctttttggggtgtcaggcgataatcgcaacatgtgcgtatcggctggggttacgattatcatcgggtgggcgaatgaaccatgatcaccgccgttcagccgcccatctccgattaatcccgacaccactatcattaatttgattaggcctaggcgaaagtggccaattgtgccttggtcaacgtatcattcatccgaccactacggaaaccacctaaatcaagggtaacgtagcggaatccaagtgattgtaattgacggttaacgcggtcgttaaagactaagaaatcaccaattcgtgcttctggtaattcgatccgcgcaatatcattgtggaaacgaacccggaccgttggaaaacctaaactacgcaaatatttttcggcggccattacttgagcaatattgtcatgtgtcaacgtcgtcccgtatgggaaccgtgaagatacagagcatgacgccactttattccagttcgtcaaaccgagttcttgtgccaaggcccgaacgtcagtcttgaagaaatcagcttcttgtaacaagctccgggcccccgcttcactacgggccttcaaaccaggacgataatcattttcatcattcttgatcataccgtctaagacagcggcactaccgttattagccgcaatgtcattcaaccggctgtagaacatcttcttcgcatagtaccagctatcaggcgtgttgttcttgatgtggtcatcgctcaagtagtctagcgtggttccttgaacgttagcacctagttcttcggctaaactcatcgctttatcgaattcttcatccgtaaataattcagagttcgcaaccacagcggtcacattgtcacggcctaaaacatcgaaggccaacttcaaaactaaggtactgtcgatcccaccagaaaaggccacggtgacccgttgtaaatcctttaatgctgctactaacgttgctttttttgttgctaatgttgccataataaaacccttcttctatttaatttaattaattccaaaaaatccatgcataaaccaagcggcaattgctgccccgacaaagggcgcaattcctggcacaatgataccgtattgccaatcactatcggctttattggcaattggtaagatggcgtgggcaatccggggtcccatatctcgagctaagttcattgcgaacccggttggaccaccaagtcccatcccaatggcccatacaagtaggccaacgccaattggcacgattcccggcgttttaatctcagaaatcgctaaaatacccgaaataaaaataaatgtatcaaataattccacaaagaaattccgcggtaagttacgaacggctggtgccgtacagaataagttccgaattgtaatgggtgaaatctcatctgttgaggctttaaaatgatcagcatacatgatccaaacgatcactgagcccacgaccccaccaagcacttccgcaacggaatacggaataaataaagaccatgcgatatttcctaatagacactgcgccaaaaccattgccgggttaatgcaaacattgccaaaaatgaataaggcaacgctaatcccaaaaccccaagttgtaatggcaaaaatatgaccggaaccccgatacttggttccctttaatacggaactacaatgaacacccaccccaaaaataatcattagggctgtgcccataaattcagcaatcaactgatgtaccaaaaaattacgcctcctcatctaattgatctaccgccactaaggctgcctggtagaccgttctaaacggaatatgaaattgctgcgccagctgggcacaatccgcatattccggcatcttcttctcaatatcttgatatgtcgccactttaacttgaacgtcaccgtacggcgttgcgaccgtcaggaagtgccgttgcataacagtacgttgccacgtctggtaacgtacaccaatcgtcgtcgtttcttgtaaaatcaacttagtcagtaagtccttatcgttaacgtttcccaaaaccgttaactttgtcgccggccgatctttcttcatctgaatgggcgtgaaaaacacatcgtatgcgcccgccgttaataactggttcatcacgtaccccagtccttcacccgtctgatcatccagattagcttcaatcattaagacagcatcagccgtccggttaacgatttgctgacttagttttttttttcgaataatacggctcgcagtgcattgaaaccacccgtgtcccgtttaccaaacccataaccaactctagttggcacggcattttccggtaacggtccgaattcacgtacgagcgtcttgaccaagcccatcccagtgggggtaatcaattcagtatgcacatccaaccgttgttgaatcggaatggcactaccaactcgcatctgcatcacggctggtacgggaactggcatctgaccatgggcaacgttaataaaaccactaccatcacttaacggtgaagccatgatggtatcaatctgcatcaattccaacccaatacagcagcccacaatatcaacaatcgaatccaacgcgcccacttcatggaaatgaacttcagctagtggcatgtgatgaaccgctgcttccgcttgcgcaatttccataaagatcgctttcgcgtggtgtttcacggtatctgataagtcactgccgtcaattaacgcctcaatatcagctaaatgacgcgcttcatgatcatgatgatgcccagcttcatgctgatgatggtgatgttccacaaaaccatggtccttaccacccgcaacctgaacatcaaagctcgtgccatagatgctactctgggcttcccgttgctgcgttaattcataaccgtgcacgtgtaacttagccaattcggtttttaattgctcaaaatcaagtcctaaatcgagtaacgcgcccagaaacatatcaccgctaatccccgaaaaagcgtctaaataaagtgtttgcatttatcttctccttgttcagttaactgaatcttacatttgattgatcatactagctgagtaagcggcaccaaagccgttatcaatgttgacaacggtaatccccgacgcacagctattgagcatggtcaatagcgcggtcataccttgaaaactagtaccataaccaacgctggtcggcactgcaatcacgggcttatcaactagtccaccaacgacactggccagcgcaccttccatgcccgcaatcacaatgaccacccgggcaccacgaatcacatccaacttggcaaacagtcggtggattcccgcaacacccacgtcatagactcgttcaacacgattgccaaaagtttccgcggttactgctgcttcttcagcaaccggttgatcggaggtccccgccgtcaccacagcaatgtaccctggtgttttcggtgcgggttgttccccgaccgtcatacactgcgcagtggcatgatagacagccgttggtaacgctggttggagtgccgcgaatttttctgcggataaccgggtcgttaaaatcggcaacgtctgttgggacaaggcttgcacgatacccacaatttgggttgccgtcttaccagcaccgtagatgacctcaggaaagccattgcggcgttgacgatctaaatcgacattggcaaaacctaatgccgctgttttgcccgcttctaactgttgggcagccgccgtcggacttaattgccctgccgccacttgttgtaatatttctgctgtggttgccatactacttcacaataacgcctaaaccatcaggaataaccgtcactttagcggcttgaccctcgcgtgcgtaggccttttccatggcttcatctaacgtcttggctagttccatatgcatattcgtaatcaaatcaggatcaacgaggtctgacacaaaaatcacgtgatgatgaactaagattcgagcaaagatttgggccgtccattggtcaggaatagttttaagccgtggcgtgttgattgcttggtccaggaattccttaggatcatcaacgtcagctaagttgtgataaaacccttcaccaccgtgaccatcacgagcaccggcaaccataataatcgtgccgccttctttgtttgttgcttcagcagcggtcattcctttaacggcctgataaatattttgatcaagcggataaccaccattcgtcgaaatcgcaatgtcacaatcaatggctggtacactagaaagttctttgacaaagtcacagcccactttatgggcggcttccatgtcaccggcaaatgacccaatgatttttttatcttcgtctaaaacaacattgataataaaggcaagtttagcggtccgagcagcgtacaccatatccttatgaatcggattatgcattaaattaccggtccgggccttcggtgagttaataaattcgccggaatggttcgccataatcgtcttgtatgaagcaatcccaggtaaaacggacttccgaccacctgaaaaaccagcaaagaaatgtgattcgataaagccttcggagattagcaaatccgcttcagcagcgaccttattaataatgcaatcgccgccagatggtaattggccaatcttgaccatactactgtcatcggttgagacatgcatcacgatttcttcgttattgacgatgtcttcaccatacttattcaccaattcttcgtgggttgatggccgatggaaaccagtagctacgagaatccgaatccgtgcatcgggcgccactgaccgtaaccgccgcaataggatcggggtgataatatgtgaaggaactggccgcgtgtgatcggaactaataatcacaatattgtgcttcccacgagcaagttcctccagcttatcggagccgattggattatccagcgacttctcgaccgtttcctgttctgataatttgttatgatatgttgcagcttgcgacactaacttaccggcgtaattttcatcatcaatctgagccgtaattgtgcgcttgtcatatggtaaatcaattgcaaccatgacttttagccatcctctttctctaaaaactaatttttacatgcacgttttgttatactagaagacggataacttgtccgttacattttaagttttcaaaaatagttaacaaatgtatactttaaatgcgattgtcacaatcatgaaaaccgctatgcttaagtagcgttatcgtcgtgattactgttgagaatcgctatttttactgacctcaaccttaaaaattattcacgaaagaactgaaaaactaagatggtattaactgatattgaatatttactaagttatttggaagcccatcacgtgccgacaatcaaaaaaaagcggcatacttacctgacctatcatggtttagccgaacactatacgtacgtcttaaaggacggcatcatcaaaaacagcattattttacaagacggtcgcgaatataatttatcttatattgccaagcccgacgtgatctccctgctgcgtgatgaagtttctcgttctacggatcaaccgtttaacgtccgtattgagtccgaatatgccactttttaccaggtcaaccgggtcgctttttggaagtacgtcaacagcacgcctgaactgcaaaactacgttaaaaattattaccgtaaaaagttgtccgaaaacattcttcgactgcaacggatggtcatgaacggtaaaaaaggagccatttgtgcctttatctatagtcttgttgatttgttcggacgaaaagttaacgaagggattctgattgactttgtggtcaccaatgacgacatcgccggtttctgtggtattagctcccggagcagtgtcaaccggatgctcaaggaattacgaacagacggcgtcattacggtcaaaaatcacaaatttattattcaagatgttagttacctcttagatcaaattgcaaattagtgaggtgctcatccgtgcatattccggataattatttaagtcccgcaacttgcggaacgttggtcaccgcgatggctcccgtctggaccgtcgccgttttaaaagttaaagttcaaatcaaaaaacatcatgaaaccctgccaatgctcggcatcgccgcttcattggcttttttaattatgatgttcaacttgccgattccaggtgggaccacggctcacgctgtcgggggaaccctgttagctgtcttgattggcccatgggcggcgtgtcttgcgctgaccgtgacgctactactacaagccttattattcggtgatggcggtatcctagcctttggcgctaacgcgttgaatatggcggtcattatgccgtttgtcggctacgcctgctatcgcctaggtcaaaaatggcaccatgaaaagttggggctcgcaattggtgcttacttaggcattaatatggcggcgctagttgctggtatcgagctcgggttacaacccatactggctcatacggcaagtggtgcgccgctctactgcccatacggcctcaacattacgatacccgcaatgttgacggctcacttattagtcgccggctgggtcgaagtcgtcttcacactgcttgtctttcaatttgtaaaacgagtcgcaccgactaacctctatcagacacccactcggcgcaatcagcggccgtggatcgcactgctactcggattagcggtgttatcaccattaggcttgttggctagcaatacggcttggggcgaatggagcccccaagaattacagcaacggctagcgcaacaacatatcagtactcacgcgcctcaaggaatggtccacgggttccattttcaggccctgttcagtgattacgccatcgcgggcttaccggtcagtgtgggttatattttatcggccattaccgctgttttgattttcttacttttgattcgaggtcttcaacatgaaaccgacacgtcccaacactgatattccagcttggctgcaaactacgaccaccacgccaacacctgctattaaagcgaaattttggcaacgtaatcagcgtcacctacgccaattactcagtcgactagcacagccagcgccagtcacggcaacgtctcattggcgcgttgcaccgcaattcaaattaattcagctcctgttgctcgtcattttaattgctttaagtaataatctcattctgttatggggcctagcactattagttgggtgccaattattatggttacctccacgccaactgcgccgttttatgggaagctggctaatcagtgttgggatggccatgctgttcgtattaccgagctactggttagccggtcccaccacgctattattctttggccttaaaaccagtctaatgctggcaaacgctcaatattaccgtctaaccacgccgtttcaagatttattggctggcttgaaggcactccattgccctgatctattaattatgactttggccattgccatcacgtacttacgaatgctcggccaacatctattgctgacgatggaagcactagaattgcggacggtcgccccaacggctcatccataccgtttaatcggcgcattatttggtaatttatatcttaaaagttacacttatgcgctagaactatacgctgccatggaagcacgcgggttcaatggtcattacgcgcgctcaaccgggcgtcgtacccattggcgcgattatcttgccctgagcccagcgattattgtctggatattatttattttttggaggcattaacgtggtattgattaaattggtgaatatttgctatgattatcctgatacgtgtggcttgaaggacctcagcttaacggtcaactcaggcgactttgtctgtctaatggggcccaatggatctggtaaatcgacccttttacgactattgagtggattagctagtccaactagtggcacttatcagtttcacgatcagccgattacgaccacttatctcgctgatgcccaaaatcgacaacaacttcatcagcggatcggcatggtctttcaaaatactgatgttcaactattcaacacgtcggtcactgaggaagtcgctttcggtccccgacaactcggtttatcagcagccatggttgcgcaacgcgtcgccgactgcttacaattaacggactgtgctaacttagcagaccgggtcccttaccaactttcaggtggtgaaaagaagcgcgtggcactagccagcgttctcgccttgaaccctgaaattttattgttagatgaaccgctgaacggcttaacaattgccgctcagcagcaaatgctaaccctactgcaacggctacaagctgccggcaaaactatcatcatggcaagccataactaccagcaagtccaagccgttggtgaacgtttcattatttttaacagtacccaccaagtcgacgctgacctaacgcgcgctgatcttgatcagcaacccgctcggcaagcgcaattgatgactttataattaagaggagttgagaagagatgcttaatccaaatactgagatccatcgtggttggaaccggcgcgttgtgaccggtaaaactttagctgaatgtgatgaacgtttagtgaagtatttaaacgaccaagattatggttctggtgaattcgttgttttacacgaaaatgacggtagcaacgaaaacactggctatgatttacctgatggcgataactgctacattagtttcttgatttataacagccgactttaagttggtggtgacaaaaatgcttactggtggatgatcgccagtaagcattttttgttaaactcacaaactattctgattttaagcccaactcggctaacatgattcgtgcaaacgccactaagtttggacgtgaccatcgtataacctgttcgtcctgttgaccagcataggctgctaacgcctgcctgatcaacggatgccactgtgttggcagctgttgtaacccacattcacccccggcctgcttagaaataattaactgatcttgctggtaagcgcgaactcgacaaaggtttaataccgtatacattggtaactgaacgatcgccgtttcagcattcgcgatatcagacttgatactgtcccaataggccgtcgcaggaacggggccaaagaccgttgtaatagctggcccaagtaagacttgtcccgctgcttggagaatcgttaagtgggcagcaagatcaggatccgtgccgtgcatcgcttttaggtaggctagcggtgtccgttgataatcctcataatggtattttgaaaaatgaaaatcgaatgggcaaggatgcacaaaatgctgggttgcactcagtaacagcacatgaaactctaatcccttgtgtggcgctaatggccacaattgcgttatggtagctgtcattaactgccgtttttcagctaatgttaacgaacgccgaacaacgatcagatagtctaaatcgctcacctgttcgttatatgagcctaaaacataggatccatgcaggtaaataccaacaaggtttgtttttaaaattgcggtggtcgtttgttgaatggcttgtaataaccgtggtgttgatgtcatcatcaaaccactcccctctaagtcttgagcttagcgatagccacgaagatgcttaatcaaccacgcttcgtcgaaaagcttttcccaatcacgttcgatagaaatattgccagtttgtttgataaatgagcgatgctgataagtttctaataacatattttctcccgtgaagatgtgttacggttcgtgcgtatcatatcatacaacgcactaaagaaaataacggactgccaagtgccagttgtttcacgtgaaacatcctacttcaaataaacacgagtcagcgcttcgcacaatttttcattacactcttgagcgttatgaatggtctgcaaaacttgctgctcgtcaccttgtggctgtgttaacaccacccacacgtcaacgttcgcttgatgaacatcatcactcaaatgtgtcggcaaagccgttgaactttgcggtgtgggtagattaatttgttgtaacgttaaaccaagttgatcaattgccttaattagcgccgccactggtgcttgcattggttctgccaacgtctcacttaactgtcgaaagccaccgctatctcctagtgtccagttgccactaaagccaaccgcgtcaatagggtcatccgtccgacgataagtcacatatcgaactggcatcggtccctgagccaagagtccgggcatcgtttccaagttcgcattgatctcagctaaaggtaattttcggaaatcatggccgactagttcgtaacgaccaccaaccaattgataatcaactagtcccatcgccttaatcaggccagcttgcactttgaaaccatcgtaaccaacttttaacgcatcgaacacatcaatcgcttgcgcgtcggttcgaaaaccaaagtttggccccgccccttctggataaacgagattacattgatactgaaacgacatgccgattacacctaagtcttgattggcccgcttcgcttcatcactaaattcaccgaaataaccggctacaactctaaagctcatgtttagccctccttaatcttgtcaccgcaatattgaatccgtttacattattgatgtcattataatttttattcgcgcataatgaaagtaattaatgcttgcagccgttattaaaagccacgcaatcaatgccacgcgacactatattaatcctcggtttatttacgaacatcgttttctgtttgactaaatttatagttgaacaatatttttccagctcttgacaactgattttcaaaagcggtatactcacttcaacaaaatatcgtccttataaaccaatgaggtggagatcaagattatcgtgcccgcacagagagtcatcgttgctgagagtatggccgaacgcaggtaattaaatggaccaccgagggctttgccgaaattaacgtcagttgagagtacggaaagacgtgcgacatacgtcagttgtcagggaaatgttagtttcctatggagtaggagtgtacgcgtgatttaatcactaaattggcgaacactcaattaaggtggcaccgcggttatcaaaccgtccttaacacagcattggctggataaggacggtttttttgacgataaaaacggggtgaaataaatggtcacgaaacgatggcaaaactcatggatcaaactaaccaaatacaattatatttttggaggatttaattatgagtttatccggaacacacaaattaattttaacaatcggcagcgtggctattattggcggcatcgggtttaccgtcaacgcccactcgcacccagctacgactaaacaatcacaagttatcaatctatcagctggctcagaaattatgagcttagatcccgctaaaatgacggacagcgtttctaatagccaagtcacccaagttgacgaggggctctatcggctgaacagtcagagccaacccgtcaacgctttggctactaagacaactgtcaccaatggtggtcatacctataccattcaattacgccacgatgcgcgctggagtaacggtaacaaggtgaccgctcacgattttgtctattcatggagacgaactcttgatccaaaaaataaatctgaattcacctatgtcttcacaaacattaaaaataccgacgccattgcagccggcaagaaaaagccatcaacccttggtgtcaaagctaatggtgactatcaattaacaatcacgttaagcaaacccgtcgcctactttaaaaagattttagctgtttcgaccttttatccggtcaatcaaaatgctgttaacaaatacgggaagaagtacgggacttcagccgcgacgaccgtctacaacgggccatttacgcttactggctggaccgggactaataatacgtggaccttaaagaaaaatccagcttattacgatcacaaactggtgaaactgcaccaaatcaattatcaggttattaagtccaatacgactgcctataatttatatcaatctaataagttagatagtgtgacacttaatggcgagcagagtgtccagaataaaaataatcaagaactcaaaacacttgcgggtggtcaaatcagctttattcaatacaatcaccatgaccatgtagcagccaaccgtgaactccgcaccgctttatccttagcaatcaaccggtcgcaactgaccaacaaagttctagaaaatggttcgcttccagccaaaagctttggtgtacgcaatatggctaagaatcctaaaactggtaccgattttgtcaatgatgcgaccgttgatggtactgttaattatcatctcaaccaggctcgagccgcttatcataaagcacaacaacaattgggcaaaaaatcgctaacgttaacgattacttgtggtgatgatgacaactcacatcaggtcgctgaattcatccagggacaattgaccagtcacctccccggactaaaggtaacaatcaaggcaatgccatttaccgcaatgctaggtaaagtttccaagggaaccttccagcttaatttaactagctggagtatggattttgccgacccttcacaatcattaacaattttgactggcgacagcaactccaacatgggccactatcaaagcaaggcttacgaccaggcaatgcaagccgctgatggtccagatgctttgaacgcgaccaagcgctatcaagacttagttcaagccgctaaaacggcgctaactgatcaggccgtgaccccactctacgaaggccgttcccatctgctcgttaagtcgcacttaaagggcgtcatctataataatttcagcggtgccgccaattatcggaccgcatatgtgaagtaacacctcatagttgctcctaaaattacccgaccaaaaagcgtttcaagaccatagcttaacctaagccggccttgaaacgcttttagtataggaatccagtgttaattaaaagtcagtgtttgcttctcgccaccaacacccgcgtcaacaaaaagatcagttagttttaattcaaaaacaacgagtgtcgatccaatagcatcccagacttgttgataattcggaactgtttctaaatattggggtagcaagtcggtcatcgtcttagttgaccgttgtaacttaacgtgttgggctcgtagatatggattgcccgctgttccatcattaggaatcgtaatgaatgcaatatccggattctggtcataaaccttcaaagcgggacttgtcttaactgatgagaagtatagcgtatctggttgtgcttcgtaccagacaaagttaacaattttaacatctgcttcattattgacggccgtgctgagggcaatcttattagttgattgaaccacttgttttaatagtgaaatatccataccgacaaactccttttactcaattagtatcataatttcattataccgcaattgatagttttaggaacgtacgtttgtctaatgtgctatcatatttctatagcttagtttttgctttaaatgctatcaacattatttataaactgaacgcttcgaaagtagtgaccttatgaaaatcatcattgcacctgcgaaaaaaatgattatcgaccaagatgcctttccagccctaactgaaccaatctatcttgatcagacgcaacaattactggctcaactgcaacacctcacctatcctgaggccaagaccttatggcattgcagtgacaaactagcccaacctaattatgattggcttcaaaaaattgacctgacccgcaatctgactcccgctattctcagttacagcggtattcagtaccgttacatggccccggacgtctttacccagccagcccttgactatattcaggcaaacttacgaatcttgtcaggcttttacggcattctccgaccgtttgatggtatcgttccttatcggttagaaatgcaagcacggttggctgttggtcaagccaagaacctctatgcgttttggggcgaccgcctctatcaggcactgactccgcggccagaaccaattatcaatcttgcttctcaagaatatgctaagaccattgcaccttatctggctccgcatcaatcaatgattgatattgtctttgcaagctttatcgacggcaaactcaagactaaagccacattagctaagatggcacgtggggccatggtccgttttttggctgaacatcaaatcgatgatgtgacggccattcgcacatttgaccatcccgattatcaatttgacgagaagcgctcgacggctaatcgattcgtctttatctatcaacattaaacatcatcacagcaatcaccaaagcgcccgcagaaggctaacttccacaggcgcttttgtctactttaaaccttttaataaccattatagtgacagccaaacaaaatcagatcacaccgataaacttctcaatctagctattcagcaaattatttcccgggaaatgattacgctcatttctctaatcatgggctgctagccagtgacgcaatcgcgtcatataggccgtggtttcatcgataaacgccatgtgacggctacggggaaataacgtccaagtcgcatgaggtaactggtcgaccatggtcttagcgactaatggcgtacacaaatcatccgttccactggtgactaaagttggcatctgcaaatactgtaatcggtcggtatactcataatccgctaacgtaccagtcggattatattcattgggaccccacgctacattataagccgtggtccccacccgttttgatcgccgtagaaattcaggatcatcagcagtaatcgggcccgacgcatgttgcgtcataaaatgttgattagcagtcaggtaggcagcacctgtgaaatcctgtaaccgttctgctgtcgcaatagccgactgatccgctggggacattaaccgaatcatccgatgctgttcctgagcccacagtcgggctgaagacaaggtactggctaaaatcaaacttttaatcccctgtggtcgatagtcacaaccataaataatagctagcataccaccccaggactgccctagtaagtgaatctcgggtaagtctaaatacgtacgtaacgcctgtaactctgccacccacgttgcggcttgccataattgatcgtcatcaggtatcgatgaacgcccacagcctaattgatcatacatgacgattggtcgtcccgtttgaacggccaggtcatcaaatccttcaaagtaattatgcgttgatcctggaccaccatgtagcaaaactaacggtgtcttatttgattgccgatcccctacgattcgataatacgtctgataaccattaaatggcatgtatccttcttgcacgtccaaaatatcactcactttcgttactaattttttacttgttacgcgttatgcgttatgctagccgctatttagcattagccttgattaaaacgtgccaaacagatggattcctgttcgtcagcaatgcgtgtccgattccggcctccggggctgggtgacaattgctggaacgtaagccgacgtcgattagagcccgtgcacaaaccgcccggtctcaaatacgagtcttattctaagccggaagcaacccacttccgactaagaataatttggctactgagcattgtcacccagctcctccagtcggtaagccgctcgaatggctgatgaacagccactgaactcagtacaatttgtcgttggctattttaatactgaaccctttaagttaaatatcagagtgccttctccactttttcgaaatattcaattattactacggtaattcagaaatagtgagttatcacaagaccttttcaatctgacagttgattgataaaattaacgtttatgaaaaacaacgacaaattcagcaaaagttgggtatatccttgtcagccattcgaacgctatcccgactggaaggcgtttctgacaatgcccagtggtgaaatttcacttagcaagcgtcctgtgcttggttagtgaaaggccagtatttgagacgtggttttttcggctcagatctgtgcccaccacgttccggcaattggcagaaatgcctggaggtcggtgtaggacgcgcaccctaagcaagtttacgctaactcgaactgttcccagcgaacctaagctggctgcttttgaatttaaaaaatggcacgttttaatcataatcgatgacaaattaactcgcacaatgcgtacttattccatcccaatactaatgtccacctgaaaaagtgaaaaacttaattccattctaatacaactcaaatgacaatggtgatgtaagcgctacaatagaagtgcagaaataatcagaaacgggtgaataatgatggtattaagtattattacagtattaggaatgggattaattgcagccactggtgtgcactttatcaatggcgcacaagcgatgcacgcaggaacggtcggccatcatgttggtcagatgccagctaaccttcaccaaatcgacttacgttaatctcttaaaaattcacgttaatttttagtattgccgctgaaacactgggcaatgctttttttgtcgttcctttagctgaccgtccttatcagtttggtgccttgagcagcttgacagtcaagcgtatcattaacttatattatctttctgttcgtctagtcacgcttcgaccgaccgttcagagaaggagtgacttatttttatgaatgatttatttgagaaggccccgattcccaaagcgtatttccatttagcctttcctgtggttcttggcatggttgccagcatgatttataacttagcagatacattttttgttgctcaaactggtaatgctgatttagttgctggtattgccctcggcagtccgctattttcgtttatgttagcagttggtgatatttttggcctcggtgggagtgccgttatttcaagagtccttggccgtcatgattatcaccaaagtgcacgtatcagtagcttttgtttttacattgcgatcgcgcttagcttagtactgacagccttattattactattcgaacaaccaattttaggcttgctaggtgctactgcagctacccgtccctacattgcggacttctatcgtatattggtattaggatcaacctttatcatcgtttcactggttcccggtaacattatccgaacggagggtctggcacaactttccatgattgcgaccatcagtgggacggttctgaccattattctcgatcccttattcttatttggctttcactggggtgcttcgggcgttgcttttgccaacgttttggggtacgcggtcaacaccagtctgttagtcttttttatgcgccgagccaaaacgctctccttagcaccaaagttagcccatatctcgcgaccaacccttaaagccgtcgtcgcggttgggattccagcctcactgactaacctaacccagagttttggcatgatgatcttaaacagctacttagccgcatacggcgcccaagccgtggcggccatgggaattgttcaaaaagtttacatggtcgttatgatggtcatggtcggctttgcttttggggcccagcctttagttggttacacgtacggtgctaaaaattggcaaagactacgggcaacgttgcgcttcgatttaaaagtcgaaggtggctacgcaaccatttgtgcgattattctaatgatttttgcgcctcaacttattaaactatttatgaatcaaccagtcattgtcactatgggtacacaaatgttgcgagcaatgttgattacgacaccattagtgggcttcatcctcgtgttcacgaccgtctttcaatcagtcggtgcgggtttgagtgccctagccatggcgctttcgcggcaagcaatcttactaggtatcgccatcgttattctggcacagttctttggactaactggtattatttgggctcaagcggtcgctgatgtcttaacgtgcttacttggctggttactttatcggcacaccttcaaagatattcaagtaccatcctcaaattaataataacgatatcatgtcgttagctcactgataatcattaaatggcgccatccatttcaagtactggtgattcagtgcgctgaaatgcataagtgaactaaaagctggtacttttggaatgagaggcgtcattccaaaagtaccagcttttttcactctgattcatttttttattcgtctacagactgagtatgggctaaatcggcttctaatgacgcagtgagtgccttcaatagttttagagtcgccgtcatgttagcgcggtaataacgttcagtacctgttttgctaaccgctaaaatgccggcatccagcatcaacttcaaatggtgcgatacggccggccgtgataaggcgatttgcgctgtaatttggttaaccgtcatctgatcagtccggcacagcatcaccaaaattcgttgccgattttcgtcttgaagaattgtaaaaatcggaacacccttcttaaatattgccatcgttcgttctgccaaaaaatcacacctttccaattacggttcgtattcttaaaccatttaacgcttgctaaaattgaaagtcaagaattaatcgttgactttttgtaagtaagcgactagaatcaacagcatggtttgttcaagatgttaaacatttaaaccaatatgttaggagtccactatgaaagctgccattattactaaatacaagcaaataacccccatggtgacagaagtccctgttccgacaatagctcccaccgatgttctcgtcaaaatcgttgccgccagtgtcaacccaatcgatttgaaaaccaaagatggcgatctaagattgttactacaatacaccatgccactaattatgggcagtgactttgccggtgtaattactgccgttggcgaccaagtaccgggctttaaagttggtgatgctgtttacggtcgcgcacccaaagatcgaattggaacctttgctgaatttatcgccattgatcatcaagccatcgcactgaaaccagccaatctcaattttgaagaagccgctgcaattccattagtaggtttaaccagttaccaagcactacacgatataatgaacatccagccgggacagaaggttttcattcccggcggttcgggtggtattgggattattgccattcaactggccaaatatctcggcgcttacgtcgcaaccactaccagtgcgaaacattttgacctcgttcaatcactaggtgctgataaaatcattgactatcatcagcaagactttactgatgtattatcccattacgatgccgtattagatactcgtggcgggcaatccctcgaggccgcttttcagattatcaaaccaggcggtcagattgtcagcattgccggactgccaaacgcgcgttttggtaaggattacggactgccaatatggaaacaatggttattgggtctagcaacgcggaaactgagtcaactggaacaacaagcccaagctacctattcgtttctgttcatgcaacctagtggccagcaacttgtacgcctgcgacaactaattgaacaggacgttattaagccagttattgatcggattatccccctcaccgacatcaacgacgcgttagaatactcgcattccggtcatgctaccggtaaaatcattatcagtattcaacctaattagctaacttcaaatcaatctttttaaggagtcatgatcaatgaaaaaagttttaattgtcgaaaccaatatcactcgttaccaaggaactaatgagccgactggtctttggttaggtgaagccgctgagttcgtcgatgaaatgcagcaagcccaaattgccgttgactatgttagtcctaatggtggcttcgtgccccttgacccgcgtagtatgaaatataccgatgccgccacaatggccgtgtatgaagattctgacttcattaatcgggcccttaagaacacgctcaagcctagtcaggtcgatcccgatgattacactgctatttactataccgggggccacggtgtgatgtgggactttccggacaaccctgagttacaagccatcgcactggccatttatcaacatggtggatatgtgacctccgtttgtcacggaattgctggcctcctaaacatcaaagaccaaacgggccaatacttgattgctggcaaaaccattacgggctttaccgcaactgaagagctgattgccggcaaaaaacggatcgtcccgttccttaaccgtgaacgagctactgctcacggtgctatctttagtcagcatcgattttatcgcgaatatgcaattactgacggccaattgatcactggtcaaaatccgttctcagcacgcgcggtcgcacgccaattgattgctaaactataaaaaaacgagcacaaggctcgtttttttgcgttaatcttcaaaaatccgctcatgcaaaacaccaaacggcgcatgatcgacataaatctgaccagtgtcgtgaaatccattacgttgataaaaacgctgggccacagcattatttgccagaacaagtagataattctgtggatagaccgcctttaagcgacggtgggcctggattattaattgctgaccaatgccatgatgatgatagttcgggtgaacatatagcgaatacagttcgccccacccctcatagttcgcatgtctggccggaccaaatgtgcaaacacccacaacttcaccatcagccgtcattgccagcaacatattttgccaccgccgttccggccgccaagttgctggcgtcaattgctgtaaataacttacaggcatcaaatcacgatatgctgattgccaggtctcataatataactgtcgaatttttccaaaatcactgtctgcttcagcgcggacgatccgataggttagtgccatcagcctgaccacctttcaattcaagttgtccctaagtgaggcacattttatcatttatataaataaggtacccaccaactattcataaagagcatcaattagatgaatgtttcacgtgaaacaaaaaacacagtacaaaaatgaatccagtacaacatgttcattttgagtttggtattgacctgaactatggccgaactcgtcgcatatttaacacgtttggcagaattacggccgtaataataatgaccacgccaaccatttgcacccaatcaatagtttcatcaagcagtacaaatgcaacaacaatcgaggctggtaattctaaagaagaaaggattgggccaatgccaagctctaagtacggcataaacaatgaatacataaccagtgggaaaaccattgagaatagtgcaatcagtactccccagccgactgttgctggcgtggtgggtgccgtaactaattgcggtgaccacacgatagcaatgagtatgaaagcgcccaaacacagtaaccatgttttcgataacgggtctaagttattgcctaagctagccgtaaactgcatcgtgcaagcatacgagcatgccgctaaaaaacttaatatcaagccccacggcgagagcgcctgcgtaattggaaacagaccagcagctaaaatcgtgcctatcaataccaaaataatgctaaccacttgcagtcgggagggacgccgatgatgaatcactgctcctagtaatgttgataaccagaccgcctgcatcaacattaccgcggccacagcaactgggataagctttaacgcctgtatgtaaaaggtgttagtaaatcccgaagccgttccagccgaaattaccagtccgatttgcttccaattcgtttgctgattacgcaaacgtgcacggcgtaaaatttgaatcacacctaaaatcacaaccgcactcagaaaggaccagaatagcaatgggccattgacaaccccctgccgacgcgcaattttaaatagtgacgccggaattccaaaactaatggcccctaagccaacgaacaggggcgcaattttcttcacattaatcatcctctcgttgacaagatatgttggagccgggcacgataccaccagtctggcaagcccagtgagtagcgcatcagcatctcaccaataatttgcacaattgggcgtcccggttgtatttggcgttctaacaagctgtcataaaagtccgctggggcactgactaagtgcccgttaagattgacccgtaacggcgcattttctaccacgagcgcttgccattcataactatgagcacgctgttcgtcctcagaaacgtcttgtgccaactgtaagtaatgcgcaatatccgctggcaatacttccgataaatccgacaaagtctgtaaagctagacctggccgagttatcacttgacttagcggtaccatcacttgtctcaattgcgcgtctgtgtctgctaactgctgacacaaccagtcgaatcatcgggcatggtagaccaccatactcgtagcacgcccccctgctcaacttgagactttaatattaccaacgcttgcttgacaaccgtggcatcggtactgtgtgacatgatagcaagctgtgctggatcatcagttgtcaatcgagttaaatcaccgatttgtaacgacaatggcaaactcaatactggctggtgcaactcatgttgcaaggttaccgcgaacgtcgaattaaacgtcacatccatcatctgactttcctcaatttctattttgatggcgccttaaaatgtgctaattccgcatccgaataaacgtacgggacgtgcgccatctctggcacttgattccaagctaccggataacccgcaccatgtgcgcaaaagaccgagtccggtgtattttctaaatctgctgtggggacatattcggtcttatcgacaacagccatctcgttatgacacggccgatagccatccacgatacattccaattgcccctgcccatgcgtgtaagctcgaaccgtctgtgaatagtcctgcatcgctgctactggcgccgttcccgtaattgtcgtcaagtcagtcccgtccgtggctacgcttgtattagcgaccggtgcgtcaaactgaccattcatccgctgaatatcagtcatcgcccggccaacttgttcctgaccaatttctagacggaaccgataccacggctccaacaactgacaatcaccacgttgttttaacatcatcaagccttgacgcaacgcgcgccacgtcgcttcacgaaagtcaccaccaaccgaatgaacattgctagcccgaccactaaccagtgttaccttaacatccgttagtggtgcgccaatcaggacacccacttgtgttttggcttgtaggtttgacacgacttggtgttgccaatttcggccaagcacttccaatgaacaatcggtcgtaaattgaagcccacttccccgcggtgcgggcgtcagcaacaaatgtacttccgcgtagtgtcgtaacggttcaaaatgcccaacaccttcaacagcttgggtaatcgtctcttgatacaagatactccccgttccaaactttacagtcagttgaaaacgatcctgcaagatttgttgcaaaacttccagttgaatcgttcccatgacctgtactcgcaattcctgaagtggttctgaccaagtcacgtgtaattgtggatcctcatcttcaagttgacgcaaggctgctaagcaggtgtgtaactcctcacgctgaggatcaagtgcgtaagtcagtacgggctgcatgacgggttgtagactagttgctgcctgtcccaatccttgccccggccgcgttcccgttagaccggtaatggcaccaacggatcctgccgtcagcgcggacgtggtcgcatacttagtcccgttgtaaacccgtaactgattgactttttggtcatcatacacgatatctttaggtcgtaaggtgccaccggtcatccgaatccaagtaagccgttcaccttgatcatcgtgcgtaatcttgaacacccgcgcgccaaattcaggacgcgttaattgtggcgtcgtccaataatcaagaccagccattagcgcatcaaccccgtccagcttaagtgccgcgccaaaataacacggaaaaacttcccgccgttgaatcatctgccgaatcgtggcatcacttaacgtccctgtttctaagtaatccgttaacacttcgtcattttgcatcgcaatatcttcaactgccgcagtcggtatgactggccgatcttccaacgtgtccccggctcccggcgtgttaaacgccacacaaccaggcgataatgtctgttgaatttgttgtatcaattggtcgctatccgtccccggcgcatccatcttatttacaaacagaatggtaggaacgtcataacgggctaataatcgccataacgtccgcgtgtacccctgcacaccatcagtcgctgaaacgactaaaattgcgacgtccaaaaccgacagtacttgttcagtctgggtcgcaaaatcgacgtggcccggggtatccaagagtgttaaattaatgtctttatattgtaaattagcttggtgtgaaaaaatcgtaataccacgctgtttttcaagcacatccgtatctaaaaaagcatcgccattatcgacgcgccctaattgccgtagcgcgccagaccggtatagtaatgcttctgacagcgtcgttttaccggcatcgacgtgggcaataattcccgctacaatccgtttcatattgggctcccttcacgattagtgaatcactgcttccagtataccggttctcagcactgaacggctagtaaaggtctgccactaacgttaaatatgcatgaattttggcgtgttttagtccaatgttaatcaccaaaatcaggctagttactttccatagttgcgatcactttaaagtagtggtgacccatttcccgtgcagtatcgcaaaaaaggtatccgtagcctacaactaccgataccttaaaatcattttcagacttaatcataaaaacgctcaaaagctgccttcaggtccattttggcttgctttaatgcctgtgataccgccaccccgttcgtttgcagtccttgtgcacggacaatctcaaaccggtcaaaccccataatttcagtaaacatcttgtcaagatacagccgagaaaattccatgggtgtataacggtcattacgagtatagattgacccactggcctgcagtaacatgacacgataattatcggtcatcaaacccactgatccattttcggtataacgaaaagtctccctggcaactaagatattatcgatatagtcctttaaccgtgccggcacgttgaaattatgcaacggcatcgcaatcacaatccgatgatgagctttaaactgttgtaggagttgctgattgattgcaaacaggcgttgttcctcaatcgataaatttacatgttgcgcttgcttttcccagattcccagcaattcaggtaccgttgcttggggaatcaccgtatcatacaaattgatcacatccacagtatcattaggaaagcgagtctgaaaaagttgcaaaaaagcttgttctagttgaactgagtagtgcgccgcattacgaaaatcgggatgtgcattaacaatcaaagtcttagtcatttaaatatctccttaattaataatctatttattggttgtttttgacaacagttatatactacagtcgaaaggtgccaatccatgtcaccattaaaatcatttttaggagttatttatatgaaccgctctgaacgtcttaatcaagaattgatctttctcagttaccgacaagaattccacatcaaagaactcatgcaagaattcaatatctccaaacggaccgccttgcgcgacgttaactcgttagaacaacttggtttgtccatttacgttgaaccgggacgttacggtggctaccaaatcatgcaacaacaactatgggtacccatcttattaaacagccaggaaattaatgcgctcttttttgcgctcaaagcactcagtttattgtcggcgaccccctttgaaaagtcctaccatacaatttacaaaaaactcatggcaacactatctttaagcaaccagcgccaggtcgccaaattgcaacgtgtggttaactactactcaattcctaacttggatgccccaacccatttaagtgatttattaacggctatccttgatgaaaatgttgtccagttaacgatgactactgtgacagctgggtttcagatttttgatttattatatcggcatggcatttggtttttcagtggcgtcaatctcgataacaatgcttggggcatctatcgctgtgatacgatcaaagcatttcaaaccagtgagcaaccagctcggtatacttggaaacagctcgcgcaacggcaacggtcctacgatcaccatcatcacaatatacgttataaatgtgcactaacacctctaggccgtgaacatgtacaaaagaataattatcctaatatgcacttaacacatcagaacgaccaagattatctcattggtggttataatcaagatgaattagcctatatggtcgactatttactgggacttggccgcaacgttagaattatttatccggaagcgttaaaaactgcctatctgcaagaactgcagcaaattcaagatttctattaacgtttggttttctgaacaaaatgtcggtagccccgtcaagggctaccgacatttttactaacctgattattctcttcttaactgctttattcagccgtaatataattcaaaattgcattcagaacttgttgattctctcgtggtaccggcgtttgtaaaatttctgctgctgtttggtttaggaccgaccccgcaacataccgataatcattaacgaccatctcacgaacattgtccgcagccagctcaaagtgaaattgtaaccccactacccgatgcttccatacgaagccctgattggtcacacgatcactagagaacaacagcgttgcttctgctggaacagtgaacatctcctcgtgccaatgcaagaccgacagttttgctggaatccccggaatcacgggactctgtcggtaaatcggtgcccaacctacttccttagctggcgccttagtgactgggtatcctaaggtcttcgcaatttgttgcgcgccgtaacacgcaccaaacattgggatatcgcggtccaataattgttgaatcaagtctcgttcctgcttgatccatggcagcgtatcgttgggactcatcggtccgccgaggataacaagcatctccgtctcatccgccgttgggagaacaccgaattgatacgggtgatagacatacatggtatgaccatgggcatgcgcccaatcagcaatcattccagggccctcattgggggtatgttgcaacacattaattcgcatgattagtcctttccacaacggcaatgtttggtctgggtatcgcctgcaattacccaagatagagtcattataccacgctaattacttgagccatgggcgcttatgttaaacttaaaaccgatcataatttagaggtgataataatggacgtccaatcttttttcgaacaagctaaaacgacgctcaaattgacacaaagtaccccattacaaagtgcttatcagtttggcagcgatcctgataaacttgcacagctcgtactaactggcacaaaagcggctaccaccagcgcttatgacctatacgaaactgatgaaccactgccaaaagtgggcgcttatgacgtcatcttagatgctcataatcagcctgtctgtgtgacccggaccgatcaagtcatgattacgccttacttggacatcgatgcaacccacgcttacttagaaggtgaaggcgatcgtacttatgcctattggcgccgtgttcatgatgccttcttcaagcaggagtaccaaagcgagcatcagcgctttgatccccatactgcacaaatggttctggaacgcttccacgtcgtttatcccgttcactaaaaatagcgttccaatcggcactggtgaattcgcttccattagtggtatattggaatagaactttcattagggggaacgacacatgcatactatcgaacaactcaatgacgggcgcgcggtctatctaaatggtcaccgcgtcaatgtcgccgatgtgcccatttttcgtaaaactttagcactcaataatcagtactatgacctgcaacacaaccatcccgaagtacatacttatcaggaaaatggtcaccgctacgatattgctttcaaagtgccacgcaccgtcgctgatttacaacaaaagcaccgtgcttatcaagaaattgcgcaaagtaacagcggcatgttaggccgcacaccggattttcttaatactgggatggccgtcttagcagaacgcgctgccttcctcgggcaaaatcaatatactgattttgcagctaatgcccgcaattacgctaaggaggtcaaagctaacgatatcttcattagccatgcgcttcaaaacccacaactcaaccgtcaaaaagccatcaatgccattccgtctggatacgcgggtgttcataccattgaacgtaatcaagatggaatcttcgtttctggtgccaaaatggtcaatacgatggccccaattgctgatgacctcctgatttttaatccgccggaactgttgttagaaaacggcgatagtagttatgctgtcgcctttgctacgccactcaataatccgggcgtcaagatcatttgtcgcaaattattagatcatcccaccgcttccattacggattacccactcagcaacgcccttgatgagattgacgcctacattgtctttgatcacgcctttattccgtggtcaaaagtatttgttgaaaataatgttgaaatgagtaatcgtttcttcatcgattcaggcatgtttagccacacttcccatcaagatgaggttcgaggtattactaagcttgagttagcaaccagtttagcgcttcggattgctcatatcttaggattagatggtttcttaggtgtccaagaaaaactcggtcggttaaccgctaatctggaactcatcaagggtaccatcacccgttcagaagacaacggtcatctggacgaattcggtatctatacgcccagtctccaagctttgcaagcggttcgctcgacccttcccgaatactatgacgaggccttgcgcgtgactcaacacttagcggccggttccatagttggcgtgccaagttttgcggaatttgacggcgataatgcgacaatcctcaaccaggcactcacgacggaccgagccaccgctaaaacccgcacgcgcttgttgaacttagccttcgatttaacaagttctggctttggtcagcgccaattgatgtacgaatactatcatggtggtgatccaatgcgtattcgtgcccaacattatcaacgcgccgatttacaggctggcaatcagatgattgaccgactattgtcagcggacaacgcaaacacccatgaataagtaatcacaccaatacccaggttagtccttaagtgagtattggtgtgattttttgcgcctttatattattgactatttagtcaaatataattcgcgtaactgttgacattccgctgaggtcagccctagacccgtctgcaagtaatttgaaaatgtgtcgtaccgggctttgataacttcaaagtaatggctcaggtaatcagcgtctactaataatgcctggttcacggcccgttgttgctcatcagataattgcgacgccatcgtcgccaagatttgttgattagcagctgcacgtgcttgatttgtgagcagatagtcagccatgatttgctcgtcactaatacccaaaatttttagaaataaggcggccccgacgccggtgcgatccttaccggcaaaacaatggaacagtagtggctgatctggaaccagtagtagctgtataaattgacaataactttgacgggcagtaggatctaacgctagctgttcatataactgaaccatgcggtcatggaccgcccccgtactactaatcatcgattgtaaacttgcgtcgttcgtcatgacttgtgctagcacatccagcacgtgatactggacgtgtggccatgtcgcatctggaaattgatgacgctcatcagcactacgcatgtccacgattcgcgtaatgccaagcgtggttgctagatactgcgtctgtgccggtgttaattgatccaattgtcctgaccggtaaattaaaccatctttgattacttgctgatttttattgcgataaccacctagtgaccgtaaattagtaatcccttccatgaccaagccccctgctagattgataacttaattgtaaactgtcaccgttaaattttcagtcaaaggccatttaaaaagtcatttagtcaccagacctaactgagctggtgactaaatgactttttaaccgctaacttgatagactcaattaatcaaagtgtcgccattcgtgatccaacaacgcacgcgctacaaatagcccgagcggtaaaaacatgatgattaacacggccttcgtcagccatagtgaaccgacaccaatttgattattgccaatactataaattgcacgataaatatataatcccggaaccataattacgattgaaggtaccgtcaatgaaatccggggatagccgttataacgattaaccaccgatgcgatcaagccggcaacgagcgccccacaaaaggcggccgcggccggtggcattgctgtcaagtcaactagttcaaggcgcaatgtattcgcaatggccccaataaatcccgcggtaatggccatcttttgcgaactattaaacattattgagaacccgtaaacgccgcaaaaactagctggtaatcgtaataaaagtaccgctaacggtgaaagtcctagcggtaagaaatcagctggcttgaagctcaccagtgtcgcgactagccatccgacgagagttgcaatcagggtaaccataatcgcgtaagctaagcgctccagtcctgagcgcatatccaacttagagatatccaacatactcgtaatgaacggaaaacccggaatcacgaataacatggcaccaatataccccgcctcatgctgggcaagaatttggaaattatattcaaaaatcttaaaactaaccatataagccaaacacgccaccgcaacgctgaccgcaatcccggcaaccgtcgtcatcgaccgtttacccatcagcgcccgaacatagttaccaagacccgcgcccaaaaaggaacaaatcatctcgggaatacccccaccaagtaagaagataaatccactacaggctaagccagctgccaacccaagaaccagtggcgaatactgtttaggacgcgtctgaacttcatcaattgctgcatgcacttgtgccaccgttaaccgtgcatatttcgcatcaaagtctttgacaaactgttcaagaatatttagtttatccgtatttacaccagtatttggtatcgataatacttgcgtataactacgttcatgatgaaaacacgtgtactgaatcgaaatcaacccgatatctgccgagcacgttaaattcaggctgcgagcaatcttattcatcgcatcacgaacccgccacgctcccgtcccacacgacaacattaaaatgccaactcgaccaacaattgatgttcgctcttgtaagctagcatgcttagcgggaacatcttcattacggataaagtccttccatggaattgtcatatgatgtcgttgtgatagtggcatcaccgacttacgctctttattcatttcttcctccgtcttagatcgttcattatgttagtagctttcccccttattttaggctactaacatcatttatgatagcgattttgtcattttaaaagcataatgtttcacgtgaaacattagcctcatgatgagtttccccagcttgttaattgaactaccccctcaaaagtaaacttgattaccattcgttaatttaagcgtcacaattttcgccgctatccgcaatcatatgataagttaccgatatcatctaataaaggagcgatttgtatgtgcactagtctaacttatacaaatagtcatggaggccacttcttagctcgtacaatggattttaacgttgactttgagacccgtattatgttcatgcctcgacattaccgcgtgacgggtgaccttggtgatttcaccacgacttatggctttattggcgcgggtcgccaactgaaccatgaaattttcacggacggcgttaacgaatgtggtgtcagcatcgcagcactctactttccgaatcatgcaatttaccagcctcacagtaaccaagacaaaatcgatctcgcaccccacgatttcgtcgcctgggtactcggaaaaatcactagtgttgctgacttacgtgagcgcgtcaaagacgttcaattgattagtagcacggcagaattaattaacgaaattccaccacttcactttatcattagtgaccaaaccggtgaaaccgccgtcttggaaccaactagtggcgagcttcgcctgattaataacccagtcggcgtcctgaccaattcaccgaacctcaaatggcagctacaaaacttaagtaagtatggcaccctgactaacaccgagcggccactaaataaattcattaactaccaacctggttcacagggacctggtacgggcgcattaggtctacctggtgactatacttcgatgtctcgctttgcacggaccgtcttcttgaaacactatgcgcaagtgccagcgacaacaacagatacagtcaacttacttcaacacatcttgaatgctgtgactattcccaagggcgccaaagtagccgccaacggccaagcaacctatactgagtaccgtagctacatggacttgaatcatcaaacgtacgcactagaactgtacgaaaatccgggagtgattcagcaagttaacttaactgatcatttattagaaaaacagaccgttccgttagaatacgcccttagtcgcaccccgcacgtccaattactacctcccgatattgccaccttgccagtggcccattaagactttcagaaaagcagtaactcaaaaaagcttgcatcacaaatctagttgattttgtgacgtaagcttttcgtattatttaaacttaggctaacgcggcttttagattagctaaggttaattcgctcgttgaagtgaagttaacatccgcacccgtcaaaatggcaggatcaccaatcccaatcgacgtttcaccagcaccattaattgactgaataccgaccttagcatcttcaacgcccgcacattcttcaggcttcaagccaagcacttccgcgccacgttcgaagatctctggatctggcttaccgtgtttcaaggttgcgggatccacccgggcttcaaagtaatgcgccaagcctaactgttccagaaccaatggtgaattcttagaagctgaggccaaagataaacgatacccatgcttggcgagatcggctaagaagtcttcgataccaggtaaaattgcagttttatccattcccttcaacaggttcagataattagtatttttcttggctgcgtaagccactttttcagcttccgtatagtcgttttccttaccacccgtttttaagatcaagttcaacgagtccattcgactaacaccctttaaattatcggcaagttcttcactccaggcaacgcccaactcgtcagctaattgatgccaagcttgtgagtgataaacggacgtatccgcaatcacgccatctaaatcaaatacaaaccctttaatatctgcaaatttactcattaatggttcctcctcgttaattaccagcacaattgattgctgggtaccggacaactgcgcaatcatcaatagatgcgccaagagtgacggttacccgtcttgttttgaagcacaccgttaatgttcacttaacattataaaacgctttcagtttcaatgcaaccggttgcatagcgattttaatgacgattgttgccaatcacacgcctgcccgccgatcaaatcgcaatggcggccccattactgccgtccatcctgaatttacggatttactaataatgactgttccaaccatttttccacaaacggttgcacgcttttatgccccgcttaatcttgggtcggaattggaatatccggtcgatactggtactgatgctgggttaaaaattgccgtaatttaaaactagcagccaatttaaagcacgtttccgcatcccgtaaatcgcatccggtcagtgttgtgatatggtgcagtcgattacgcagtgtatttggatgaacgtataattgcttagccgtgcgggtcaaattacaagtcgcccgtaagtagacatctaatgttggtaccagttctgtatggttttgctgatcataggctaacaacaaacgtagggctggattaataaagaacggtaagatctcaagatgattaactcgtgccaacgcaagattatagaattggtcttcacaaaaaatcacccgaccacggccagtcttcagttgcgccgttcgttcacaaactgtatacgcggcaaaggtatcttccggattaacgtagtgctgagacacgatcaagcggcaatccgcttgcttcgtaatttgctgcaacgttagtttaaattgattctgattatatgcgaccagactaattgggatcagtgccacacattgttgctgataagtcgaaaccaacacttgtttgaatcgtggcatcatcaagtactgtagtcgctgctgtaaaatcatcggtgcttgatcagctagtggttcgcagcggattaacaccatggctgtcggtaattgcacgtgttgttcagcaaactgatcagcaaacgttcccccttgatgttccgtcaataataagtttaataaccggtcccgttgcgattcagctgttggcataatctgatttttaactaacgagccagcgataacctgaccaatcgaattgatcagtagtgcttgtcgatcattcagtggtttattgagtgctggcatcaccaaataaccgatcggctcggtgccatttgctaacggcgtaattagcatgggccccgccgacaactgatcttccgccacatagacttgcgttaaaaaatccggcgtatccggtgcaaatccgtggtctaacagccagcgtccgactcgattcgtctcaactgcagcgtgaatactagtcccattgagttgcgtcgtatgcgaccgtgtcagaatctccccgttcagatcaataatcgccagcggattctctaataagtgtactgcttgggccagtgtggtatcaaaatccgccgtgattgcttggatagcgagctgattgatggctgcttgaatttgaacatcgtggtgtaagcactgaccaagcgtcattaataatttcaataactgattttgtgccgcaatgatcgtagtcagaccggttcccagatttactagtccgaccgactgacgatggccgtgccaactataagcaagttgaactagctgacccgagtcgggggacaaatataaccggtggcttgctaacacttccgtcggatcaacaaattggacgtgagtaacttcgggattatgtgtaaatgttggatcgacagtcacctcaaacgttgtggctaactgccgcaataacggctttaattgcatactcaagtaacctccttattcacgcttgtcgccttcatcataaataatgtaagcgcttttgtaaagaggcctactgacaacccaccaccccactcgaaaggccctcagctttcttaggcccgtattcggacaaaaaagagcgggaatcccgctcttttcataaacctattaggctaagaaatcagtctgtgttttggcatcgtaccgagtcgtatggagcggttcttgcgctgctttcccgattgcgatccccattactggcacgtatcgtttaggatcaagacccagcgtcggaatcatcttttcaaagtcaattccggagaacgcattggcatcatacccatgagcccgtgccactagcagcaactgcatcccgacaacggaacaatcaatcgtcgcatcgaatttcaagaaatctggtgtggcattttcatataatggtaagaaggttcccagaatctgatccaagcgttccttcgtaatattcccatcctcataaactttgttccagacatcgcgataaacataatgcgactgggtgtcaccggcaataaagacgatggccgatgcactgtcgacctgtgggtagttgaatttcatcacggcttgtttgaacttagcctttgcctcgggggtatccacgacgacaaagtgccatgactgtaaattacatgccgatggcgcggtggctgcttccgcaatcatcttttgtaactcatcacgtccaattttaacgttcgggtcaaactgccgaactgaatggcggttaaacatcacgtctgctaaatcattgttcaccaaattttttactgcttctgacatcagctattcctcgctttcgtaatcggcctaaataatgtaagtcgctgccttgggattgaagaaactccggtcataccgacccgttaagagctttggcattgttgtcgcagcatcaacttcgtccaacttcagtgtgttaaacataactgacgtgtcgaagtgaaaccaagcggcaccgagtggcttcaagaccttcaattcgccaaatggatcatcatcggttgactccaactgaatacttaggttcccaggttcaacttgatcagctaaggaccgtaattgagtcgcaactaattggacattactgaaatggttcgtcccatcttcatgttgatcaatgtcatatttatagaagaaactattcatttcggcttccttacctaacgcgagctgccccgcaaattgtttcataattgacggatcattcagttcaccggccgtccacgaaacgttcagtaatgtcttgccatggcgttcgaccgtggctgtcgcactgttgtcattccggcgcaattcgatgtcatccgctaatttcttaggaatcccagcaccttcccgacctgcaatcacaccactctccgccccgggaccgtggagtaagaggttaatcgggtaagcgcccatcattttatccttgtagctaactaacgcaaataggctttcttcaaggtatggggcactaaaagtcggttttcccatatgaacgacataaccgcaaaccaccggtgccattaattttaatggtgctggaattaaagccttaagcaccgcttcgtcagtggcataagcaaacccaataccttcctggtcattcatgcttggtgctgtcaaaaagttcttaacatcctgatcacttgcaataaaacttgccatggtaaaacactcctttgtttgcgtgattagcttacatgataccgtccatgatgtgcacgtctggtgcgccatccgtcacgatccgtttaactcggtcttcaatcagtggattatattctggatgggtcaaaatgtagaaacggttatcctctaaggctttaaagacggtatcggcaatcgtatcaattggtttcccgttggtaatgacatacttcgcaaattgttgtccctttaagtacgcttcactttgataatacgggtccgttgggtcgctgtattgcgctggccggtgattttcagtgtgatagagatccgtctgaacaaagccagggcacatcacgtgcatgtcgatatcaatattagcccgttgtaagtcataggcggtcgcttcagtcatcccaacagaagcgaacttgctagcatgataagaaggcattccgggcgtatcaactaagccggcaatcgaagccacgttaagaatatccgcatgggtcttctgttgaatcataattgggataacgcgcttcatcgcataaacttgactcattaagttgatatgcatgatccattcccaatcacgagtcggcaattcccaaattcggccaggtagcgcgatcccggcattattaatcagtaggtcgatccgcccaaacttttccatggcctgctcaaccgcatcgtcgacactagcttcctttgtaacgtcagcggtaaccatcaacacctcggcacccttgtcgagaatatgttggtacgttttcttcaaagctggttcgtcgatatcaacaatcgtgagcttcataccccgatccgcggcgccttcagcaataacttgaccaaatccgtgggccgcacccgtgataaacataactttatctttaaaatctttcatgatgttttgcgtcctcctcgatgaaattgtgattttattaacttatcagtaaatattaacctgatgaccggtcatttatcttgactacgctttcatattaacccactaaatttgtttgagtaatggataaaagtactagtcttacgacgattaaactgtagcttttatacatgtgtgttggttcacaattataactaactaaagtgtggttccaactttaattagctcataaaaacgcatgccagcccttcttagcttacatgcgcatcattataattggatttattttcttaatactgcaaccgttcattgtgcacggctacgttgccgaaacattcaaggtccgtgccagatcaatcactcgtgctttgatctgatctcggacctgtcgaaatactagcaattggtcactaacactgccagtcgtgcgagccggatcaggcaatggccagtgtagcctggtcaccgttgccggagtgacggggcagcgatcccgtgcatcaccacacaacgtcaccacgactgcacactgattaagataggtcaggtcgattaatttagaaacctggtcactgatatcaatacccacctcgctcattacttgaacagctagtgggttcaggccatgtgtctccaccccagcactagcaacttgccagtttggtcccaataattgctgtgcaaagccttctgccatctgactgcgacaggcattgcccgtacataaaaaatatatttttggcatttcgccgtcctcctaaattactgacgataacgacactaatcgcgtatcatcaccaatattatgcccgcaagaatcccgcttgctccgctaataaccattaagatacaacatcgtcatgcgcgtaaccgcgatagattgctgtgactattccagcaatcgaataagctagccttaaccctcaagaatgcgctcactatatttttgtaatcgatttcaaaacgatttatactagaattgatattacaatattattctaaacttataaccagtccccctgagcagttactcatcgcgagaacggtcttatttcaactaatttatcggaggtcttttccatgacagtagcaattcgttatcaaactcgcaatggcaatacacaagcatttgccgaacaaatcgctagcgtggcaggtgttccagcacaatccatcgatacacctgtcgaacaagctgacacactcttttttggcggcggtacttattttatgaaacccgacaaaaccgcatctgcttttatgaagaaccttgatccgactaagatcaaacaaatcgtcctattcacaacttctggcggaccagaaatggtttcagacaaagccctgacaaagattgccaccgaaaagggcattcccgtcatcggccacttccaccaagtcatgggtggcaaaggaatgaaaatcatcggcagtactggcggcaagctcaaagatgagcagattgaactcgttaaggaattcgctcaaaaaatgttagctcaataatgatttgacggcgctcgcgttgactgaaaaagtcaatgcgagcgctatttttggattagtgctgaagacctaattagcccgtctaatttgacgtaggacgtcaatgcaccgctgctgattagcgttaggcaaaaaggacttccgcaccgccagttgcatgtaacagtgtaattgctcttgggcagctagtggaatccctacaacctgatcacttagcactacggaatccgcaatgaccaccccaacaccaacgttttgagcaactagaccttcgactaacgcgttggtagctgcctcgtagacgattttaggctgtatgtggccgcgctgacaatattgttctaatgctaaccgtggtaatgcgtgtttaggacgagcgatgataggcactccttgtaagtcagttgctcgaatcgtttttaagtgacttaatggactattgacattggctaagacctgcatctgatgttcctctaagatgctcacccgtaaatccgtggcacgttctgggaccaaagttgaaaaaaccgctgcgtctaacttgccttgccgcaagtcaactaacaattgttctgaatcagcaacggtcgttgtgacctggtctaataaatcaactgagataaatttttttatcacccggggaagccaaataccacccgcaacattggaaaatccgagccgaacttgctgctcattagcgtgatgaacttccagtgccatctgcgcaacgtcttttaagagttgcttagacttaatatacaaggtccgccccgctgccgtcgttactagttgggcccgatggttggcctgcgttagtaatactgcttggtattcttcttccaatcgtcgtaaagctgcagaaatagccggttgtgtgacgtgaaacttggtcgccgtggccgtgtaatttcccgtctcaactaatgaacagaagtactttaaatcgcgttcattcacgtcaacgcccccattcaatctatttaatacctaattttaacacgaaagatgcggcaaatcgtggtcaggatcaatcacgacttaccgcatctatattgctcagttagtcttaccaaaagcctaataacttggtccacagcaagcccccacctaaccagatgacgttaaaaataaccccaataattgcactcaatcgccaccactccgcactagtcacatagcctgtacttgacaataatgccgcgggcccggccgagtacggcgtcgttgacaagttgattgaaccagcaaatgccaatagtaacgccgctaaaacatggggaacaccggcaccaatggcgatggataaaaagccagcatataacgccgaaatctgtgttgaaacactcggaaacatgtaatgtaagtaaaaataagctaaaaacaggataatgagcacgctaatccagttcataccattcagtaaatgacctaacgttttggaaaaccatgggaaaaagcctagtgtcattagcttcttagacatcatcatcatgatcgataaccagactaaaatattccaagcaaaatgttcattgagcaaatcgttagtcgttaacacgcccgtaatcagcaaaataacaactgcgataaaacttacttcggtcgcatcgatgccaattttagtcccgatcaaccataaaacaatcgctaaaataaaggtaattgacataattttttcactagctgtcatttttccaagtgcggccaaacgcgtcgttgcccagcggtgcgcgtctggcgtttgtttcacctcagggggatagactttatatagtacccatggaataattagtagcgataaaatacctgggacacaagcagccataaaccattgcatccaagttaccgtgattccctgcatcttagctaaaccaatagccaccatgttgccagctaaaccggtcaaaaacaagcctgatgtaatattattaacttcatattcattaaaaactagaaatgagcctaattttcgctgtgtgccctgtttcggatcagatcccatttcacgagaaagattatcaataatgggatacataatcccgttgacccgcgcattattgctaggaataccaatcgccaatacggcatcaacaaaggataaggcgtatgctaagctcagcgtgcgcttgccaaataaactgacaaacagataggcgatccgcttgccaagtcctgatttaataaaaccagcagccatgaacatgcacatggcaaccatccacgccgtcgaattaccaaaaccagtagcgacttcgtccatcgtaaaaacacccgttaacgtcgcgacaacaatcccaatcagcgtgacggccatcatcggtaatggcttggtaatacaagcaataatcgttgccacaagaattgcaaataagtgccacgccataatactaattgctactggtcgtagtggcgtaactagccataacccaattcccaaaattagcggtaacagaaagcccttccattttatttcactcaacatctgcacttcctcctaatcttcatataattgttaagattttcacatatcttgccattaacggttgtttgccgtttttcaatatcaccataacttaatttataagtctgtcaatttaaatttagttgtagttgcttgaggtgtcgcaataaaacccgttatatacagcctacagggacctgtttgcgattaaaaatacctgaaattatcatagcgactagtgccttttatcggacacttttataaatagaatttataaaaagctaaaataaagtttgccacttgcttaattctcactaaagtttcgacaacccgtcaaattaatcacagcttgttatccttgtcacaatagcattctgttggcttcgttaaaattaacggttgttttttctaggtaactatttatattgaaagcgtaaacaattcgtatacttatccaactaaaaactaataaaggaatgttaattatgaaatatattgccttgattggtacggcggcacaacagtcttacaaccgtgaattattacaatttatgaagcatcattttagtcaacgggctaccattgacgttaatgaaattacagggattcccctttttaatgaaccaactcaaaatcatatcccggcgaccgttcaagccttaaatgataaaattagccaggccgatggggtgatcatcggggtacccgaatacgatcatgccattccggccgcactcaagaacgttattgaatggctttcttaccagctccacccctttgctaataaaccggtcatgttagttggtacttcccttggcgtacaggggacgtgtcgtgctcaaggtgacttacgcaatattctcaatgcgcccggagttgatgctcaggtactccctggcaatgaatacatgttaagctacgctgctaaagcctttgatcagaatggtcaaatgaccgatgtcccttctatcaagttcttggaacggtgcttcgataactttgaaaaatacgttaaggcactcaacggcacgcccgcgctcaatgtgaactggcacggtaactacgacgtcatcgttttaggctttggtggtgccggtgcttcagcggctcgttttgctgctgataatggtgcccacgtactagtagttgatgcggcaccatttggccgtgaaggtggcaacacccgatactccgcccaacacgtcgttacgggtgaaagcttagataaactaaccgcttattatcaagcactgggcgcgccattcagtacccctactaagacactcaacgcctatttaagcggcatgagtaaaattccagcatattttgaaaaatatctggggattaaagccgttagttggaaacatgatattaaacccggtgatgccgttgccatcaagaaaaccatggcggaatacccagaactagccggaagtgatacgattgactttgccctcgttcacaaacgtgataaagacgctgcattatggaaactactccggcaaaaagtccttgaacgagctgacaatattgacgtttggttggactcacgggcacaacatttgatccaagatcctaatactaaagtgatccaaggggtccaaatcaaacggggcgagcgactgcttaatatccatgccaataatggcgtcgttttagctatgggtggttttgaaaacaatcctgagttaaagcaaacctacttgcacagtgatcatctgacaccacttgggacgctctataaccgcggtgatggtatcaaaatggctcaagaagttgatgccaaaatgtggcacatgaccaattatgaatctcacggtatcttacctggaatcaccttcaaagaagacgccaatgaacggggccgtcaaattgaacactggcctttattaaaaaacggtagtattttcgttatcgctgatgacgggacacgctacttccaagaagacgctaagcaccgtcacggacacgtttacacacatggctcttggctaatcccaatgaataatcagcacccctacttaatttttgatcaaacccagtacgatgccttcaaacaagaagaaagtcaggctggtcagttaccgtatccgaaattcatgaccaagctcgtttccgcgccaacgattgcacaattggccgccaaattgggagttcctgctaataatctacaacagacggtaactgactttaatcactacacagaagtgggacgtgattttgaatttggtcgtgatccgcaaacgatgcgtcaactggacgatggcccttactatgccattgctgcggccaatgacgtcctcaacacgcaaggggggccacaacgcaatgaaaatgcccaaattctcaacgtcaatgacgaacctattccacgcttgttcggcgctggtgaattaggcggtatcgttgcaaactgctatcaaggtggtggtaatttagccgaatgtttgatctttggtaagttagccggtgaaaacgctgctcgtccaaaggtagatagtgaatctgtcaccgccaacgaagccaacggaattaatgaccttgttgatggcgaaacagcatctaatgttaaactggccgctgatcaatatctcggcagttccaatgccgggctaggtggcaaagttattgtgcgtgtgacttacaacgaccataaaattcaagcagtcgatgttattcaacaccatgaaagtgaagatgttggtttaaccgctatcgatcaaattccacaagaaattgtggcagccaactccactagcgttgacgccgtttcaggtgcctctgcatctagccgagctattaaagaagcggtccaaaatgcgctgaaacaagtcaaagattcagtcacgaattaagcacaattcaaagcgaatatgtatttgagaacatcacgtaactcacgagttgcgtgatgttttagtgtcccatggcgaaagtttcacgtgaaacattttaggacttacggtatttgatttccaaatataagttatgcaaggtgcctatcaaaacagacaccatctattgccaaaatcagcagtatccgttatactgtttatcgctgtggctataatcggccacaataaggagatgattaatgatgatggcatcattatctgtacgcaaaagtgctgctcgttagcgacacttttcgacagaacctttcagagaagtgtctggtttgaatctgaaaggaattatattatgcaaccgacaattaccacctatcaatacagttatattactcagcaagtcaatcagttaattagcgccgagctcgccgtaaacgatcttcaaattagagccgtcgtacgggcacaagctatcgagcggattacgccactgcttcctagtgacaatccaatcaccgctaatttcttgtcccatttgcaaacggaccggctaacccgtgccaaggcccctcaactacttgaaacgctaattccgctaattattccgtttccatccttgacgacaaagcaactaagcaagttgtttcgcaaggtcaaaaagttgaagcagcctgtatggtcacaattagcattacacgaattgacttacctaggttggaatgatggtggtaaccagaaaaagtatttagtaatcccggatcatgatcgtctcattggtatccagggagatttagcaccacaaacagtcaagggcgtctgtgccatttgccaaacaattggcaacgtcgcactctttatgtcgacaaccaagtcatctggtctcggaccttacacgcgtaacggcaattacatttgtcgtgacagcaatcagtgtaatcgacaattgaccaacccgcaggctttagctgactttttagcagttgtccgtccaaaacgataattaaataaaaatcagggccaccaagaacagctgcaactgccgttcttggtggcccctttcattaatcttattcggtgacactaatacaataagcgcgtgttggcgaatcactaacttcaattcgcagcagttgcgccccgttgtctcgcaatgtcttatcaatcttggtaaataaatactccgtgacattttcaacagttggattaacagttttaaattcaggtaagtcgttcaaaaatttacctgacaattcatccaacgcttgatacaagtttttttcaatatcgtaaaaagcgaccatcgcatcaaccgtgtgcaattcacaaacaatttcccacgtgtgcgtgtgcttttttccggagccagttgcccaccgcaccgcatggctagcgttgacataggacttaattttgtacgttcgttgtttagtcggcattgcccagcctcccctatcaggttcaagttaccctccatcttagatgaaacggtgtcggttggcaatagtgtctgctggtaaacagctggttttctgctgcaaaagtgagtctaaattagttgataatatgcaaaacttgcggcgtagcaactcggtcagttcgaaattgatttaacggtttttcaggcttctcatagcctaaagcaatccccatcgccactactttattcgcaggcatcccgagtgcatttcgtacaatggccggatatttaaccaattcataagatggtactgactgtactccgcgagcagttgcggccaacattaacgtctgcgaaaaagcgcctaaatcatagattgaccaactattagggttagcgtcgagtacgagataggcaatcgccggtgcgcgataaagattagcacgactatcccaataagtggtcgggtctgagtcgatcacgggccgaaaagttccgacccagtgccccatattttggctagcaaacgccgaaaaatcaccccggtgtactttggcgagatcagcgtcttccgcaatcccttgctcagcggcagtagcatagtgttgtttaatattagttagtgcgtgccccgttgcaatatagacttgccatggttgtgaattgccccacgagggggtatccgtaacaatcattgttaataactgtggctcaatagggtcgtctttaaaagcccggactgaatgccgggtgtgaatcgctttaattgtttccatgaatttttagctcctatattttaaatagtgatgaacaaagagaataaatatcattataaaagatagtactatctttttcaagtgagaaagcttggctagctaagcgcatcgtcataaaccagtaaactaaaaacgtggtaataccgagccattcatgctcagtattaccacgtttttaaccaaattaggcccttgaagttacagtcaacaagctatgaacactggccttaacaaggctgtcatagaccttattttaatgcaatctgtacccgtcgttgaagatctggcaccacggtcgcttggaaccatggattcttcttttgccagccataatttaggggcgatggatgcactaatgggaaataatcaggcaagtaatcctgataattttgaaccgttgcagtcaacgtcttttgccgtgaacgtcctaaataagccttaattgcatattggcccacaagtaacgtcagttgaacgttaggcatcattgctagcagcggttcatgccatttatccatgaagcccttgcgcggtggcaagtcaccgcttttgcctttaccaggatagtagaaatctagtggcataactgaaatgcggtcactttgatagaattgctcccgcgtcacgcccatccaatctcgaagtcggtcgccgctcgcatcattgaaatacgtcttggtattttgggcaatacgtcccggcgcctgactaatcactaaaatagtggctgtcggtaacacatgaaataatgggtcccaccccttcgccgtatattcagcgttatcgggatcagccttgatagcttcagtaatttctttgattgttgtgatatagatgcacctgcgattcgtttttagttttagtgacgatacttttcccatgcctgtttgattaagctcagaatatattcaatctgagtatcatcttttataattacttcataatctccatttccccaatggccgatactgctaacatctctcaataaattattgggatcgtttagttctccttttgataagttaatccaaatttttaactggcttttttgcggtaacaaatcaaccacattatgatgtttaatacgtagtccgatgtaaactttggtcggtttaacttcaaattctgaatcccacagcaaaatggcggctttaagctcatcatacaagtcacaaatattagcagtagctttatctaggaacatttcctcagtatagggcttcaaatcacttacctgatcaacatccgctgctttcgagattactttggattgtgacgataacgcactaaccttattggcaaaacgactattttcactattattcataatttgaagcagagtcaaatagccattctcagttttcctagcctcatataactcaattggcaaattggggttatcgatagcatctttttgataattagtataactaccagcgataaaaacaacccgtgtttgtgtccagtcaaagtcagccactcgcgcccgtgcaccaagcttttcattgtaggctaacgtaaaatcggctttatgttgcaaaagtgtgtttaaataggcagtgccctgatcaactacgctatccttagacgttcgtttatattcaatgattacgaaagctcgaacctcactatcatacgccactgtatccaaccgataatgacctactgtaaattcactgacaataaattgaatccctaaaactaattctaaattattttcaatcaaatcttgtaattcacgctcaatattaaaacttgagaccctaaccttatttaaactatttttactttgatttattttgtagagatccatattaactcctaatcaatgttcatacttatactagtattttacatcaattagtcatagacacgaagaaaagtcctaaccatgttattgccctagattaaacacgacttcatagtcccaacattcgcttcagcagcttttcattacgtttattatggatcggcaccattaagcgcgtagtatattttgccaaaacaccttgcttatacacagatttttgattactaaacgtctcaaagcccgtcttaccgcctttatagcgtcccattccagaataacccacaccaccgaaacccattgaatgcgaacccgcatgcaaggataactcattaatatctactccaccagatgatgtctgcgaaataatttgattcaaatgccttgaactcctaccaaataagtacatggctaacggcttttcatgagagttaataaaagcgatggcttcatcaagtgaatcatacgtaaaaatcgataaaataggtccaaaaatttcatttctggcaatctgtaaatctcgatcaggattaatcgccaacgttaatggaattagccgtcttttcacgtccggaaccaattcattatttggattaatcgttatcagcctagttccccgttgccgagcttcagtaagcattctcaaaatccgatcgtaagaacgatcgttgataatggcagaatattcagaattattaatgtaagttggaaatgcttgcgcaagttgtgcagtgattaagcgcacgtattcatccaactggtcagtgggaagtaacacataatcggtgtccaaacaaatctgaccactattaccagaacgactacgcgcaatcttggcagctgtcatttgcttgttagcatctggtaaaacaacggctggatttttaccacccagttctaaaacaaccggtgttaaattaggagccgccgccgataataccttcttaccagtttcagagccacctgtaaaaactagtttgtcccaatccagtgctgaaaactgagccgcaatatcagcttctcctgtcactactgcaaagttcttttcatttaaatactgttgtgacaatttctggaccagtgccgctgtcttaggggtatactcagagatctttaccatcactcgattccccgctgcaatcgcttctaccgctggatctagcgcaagatcgattggtgcattaaacggcgacatgataccaactacacccaatggttcattataaacatactgtttagttccagttaatgccatcaaacccgaccgttgcttagctggtagtatccatttacgaagatgcttcttaatatatgcaatcgtcgctagtggtccggttaaatcagcacttacaatttgtagcggatcacgctgcccaaaatctgcttgaagtgccgtgattaattctgaaatattatcccgaatcaatgcctcaatctgatttaaaacagtcacacgctcttcataggtcattggttgcgcacggtcatactgtgtcttttgcaagttaaaaatttggtgcatctcattaattgtagtcatcatagctctcctttttaatcgaacaatcgtttaattatagacaaaaaaatatcatgttctgatattttattttttcaatagtgcattcatacacatcacaaccacttgatcgatcataattgtcttattatcaatttgacgtgtttttaaggctttaacaaacaaaacaattggtgcataaacaaaacctaaaataactgctggtgaagaaatgacaaattcaggtgtatgtttgactgcttcaaaaagttgctcgaaaccttgataggattcctcctttttgatttttaagctatcaagaatgggcgaattattgaattgttcaataatcattaatgcttcgtaatattgcatgccgaaatcgtataacgcatacataaactgttggacaaacttaactgagttattgggtttggtattgatattttgacttaaaaatgctgccaactgtcgctttttagcaaggtagacctgttttagaagatcctctttatctgaaaaataaacgtaaatagttgacgaagaaataccactcgctttggcaattttggacatcgaaacatccgcaattccctcttttagaataatacgacttacttcatcgataatactcttctctttgtctaaatctttttcccgcatatttggcaccctcttttaatcgattgaacgttcgattaataatataaaactatccctaataaatgtcaattaaaattattagaaattttatggatgtggcacctgtacgcaaaaaatcactagctatatatacctgagaatctacaatcagcatcttggggattgggtatactcaaaaacggcaagcctttttgaggagcacctgccgcttactttgctattatcaatcaattgagtatagtgataaccaggctatttcaatctagccttaatatcagcatctgaaaaatcgttgctaccgtccttttttattttgccattatttaatggtaattgcatatctatatactgcttacactttagtaaggtaactgtaattctttgcagccttatctaaactgttataaatacgaccatcaaaaacagattagaattcctattcacctaataaatccgtaactattgaaaaacaaattttagcatcacttatggtacggacttcccacattaatcataaacgcccgataaacctgctccgacagcactaaccgcattaattggtgaggtaacgtgaaacgcccaaacgaaatctgagtatccgcgcgcttcagcacttccggtgataatcccagcgaaccaccgattacgaaatcaatatcactgtgaccatacgtcgttagtttatcaatttccgccgcaaattcttcactcgagcgttctttgcccaaaattgctagcgcgtatacgtaatcgcgatccttgatcttttctaggatccgttggccctctttggccttcacattttccatctctgcgttacttaatgactctggagccttttcatctggcacttcaacaatctggaattttgcaaatttactcattcttttcgcatattccgcaatcccctgtttgaagtatttctcttttaatttcccgacacagataattttgatgttcataattgaccgcctttacacaagttattaacatagttatccacaggtgcataactcaataatcaatatattgtgttgaacaccagttcgccacaatatttatttagcctcgttttgtcaagacctttccgacttatccacagttttgcacagcaacacttgttcgtggattccggttacaaatcctattatatcaagaaccgaggcctattaaaataactttttaaaattaaatccacaggacagtccggtgcctgtggataacttttaaacaagcttcaaccccatggttccggctgttcataaatttcgactaacgcgactaaaatttatcaccaaagttgtccacacttttgcacaccatcaaattcgacaataaatgctttctgctatttcaaccagtttgttcggcttttgtcgcaaccattgccagctttcgcaaatttagtcgattattgaaaatcgattcttcgttttttcataatttcggctactaacctaaaaaaacgcccccgactgctttatccagtcagggacgtttatgaaattctcatttattagttactttgtttagttaacgttttggtagtttccgtcaacttcatgttggctgtcttgagttttccgttatggtagtatttcaccgtcacggtatcattaaccgaatgggcatacagggcactccgtaacgtggctaagctggtcactttcttgccacctagctccgtaatcacatcgtacttcgttaacccagcagctttagccggtgaacctgagtacgtcttcatgatgacgacacccttcgtcacactggttggtaacttaagaacagacttctgatcactagaagaaatattggataggtcataggttgcaacccctaaagccggccgaacgacttcacccttttgaaccaattcattgatgatcttcacaacttcattacttggaattgcaaagcccatcccttcgacactagtcccagaattatctgaggccaacttcatcgagttgatcccgataacttgtccagcaatgttgaacaacggaccaccagagtttccagagttaattgccgtatctgtttggataaccgtcgcgtaccccgtcgtttgaccagatgtattcgtcgtcgccacggtccgcttcttcgctgaaatgattccttgcgtcaaggtcgttgcgtaattagagcccatcggtgacccaatggctaaggccgtttcaccaaccttgatattatctgagttaccaaagctagccgtcttcgttactttagaagaattgattttcagaacggccaagtcagtcacagaatcggttccgacaattttagctgacaacttagtcccatcactcataatcactcgaatggcacttgaaccactcaccacgtgattattcgttacaatataagccgcgtcaccgctcttcttatagatcaacccagaaccttcactgtactcttccagcttactagagctagaatctgaactggatgaactatcactgccagacgagtcatcgccacccaaaataccactccaactgcttgaagagctcttcttttggagattaatgaccgatacaacggccgccttgttattttcaaacaccttggtcgcctgtgaactgacattgaccttaacgttcgtcgttgacgttgaccccgatttattagaaccagttggtacactggtcgatgacgttgcgatgttattgttttggaaataattaataccgccgtaagcaacaccaccaccgattaaaccagctactagtgcggttactgcgactttgattaatgatttattagccataattgcgcgtcgaaacgcgatccctccctactaatgcttattttaagtttattttagcgaaaaagtgtgatttttttatgactgaagcgttgtgaaacattaaagctaacctataacgtaattaacttagtcgcttgttctggctccgtatcgtacaattgaaaatcatgctcaacgtcaaaatctcgttccgtcatcatggaagcaaccgttaaatgcgccaaggacttcaagttattatcctgactacgatgccctaagtaaatccgcttggtatgccggccaatcacatccatcaaggcgttcgcaccatcttcattcgataaatggccctcatcaccaataattcgctgctttaatggccatggataccgacccatccgcaacatttctaagtcatgattacattcaaataaatagccgtcagcgtctttgattacaccttcaacgtgctctgaaacgtagcccgtatccgtaatgatgacaaacgattttccggcatgatgtagttcataaaattgtggctcggccgcatcatgtgacacactaaatgattccacgtcgagatcacctagtccaagcgtcgtgttcgggtcaaagacatgacataattcggcaggaacgttgccgattttatgcgccattgcgtcccaggtcccctgattagcataaacatccataccatacttccgcgctaaaatccccgcagaatggcagtgatcagtgtgttcatggctaataaataaactatcgacttcattaatatcacgatcgatcgacgccattaaattagcaatttttttgccacttagccccgcatcaaccaatactttgtgctctggcgtttcgatgtatgtcacgttacccgtactacccgatgccagaatgcttactttcatatcatccgttgctaattttaataccattatttaggctcttcctatctctgaaatccattactatcttcatatgatacacgcttttagcggggttgaaaagcaagccacctgcaagtgctcaaacttaacgtccacgactatcgccatcacgcggttagtctagtttactgtcgtgtatgcgcacactagtttaccggccattaaactcacacgaaaccgcgaacatcaacgctgagcaatccacgctacgtcatgccacctcgacattggcgtatcacaactagtcaaaaatctagtcaccaaaaaacgggcctgttaggaaaaacacccttcttcacagcacccgttattcgacaacgacacctagtcgttaaactggttttcactaatcaattgcattccacatcattccgaccgtcgcatctaaactactcgtatcactagccgtactaccgttcttcattgaagaaccagtaaaggcattgatacggtgcagtgtaacgttagaactattcttaccccggaccgcaaagatccacgttgggacgtaaacactactatccttcaatttcaataaccgagaatacccaagctttgcccaaacgatccgggaactacttgccacctgattatattgatacaacgcaaccagggcctttttttcactgatcgtaacagccttttcgcgtaaagttttgacgtgattgacgtacgtctgagtataacttgtcagctgcttgtttttattaacaaataggtggacttgcccagcgccagtcatgatctcgccatccgcaaccttttgaacaaaaacgtaatcgccgttagacgacaaatccgcatcatagacgtactcggttccatggattacattggtccgctgactcataaacgtcgtcaagtccgctttaggattgcgggtatcgatagtggtggttgcccgtagtgtgctcacgagcttaccgccgctttgcacctgggctgtctgttcagttaactgactcaacaattgtttgagaccactctcgttactgcccgcaatatagtaacccgtcccttcgctcgtgtccgggtttttaaagctaatattatctgcgcgcatttcacgaattatcgtggtcgccgtatcaccagtcgtttgtgtcgacttagagctcgtttgcacgaacataaaacccaagaagatatctagaacaacaaatgctagtaggaaaatccactcaattctccgaaaattcatgcggccacctcctaagatccacttaacatcgacgtatatgtccgccaagtgccattatagtagacataatacgtcggcgtcaggtcgatcacgagtttggacgacttgttctgtgaccattcgtagccaagttcaatactgccaattttactgtctttataaccagcggccttcagacgttttaacacacttgtcgaactcggtaaggtcaccgcttgcttctgaccagtagttggtactggcacctgcaaactgtacagtgagaagtagtaacggtctaacccgttagaagtgagctgaatccggacatcgccattttcggtctgattaaagatcgggaacccttcaacatagcttcggtaaatgacactattactcgttgcgtcaaaaccgtagtagcggatattatccattgggacaccgagactagttaacaaattgaagctcttctttagctgattagtcagtgataggttccgcgtggttcctgaatcactataatcttcgaaatacactgttcctagcttagaatccaccgtcatgcgcttgtaactacccgttgtatactcctgtttaccactgcgattatgcactgaaacggtcgaattaccatccgcatctagtaatcggttggcaatctcactcgcagccgctttactcatcaagtagctataatgttgcatcgtaacttgctttggataatcaatatacgttgtattatcctcataggtcatcttgacagcaatccgtttgaccttgtcgactgccaaaacttttttcaacgacgacagagattttttcttcaaccgaacactataaatctcatgatggtcatcattcaaaaagtagatgtgattcgtatcattgactggaatcacgatccgactaaattccgaggagcgaaaattactgagatgttgcttgaagaccgtattaaacatactgacagtaatactgtcaggaaagttcaatacgtacgaatcagttccatttaagagcgcacggtagctttttgccgacgtaatgcgaactttagagatactccgcgcatcccatttgcgtaactgctcactaaattgactgactaagctgacatttttattaatcagcagggattggccaccctgactgttagtgtgaattaattgtgtcggtaaataaatatcatcgattgtccgagttgtcaacgaagagttcgatgacgtcgtactaaccttgctttcatgctcatagcgtgacggattcaaccagatatacatggataaaaccacgctcaataagatcagaatcgtcaataaaatgggtaagataaagcgtctaagcttgtgagtcgtcatcccaaaggtcctcctcctcataaggttcgtatggcagggagatatagaacgtagaccccttaccttcaacactatcaacccaaatacgaccgccgagcatctgaacaacttcttttgaaatcgccaaaccgaggcccgtcccaccttgggcccgtgaccgcgccttgtcgactcggaagaatcggtcaaagacgtgtcctaagtcggcccgtgggatacccaagccctgatcactaatactaatgatcacttggttatgcgtctctaacaggcgacaagtcacgacaccgccatcaggtgaatacttgatcgcattattcataatgttatccaatacttgagtgaatttatcggtatcaatttcaacccacagatcacgcttggtaaactcgcgcttaatagtgtaatacttagctggattatcatccttctttaagatcatatcaaaccgatcaagcacgtaattgaacatctcattaatattgaccaattccatatcgacccgggtggtccctgagtccatccgtgatagacttaagagttcattgatcattcgaatcatacgatcggtttcttcttgagtgaccttcaaaaatcctggggccacttcaggatccttccacgctccatcactcagtgcttcaatataactccgcaaactagtcagtggtgtccgtaattcatgagacacgttcgaaacaaattgtttccggtcattatcaatcttttgttgttccgtgacatcgtggagcacacagactaacccactaataaacccagactcccgttgaattaacgagaagtaggcattcaagattaggtcacgctcgttcgaagaaaaatcaagcatcaattcatcttgattttcaatcaaatcacgcaatgaataatcatcacggattttcaaaatatctaaaatcgagttaccgattgccttttcggccgtaacatccataaagtccgaggctgtttcattgatgatggtaatattaccccggcgatcagtggcaatcacgccatcactcatgtgtgagagcacactatccaaccggcgccgctcagcttctgtcgactcttgcgattcttccactcgaatcgacaagttattaatggctttagccaactggcccaactcatcatcgctataaactcggacttgccccgcataatcaccacgggcaattcgttgcgtctgctgcttcatttcttcgattggacgagttattgcccgggcaataatgattgcaattcccagtcccaagaccatcgcagcaagtgacgcaatcacaaagattcccataatgttgttaatcgtactgtagacagacttcatatttgcccgtacatacagtaccccaactaactgactgctattacccgctgaattggagctatatagcggcacgattgaaacgtagtagcgtccattattctgagtgtcataggtacttttagtgtaagttcgattattatagatcgcattcttgacgtttcgatcggtcgttttttgtccaactactgactgatcattaacatcactcgtcccacgaattgttcctttgctgtcaacaacttggatttcatcaacattcgtattgttgtagttcgacaaaatcgtcttgatttggccgttggccttgcgcgtactgctgacggtcaattgttcggacaacgaattatcaatataagttggaatttgcaccgactgtttaaaatcctggatgttctttgattccaactgtttcacaaagattgcacccacgatttccaacgtaatcaataatagaagggcaaacacgagcgcaattttgaaattaattgttttaaaaaaatttttccgtttaaatctcaacacggtttagcaacctctactcattttcaggattgcggagatagtaacccacgccccgccgcgtcaccagccattttggatgactcgggttatcttcaactttttcacgtaaccgccgcacggtcacatcaactgtccggacatcaccaaagtaatcatagccccagaccgtctgcaacaagtgttcccgcgtcatgacttggccgatatgttgggctaagtaatgtaacagttcaaattcacggtgcgttaattcgatgttttcaccgcgtttggaaaccatataagcttctggatgaatcaccagatcgccaatttcaatgtctgaattttcttcaacttcagctggttgagcacttggtgcaccttgccgccgtagatttgctttgactcgagcaacgagttcccggtttgagaacggtttggtcacatagtcgtccgcgcccagttccaagcccaacaccttgtctaattcagagtcctttgccgttaccatgataattggcatatcatagttcttccgtacttgtcgagcaacttccaagccatccatcttaggcaacatcaaatctaacaaaatcaaatcagggtggacttcatccactttttgtaaggcttcctctccgtcagctgcaacgtgaacttcatagccttctttggtcagattaaatttcatgatatcagagatgggcttttcatcatcaactactaagatttttttcataacgattcttcctccttaggggaaaacaggtttacatttcaatttttagggtaattcgcgatatattacgagaaaacaggtcctttctcgtgtcagggttggttgaaactaaattcaacactggttttagtatatcacaaatgtagttggctttctttgattgctaatccgcgtggccgtagtatttcccgggaaatcatttgccagttcaagcaatcgttttcaccaattaattactcaaaaaaacacttttttcgaaaaaactttcgaaatagtgttgtcagaactcaaaattcatgatattatattttttgttgagttatgggcagttagctcagctggcagagcaacggactcttaatccgtgggtccagggttcgatcccctgactgcccatcatataaccacactaatcagttttcacgccgtgataatccaccgtgaaagctgatttttttattcctacaaaaaagcctcaggaagcacaacgcaaagtgcgtgtgacgtccctggggctttttctaacgatctaatgtttaccatcagcgtagctaagtaactcaattgctagggttattcttgatcaatatggaaataaccttcaggagctgcactcggctgtgcttgatgccaatgttggctactacttccatatttagttggttgtggatccggtcccattgcaacaaagcgccggcccaatgcgtccataaaaataacgacccgctgatattcacgcgcaggtgcaactaacgtacaattctcatgcttaatgccgtaaacatctacaaaatccattccgaccacttagctttcttgtttagctgacaacccgtcacttcaaataaaaaccgaaccagttaatgataatggttcggcccaacagttactattgtggttgaacgttcgttgcttgggggccacgatcgccctgttcttcatcataagttactttttgaccttcatctaaggttttaaagccatcagtttgaatcgctgaaaaatgaacaaagacatcggtaccgtcttcacccgtaataaaaccaaaccctttatccgcattgaaccattttactgtaccattcttcattattagataagtcctctcagaactgactgcagtaacaacatcgttaaccttgggagcgccaatcaatcataacgttccacgcgttaagtggcttaagtatatcacatccctagtttttaatcgctgaaaacggtgtgcataacgtatgactttcccccatgattcctgcatactgaggtgtaaaggggtgactaagtatgcaacacacgactcgtcaggcagccctacatatgatccaaaccgcccccgtcttcacgttagcaactgtttatgcggacggctttccgaccatggtagcgctcagtcccttacctatcaaacggagcctagaagaactttacttctatactagtcgtcaaacttcaacaacgcagaacattcaaaactggcgtcaagcgagtttattctattaccaactgtcagactatgcgtcaattatgcttcggggaaaactctcattagtcggtaccaacgtttttgaacaagattggcgggctgaactaacggactttcagcagcaactaaattacaaagaccccgtcattctcaggtttcagacaagttcaatcaagattcgccagatgatgacgatcgaccatctcgaactcgttgatcagcccactgacggccccgctcacttagattagccgttacaaattgggccttctcagaaagacacaaccgaagcgccacgactagattctacgcaaattctagttgtggcgcttcgttctttggtcacccaacaactagcatggctcgaagcgtgatatcactttcaaaccagttattaatgcaagcacgtccgactattccggacgtgcatcaaagaccaagtatcatcagcacaagccagaacactttgttcattcaccttcgaaaacaacgccactttcaacctcgtcagcccctactttcatcaccaatatttgcgagtcttgtaaaaagagactaggctgtagttatggttaatatttttatatttaggattacttattgcaatttttaatgaccgaactaaggagtgtggacttatgaaacttattagattgcgaattgaaaatgacgcgatggatatcgcttatcatccagtatcggggcaagccgcaacggcccattacctgattgcctataattctgaccaaacaattggtgaaaatctagagaacatcaaggttcgcttagccggacttcaattcgatgctgctattcttgaaaacggactgtcctatccattctcagacacaatcgtcggtgtcaactatgatcgcattgatgtcgggctagctttgactaatttgcttaatatcccagtcgttagccaagctgccgttgatcaacttggactagcagccgcagttaaagctaaaagtgcctatttaaaatggcatttggattactacggccaataccacggtgtccgtaataatggtcaagaagccatgttgaccattggtaacggttattttggtctacggggcgcctttttggaaagtcacgccgacaaggacaattatcctgggacatacgttgccggggtctatgatcaaaccaccacgactgttcatgaccaccaagttaagaatgaagatttagtcaatttaccgaacgctcagttcatgactttcggtattgatcatcagactccctttacactcaacgaacatgatttacaagacgcttatcggagccttgatttgaaaacgggactcttgacgaccactaaattgattcagctcgcttccggacatcaactcagaatccggtcgcagaaagtcgccaacatgcgtgattggcaccgttacagcattcgttaccaagtcaccccactcaactttgcgggtagtctacaaatctataccgaaatcgacggtagcgtcgtgaatagcaacgttagccgctataacgtcttcgatcagcatcatctgaagactatgggtatcgaaacggctgctaataccgtctacctttctggtcagaccaaatcatcacatatcaattacacaattggggccaaactaactagcccagacgttcctgccattgagaactttaatagcacgcaacaacctcagggcgttcagcaaaccgtttcactggcggtagaagctggtaaaacgtataccttcgataagaacgtcgtcattgaaactagtaatgaccatagcgatccccagttgacccacgtccaagccgagctcgaccagtccagttttgacaatacggtaaccactagcaaggactattgggaagcgacttggcgagccacagatattaagatccgtggcgatattacaagccaacgcttactgcgcgtcaatatttaccacagtttcgtttccgctgccgcaattgaaagcggccaattagacgcttccgttggtgctcgggggctccacggagaagcttaccggggacacgtcttttgggacgaaatgttcattttaccattctacacgttgcaccgaccggaactagccaaacaactcttagcttatcgttaccggcgactaccaatggcgcgtaaaaatgccgaagcagaaggctacgcgggagccatgtacccctggcaatcagcatccaagggtgatgaacaatctcaattcactcacttaaatcccattactaaaacctgggatccagataatagccggctccagcgacacgtctcgttagatattgcctacaacgtctggttttactaccacgttactcaggaccgtgatttcttaactcattacggtatggaaatgttgctatcgatcgcagccttttggatcagtaaagcagattatgaccaagctaatggccgttataacattagtggggtcatgggaccagatgaattccatgaaaactatccaaacagcacgaccgctggattgaagaataacgcctataccaatatcatggttgcgtggctctttgacacgattaccacgcttcgggcgcagatgccccaagctgcttttcaagcggcagctcaggccgcacaatttgactcaacggctgagcaagcgttaacgacgatcagtcatcaattaacacttgaaatcaaccgtcggggaatcattgctcaatttgaggggtacttcaacctaccgacgcttgactttcaagcttaccggcaaaagtacggtgacatcgcccggatggaccggatcttgaaagcagagtctaagacacccgatgcttaccaagtggccaaacaagcagacgccttgatggccttttataacttcgatgtcacaactgttcagaagattattgaaaaaatgggatatcaacttcctaaagagtatctgacccataacattcaatactatttagcgcgcacaacgcatggttccactctctcgcggatcgtttacgccgttttgaatcagcttgacgataatgacgatgacgcctggaagcttttctcagaggccctcgcatccgactattacgacattcaaggtgggacgaccgctgaagggattcacctcggcgtcatgtgtgcgaccttaaacctgacgacacggaactttggcggggtcaatccactaggtgcccacttacaggtgagcccacggctacctgaacactggcaaacattgaaattcaagcatctctttcggggtgttcactatgttttcgttatcgatcatcaacgggtaaccgtcactgcggaccaacccagcacgattatgattggaaaacagcattaccaattacaagctaagaaaccactttccgtcacttataccgattaatctaggaggcaatcaacatggttaaatttgcagcaatcaaggggtttgtctttgacctcgatggcgttatcacggacacatctacttttcatagccaagcttggcaccagatcgccgataaagtcggggtcagttggaatgatcaattagctgacgcgctcaaaggtatcagtcggatggattcactcaacctcattctagctcaagggcaccgagaaaatgacttcacaccggcccaaaaacaagcgctagctacggaaaagaacaccaattatttgcagctcgttaaccaaatgaccccagccaacattctaccaggcatcaccgcctttttgactgaattaacaacggctggctacgcattgtcactcgcttcagcatcaaaaaatgctccgcttgtgctacgtaaactcggtcttagtgactactttacgaaggccgtcgaccccgctagtctcaaacacggtaaacctgatcccgagatttttcggcgcggtgctgagattttaggccttaatccagctgactgtattggtgtcgaggacgcggcggctggcgtacaatcgatcaaaggcgctggcgaaactgccatcggtattggtgacccgaccgttttagcggcggcagatatcaattttaccgatacgactcagctcacactcgccaatattaaggcacaactaaactaacgtatttccattaaactcatcacaaaacaaaccggatttggcgaccacgtcatggttaccaaatccggtttgttttgtttaagccagtcgctaatctcaccagttggactgctcactggaagcttataattatcagactagctgtcaattctcaaatcaaatcaaaatgttgcaatccttgggcaatcccgccgtgcatgttgtcagcggtcacgtaccgcgcgagttgtttgacctgcggatgaccattgcccattgcaatcggtgtctggatcattcggaacatctcaatatcatttaattgatcaccaaacgcataggtcggtaccttagttaaatgcgccttggttaagatatcctgaattccaaccgccttggagacgccccattgcatagtgtccagcgcacgcggattattacgaacaaaatgtagtcggcctcgatatcgctgccgatattgcgccgcattcaacggatcaaacgtcagtaagaaattaatatgttgatgttcaaaaaagtgcggtgcgacccgggccgtctgtctgagtgcccgataattactggttgtcaatgcatcacgatggcttaacgcaaaaccggcgttattataataagctagcgcattctgttggcgattggcaaaatgagtaatatcggtcaaaagctccttatccagttcgtgcgcactcaaaaactgcccttgatacgcgacgtaactcccattcgcactgacgattgaatcgatccccgtcgttgtcatcacatcttgaacttcgaatacattgcgacccgtggcaatgacgggtaggacgtggttagctcgtaattgctggattgcccgcacactgctggccgcaaccgtcttatcgtcctgcattaacgttccatccaaatcaaaaaacactactgcttggtacaaccaattaccccctaattaatcagtcactggccaataaccagcgccaccaatacactaattaccttcgtgatgacgtctatttaaaaccatccgaaaaggtgctttagtgtttacctttattataagcacctcgtctgaacaacgcagacattctgcttataagcgcacaaaaatgcgtggccaatcaaggaaagccacgcactaatgtgcctacgtctcattaaggatcgatgagtacttcgtaatacataatcaatagcggggtgctattaaaaagtacaattatactatacggctgaaccgtactaacaatcatcaagttcctgtaaaatttaggtaaagttttcaataaggcgcaactgttcaccacccagcgtctgcgtcacaagggagcgttgaatcgcttgtgctaattttatgggcacaccactcaactttaaatcgtgactcgtcatggttcgcggctcagtagtcacattgacaatcaccatcacggtctgatcagcctgccaataaaggtagccaatgccataatctgccaagtaaaacggcacaaagtgggctgtgtttaaccacgggtgccgttgacgccaattcgcccagtcagcaacaaactgaacttgcgcctgatctgcgtcctgccacggataaaacgcacggttatcagggtctttcccccccatcatcaacgcctcatcaccgtaatacaggcacggtacacctggaagcgtcaagagtagttggacggccaaacgtaggcgttggcgatcttcggctaacatagtcaggattctgggcgtatcatggctaccgatgttattgaagttaaagcgaaacgtcgtagcgggataattttccttgagggtcattagttcacgccaccattcggccggtgttagcgtgccgtttaaaacgtgaataatcaagcggcggagcggataattcatgacagcctgtaagccgccgccctctaagtagtgccggcgcatcccatacgctaatttatgagaggcatcctcccaaacttcaccgatcaaaaccttatccggataacggtcaagggtccgtcgaattccagcaatgaaatcgtctggcaactcatccgcgacatctaggcgccagccatccacaccgcgttgcgtccaatagtcaatgaccgaatcgggtttaccaaagataaaatcgcggtatgttggatcgtctttatcaactgtcggcagatcacggatgccccaccagctatcgtaatcgtggggataatgaatgaatgtgaaccacgggtagtacggactcgtggtcgactgagttgccccaaccgtcgggtaatggcccgcctgattgaaatacttagaatccacaccaacatggttaaaaacaccgtctaagatcagtcgcataccggcccggtgtacggccgcgaccaggttatcaaagtccgtcaaatcgccgacgaccggatcaatcttcagatagtcacccgtatcataccgatgattactgctggcctcaaagatcggcgtcagataaataattgtcacaccgagtcgctgtaaatatggaatcttagcactaataccgcgcaaattaccaccgtaaaaatcccagcgtaaaatcgcccggtgttcatcacgcacgtatagtgggcgatccgttagttgaccataaataaagctatttggcttgggcgcattaacgtggccatccgcgttgccattattgaagcggtcaacaaagatctgataagcaaccccttcacgataccattgtggcaatgtttctactgctttcaagattgtcaattgaacatgctcgcgcaagacgtattgaacgcccgggccaccataaccaccatcaacgcaaccataataagcggtcatggtcgccgtttcaatccgaaaatagtagaagtacaggccaacctgggtcggtataaacgtggccgtatacattgtgggactgattggatgtaacggtaaggcctgttcatcatcccactgaccatcatgagccacgcataaatcaatctgcttaaccggcgttactgtctgaacactgattgtgaattgaacgggtgtctggcgggtcacggcaccaaagggtgtcttatacgtgggtaaaaatgagttatacgttacctgcatccgtcacccttcctttcttaattcagtcgttcgtggggcacttgccaaatatcgtcagcataccgcgccactgctaagtccgcggcaaagtgtcccgaagcggcaatgttggctaacgagcgttgttgccaagtgggttgattttgaaaatcacgactgatctgctgttgttgggtgacataagcccggtaatcggctaagacaaagaattcatcattataccgcagtaatgaatcatagatttcccgaccaaccgttggaattcccggaatcgtgccatcaatcaaactatctaagagccgttttaattcaggatcagcatcgtaaaagtcagcggcgtgatagttgccgcgatggtaatagtcgtacacttcattgaccttaagcccaaacggatattcattttcagcacccgccgcttgcataatgtcgatattcgcgccgtcatacgttgccaatgataatgcaccgttggccatcagtttcatgttactagtccccgacgcttctttggaggccgttgaaatctgctcgctaacgtcggcggcgggaatgatcagttcggcaatggagaccccgtagttcggaataaagacgatctttaaccgatcaccaatcgccgggtcctgattcaccatgtcagcgacgacattaatgagtttgataatcgccttggcatagtgataactaggagccgccttggcaccgaaaatgtgtactcgcggcacgactggctgttgcggatgatccttaatggcaaaatactcgcgcaagatttcaaagacgtgtaggagttgccgcttataagcatgcaaccgtttgatttgaacatcgtaaatcgcgtcggtgcgaatcttgatccccatagtacgctgaacgtacgcggctaaagcttgcttgttagtcagtttaacttgacctaactggtacaaaaagtgatcatcttgttgatacggcagtagcgtctgtaataaatctggttgccgccgccagtccgaaccaatcgtctgatcaatcaattgcgctagtggttggttcgccaattgaacccaccgccgggttgcaatgccattcgtcttattattaaaccgctccggataaacttgatacaggccccgtaacacatccgttttcagtaattccgtatgcagtggcgcgacaccgttcacactgtgactcccaatcacagctaggtaggccatccgtacttgtccgttgcctaaaggcgccgtctgatcaacgagcgctttgccaaaaatcggcgtttgttgttcccggtagcgccggtcgatttccgcaataatctgatagatccggggtagcaggtttttaaacatatcgattggccaagtctcgagggcctcttgtaaaatcgtatggttcgtgtaactcatgacttgcgtcgttaacgtccacgcgacttcccatgaacagtgatgttcatccattaatagccgcatcatctcagggatcaccagcgtcgggtgcgtatcgttaatgtgaatcgcgacctttttgcctaacaatttgatgccatggtgcgtcgcacaaaaatcacgcacgatactttgaacacccgcagaagagaaaaagtattcttggcgtaaacgcagttgttgcccggccgagttagaatcgtcaggatacaagaccttggtaatctcactgattcgatcacgctgatcctgcgaagaataggtcgcactgggtggtaactccgcggaccacaaacgcaaggtgttcgtaatatcgttgtgatacccgacgataccaacgtcgtaaggaaccgctagcacgtcttccgtattttcagattgcggttgtaaactaccatccgcttgcggttgtaaccacacattgccgccgaactggacaatgcagctcttgttatcgcgccgggtctcccacacgttgccatgatggagccaatcatcgggtaattctacttgatagccatccatgaaaacttgtttgaacaagccgtaacgatagcggatgccgttaccgttgccggcaattttcaaactagccatcgcgtccatataacaggctgccaaccgacctaatcctccgttaccaagcgccggatcaggttcagcctgactgattgtctcaaagtctaagcctaattccgttagccctttttttaccgtcgtcaataagttgagattcaacaaattagaagcgagtaagcgtcccggcaagaactcgatggaaaaataatagacttgtttctgatgatgatcgcggtaaaatttagctgttcgtgtccaactctgactgttatagcgccgaactagctgtcccagtgcaataaattgcccaatcgtcgaggtgtcactcagcgatgttgaatacaaggtctcaatttcacttagaaagtcctttttaaattgcgcacacgttaatttcaaattcacacccccatcaaacctaacgcattagcttctgataagtcgcacggtactgctgtgcagaatgttcccagccaaaatcacaagtcattgcttggtgctgcagctgccgccaaaccagtggatgctgccgatataaggtcacggctagaaccataattttacgtagaaccgctggctggtagtcgtcaaagctaaagccggttccctgatcggtatagcgattgtacggaatgaccgtgtcccgcaacccaccgaccgcgtgcacgatcggtaacgtcccgtaatgcatcgccatcatctgcgacaagccacacggttcaaaggcagaaggcataagaaagatatcactggccgcatagatttgctgagctagctgcgtatcaaattgaatcgcggcgaccaccttttgcggatacgccgactgataggtgcgtaacgcgcgttccaatgctgggtcacccgttcccaaaacaatgagttgcacatcttgttgctgcaagaatggattcaatgcatccagcaagaggtcgatacccttttgcttcgttaaccgagaaacgactgccaataccggcacgtttttgacaggcaaccctaatcggcgctgtaaagcacgtttattctgacgcttaggtttcaaattcttagccgaataattcgccgttagtgccaggtcggttgcgggatcgtataattgcatatcaatgccattaagaatcccactcagtttgtaccgattggcccgcagtaccccgtcgagacgttccccaaaagctggtgtttgaatctcttgtgcgtaggtcggtgacaccgtattaacggcatctgcaaagttaataccgcccttcagccagttcacttgatcgtaaaacgccacgccggcttcggtgtaggtctcagttccgattcgaaagagactatccaaaataatcggatcgtagacaccttgaaactgtaagttatgaatcgtcagcaccgttttaatatcacgatacgcttcgatccaatagtacttttcagctagcaagacaggaataaacgctgtatgccaatcattgagttgtaaaatatcagggatataatcgatccgctccatcatttcacaaacggccatttgaaagaaggcaaagcgtgcaccatcatcccaataaccatataatccttcacggccaaaataatctaaattatcaattagataatactgaacgtgcgcgactgtcagagttttaataccgcaatacatcgcatgttcacccacttgaacagtaaaatgcgtcactggcactaactgctgctgatattcggtcggcatctggtgagggtaatacggaatcactacacgcgtctcaattccttccgcttgcaaggcgcgcggtaacgccatactaacatcgcctaagccaccagtcttataaaaaggggccgcttctgccgccgcgaataataccctagtcatgcacagccacctccgcttgttgaaagacgtgctgccctttgctgatgactaacggtgtcgttgaagttcctttaagcactaggttgggcccgattacggcgtctttatcgataatgacgttttctaacttacaaccggcaccgatccgggccccctgcataatgatggcatttttaacttggctatcacgattaatcagtacatcccgaaagatgacggagtggtcaagttgcccttcaatatagcccccagtaccacataaactatcacgacactgtgaaccagtcgcaaagaacgtcgggatttcatttttgaccttggtgtaaatacggcgcgaactgtagaataacgctcggaaattagcttcatccaaaacggccatattggccgcaaagtagctgttgatatcatgaatattcgcctgaaagcccgtatattcaaaagcattagcgttatgttggatgactgcttgccgcatcaattcctctaggctgatcatgtcaccccgttgattggccgactgcaataattcgattaaatcgaccgtactcatcaagtaaatagccatgctcttggcaacttgtttcgtcttcgggctaatcttggccttgctcatcggaacgaccgccgttgcttctcccttagcagtcaattgtaagattgtattttcgggaatcaaactagctggatcaacgcgcttataaaccgccgtcacgggactgttacgttcctcgtgataccgtagtagcgcctttaaatcaatattaccaacattgcgagtactcatcactaccgagtactcactctggctgcatttcagaaactgaatcgaattatcatagtaatggtgcagtaatgcggccttcttttctggcgccactaatttcaagtcattgtatggggacaagaataggccgccgcgaattgtgttcaggctccagtcacgcccgctacgcaaatgatcagccacggaacgccctgaccgcgggaccgtcaccatcacattttgaatccccgcattgatgacactcgataattgaaaatcaaccaaccgataacgaccaccaaagggtaacattccaactggccgaactgcagtcaatggttgtaacgcgtcacttggttccagtaaattaataatggcactcacttgttcacgtctcatggttgttccacccccatcgtttcgtgatacccaacaactgcaatcttatcagtcgtaccaataatctgggcatcatcaccaatcaatgcatcttcgccaatcaatgcgtggtcaatcaccacattttttccaatcgttgcaccgggcataatcatactgtcaaccacgcgactacccatcccaactgacacgcgttgcgataagattgaatgatcaatttcgcccgcaacgtaacaactatcaacgaccatggcattattaacctggctcgtttccgtcaaaaacatcggtggtagcacctctgctttagagtaaatccgccagtaacgatcgccgatatttaaccggttatggggcgataggaattccatattggcttgccacagactcttaatcgttccaacatctcgccagtaacccttaaaagcataagcgtaaacggattcattattggctaagtatgatggaatgacatttttaccaaagtcttcaagtgacttatcggtagcataactcttaactaagtaatcccgcaaagtcggccaattgaagatataaatgcccatcgaggctttatcactcttaggatgttccggtttttcctcaaactcaatgattcgatccgtcgcatccgtattcatcatgccaaagcgtttggcttcttcgttagtcacgtggatcaccccaacggtcaacgaagccttcttctcctgatgatatttcagcatagcgtcataatccatcttataaatatgatcgccagataagacgagcaggtacttggggtcttgttgatcaatatattcgatattttgataaatggcgtgcgccgtcccttgaaagaacttctcaccttcactagacgagtatggttgtaaaaccgtcaccccaccatttaagctatcaaagccccagctcgcaccgctaccaatatgtgcattcagttctaggggttgatattgcgtgataaccccaacggtattcacacccgagttagcacagttgctgagtgtaaaatcaataattcgataacgaccgccgaatggcacggcgggcttagccgtatccttcgtcaacttaccaagccgggtgccctgaccgcccgctaaaataatccctaacatttcatcttgcatgcttaactcctcctatcactttaactggtcgaatcaacaatgcacccatcgccggcaaggtcacggtaaaactagctggttgcccccgatacggcttatcgaccgccgtaaacgttgtttctagctttgtccacgtgccgccaaaagcctgcgcttcagtattgagtaacaactcataacggccacgatacggtacgccgatccggtaatcttgacgttcaacaggaacaaaattgaaagcagcgaccacaaaactgtatttccgtttggcctgccggataaaccccatggtcgaactgtcaggatcatcggtatgtgtataaataatccccgcaggatcatggtcctgttcccacaacggccgattgtgccgatagaccgcgttcagttgcgttgtgaactgttgcatccgatggttgagatcatcctttaagtcgacccattccaacgcactccagtcccgccactctaggaactgcccccactctgagcccataaaattcagttgttttcctgggaaggcagccatataagttagcatcgtccgcaaatttgcaaactgattatagcggtcccccggcattttatgcattaatgatttcttgccgtgcacgacttcatcatgtgaaaacggtagaataaaccgttcatcgaacatgtacacgaatgcaaatgtcagtagattaaagtggtcgtgccgatataacggatccatcatgaagaaatccagggtatcgtgcatccaccccatgttccacttatagttaaatcccaatccgccattggccaccgaacccgtaacctgcggataggcggacgactcttccgcaatcatcaagatatcgggatggtgggttaagaccgtggtgttcaacttttgtaaaaaggcgatgccttctaaattacgattatccccatactgattaacctgcccttcgcgcccttcatcatagtcgcaatacaacatgttagagacagcatccactcgcaagccatctagatgacactggtcgagccaatattcggcgcttgaaatcagaaaactctgaacctgtgttttaccgagatcaaaattccatgccccccaacgacggttattcgcgcgctcaggatcagcgtattcaaatgtcggcgtaccatcatactggtacaacgcatcataattgcgaataaagtgacccggtacccaatcaacgaataccccgatattcgcttggtgacactggtcaacaaagctgagaaaactgtcacgcttgccaaaacgactggttggcgcaaaataccctaattgctgataaccccaagacgcatctaacaaatgttccatcacgggcattaattcaatgtgggtatagccccgttgttttacatagggaatcagttcagcggctaattccgcataagtgtagtagctaccatcaagatgacggcgccacgaacctaagtgcacctcataaatgttaattggccgattggcagcgcgcgacttcttccggcgagctagccacaaactatcgtgccaacgcatcgtcatcggctcaacaactacggccgcatcccccggttttcgttcgaactgttgtgcaaacgggtcaatctttagttgcacttggccagttggtgttgtgatctgaaacttgtataactgacccgcatgaacgttcggaacttgtccttgccaaatccccgtcgcccctaataactttagtgcgcttggttgccagtcattaaaatcgccaacaagcccggcagccttagcatgcggcgcccagacgcgaaataccgcccgaccagatgcgcccaaatgacagcctaagtaatcctgactattaaatcctgcgccggtattaaataagtaacttgcatcattcatttccgtagtttgtttaaccaaagcatcacaccccctatgtgattaactgagcagattataaaattaatcttattataagaaggtgacagggtgtttgcctatccttgataaggtcgccttacttagtgatcaaacagggcacaaacccctaaaagataacgattattatgactagccacccagaccgctgcaaactgattcaggacaactattcacagttaagcccgtggttatccgttttattgcgccgtttgccaaaacatcaaaaaaagcccgaaaaaacgcgttttttcgggctagttgatttattcaattacatttctatcaaattaataatatttatctgactgattacttccagtaggcatagcgataaagggcgtctcgcaacaatgtgaagtgaaccccaccaaccttgttactgatcaagtgagcagcagcagtttgataaatcggtgtgaccccctgttgctgagcgactagcttagccgcttgctgcatcgtctgatatcgggccttagttgactgcttatcggccgtaatcgtcgagattaattgctcatatttcgcattgttaaacttcccaaagttgacagaattagttatcgaagccttattcaagaaatcaactggatcttggaaatcactcgaccacgacaacgtggcaaagtcaaaatcacccttgcttaaagttgaaatctcatttgtcagtggtactgacttgacattgaccgtgacaccactaagatttttctcaattgcagcttgaatatattctgccaccgacttattaatatcattatcgttcgtcaataattgcagtgttaacttttgctttcctaagctcgcctgagccttctgccaatactgtttagcctttgctggactgtatggatacaaatttccggtatccgtattaaaatctttccctgttgtcgggttcttggtattgccagcaggaactaatgacgtcgccgctactgagccgtctttgagaacgttcttaaccaatgactggcgattcaaagcgtaactcacagcacgccgcaagtcagtattctgcaatgctgagcgcttctggttccacaacatgaagtagagttgatttaacttcgtaaccttcatctgactttttagtgacccttgctcagctgccgatacttgggtgcccgtaatctgggtgacttggacctcattgctttggaagaggttctcggccgtactgttatttttgaccgtctgcaccttaatattcttgattcggacctgtttacggtcataataatacgggttcttcacatatttccacgtgtcattcgtcccattccaactcttcaagacatagggaccattagagagcgttcgctgtgccgatgtcccatacttattcccgtatttctcagtaaattgtttgtttaacggatagatctctgtggctagccgataattaaaatacggcacgcgctgttgcaatgtaatttgtaacttatacttacccaacgctttaacgcctaaggtcttcaccgccttcttaccagccgtgattgctgttgcattcttgatttcagcaacgtgtccgacttcctgtgacttggtattcggatcgacctggcgttgcacggaataaacaaagtcagcggccgtgaccttttttccattcgaccacttggcattgtgccgcaaattaaaggtataagtcttcccattattagtcggtttgacgactttcttggcaattgccggcacgactttccccttttgattagttgtatacaagccttccataaactgagcaatagcggcctgactagcgatatcgtcggccttattaggatcagcggtcgcaatcgactgggtcgccgttacgttcaacgtcttctgctgactactctgctggctaccgcagccagttaagactaatcctagggctacaataccaatactgctgatccatattctttttttcatgaatgatgactcctaacttaacgatgatgtcggttactggcaacgatacttcgattggcgccgacaacaacacatcaacggtaagcctccgttatccgtggtaaaccggtaattaccggttttcacgactacaataacgttttgcaatcctgcgttcatcatcatgattcctccccttagattaaaaactaattaagataagattagcttttaagtttacatctgtcaactaaaagtttcgctcaacattctaagtcaccatggtattgtgccttcactattcaggccgaaaccagcttgctgcttttgaaccaaacgtatggtacgcgagcttaaaactagaccggctatgttgggttatcaaatcaagaagtcaaaaatcggataaacacttgtccccccaatcggcaataaaaaaatcgctattagccgatataatgactaataacgatacttgctcatcaatggcgaatctgaccattgccatcaatgacatatttataagatgttaattccgctaatcccatcggaccgcgagcatgtaacttctgcgttgaaatcccgatttcagcgccaaacccaaattcaaagccatccgtaaaccgggtggaagcattgatataaacacacgctgcgttgacccgttgctggaagagcttcccagcttgataattatccgtcacaatagcttcggaatgttgggtattgtaacgattgatgtgcgtaatggctgctgcttctgaatcaacaactttcactgcaataattaaatcattatattccgttccccagtccgcatccgttgctggaaccacatcaggaacaatggcttgagttgcggcatccccgcgtacttctacgccttgttcacgaagtgcctgaatcatgctaggtaaataatcggccgcaacctcacgatgaattagaagcttttcagtggcgttgcaaaccgatggtcgctgaactttcccattgatcacgatatcggttgccatttgcaattgcgcgtctttgtccacatatacgtgacaattaccggctcctgtttcaataacgggtaccgttgctttagccaacaccgtttgaatcaaacgggcgctcccgcgtggaattaagacgtccacgtaatcagtgagctgcatgaacttagccgcagtcgcatgcgacgtatccgtaatcagttgaatcgcattctcatcgaccgcttcggcccgtaatgcaccacgtaagacttggacaagtgcttgattagagtgaagggcttccttaccaccacgtaagattacagcgtttccggttttaaaacacagtgctgatgcatccaccgtcacattggggcgcgcttcaaaaatcatgccgataacacctagtggtacccgttccttggcaatcatcaacccggcctcgttgcgccacgcgcggtccacatttccaattggatctggcaaactcacgacctgtttgagtccggtcgccatatcctggatgcggtctgctgttagccggagccggtcaacaaacttaactggtacttgcgggttctctaaatcctgcgcattagctgccaatatctcatcttgatggctcgttaacgccgttgccattgcggtcaacacttgatttttttgcgccgttgaaagtaaccccagcgtatagctagcttgttgagcctgctgacccaactgttctaaatctaccattttgataacctccccaacttaaccgaatagcgttccgactggttcgcctgctaaaatttgaaaaataattgtgggatccgcaccattggctaaaatcatttgaccattcgcatcgatcatccgttctgccgcttttagcttagtgaccatcccaccagtaccaaaccgactgccactaccgccagctagcttataagtatgttgatcaaccttctcaatgtgccctaataactgggctcgggcatccgcattgggattaccatcataaaagccatcgatgtcggatagcatgattaacaaatccgccccgatattcgtggccacgattgcggatagttgatcgttatcaccgaactttgtttcatgatccaattcatcgaccgcgaccgtatcattttcattaacaattgggaccacgttttgttttaatagcgcctcaaatgtattcaacacattatggtgactcttaggataaacaaagatatcacgtgttaataacaactggccaattttttgttcataaatggcgaaacgttctttgtaaatcgaaatcaattcagtttgcccaatcgccgcaatcgcctgttgttcaggaattgcttttggacgttgcttgagtcccatataattcaagccaacaccaatagcccctgacgaaaccaagacaacttcacgcccacggtgtcgcattgcgctaataacaaaggctaattgatcgattgcccgtaagttgatcgatccatctggataaactagcgtgcttgtcccgactttaatcacgactcgtttagcctttagttttcgtatcactttcactactgccaccaacttctctaattattttgtttcacgtgaaacatcggtctgaacgtccgtcttcatataattaacggccttgcgtaaattaaagtgaacgacaccgatattaactgccaacacgatcaataaaaccacaaatgccaacaaaaacagcaccttataagaccaattatcgataatcacaccaccaaataacggccctagcgagcgccctaacgcacaaaaggcttgtactagtccttggtaacgccccttagcactaactggtgataactgactcactagtgttggcatggctggtgaccaagttgcttcaccaatcgtcaataaaatcatggcaaagataaagtgtgggtaatcatgcgcaatcacaagtgatagaaatgataagcccacgaatagcatgccgaagaaaaattgattatataaatttttaatccgattccccagcaaacttaaaatactctgaataaggactagtaagcccgcgttgattgtccatagaaaactgtaattccgcagcggcatccccaaattcgtcatgtagacggataaattgctgacccactgttcgtatagcaaccagataatgaataaactaataaagaaggtccagacaatgtgaaaattggcccgtggcaagtgcacatcttgtccttggcgcggatcaaccccggtcacgttcgacgaatccacattgtattcaaataatgcaataatcaagaaaatcacgaagaggctcgtggtcatcgagaatagcaaggccatccccatgctatacacgataccaaccagcatcgtgccgaagacaactccgagattggcagcgagatacatcaacgtaaacgttcgccgcactttatcgcgggggacactggcagccaaagcattaaacatcgtatttagccagccactagcaaacccggtcacgactaacaacatcggataccacggccatccatgaaaaaagatcagagcaaagttcgcgaggccattcaacgtgattcccatcagtaacaggtgataaggattacctcgatcaaatatacgcccaccaatcgtacttgccaaaacgttggcaactgaattgagcatcaggacaattccagtctccgtcaacgacttacctaacacattgtgcatgtagatcgtcgttaacggccaaatgaaactcataccaatgttattcataaactgcccggcaattagccacggcgttttaatgagttgcttttgtgccacgccatcaccaccattattaaatctgtctacttttcatcatagcaaagtttatttaaaataacagggacatttatctcactaactcattattatcacggccaaattggtgcatcagcccaaccaattagcggaaaacaagtagcctcggcacgtgataaacaaaaaattcctcttaattagtttaagaggaatttgataacaaatttattgatcgactgcaattaagcttggggatcctgcgcataagagactgaggagaacttattaaatggtttcacaaataatagtttgaccgttccccgcgccccagcacggttcttttcgataatcacttcaacttcaccaacatcctcagaagcatcttcgtcccgcggatcgccgccattaaagtcaccaccgccaccaaaattaccgccatcatcatcgtcgccgccttcgcgatcataataatcttcccggtataggaaggcaacgatgtcagcatcttgttcaattgaacccgattcacgaatatcggaaagcactggccgcttatcttgacgctgttcaacaccacgagatagctgtgataaggcaatgactggaacacctagttccttagccagtttcttcatttgccgcgaaatttcggaaacttcctgttgccgactttctgtgttactaccttcgatcagttgcaaataatcgaccacaatcaagccgaggttaccttgctctttcgctaagcggcgacttttggcccggatttctgacatcttgattccgggggtatcgtcaataaaaatactagctttagacaaactccccatggcaaccaccaagtgttcccactcttcttcgttcagttgccccgtccgtaaatgcccagcgtcaatactaccttctgcacacagcatccggttgactaaggattcggcacccatttccaaactgaaaatggccactgtcgtatccgttttagtcgccacattttgggcaatattcaggacaaaggctgtcttaccaacggctggccgggcagccaaaataatcagattatccggttgtaagccggcggtcattttatccagctccgcaaaaccagtcggtaaaccggtaatgtcatcatcattttgatacaagcggtcaatttcttcaatcgacgcgttcaacacatctgaaatcgacttaaacccactctgattacgctgttcagacacgttcataatgtcgcgttccgcgtcatctaataacgtggtcacgtcatcattttccgtataggccttttgcgtaatctccgtggccgtcttgatcaaccgccgcaccgtcgccttttgcgccacaatcttagcatagtagccagcgttagccgcagtcggtacggacccagctaattcagcaatgtaactcatcccaccaacatcatccaattgattttgggccgttaataaatcactaacggtcaccgcatcaatagcctcgtcacggtcatttaaagtcaccatgctggcaaaaatgatctgatgtgcgcgccgatagaaatcttgcgcttcgacaaactccatcgcttccacgagggcatcactgtttaagaaaatagcccccaagactgccttttcagcttcaatattttgtggtggggtttgatccagcacatcgttgttcatttgtgatccgtccttttacttttcgacaacgtgcacgcgaattttcgccgttacttctggatgtaacttaacaggcacgtttgtgtaacctaatacccgaattggttctggtaattcgatcttacgtttatcaagcttaacttggtattggtcagctaacgccgttgcaatttgtttgctaggaattgacccaaacaaccgaccatcagtaccagctttggccttcaattcaacaaccgtttcatcagcttccaaaactgtcttgacttgcttagcttcggctaattcctcagcggcacgtgctgcttcagacttctgttcagccttcaacgtattgattgccgctttagtggcttccttggccaatccctttttaattaaaaagttctgtgcgtaaccatccgggacattcttgatttggccccgcttgcccttaccacggacatcattcaaaaaaataacttgcatttagactcactcctaattagattctgtggtcggctcatcagttgccgttaacaaatcaatcaacgattgtttgacggcttcaactgactgcccttcaatctgggttgcagcattcgataaatgaccgccaccacccaatttttccatataaacttgtacgttgatctcgccaagtgatcgtgccgaaattccgacccgtccatcttcacgacgtgtaatcacgaatgatgcgtcgacaccagacatagataatagtgaatcagcagcttgagccgccgttactgggtcatagacctgatcatcttcaccaacacataatgccatatcctgattaacaaattcaacggtttcaatcagatgattgcgttgtagataactatcaacgttctccttcataaattgttgaacgagtaacgagtccgcaccggctgatcgtagataactagcagcatcaaacgtccgcgatcctgatcgtaatgaaaatgacttcgtatcgataacgattccggtcaacattgcggtcgcctcaatcttattgattggttcggcatcgtgcgattgatattcaaacatctcggtaatcagctcacaagtcgacgaagcatacggttcaatataaaccaaaactgggttttctggaaattcttcgccccgtcgatgatgatcaataatcataacgcgattttcgagccgctcataaagggcctgtgacattgaaatacttggcttagaatggtcagccataatcaataaactttggtcagtggccttctcaagtgcttcttccggcgagataatcgctgactcgatgttctcatcagacttcaactggtccagtaaacgctgaatgtctgaatgcacattttgctcatccaagacgatccaacactgtttaccattcatttcagcaattcggcgaatcccgagacaggccccaacggcatccatatctggttggcggtgcccctgaacaaagatctggtcagattgattcattaactcttgtaacgtctgactgatcatccgggcccgtacccgcgtccgtttttccatcgggttggttttaccaccgtagaaacgagcaggttcgtcctcagacttcaccacaacttggtcaccaccccgccccaaggcaaggtccatgttactctgcgctaaatcggccaaattgttcatgttccgttcaccataagcaatcccaatactcaatgttagtgggaaattttgcttagaagtcgactcccgaattcgatctaaaatgcgaaacttattctcttcaacacgtcgtaaactactagcatagcccaacaagaagaagtgatcatcatccaagcgcttcaggtacatcccaaacatctgggtccacttagacaattcattggtcacgtaattgttcaggttggaaatatccgtatcagtcatcgactgggtgatttcatcgtaattatccaaaaagatttgtccaatcacgagtttttcatcttcgaattgatccgtcagctcagcatacttggtcacatccatcatatagaccgtattagtgctctgctggacacgtacatcaaactggtagtcttgccaacgaatcgtcgcgggctcgtccagatgagcgttcagcgtcgctgccagtgttggctcaatatcttccaagcggtatcctaagacgtccttatcaccgaaatagcgctgaagataaggattgatccattcgatggtctggtcggaattaaaaatcattactccgataggcatctgaatcagtgcctcttgttcgccgcgcttaatacgatacgacaagtctgagatatattcatttgcactcgaactgagctcaatcaacgtattataagatatcaccacagccatcacaatcaagatgaggacaacggtcccaaaaatccagttcattaaataaccagtgacgagcataattaacgacaagctaaaaataaccaacgctaagagtcgtaactgctgattttgtaggaaaaatggaattttttcacgcgaaaagatctttttcatattaaaaatccctcaagccttctcagtaatgactatattttatcacaaaccaccgtccgcttcagcgtttcgtgtcaatcaccgtaaacgcttcattgaacggccaccaccctatctagtcaagttaagggtaaataaaaaccacagagccgaagtctgtggtttttgaatgactaaaaattagtcttcagatacaaaggctaataagcccatgatccgtgcacgcttgatggcgatagttaaagaacgttggttcttagcactagtccccgttacacgacgtggcaaaatcttcccacgttctgaaataaagcgacgtaataagtcagtatctttataatcgatgtattcgatatggtttgcggcgatgaagtcgactttacgacgacgacggccacctcttctttgttgtgccattgatatttccctcctcgttatctgtctaagcaattagactagaatggtaaatcatcatccgagatatcaatttgatcgccattattagcgaatgggtcagcctgattattgttgttagcactgcttgatggtgccgcactgctagcattaccagtattaccattaccaaatgggttattgttattcgctgatgattgttgaggagccgcattttggccttgattactatacccattattattgttgttgtaattgttattaccactaccaccattggcagactgatgacgttcagactctgcccgtgattctaataatgagaagttttcaacgacaacttctgtaacgtaaacacgtaccccttgttggttttcgtagttccgggtttgaatccggccatcgataccaacaagtgaacctttatgagtaaagttcgcaaaattttcagcagctttacgccaaatgacgcaactaatgaaatctgcttcacgttccccattttgattcgtgaattgacggtttacggcaatagtgaacgtcgcgacggcggcaccaccattcgtgtaacgtaattccggatctcttgtcagtcggccaacaagaattgtacggttaatcatgcagaagcgctcctctcttaaaattaattttgtctattagtcttcgcgtttaacgatcatgtgacgtaaaatgtcatcattgatctttgaaagacggtcgaattcgtttaaagcagcatcgtcagttgctgttaagttaacgatatggtaagtaccttcgttaaagccaccgatttcgtatgcgaaacgacgctttgaccagtcttttgaatcaattactcgcgcaccgttatcagttaagattttgtcgaaacgatcaactaaggctgtcttggcagcatcgtcgatgtcgggacgtacgatgtaagtaatttcatatttctttgattcactcatgaaatttgcacctccttatggacttcaggcccttctttttgaagagcaaggaaagtaatctagctaatgctagatactcacgaatttaaagtatagcatctaaatcagtttgttgcaagggttgaagcggccgactgttacaaaaagatcctgaatccgttacaccaatcaattacgtcaattgagcgatatttcattttatttcccgggaaatatttcttttttctgaaatcctccccttcgcttacatttccccacacccacacagcattaatttaaaccaagtcgacgtcagaataacacgcactgctgtaatcctctcaatcgcacaagccagttttgaccgcgtaaatctaaaattgcttacttcatgttgtcctctcccaatttatcggcatttctgccaatcactggaagatggcaggactaagtgatgagcctccagcagtcaaattattcttcgcaggaagattgtttctaccggttcaaaacaagactttggaggccagaataggaccgatgaccggtaaatcacacacgacccgttgccataataattcttgactcacataaaaaacaagcgtggtcgacaatcttgtcgaccacgcttgttttatcaatttattcgtttgaatcgtttgaatcagttgttggttctgtcgtagtggcatcggcgttgacggtttgatcgtcaactggtgcctcagtcgttgcatccgttgcgacagtctcatcaacttctggctctggatcaaccttggccatcgttgcgacttgaccatcatcgcctaaccgcatgagacgaacacctaaggttgcccgaccagtctgagaaacggttgcgatattgaagcgaatcatgaccccttggttcgtcattaccatgatatcttcttgaccatcaaccgtcgtcaaaccagctaaatgaccattcttctcagtcacgttagcggtcttgattcctttgccaccacgccccttaattgggtaatcggcagctggcgtttgtttcccataacccttttccgtgatgatgaagacgttgctgtcgggcttcaaaacgtcaaagccaatcacaaagtcatcatcgcgtaagcgaatcccgcgaaccccagaagccgtccggcccatggaccgcactgtggtttcgtcgaaactgacggcataaccgtcgtgcgtcccgatgattacattttggtgaccatccgtgattgtaaccccgattaattcatcatcatccttaagcgtaatggccttcaaaccattgctacggatattggcaaattcttgaactggtgtccgtttgacaacccctttaacggttgtaaagaacaggtagttatcagaagcgctcgcatcgcccgtgacattaacgaccgcctgaattttttcaccagaattgactcccagtaaattgatgaccgggattcctttggccgtacgaccgtattcaggaatctcgtaagccttcatccggtaaactttacccgcattagtgaaaaagagtaggacatcatgggtcgacgtcgtcaggagatgttcaataaagtcatcatcatggacgtccatcccttgaatcccacgaccaccacggtgttgcgacttaaattcagtcgttggtaaccgtttgatgtagccattgtgagttaaggtaacagccacttcttcttcttcgatcaagtcttcatcttcaatactgaggacttcaccgaccatcaattcggtccgacgcttatcaccaaacttacgttgaatttccattaattcttcgtaaataatttggttgatacgatccttgctagctaagatttctttgtagtcagcaatggctttcaataagtcctggtattcactctcgatcttttcacgttccaaaccagttaaccggactaaccgcatatcaagaatggcttgtgcctgcttatcagacaagccgtaattatccatcaattggttcttcgcaatttcactcgtttgtgattgacgaataatcgcaatgatttcatcaatgtgatcaagggcaatccgtaagccttcaagaatatgggcccgtgcttgggctttcttcaagtcaaactcagtccgacgccgaatcacgtcttcctggtgttccaggtaatagattaagatttgctttaagcttaagacttttggagcacccttaacgatggctaacatgttaaagccaaagttagtctgcatcaatgtcatcttgtaaaggttattcaagataaccgaggcgctggcatcccgccgaacatcaatgacgatccgcatcccttcacggtcactttcatcattgatatcagtgataccttcaatttccttgtctcgagctaaaccagcaatccgttcgatcaatttagctttattgaccatatatggtaattcggtcacgataattcgttgcttaccattcttttggtcttgaatatcgaccttcgcacgaacaataatgttcccacgaccagtctggtaagccttacgaataccggactttcccattacgatcccgccagttggaaaatctggtccaggtaagacttccatcaagtcagcaactgttgcatcaggattatccatcaacaggtggattgctgaaatgacttccgctaagttatgtggcggaatgtttgttgtcatcccaacagcaatcccagtggcaccgttaacgagtaagttcgggaaacgtgctggtaagactgctggttcccgttctgtatcatcatagtttggttgccaatcaacggtatccttgttaatatcgcggagcatttcaaccgcaatcttactcatccgggcttcggtataccgcatcgcggcagccccgtcaccatcgacagaaccgaagttcccgtgaccatccactaacatgtagcgatagctaaagtcttgggccatccgcaccattgactcataaattgcggagtcaccatggggatgatacttccccataacatccccaacaatccgggccgacttcttatacggcttatccggcgtcacacctaattcactcataccgtaaagaatccgccggtgcactggctttaacccatcacgtacgtccggcagtgcccgtgccacgataacactcatggcatagcttaagaatgacgttcgcatggtcttcgaaaggttcacatccgaaatacgattgttcgataaatctgaatcagccaaaatattcgtcctccttcatccgttttgccgctattaaagcttgattaagctttacatgtctcaagtaaaagtcgccattaagacaaccgtcgtgccattacgaccctaagtctgattaacagcttgcgcctcagttcttaggtcaaaatgactaaactgacacactaaacatccagatcctggacgaacttggcattatcttcaataaattctcgccgtggtttgacttggtcccccatcaacatcgagaagaccccatcggcatccgcagcgtcttcatcacgaacccgtaataggcgccgcttgtctggatccatggtcgtttcccataattgttccgcgtccatttcaccaagccccttgtaccgttgaacaactggtttcggtgatggtgccaattgccccatgacctcactcaattcttcatctgaatcaatatacttcacaaatttaccttgccggacttggtacaacggtggttgagcgatgtacacaaagccagcgtcaactaatggccgcatgtaccggtaaaacaacgtcaataacaaggtccgaatatgggccccatcgacatcggcatcagtcatgataattaatttgtgataattggctttgctcaagtcgaagtcaccaccgaagccagttcccattgccgtaaacaatgaccggatttcttcattggctaaaatcttatcaatgctggccttttcaacgttcaaaattttaccccgaatcggtaaaatcgcttgcgtcaaccgggaacgtccctgcttagccgacccaccggcagaatccccttcgacaatgaacaactcactaatttcagggtctttactactgttgtccgccaacttacctggtaaattactaatttccaagccactcttttttcgcgtaacttcccgcgcacgcttagcagcgacccgggccttggaagcaagtaaccctttatcgaccactttacgggcaacacttgggttttccatcaagtacttgctaaagtgttctgagaataaccggtcaactgctgcccgagcatcggaattaccaagtttcgtcttcgtttgaccttcaaattgaggatccggatgcttgacgctgacaacagccgtcatcccttcacgaacatcttcgccagataggttcgcatcgctttccttcaacaagttattcttacgagcatagtcgttgatgacccgcgtcaaagcacgtttgaaaccttcttcatgcgtcccaccttcgtacgtatgaatattgttggtgaaggtcatcaaattactgtggtagtcgtcagtatattgcaacgcaacttctaccgtaatcccattctgttccccttccacataaatcggttctggaaatagaacggtcttattcttatctagatattcaacatagtgacgaatcccaccttcgtagagaaagtcatcttcagtgggttcatcagggcgattatcccgaatcgtgatccgtaatcccttatttaagaaagcgagttcgcgaatccgagtcgtcaaaatattaatgtcataggtggtcgtttcccggaaaatatcaggatccggaacaaaatgaaccgccgtaccatgagcatcatcaggcgcatcaccaatgatcttcatcggtgttttaacctttccacgttcaaagtccatgtaataaacatgaccattccgagttactttgacgtccagggtcgatgataaggcgttaacaacggaagccccgaccccgtgaagaccaccagagactttataaccgccaccaccgaatttaccaccggcatgtaaaatcgtataaaccgtttcaagcgctggtttacccgttttttcttgaatatcaacaggaatcccacgaccgttatcagtaaccgtaatactattatccttttcaacggtcacgtggatcacgtttgcaaaccctgctagggcttcatcaattccgttatcaacaatttcccaaactaagtggtggagtccttggctactcgtcgtaccgatatacattccgggacgtttccggacagcttctaaaccttccaaaacttgaatttgactagcatcatattcgcgagcctgttcaagtttggtttctttttcgttttcggtcaatgcggttcctcctcatgtaaagtgccatggctaacttcaaatacttttggcgcattaattaatttgcgggccaccccgtcaagacttggcgtggttaaaaaggtctgcactttatcttggatcgctgtcagcagatgagtctgccgtgcagcgtctaattctgataagacatcgtctaataataagaccgggtactcgcccgtctcagctttcatcagatcaatttcagcaagcttaacggacaaagcagttgtacgttgttggccttgggagccaaaagtctgcacatttttgccgttaacaccaaattgtaaatcatcgcgatgaggacctaataaagtcgttccttgaaaaatttctttggcttgttgttgctgatataaggcctgtagcgtttgataaatgtgatcgaccgacgtctggtcggcagttggcacttgagtgacatagtgaaacgttaattgttcctgttcttgcgtaatctcgctgtgaacagcttgcgcccatttctcaagttgctgcaacagttgtagtcgtttatggatgatttccgcaccaaatgcagccaattgatccgacaagacacccaaataaaccttatccttggcctgctgccgatttaattgccgtaagtattgattacgttgttttaaaatcgtgcgatactgacttaggttatagaggtatttagggctcatctgaccaaattccatatccataaaccgacggcgaaccgcgggtgcccctttaacgatggataaatcttcaggtgcaaacacgatcacgttcaaatttccgacgtactgggataatttggcttgctcaagatgattgactttcgctcgcttgccccgccgccccaattcaagttccagggggacagcaccggtacttttatgtaaccggccttgcaacgttgccgtggtggtttgccaccgaattaattccttatcgttagcggtgcggtgactacgcgttaacgccaacacataaatggcttccaacaggttcgtctttccctgcgcattttcacctaatagaacattaacgccctgactaaaattaatggtcaaatccgcgtagttccgaaaatcatgcaagactaagttttctaagtacatctaatcagtcgtttcttgatttgagcgaataaaaaatgacccgttgtcttcaacttcaatcgtatcgcctggataaagtttccgaccccgccgatcatctggttcaccattaactaacacggttgtttcttttaagaaccacttcgcctgaccacccgatccaatgatggccgtttcttttaagagttgccccaacgtcatatatggggttttaatatctattggctgtttcacaatgtcacctgcctatctgattacaagctattaaacgactgtctggcgtgctacacacactcctaacaggttatattatacttgttttttgatgaaaattcaatttataaccgcactcagagccattttaagacgatttaaggctttttaatatcgggatactagcctaggggtaaatttgctgaaattccctaattttgcggattttaataaaatatcttgttttttacctataaaaattggctaaagccagcattcattatctgaaagcgagcgtttgtagcgaacgagtgcaaggactggggttcatcagatggtgggattttagtagggcaacatcgatagttagcgtgacaattcaccagcagctaatataatatgcataagttaaaacttcaaaagttacatcatcgctattgcctattcattgccccatctttagctagttttagccgtcataaaaggcccgcatttcacggtgaaatgcgggccttttatttagaattgtatatttattcagctaattaaaacgttcgaactggtgtaatcaactgaataaagttttcgccttcttcagttggcactaaagtgaatgggcgcaatgccatcgtgaatgagattttgatcatagcttgcccaaacgaacgtaacgcttctttcatgtagtctgggttaaacgaaatttcaagttcgtcacctgacaaatcagtgggctgtagttgttccgttacttccccgacatctggtgagttaccgaaaatcgtaatcgttttgtccgttgggttaacggagaagcgaaccacattattgcgactttcgtgtgataacagggatgcccgttcaattgctgctgaaagtgcgggtgctgaaatttcaacagtcgtattagattctttaggaatcagccgtgacgtgtcgggataatttccttcgagtaagcgagaatagaaggacgtattccccagcacaaataggacttggttttctgataaccgcatctgcacgtcaggattattgtcgccgatcatccgagataattctgtcaaacttttaccaggaatgattacatcataattggcattattggcttctggcaacttgatccggcgttgacttaggcggtgtgaatcggttgcgaccgctaagaactcaccgttagctaagataaaatgaaccccggtcaggattggccgactttcctgattggaaacagcaataacggtctgaccaatcaactctttaagtacatccccagctaacgtgatggtattagtcgtatcaatttcaggtaagtgtgggtagttttcagggtctaagccgttgattgtaaaggaagcggctcctgaagtaatttgtgtttgaaaaccgtcgaccacgttaacagtcatggtgtcttctggtaatttttttacgatttcactaaagaaacgggcaggtaaaacgattgaaccggcatcttcaacgactaacgtattgttgtcatcacttgctggaatggtggtttcaatagaaatatcagcatcactaccagttaaggtaatagcgtcagtattaacgtcaagtttaagaccagtcaaaattggaatggtcgtttttgaagaaatggcccgttggacgttatttaattctttgatgaaggcagatcgattgatcgtgaatttcataagttaatcccctctttattctagcgacgggcactagatatatattaataataaaagttcgtagtaatagtagagcagtgggtactgtggaaaaccgagtaaagactcggcgttatcaagttttccacatgtgtataagttgtggaaaactttttgagttatccttttttatccacactaagatttgagctggcctgtcaaatcacccacggctttttgtaattcagcatcagttttgagtgccttagtgattttatcatgcgcatggatcacagtcgtatggtccttaccaccaaactcgttaccgatgcgcggaagtgaactttcagtcagttcgcgtgataaatacatggcaatttgacgtggaatcacgatttgtttattgcgtttctttcccttaaggtcagccattgttacatggaagtacttggcgactttttcctgaatgacgggaatcgaaacctctgatagtttactgctaaggtgcaaactcttcaatgcatccgccactaaactggtggtaatcggtgaattattcagtcgtgagtatgcctgcactcgtgctaaggcaccttcgagttctcgcacgtttgagtcgatctgaccggcgatataacttaacgtatcgtcagggatttcgatcccttcaagatcggctttattgcgcaaaatagcaatccgcgtctcgagatcaggtggggtaatatcaacggataatccccacttaaacctagaaactaggcgatcttggagttgcggaatttcgttcggtaagcgatcggatgtaagcacgatttgcttatcatcttcatataaagcattaaatgtatggaagaactcttcttgggttgcttccttattggcaaaaaattgaatgtcgtcgactaataacaggtcaacgttccgatattcttcgcggaacgcctcctgttttttagtttgaatggcattaattaattcattcgtaaaagattcgctagtcacatatttaatgttactagtcggatcggtttctaacaatttgttaccgatagcgtgcattaggtgggtttttcccagaccaacgcccccgtagaaaaacaacggattatacatggtgccaggttcttccgacacaactaacgcagcggcatgggccatttgattgcctttaccgatcacgaaagtatcaaaagtgtatttcgggttgagtttcgtttcccgcataaatgtgggggtagttgcggttgttggttgttgtcccgcaacgttaccggtagtcacttgcgagtccttgtctctcgtaagttgctgacgttcttcttccgttatcatgaccggccgaatctgctcgttagtcgcttgcatcgcaatgtccgtgaactttgcggccaagtttttctcccaatagtcacgatgaagttgtgttgggacttcgatcgtcatttgggctttatcgagttggagtggttttgccggttcgacaaacgtttgaaacgtgatcttggacagatcttgttccatagagaacttaatgagattccataagtcattacgttccagcacgtggataccccttttcttaaaaaacgtaattctattttagcatgaacatatagagttttccacaagtggacaagttaaagttaagagaattcacaggctgggatttgaatatacacagcttgtcgaaaactaggaattaattttataaaacagcacttatccacaaaagcgagttcaaaactaaagccgcaataaaagcgtttattggagttatacacacaacaaatacgccctgtggataactaaataacaacccgttaatttgtcgaaaaacttgtgggtaaattgcgaataacggaaagtcactttgctataatccacaaataaattcgcaattaaataattttttgacctcgaattactacggagaaatttaatttactggttttcaaacaaataaaaatatgctatagtagtcaggaaatgcgtttagatgtaaactgcgttttgaaaataacgacttaatcgaattgattcatgtcattatggagaaggaggtgtcatgatgaagagaacttaccaaccaaagaagcgccatcgtcaacgtgtacatggtttccgcaaacggatgagcaccagcaatggccgtaaagtgttagcccgtcgacgccaacgaggcagaaaagtattgtctgcataggccactgataatcagtggctttttctttacagtcctagaccaggtgtttagggctgtaaagttgtgtagcaattcgctcaagagcttgagcgcacacatggagatggattatgcgaaaatcatatcgggtaaaaaaagaaactgagttccaacaagtttttgagacccgcaactcgtatgccaatcgtcaatttgtcatttacgttttggaaaaaccggggcaaccccatttccgcgtcggtatttcggtcggtaagaagatcgggaacgccgttgcgcgtaactgggtcaaacgccggattcggcaatcaatcaccgagctaaagccgcagcttaagcaagatgcagactttctcgtcattgcccgaccaaccgttgctggtaagtcgcaagccgaaaccaaagcttatctaagccatgcgctaaagctagcgcacctgctggacaatgattaaagtgaggacattcgtttgaaaaagtacagaaaaatactggcaatgctggccgtactagcgatcgtactagttttgagtgggtgtagtaataccccaatcacggataagagcaccgggttttgggatggcttaatcatcttgaacttctcacgggcgattatttggttatcaaacttgtttggtcatagttatggtctcgggatcatcgtctttacgttgatcatccggatcattatcttgccattgatgatcttccaaacccgcaacatggtagccatgcaagaagtccaaccgcagatgaaggctttgcaaaagaagtattcgtcacgcgatatggaaactcagcaaaagctccaagcggaaatgaagaagttgtatgccaagcatggtgtgcatccaatggccagcatgttgccattactagttcagttgcctattttgattgcgttgtaccaagcaatctggcggacacaagccttgaagaccggttcgttcttatggttgcaattaggtagcaaggatccgtactacgttttgccaattctagcggcgatctttacgtttgctagttcctggttagcgatgaagtcgcagccagaacaaaacgggatgacaacgtcaatgacgtatttgatgcctgtgattattttgattacggccattaacgtgccatcagcgttgtccttgtactgggtgatttccaacgcgttccaagttggtcaaaccttgttattacaaaacccattcaagattaatcgcgaacgggaagctaagaagcaagctgaacgtgatcgtaagcgaacgcttgaaaaagctagaaagcgcgcgattcgtaatcataaacgttaaatacaagtagacctgccatgtgtggtgggtcttttttgttggctctgtatcatctttaccaatcggtcaatatgatttggactgtgatggcaggatgctaatgtgcgtttatgtaaggcccctggacggtccgtgatgaggaaattgtaatgaacgatcaaatactggtaatagtaatcatccggggatcaaggtgcctataaaaataattgtctgcaccattttatcacatgtttttaatagcgtgccgcggtttgagagagctactttgtcagtcgtaattagaacgggcgattaaaaacgtaatgacccggcgcatgaaaaagttccaaaaaaagatttgacaaattgaaaaatgaccgctaagatgtgaatcacattaaaaaataattagattaagcgaacggcagtcgaggagtcggttatcagtcagttacagcgagtcgcggatgatgaaaagcgatctgaactggtagctaaaagtcgattactagtgagaagttgcgtgaagcaatttccgggtgtacccgataacgtaccaacatatcgtcaataaatttggccgtatgtaagtggtgagtctgactggctcgcaaatgaggtggtaccgcgtgaagacgtccttttaagcataacagcttagtagggcgtctttttgttttgcgggatgccggttgatctgattaaaatcaaaacataatggagggattagagatgcaagcaaagtatacatatagcattataggggtggtgagcgccttattattaaccggctgcttgggggcggtctctaattcttcgaaaacgaccagtacggctgatcaaaataggacgttaggcatcacgattcctggcgaaccgatgacgactgatccaacgacttcgatcgaaaccaacggcggtgccgtaattacacagactggtgaagggatttaccgcaaaaacgcgaataataagattgttgcgggggtagtcgagaagaaggtcaagcctactgaaaacaagacccggtatacgtttacgattcgcaaaaatgcacgctggcaaaatggaaccaagatcacttcacaagatttcgtgacggcgttgcggcggcaagctaatccaacaacgaagtctcaaaacttggatgccattagttacatcaagaactttgatgccgttaataaaggaaaaatggccgttaataaattaggtgtgacggctattaataagcgaacgttttccatcaagttgagcaagccggtgccttatatgaattatgagtttacgagcttttacccactcaatacggcggcagtccagaaatacgggtttaagttagggagtaactcagcgacgacggtagcaaacggtgcctacgttattaagggctggaaaggctctaatgatagttggtattacgttaagaataagtactactggaatgccaagaacgttaagatcaagcgcatcaaagtcacggtcactaaggatgataatacggcgcagaacctcttcaacgccggaacggtccaagtgaccaacatttcggggcagtacgtgaagaataatgccaataatagtcaaatgacggtcactaaaactggccggaataattacatttatttcaatagtaagaagtccgtaactgccaatgagaatttccggcacgcgctaagcctggtcattaatcaaaaaacactagcaaaagatgtcttgcaagacggctcgcaagccgcgacgaacattgttccgaaaaactacgcgagtgatccgactactggtgaggattttgttaaggaagttgggaacttatcaccgactaatatcaagcaagctaagcagtattggcagaaggcccaaaaggaactcggcaagcaaaatgtgactttgaattttctatgcgacgatacggatactgagaagaaactcgctgaatatgtccagggcgtggccgaaaagtatttgaaaggcgtgacgatcaagatcgttgcggttccacacgcgacccacgtatcacgtgattttacggggaactttgacctcgtcacagtcggttgggggccggattatccggatgcccaaaactttttggatgggatgcagagctcgaatagcatcaactttactcagtggaaagatgcgaagtacgatgcgttgatggccaaggtatctaatacggcgaaatacacggccgcgcaacggtggacttatgaaaagcaagctgatcgccggttgatgaaactcgatgccgtgattcccacttaccaagcctcttctgcatttttggtcagcaaggatgttggtggcttgcaatgggatgaattttctggaacgtccagtcaacttcaatatgcttattggaaataaaaacttgtcatgaaaggtggtgaggcgtggtgaatagtcagttagagaaccaacaatgcagtgatgaaaatgatggtccgttaccgttaatgaacggtgtgcgacctgccaaaatgaaaggaagtcattattatgaccaaaaccaactatatcaatgcctcaatctacagttcagaaaagcaaacttttatcgataatcaattcatgactgttgacgacgcaaccggaaaaatcatcgcggtcggtacaggaaccccggatacgattgctgaacaaacgacagacatgcaaggaaagtatgttatgccgggcatcatgaatgcccatacacatattaccagtattccaacttactggtggcatgacggccaggaagaccgccatccggagtcacgtgagtataataccatgtatgcgattcacaatatgcaagatatggtaaaccatggggtaacctatattcgcaatgttggcgcccagtatgatattgacgttgcgatttcaaagatgcaacgagaaggaaagattgcgggtcctcgcgtgatgacatctggccaggccttttcaattacgggtggtcatggtgcggatggcggccacgaagtcgatggtgtggatgcggtcgttcaaggtgttcgccaggcccttaaaatgggcgtcgataatatcaagatgatggttaccggtggggtacttcgaaacggcgagaccccagatgatattcagtttaattttgaagaagttcaagcagccgttgctgaggcccatcataaaggcaagacggtggcggctcacgcgcaggggaatgccggggtaaaagaggcggttcaagccggcgtcgatactgtcgaacacgcctttgatattgatgatgaaacaattgagatgatgcggcaacatggcactgtgatcgtaccaacgatgaacgcgatgtatgctatttataaatatggcgagaagaccgttccagcatgggcgcgtgaaaaggtaatcgtcaacatcaagaagcattttgcaagtatcactaaagccgcggcggctggcattcccatcgcgatggggacggatgctggaacgccttataatggctttgaggatgaatcagcatacgaaatgcagctctatgtcgataaggcgggcatgactcccgcacaagccatcgatacggccacaatcaactgtgcccgtgcgatgcatgttgcggatgaatacgggacgatttctgctggtaaatttgcagattttattgcaatgaccgccaatccaatcgaagatattcgggttattcagcaagataaggatgttttccaacatggcattcaagttcatcaagcggctaaaacggccggtgttgatgagcaagttcctgtacggcaggtcgggtagtccgtcttattgagaatcagggctaagtgtgggtagtcttgattcgtcatatgaccagttagtgtactgacaggtgggctggttctggcttgaatttgatagtggtttgatttagtggccaatcagtaggtcagatgccgtgaattagtcggctaaaaatactagcattataaaccgattttctagtcattacggacgggaaaatcggttttattgagtttagagcagctttgatacggctcgcgagtggcaattagtaaatacggcaaagggaggctgtgggccgcgtctctgaaacgcgccatgaacaggttggttattgacataataagcactagattttgctagtctgagttttcaggggtagtagaacggccgaagtcctaatcgttgtaagggttcattaagtgttcatactcaggtgttcgcatggcgaatggtaatgctataatgaaagcaggatttttaacgaggaggattcaagcatgacagtatttgaaggtaataccgtcgcggccgcaatcgcggctggtctaaaacaactgcaccgaacacgcgatcaagttgaagttgaagtgatcgctgaagcaaaaaaaggatttctggggctaggcaaacaccccgcccaagtacggctaacggtggtgccagcctccgcagcacctgcaacgacgccaacttccgctacggcgacagcgcaacagtcagtagctactgaatcaacgacagcaccgaccatgccgcggcctaccgtgcggacaccaaagtcaacgccgaccagacaagctaaaactagtcaggccacgaccagtgccgcaaaaccagcgactagcaaggcgaaagcagtggctaaacccgcttcaatggcggttaccaccggcccggttatcgctgataccgaccaatctaaaccagcgaccactagtaagaccaaatcagtggctgctgaccagagccagacgccgcggacacccgcagaaattgcagcgcgccaagcagctaacgagaccgcggtgcgggcgttgtgtgattacttgcttgcggtggtcaaagaactaggtgtcacggcggatcttgacgtcgacttcggcaaccgctatgcgacattgaatttcgatacaactaagcagggtttgctgattggcaaacacggtcgaacgatcaatgcactgcaagatttggcgcaagtttatatgaatcatcatggtgcgtcacacgttaacgtggtgctagatgtggatgattatcgggagcgccgggctgcgacacttaagcggttagccgagagtacggctcgagaagtgattgcaacgggcaaacaagttttcttggacccgatgccatcgtttgaacggaaattaattcacgctgaactagcgaataatcaccatgtaaccacattctcagaaggccgcgatccgcaccgggccgtggttgtggcgattcgcaaatagtttattcaaagtaacgcaaacaggcgtttgacaaactccgggtgagctattatagtaggtgttaatcattcttatcttttagataaagtagtcaaagtgctttatccacgctttaaggtggcgtggactaggcgctttttttctgcattttaggacatattattaactaattgtaagtaaatttggtatggtattaggcgatgaaacgctgacaagaaaggacatgatggtatgccaacgaccacagaatttgacacgatcgcggcaatttcaacgccgcctggtgagggtggtatttcaattattcggattagtggggaccaaacgtttaacgtggtgacccagatttttaagggtaaagatctcagtcgagtgcaatcacacacaatcaactatggacatattgttgatcctgatacccatcaggaagtcgacgaagtcatggcgaccgtaatgcgcgcgcctaaaacctatacgcgtgaagacgtggttgaaatcaactgtcacgggggactcgtggcaactaatgaaattttacaattgatcttgagtcacggtgcgcgaatggcggaacccggtgaatttaccaagcgggcattcttgaatggtcggttggacttgtcacaggcggaagcagttatggatctgattcgtgctaagacggataagtccatgaaggtcgcgttaaaccaattagatggtgatctatctaagctgattcgacatttacggcaagatattttggacgtattagcccaagtagaggtcaatattgattatccagagtatgacgcggttgaaacaatgaccaccaagatgctgaaggagaaggctaccgaggtcgcccaaagcattaatcaactgttagcgacggctaagcaaggtaaggtcttacgcgaaggtttggcaacggcgatcattgggcgtcccaatgtcggtaaatctagtctgcttaaccaccttttgcatgaagacaaagctattgtgacggatgttgccgggacgacccgcgatgtgattgaagaatacgtcaatgttcgtggagtgccattgaaactcgtcgatacggcaggaattcgggacactgaagataaggtcgaaaagattggggtcgagcgaagtcgcaaagcaatcggggccgccgatttagtcttattagtgttggataatagccaaccgttgacggctgaagaccgagagttgttgcaagagactgaccagtcaaaacgaatcgttatcttgaacaagactgatctaccagcccgtcttgatcaagctgaattggcgcaattagtcgatttgagtgacgttttaagtatgtcagtcttggaacaaagtggcgtcacgcaacttgaacaacggattgccaagatgttcttcaatgaaggtatcgaaagtagtcaaaataacgtgatggtgaccaatgcgcgtcacatcggtttgttgaatcaagccaaacaagcgttgcaagatgttcaaacgggacttgcggctggtatgccagttgatttggttcaaatcgatatgacccgttgctgggaattcctcggtcaaattaccggggatagctatgaagatgaattattagaccagctatttagtcagttctgtctgggtaagtagtggtaggaggaaattggaatgacagaagtaaagcagtacccaggccgcgactatgatgttatcgtcgttggtgctggtcatgccggttctgaagcagcattggccgctgcccgaatgggtaaccggacactcttaatgacgatcaacctagacatggtggcctttatgccatgtaatccatcggttggtggtccggctaaaggaattgtcgtccgtgagattgatgctttgggcggtgaaatgggccgtaacattgataagacttacgttcagatgcggatgcttaatacgggtaaaggcccagctgttcgagctttacgggcccaagctgataagcatgcttaccatgcggaaatgaaacacacgattgaacgggaaccgaatctgacgttacggcaaggaattgtcgatggcttaattgttgaagatggggtctgcaagggcgttatcacgaatacgggagcgcgctatagtgccaagagtgtcgttttgacgactgggacggcggctcgtggcaagattatcattggtgaactaatgtattcttcgggtccaaataattcgcaaccagcgatgaagttatctggtgatctggaacgacttggatttaacttggaacggtttaagaccggtacaccaccacgagtcgatggtaatacgatcgactacagtgttacggaagaacaacctggtgatcctgaaccacatcattttagttttgaaacgaaggatgctgactacattgatctaaagcatcaattatcttgctggttaacttatacgaatgagacgactcataagatcattcgtgaaaatcttgatcgagcaccaatgtttacaggcgtgattgaaggggtcggaccacggtactgcccatcgatcgaagataagatcgtgcgattcgctgataagaagcggcaccaattattcttggaaccagaaggccgtaatacggatgaatggtatgttcagggcctttcaacgtcgatgccggaagaagttcaacagcggattttacattccattaagggtcttgaagatgctgaaatgatgcgcccaggttatgccatcgaatacgacgtggtggcgccttaccagttaaaggcaaccttggaaacaaagttggtcaagaatctctatactgctggtcaaacgaatgggacttctgggtatgaagaagccgctgggcaaggattaattgccggtatcaacgctggtttgcgagcccttgatcgtggtcaattcactttgaagcgtagtgatgcttatattggagtcatgattgatgacttagttaccaaaggcaccaatgaaccctatcggttactaacgagtcgggctgaataccggttgatcttacggcatgataatgctgatttgcggttaacggataagggccgcgagttaggattgattgatgatgaacggtatgtggcatttgaggcgaaacgccaagcaatcaagaatgaacttgaccgtttaggcaaaatcagaatcaagcctaatgatgaggtcaatgctttcttacgtgctcataattctggtgagcttaaggatggtgtgttggcggcagatttcttaaagcggccagaggtacaatatgctgatttaatgaaatttatcccggcagcacccgaaccactagaacggcatgttattgagcaagttgaaattcagatcaagtatgccggttatatccaaaaagcagaggaacgtgttgatcggttgaagaagatggaagctaaaaagattccggatcggatcgattatgatgcgatcgacggattagcgactgaggctcatcagaagctaaagaagattcagccgacaacgattgcacaagcttcacggatcagtggggttaatcccgcggatattgcaattctgagtgtttatattcaacaggggcgaatcgctaaagttcaataatcatcagtagtaggttatgactggtgtgttcagttgatattaacgaatgatgaaagaaaaaattaatatttttaacgataaagcacaattccaacttggaattgtgcttttttagtgagcttactttttaattagtacacgtttcattaaaaaaacaacaacactttaattaatgatgactaaattaaattaaggtattatacttcagaactagtaaacattgtttacagtgtttacaaaataaagggggagttattgttggtaagagttagtaagttagtcagtggtattttagtggcaagtagtttattagtgagttcgggtgtcatcgctcaggcagatacgcctgctgctcccaacgcagatagtacggccaatacgactggtacgactgatattcaggcgatgtttaaaggaaatagtagtccggtatcaccagttaatccggataatcccaataagcctgataatagcggtgatagtggtaacggtgctaaagccggtggcggcttatcgctgatctacgtttctaataaattagattttggaagccatgagatcgatgttttaaatccagaaacgtacactgccgcagaaactgattcggatttatcaggcttatggaacaaaaaagcagtcacagaagtatctgatgtccgaggaagtaatgctggttggacactggccgttgccgggagtagtttgactggtacagacggttctgtaatgaaaggggcaacgcttcagctaccaaaaggtacggtaactaattctggtgcaactaataatggcgtgcagtccactgaggctcttaatgtgttagatggtaattcggcgacagtattatcggcagcgaaagatcatggtgctggtgtaactgttgatcaaattgatccaagtaatgttaagttaacggtgccggcaaacacggctaaagcgcaggggtaccaaacaactttgaactggagtttgagtgatacaccagcaagttagttagaatataaccaagaggggaagctaaagcagatggcgatggctaacggttattatggataaagtaatcgttgatgtaatcgcgagcagtggcttcccttttattaaatgatagctttaaaagatgcgtcataatatggggtgtgttgagattgaaagtggttatccaattcataagactaatgggtgtgagtcttggatttagtattttaatcggacagacaggagtgtcggctaatcggcaacaatcggtccacaacaacaatgtcggttttagtgttgccgctgagataccaaaaaatcagattcataaacaaaattctttttttgatttgaaaatggcaagcggtcaacagcagacgttacggacagtcatttacaatgtcactaataaggatattaaggttcgaacggctattcataccgcgtatacgaatattaatgggacgattgaatatattaatccggccaaatcgtacgatcagtcgttaaaataccgagtcagtgatttagccacaattcagggtgagcggacaataacgattccggctgaaggctccaaaacggtcgcaatcaaggtgaagttacctaagcagccagtaaatggcgtcttgttgggtggatggtattttaaacgggttgatgacaaggtaacaggagtaacggagaaaagtatcaacgttaagaatgagtattcgtatgttattgggttgaaattatcttcaggaaaattgccaattcctaatttgtgtctagggccggtgaaagctggcttgaacaattatcatcgaagcattattgttgcgctacgtaatcctgtcgcaagaattattccgaatttaaaaatccgaacggtgattattaataagcggcatcaaaaggtcattattaagaatacgaaaacgggtgtcatgatggcgccaaacacagtttttaaagcaccaatgccattaggatcacaacaattacaaccgggtgattatcagttacaaatgacggttaataatcagcgtcatcattggcgatttaaacgagattttcatattagtatgacagcagctcaaaaatataatcatgagtcaattgataataagggggttagtatgtggatgctaattggaattggcgcaatttcaatgctagtactggggttagggttaggcgtaatcgtctggctatggcggcgacaacggcggtcgaaggattaggttaattaatgggggtaggatggtgcaacggtttagcgtgtgtgtagcaaccattttaatcagtttaataatgttcacaataacgggagttgcggccgttggggggcggtcaacagtcaccgttagcttttatgctggtcagagaactcagcaacagatagataatcgcaacgttaagattcctaatggaaccaggccatatcgtgtggtgacagaaaagacgttgacaagaccaaaggggtattatcaattaccacagactgatgagcagctcttaacctggttttatgcgagtttcggtagcgtgctactgatattattgatggttatccgttggtttaataaagaaagctattgctaggtaaggagggaccgtagaagtgagaaggttacttactggcacgttggtcgtgggtgggctgttattggtagtttgcctcatggctgttaatgggcaggcaaaggttgtcgatgagccgaccagtgcgatgcaggatattacaactaatttcgaacaacgaacaattggtcgagtgccatggcccattacacacattgcggctaattatgtgcgagatggtcacatgacgcacaagactagtcgagtgaaaattactttagggaaaggtgtagtacattcgccgaatggtaagggattatataatttatgggatctggttttgaatcgccaaggcaaagagtatggcgcaactttcctggcgtataatatcaataatcgagtttggcgaccgcatcgaacagatactatcaagacgcatggaatcaaagcaggtcagccggtttggattggtaataagagcagtactaatgcgagcagtaatcccattcgaacactgcctgcttacatggtaacgaagcagtactgtcaaatggttagtcagattaaattatcaccacatattactggatttgaggctaataagcgcatcattaccgggacgggcacacaaggtggtgatctaatcatggctaaatttggtaatcagatcaaaaaaacacgagtcgatcatgaggggcgctggcagatgaaatgctttagcggtaatggtcacttgatggtaacggaaacaaatgcgtatgatgatattccagggcacactgaaacggtgattaataacggaactccacgaacggatgcgacgattaagctcaacttgtttttaactaatggtcataccttttcaaccgctaagggacgcaaggtattagtgaccggaatgatcttggggactgatcagaatgattttgatcgcgatgttgttttaaaaaataacgcactaaccatccactttgcccatgctgatggaacgcccatcgctaattataaggctaatggttcggtgaatgagccagataaggcggggtattttcatctgaaattacccactgaatcgcttaaacaagggcctaatgatgtgaaagtgtgggtgtcagatcaacacggccaacgatctaatattgatacgttaacagttaatgtaaattcaggactcatgtttggtcaaatcaatgctcaaatgcgttttcggagtaacacgattccacaaagcgagcgcttattatcgcccacaaatcagtggcaaattgaggttcatgatacgcgatcagttgcttcaaagtggtatgtgtatgccaccgcaactaaaatgaagtctgctcaacactcattaattggggatttggtctatattgatgctgctggtcaaaaacatgtgatgaccaatcaggaaacgttggtaggccatggcacacatacaaatcctaatcaacaaactacaaatattgcagcaacctggcaagcgcgacaaggtatttttctcgatgttcagcccgaattgtatgcaggatcctatcatggaaagatcaattggagtttgcaagatacaccacaatcttgatgagtggaagaaagatgtcatcaagatgtgttagttagtcattaaggaaattatgaatgaccgtcaagattgttttggcggtcattttagtgtgatatcgttgcaaggttacttataaatttgtaaaaacgattcaccaataccagacaagctgagttgattggactataatgattggaagttatagcggggtaagggagaacgtttgatgaaaacttttaagagtattatgagctgggtactaccaattgtagtggggttactcgtcgccatggtgatcaggcactttatttttacgatggttcgggtggatggaccgtcaatggaacctaacttagatgacaatgagcgcgtcgccgtggtcaagacagctaagattcagcacctcagtgtcatcgtttttaacgcctatcaagttgatccagacgcacgctccaagacggtcaaatatgtcaaacgagtgatcggaatgcccggtgatacagttaaatctgaagacggccgactctatgtcaatggcaagcttgtcccgcagaagttcatcagtcagtatgagcggacgcagggaacgacaaattgggatttgagtacgctggagaaccgttacagttggaatctgaaaacaactaaggtccctaagcattcgtactttgtgttaggtgatcatcggtcagtgtcaaatgatagtcgttactggggatttgtcccagccaataaggtattgggtgtggtcaaagtgccattttgggactcgaataaaactaagcgccataatattaattcaattagttactgaatagcagccagcgcgactcgttagtgagcgcgctttttttgtatgctcaccaactgaattgtaggggggaactaagttggttagtcattctttacagggagaacaacgtgggatggttaaagtgactaatgttgttcagaaaagcaaacaaaaggtagcatctaaattgaatttaatggtcaataagcctagaataatggcaagtatcacgatggaggctggtaaatatggcaactgaactaacaccggatgcacttgccgctttacggacaacgcatgcgcaggatcgaatggcaccagtattgacgcgagcgattacgaagaatgggattgaggctgcaagttttgataatcaagctgcgagtcgcttagcgcggactttttctgttgaagtactaacgggtaaggtcagtaatcagaagcacagcggtcgttgctgggagttttcattattaaacacgctccggcataagtttgcgacccggtatcacgtcaaagactttgagttatcacaaaactatttgtttttctgggataagattgaaagggctaatattttttatcggaatgttgaacaaacggcgcgtcagccgattgatgaccggcttgttcagttcttatttgctaatcccggcgaagatggtggtcagtgggcgatggcggccagcttggttcaaaagtatggtgtcgttccagctagtgtgatgccagagtccttcaacactgataatacgacggcatttcaagccagtttatcacggcagcttcgtaaagatgggttaaaacttcggcaactcgtgatggatggtgcaagcgaggccgagctacaatcactggagaaatcaatgttgcaaacggtctatcggatgacggcgtactcatttggtgaaccaccaactagctttgatttagaatatcgtgatgatgagcaacagtaccatcgtacggctaatttaacgcctcagcaattctatcaggactactttgaaactgatctggatgattacgtggtcgttactaattcaccagataagccgtttaatcgactttatagcttgccagacgaggataacgtgattggtggtaagcctatcgaatttttgaaccttgatatgggtgtgctgacggacgttgctgtgcaacagttacaggctggcgaaacggtttggtttggcaacgatgtgttgcgacagatggaccggaagacgggatacttggatgcccatttatttgaaactggcaagttatttggaaccaacgatcatctgactaaggcgcaacggctgttaacaggtgaaggtgaagttagccatgccatgacgttaaccggcgttgatttagtggctgatacgccaactaagtggaaggtcgaaaatagttggggtgagcaagtaggtgatcaaggctacttcgtaatgagccaagattggtttaatgagtacgtctatgaagtagttgttcacaagcatttcttggcaccggaatttcaggcgctgcttaacgaacgtgcacagcggctacccgcatgggatccgttgcactaggagggtaatgtgatgggaatattttcagaacgattaaaagaagcgatgcaacaagcgaacataacctctgctcagttatctaaacaaacgggaattggtcgttcatcaatcagccagtggttaagtaataaatacgtggctaaacatgataaggttacggcgttagcgacagtactgaatgtgtcgccagattggctgctaggtacgactgatgttgcaacagcggtggccccggaagcggtaccgattccagtatcggtcacgccaacccctgccgttgaccccgaattaataacattgtgggaacagctggataccaaacaacgatctaagttgatcaaaaaggcacggaagttgttgactaaatcggccgaacagcccaacacaaagcggaaaaagaacaagaaaaagaaaaaaggcaagaaacggaaataaggcaatgcaaaaaacaacttttgctcctcagctcgtcgtgaggagcaaaagttgttttttgactgtcatgatgaattatcaggggttgataatggtgaactaaatggtccatttttcccagtcacgcgcccaaatcagtcccatgacgccttctccaacgtgaaccccaacgacgggaccaatctcgccttcatcgatggtgagatcaggaaagctagccttcaagtcagctgtccattcggcttggagtttcggattgttgccattttcgattgtgacgcgaagtggatagtcaacggcagcaatctcagcagccagcttggctttgatggctgcgtatgcccgccgcatcgttcgttctttttgaatagcgacgatcttgccatcttgaaaggtcagaacgggtttaatgcgtaagaggttgccaacgagtccagaagcgtttgagagccgaccagtccgaaccaagtgactgagattatcgacaacaaaatatacgccggttgtttcacggatttttttgagctgagcaataacttgttcgggtgagtatccttcagcgactaatttagcagctaacaagaccatgtaagcttctccaccagccgtaattagtgaatcaaacggataaaccttgatgttggttacgtttggcaggtaactttcgagattagtaataaagctggtgataccagaagaaagatggatactaatgacagcatcatagcccgcctttgccagctgatcataagtcgtttgcatctgaccaagggtaatctgagtggtcgttggtaactcaggcgcggtacgcattcgttcataaaattctttggacgttatttcgacgttttctaagtaggtttggtgaccaaaaataacagtaattgggacgacgtgaatatgatacttttcaacatcggccgctgagaggtagcttgcgctatccgttacaattgcggttttcatttttcccccgctttcatttggtgaaagtattgcctaacattataacgcttgtcagtagttgaaagctagctttgatgaatagattaaggcgattaatgtttgaaattctcaacaactaacgtcataatgagaatcattaaatgggggagggcgcaggatgaccaaacgaattgagataaaaccggcaacagctgcggatcaagcagcgctggctgaaatatatttagtggaccgtcagcaagattttccatgggtcactgatccacaactgcaagattttaacgaagacagccgtggtgaattcgtgctggtcgcgtggattgatggtcagcgggctggcttttgttcgttgtaccggctggccaacttcattcatctgctttttgtggccccagatttccgccacttgaaagttggtgaacggctactgacagaaatgcgccagtatgcaaccgaaccactcacgttgaagtgtgtgatggccaacgaaaatgccctgcgattttatgcgcaagtagggtttcgaattgtcaaagcagatgcggacgcgctcccaccaaattatacgttgcgtgatacgcatactgagcagtacgtggcattagtggatgttatggccaatgaacgcaaacttaattaatctaatttatttttaattttaaggttgacattgtgataatctggcgctagaatctaatcattaattaaatttagattaaaaaccgtgataaggaacggtgctaagctggttagttagcgagctgcggattggtgtaaggcagtcaataccacttaacatagatcaccttggagttgcgcctcgaaattcgtggagatggtgctggatggtacccattaatgtaccggcgtatcgcaattgctgtacgtactaaggtgactattgtgaagtagtcgcgaataaaggtggtaacccgttctggacgtcctttaattaactcataggagttagttaaaggacgtttttttatgatttaaaggtggtgaggagtatggaatcggacattcaggtggctagttaccaacaaatgtgggcaatggtaactagtcgcacgaggacttgctcctcgagtaacacataggtcaacaaggaatcaaaaacacatagtataactgagtactccgggtagatcacatacgataccacgtgtatcgattaacacatagttttagcaacgtgcaatttatacgtttaggcacacatagttttaacatgaacgatatttatgacccgtagtcttaataattcgtatttaagacgcccgtacaattagctggcgcactgaatacatccaaataatgaagtgacaactagattaattgtaatgagttaacgtattagcaatggttagacggcctcattacgaacacatattaggataacagtaaccacaaacacataatggaggttttataatgacaactaccaccacagaaacagaaactcaagttgcacaacagctatttacggcctatcagacacagcatgcgttaacaatggctgattttacaagtagtgtcgttgacgaagacgctgcgtatcgagttcaagccgcattaacggccttaaaacagcagccggttggtggatacaaggtctcgttgacgagtgcggaaactcaaaagatgtttgatgctcatacgccgctgtacggtgtccaggttgcggatcactttttggcggcaccaaccacggttcgacgcgggcaactaatggacccactcgtcgaagtggagttggtctttaaggctaaagaagacctgtcaaccaccgattcattgaccgatttatggcaaaaaacgactgtcgcgccgggacttgaattgccagattcacgttttgctgactggtttcccgatttgcctaaaaatttggtggtcgcggatgccgcagtcggtgggctagtggtatatggaactgaacgagagactgccgagttgttcgcttcagctgatgcagtggcaacgtcaaagtgtacgctagtccatgatggggggacggttaaaactggtcaagcgagtgaagtgttgggtaacccgcttgagtcattgaagtggttagtcggcaagcttgcagagcaaggtaagacattaacggctggccaacgagtttcgtcggggacgtttgtcctaccaccacatttgaccgcggggcactggcaagccgacttcgatgccgggctgggacaggttgcgctggatgtaacagaagcctaagtaaaataatcacgaaaaaggccttcataaatgtcatgacatttatgaaggcctttttgaagtgttgctaaatgaatgtttttcagatgattagtaattttcaaagattggacagactgctaattatccaatttgtagaccagaatgtttcacgtgaaacattacttatttaaacgatggtagttttgatcaaagtacttgccgttgcgaatatcattcggcatttctttgtaaggtgcttcactgattatatcttcattgttttggccggcgtcgcccatgtaagtaatattggcaaattcgggtacaactagttttggataagtggcatacttttcacgagactgttccattaaatcgatgtgttcgttttggtaagtgaccgtaatttcagggtgttcttcaacccactttgggaagaaaatcgtaccgtgtagtttcttctcattgggcatgaagtctagtgcaacgtcagtcccagttggttcagtccaagaaattttgtaaatgccttcggtcaacatgacgatgtcagctttttgatcagtgacccaacgaccggcaaccatcccaccgtggattcggtaatcaacggtgtggtcgttcttggcgtaccactcgtattcccagccgttatcataagtgtagataaagtgtgtgccgagaaagtcatcaagtgttttaaaagtttttgtcattagaattaccttccttatgtctaatatgtcattttaatcatgtaatttattacatgttttaaacaacaaggttagtgtatactgttatcaaggaatcgtcaaggaggaatttccaatggcgcaaaaaaacaagttacaatttattattctagggttattaaaccagcaaccattaacgggctatgatctaactaaagcctttgatgacgagatcggtgaattctggcaagctcaacatagtcaaatttatccgcaattgaagcgactagaagaacaaggttacgtcacgcatgaaattacggtcagtggcgaaaaacttgaaaagaaactctaccacatcaccgcaactggtcggcagctgttacatgagtggatcagtgtcggtacaccagacttaaccgctacgaaagatgaatttattttaaaactatactttattcaaacggatcgtgatccacgcctactagcgatgttacaggaacagctcaccctgcacacagctaagttagcacacttacaacagcgattggcgaccgttttcccgcaagctaaagctgctaagcaacattatggtcactatttgatcttacaacatgcgatcggacgagaagactactatgtgaattggttgaagcagacgttgaaagccttaccggagtaatggggagagtgctgccgttctaactggtggctggaatcatagcgttaaaagctacccttaattatttagagcggcgtttgaaggaaatcagcttatgattatatgcgtgtgagaaatggtgccgtttgaattctgaaactggtataatggcagtggtcaatatcaattcacttcaatgaggagattaactatggaaaatcaaaaaatgcaagagccacttgtctatcggcgaattttactgaccgttgatgaggacgataatacctcttcagaacgtgcgtttcgatacgcaacgactttggcccacgactatgatgttccgttaggaatttgttcggtgctggaaagcgaagatatcaatatctttgattcattaacaccgtcgaagatccaagctaaacggaaacacgttgaagatgttgttgccgagtacgttcagcttgctgaacaacgaggcgttaatcaagtagagccgcttgtctatgaaggcggtgatgtggatgacgtcattttagagcaagttattccagaatttaaaccagatctattagtgaccggtgccgatactgaatttccacattctaagattgctggggcaattggtccgcgtttggcccgaaaagcacctatttcagttatcgttgttcggtaatcaagactcgggacagggattaagatccaagctgatgaaattttaacaaccgcaagctcatcatggctaatgaggagcttgcggttgtttttgactgctattgttcattaatgaacttaacaatttaatttttttgttggctataaatactgctaaacatgagtttataagtgtactgtttggatgatattaaataatttttcaaattcttgttgcattatgagcaaggatgactataataaagtttgtaaattaattcacaaaggaattgaacggaggaagcacttcatgattaagacagaaaaaaatcaaacaagcaaagttactgatgaagttgatcaattagttcaacgttctaagaaagcattagctattttgaagtcatatacccaagcacaaatcgatgatttatgtgaaaaggttgcggttgccgcactggacaatcatatgaagttagccaagttggcggttgaggaaaccggtcggggtgttgttgaagataaggcgattaagaacatctacgccagcgaatatatctggaacagcatgcgccatgataagacagtcggcgtcattaaagaagacgatgaagagcaactaatggaaattgctgaaccagttggtatcgtagccggggttacacccgtaacgaatccaacttcaacaacggttttcaagacgttgatctcattaaaggggcgtaacacgatcgtctttggtttccatcctcaagctcagaaatgtagttctgcggctgctgatgtgatgcgggaagcgattaaagctgctggtggtccagctgatgctgttttatacatcgaacacccaagcattgaagcaaccgacgccttgatgcaccatacggatgttgcgacgatcttggctaccggtggtccaagtatggtgacagccgcttactcatcaggtaaaccagcactgggtgttggtcctggtaacggcccaacttatgttgaaaaaacagctgacattaagcaggcggttaacgacattgttttatcgaagacgtttgataatgggatgatttgtgcttctgaaaatagtgccattatcgacaaggaaatttatgctgaagttaaagctgaatttattcgtttgggttgctactacgttaaacctaaagatgtgcaagccttgagtgatgctgtcattgatcctaaccggcacacagttcgtggtccagttgctggtaaaacagcttatcaaatcgcacaaatggctggcttgaaagatgtcgctaaggactgccgggtcttgattgcggagattaatggtgtcggtatcaagtacccattatccggcgaaaaattatcaccagttctgaccgtttacaaagcggattcgcatgaagcggcgttcaaacgggctaatgaattacttcactatggtggcttaggccatactgctgggattcatacgaccgatgatgcattggtcaaagaatttggcttacaaatgccagcttgccggatcttagttaacacgccatcttcagttggtgggttaggtaacatctacaataacatggcgccttcattaactctgggcacgggatcatatggtggcaactcgatttctcataacgttacagatatggatctgattaatatcaaaactgtggcaaaacggcgtaataacatgcaatgggtcaaaatgcctcccaaagtctacttcgaacgcaattccgttcgctacttggaacacatggccgggattaagaaggttttcctagtttgtgatcctgggatggttgaatttggctatgctgatcgagtaacggcggtcttgaacaagcggactgatccggttgatatcgacatcttctcagaagttgaaccgaacccgtcgactgacacagtctacaaaggggttgcccggatgaaggcctttaagccagatacaatcattgcactcggtggtggttctgcaatggacgccgctaaggggatgtggctcttctatgaacacccagaagcttccttcttaggtgctaaacagaagttcctggatatccggaagcggacgtacaaagtaccagtatccgaaaaagtaacttatattgggattccaacgacttctgggactggttctgaagtaacgccatacgcggttattacggactccaagacgcacgtcaaatacccgattacggactacgcaatgcaaccagatattgcgatcgttgacccacaatttgttgaaacggtgccaaagcggacgacggcttggactggtctcgacgtaattacccacgcaaccgaagcatatgtttcaacgatggcttctgacttcacacgcggctggtcaattcaagctttgcaattagccttcaagtacttgaaagcttcttatgatggtgacaagatggctcgtgagaagatgcacaatgcctcaacgctagctgggatggcctttgccaatgccttcttgggtatcaaccactcgatcgcccataaattaggcggggaattcaacttaccacacggattggcaattgcgatcacttatccgcaagtcgttcgttacaatgctgaaatcccaacgaagttagcaatgtggccgaagtacaaccataatactgccttagccgactatgccaacattgcccgggccttagggttaccaggcaagaccgacgaagaactcaaagaaagcttagttaaagcttacattgacttggctcattcaatggatgtgaccttatccttgaaagccaaccgggtcgaaaagaagcactttgacgccaccgtcgacgaattagccgaactggcctatgaagaccaatgcacgaccgctaacccacgcgaacctttaatcagtgaattaaaggcgattattgaacgtgaatgggacggccaaggtactgaaaaatagccctttgtgaattaagggagcccgcgctcatgatgagcgcgggcttttttgtcatgtggttttagaataactacctggaaagtttttactgtttgttttcagaggaggagaaaatgaagacttgatatggataaattatcggcttgcacactatatagatatacttataggtgtactaaatatttttgagattcggttaggaaaattcggcgttctaggctacaataatgcaagagttaattttacggaggagaagcccatgaaaaataaggcagtcacaatcaaagatgttgcgcgccttgcagaacgctcaattgcgaccgtgtcacaaattttaaacgggcatggtgataagtttagtgcggcgacggttgctaaggtggaagcggcccgggatgaattaaattatgagcctgattactttgctcagcggatgattaagaagaccagcaaaacaattggggtccttgtgcctgatattcggaatcccttttttggtgagctgcttcgaggcattgaaaacgtcttgtatcagcaaaatttcatcacgatgttgtgtaatgctgatctggatgaagacaaagaacgcgtctatttggatgaactcagccgccggggtgtggatggctttattatcgcaagttcggccgtttccaataatgcgattaatgatattctacggcagaagggtcacccatttatcgtcttagaccaaaagcgcgccgaagggttcagcgattctgtgttgactgatgactatgatggggggcggcaagctgctcaacacttaaaagatttgggacaccggcaagtcgccgttcttattccagcaaaaccgtcagccaatgtccaaaagcggcttagtggtttttatagtgtgtatccgcggacagcggtacatgtcatcgcgacgccgctttctaaagtgggtggtcgccaagttgttccggaaattttggcgactggagttacggggatctttgcagtcaatgacgaaatcgcattcggtgtatacttaggcatggctgaacatgataagcggataccggatgattacagtgtcattggctatgacgatgtcgaaatgtgccaatatgtcgcgccacagcttacaaccatcgcacaaccgatttttgagttggggcaaacgacagccaaccagttactcgaccgtattgctaatccgcagcagccatgggaagaacaccacttaccagttaaattaattgaaagaaattcgacggcacatttgaattaattattcagatgtgttatattttttacgagttattaaaacgttttcataaaacgttttaataaaaactaaattcagattaatttaactatttggagggaccattatgaatacggtaaccgttattgggagtatcaacttagaccggacgattcgggttgaaaacatgccaaagcctggcgaaacgattcacactaaggaaatcttttcagccggtggtggtaagggcgcgaaccaggccgtcgcagcgcaacgttctggtgctaatacccactttattggtgcggttggtgacgatgctgctggtaaaaccatgcttgatttattgacgcaggaaaagatcaacttggcagggatcacaaagatgactaatcaatcgacaggtcaagcttacgtcacggttgatgatgccggtgaaaaccaaattatgattcatggtggtgccaacatggcctttacgccagcagacgttgaagcccaccgtgatatcattgaaactagtgattttgtggttgcacaatttgaaagcgctgtcgatagtacggtcgaagcctttaaaattgcacaggccgctggcgtaagaacaatcttgaatcccgctccagccatggaaaaagtccccgctgaacttttagcagttactgacatgattgtaccaaatgagacggaaacggaaactttgactgggattgcaatcaccgatgaagccagcatgttaaaggcgtccgctgcattacacgccctcggtatttcagctgttatcattacgattggtagtaagggtgcgttttatgatatcgatgggcgacatggtatcgtaccagcttttaaagtcgaagccgtggatacgacttcagccggagatacgtttattggcgcgatgagtagtgtgttaaataaagattttagtaatcttgaagatgcgattcgctatggtaaccgggcgtcatcgattgccgtacaacgtttcggtgcgcaaccatcaattccttataaaaatgaaattacagccgcggagggtaaataattatgaaaaaaacaaaagttattaattcagatttgtcacgagttattgcaacgatgggccatttcgataagttgagtattggtgatgctggcatgccagtaccaagttcaaccgaaaaaatcgatttagccgttgataatggtattcctagttttatgcaagtcttgaataacgtcttggaagagcttgaagtacaacgaatctatttggcagaagaaattaaagttcaaaatcttaagatgttgacggccatcaagaagcgcttaccagacaccccaattaccttcattccacatgaagaaatgaagaaggacttggctgactgcaaggcctttgttcggactggtgaaatgacaccttattcaaatattttattggaaagtggcgttactttttaaagtagttggtgattaatggagggattggaatgaatactaccgctttactaattggcttagggccgttacttggttggggactttaccccacgattgcgtcgaaaattggtggtcggcctgttaatcagatcttgggttcaactattggaacgttaatctttgcgctgatttatgcatgggtgcaagggattgcttttccaagcggcatgaatctctggttttcaattctatcagggatcggttgggcaagtgcccaaatcgtgacatttaaagtgtttacgatggttggttcttcacgagcaatgccaattacgacggccttccagctgttgggcgcatcactgtggggcgtcttcgccttaggtgactggcctggggcaatggacaaggtcttgggtggcctagccttagttggaattatcattggtgcctggctaacagtgtggtctgaacataaggatgcaggtaacgcccggaccttacgccaagctgttatctggttagcagttggtgaaatcgggtactgggcttattcggctgcgccccaagcaaccaatattggtggggaggaagccttcgttccccaagcaattgggatggttattgtttcgatcgtatatgccctgttcttagcatcacgaggtgaaaagttagccctcgttgaaggggtgtcatacacgcacatcatctcaggtttcttcttcgcgtttgcggcgttgacttacttaatctctgcgcaaccaaatatgaacggattagcaaccggctttattctttcacaaacctccgttgtattggcaacgttaaccggtatttggttcttaggccaaaagaagactaccaaagaaatgtgggtcacgattggtggactgatactaattattgcggcagcagctgttacggtgacgatttaaaacaaattaatatggctataagactatttaatagagtcgctttgaaggagttatacgcttctttaaagcgactctatttttacggttattgattacaatggtcgattacaaaatttgctttatgatatggcgataatgaaaataattcggcataatatttatagtttatatcagacatctaaatgtttgatgaatcattagtccattaatttaaaaagccaatgaaaaaagagtgcattaataatgtatgcgctttcgtatatatttatctgtgaagaaaagaaatgattaaggagcgattttgatgaataattcatggattaatatttcgggtaaggtatacgttgttactgggggctcatccggtattggtaaagcaattgtaactgaattattgaataacggggcgattgtttataatgctgacctcaatcaaggtgatcagcaaaatgataatttacactttgttgaaaccaatgtcacagatgcggaagcggttaatcggctggtcttaaaggttgttgatgaacaaggaaaaattgacgggcttgtaaataatgctggtatcaatttgccacgtttattggctgacgccaaggatcctcacggtaagtatgaatttgcagaatcggattttgtgaaaatgtttgccgtgaacgtgaaaagcgtcttccttgtatcgcaggcagttacccatcaattcgagaagcaacagtacggtgttattgttaatatgtcctcagaagctggacttgaaggttcacaaggacagagtgtttattcagcaactaagggagcgattaatgggttcactcgttcgtgggctaaagaattaggtgaacataatattcgggttgttggtgtcgcgccaggtattatggaagctactgggctaagaacacgctcttatgaagaggcgttagcttatacccggcataaaactgttgatgacattcgggcaggctataagagtacgtcaaccacacctcttggtcggagtggcaaactatcagaagttgcggatgcagttaactatttactatcagaacgtgccagttacattaccggggttacgattaacgttgcgggaggcaagagtcgtggttaacctttaaattttagttgggggcatggtgaggcaatggataggcaaagttttgaaatattaaacttttttattaataatgatgcattgacactaagagaattacaatcccatttttctgtttcgagagtcacaattaccaagaatattcgtgcaatcaatgattatttggtgggtattgcaaaaatcaacgttaatcaagccaagttttacctagttatcaataattattctgccatggctaagctacaaactaatttcttgaaaaaggatttagatttcaatgatccctcaaagcgacaagcaacgattttaaaagaattgttacagcaaatcacggattacgttattctggatgatttggcagaatcattggctgtgagtcgtggcactatcaataaggatttaaaagcgctcaaacaacagcttgattattaccaagtcagaattgagacaaaaactaatcgtgggattcatttagcggttgaacatgattatatgtatgcagtaattacacgaactttagtcgggaaatactacgaactggaagcaacctgggataaagcgacagatgtcaaattgcttaatcttgttaaaaaacttgatcataataatgatactgtgaccatgattaaaagaaatattgcggttgttaattggttacgtaaatataacattcaaatcaatgatcgtattaataactatcatccacttcttagtgatgtaacgatggcgtccttgcggaatctagttactgagataattggtagctcgttaagcactagcgaatgggaatttatttcatacccattaaacatcagaaagctaccgaaggatgataatcagttagttcaagtgggattggtcgaagttgaggatttaatgcagtcggtttttccaatccttaagcaaaaattagatgtgaatttggactttaaacggttgttgatggagttgcgatatcatttattatttctcattaatcgggctatttttgatgtcaagtcagaaggatttatctcggtagacatgttaagtaagtatccagtttcaacggagttagcgcaattaacattatcaaccattgccactaaattgaatattcggattcgttcccaggaggttggttatttaacagtctattttcagatggagcttgaagaatacatggcagcgccaattattcatcgggttgcactagttgagcccattaatactagtatgaaaaagtttatttccgagaaattgaaagaaatgttagatgatgatttgcagattgatgtttttaactcaattagtgaatgggagcagagtccagaaaaatatttactgattttttctaacagttttttaacagataatgaattaattaaccacgcgcctattattcggttgaattctatttttaatcaaggaacgttacgtgaacgtcttcaaatttcgttggttgatgaagctgttaatcagggacagtgtcgatttgatgtcacgcagtttgaggaacaggagacctacgtcactggagtgaaaaaattaattaatcaagagatacaacatggtcaactgacaccagattttatgcaagcttggcttaatagagagcaacaatcgagtagtatttttggtgatggggttgcattgccacacgttattgataaatctggactaaatcgaatccttgtaacagtaggagtgtttgaaaaaccggtagtattcgataatcaaaaggtaaacgtggtttttttggtcgcaattccgtataaactagatgcaacattaagcaaaatattagcacaagtatacgatctaattcgcagtatcacagctaacagcaatatttataataacttgaaaaattatgatgaaaatcaaggattaaatcagttgatggaggcgatttaatgttaatttattttggcgtgatcctagtcagtgcgtttctattacaaggtttccttggactaagacaaattaagaatttttctaaaacctttcatcaattacgagtgttagcgccagtagcaattggcaaaaatcctaaaaaattacggtcggggacactaattctattagcgataaaggatgacggcacgatcttagaggctcaaatgatgaagggggttacgatttttgcaaagtttagggaattgcatcaactgcggcagaaaaatattgcggaaattgctgcttcataccagcaattaaaacaattcgataagctaacgcgagtttgtctattggatgcctataagaactatttaaattacaaagcaaatcagctaacgccacaagatttcgatggtagtgtcaaaatttggagcctaccaatgattgaaaagctgaaatctatttattataaaggcttagcaagtttgcgaaaaaaacaagtgaacgtaaaggagcattaatactatgaaagtagtcacagatttggcctcgggctttatggggctgtttcagagcggtggtaagacattaattggatggatgacatcaattattcctgttgtgctattgctgttagtcttgatgaacgcgattattgcttttgttggtgacaagaagatggccaagttggccagagcttcgtcaaagaatcctgtaacccgttatttaattttaccgtttgtttcggcatttatgctcggtaatcctatggcgcactcaatgggacggttcttgccagaatactataaacctagttggtatgcatcgattgctcaattttgccacactagtaatggggtattcccacatatcaatccttccgagtatttcatttggttagggattgcgcaaggggttcagaagttaggattgaatacaatggatttggcgattcgatatctattagtcggcctagtaatgaactttatcggtggttggattactgactttacaacagcctatgtctgcaaacaacaagggattaccttgtccaagaaagttgaatttaacggctaattgagagagtgaggaacgagatcatggcaaaggaatatcatagtatcaaagttgttaaaggctctggtggctggggtggcccgctaattattacaccaactatcacgaagcataaatttgtttatgtcactggaggtaataaaccagcaattgttgataagattgctaagttgacaggaatggaagctgttgatggctttaagacgtcaattcctgatgaagaaacagcattagcggttgtagactgtggtgggacattaaggtgtggaatttatcccaagaagggtatcaaaacaattaacgtattaccgactggtaagagcggtcccttagcgcaatttatgaatgaagctaattatgtttccaatgtagatgttgatcagattatgttggtaacatctgaggaggcgcaattttctgatagtcaaaatgaaagcgctaaccaatttgaggatgtagatgacgatacgaaattcgataatacaaagacactaacagcacaaacaaaaaatcctgggatcttaactaagattgggattggtgctgggcgagttgtttcgacgtttaatcaggccgcaaaagatgctgttcaaacagttattaatactattattccatttatggcatttgtggcattaattattgggattattaatggctctggaattggtaaggtttttgccagtgtcatggagccgttagcaggcaatgtctggggcttgatggttttaggatttatttgctcattaccattcttatctccattgcttgggccaggcgcagttatcggtcaagttatcgggaccttgattggcgttgaaatcgggaaaggtaatattccaccacagtatgcattaccagcattattcgcgattaacacgcaaaatggttgtgactttattccagttggcttaggactagctgaggctgattctaagacggttgaagttggggtgccatcagtgttatatagtcggtttatcaacggcgttccgcgggtctttattgcttggattgcaagttttggattatattcaaaataaatttttagaaggtttgaggtgtattgtatgatgacaaaagagagaattatcttttcaacaaaggtcttagaaataggtgcggaatctgctgattttaaatcgattggcatggcagtattatttggtgatgaagctccagacgcattacggccttcttgctttattatcgaagttgtcccaataagtgagcaaatcacagcaggaatgaaacttgaagtcgacaatcaagtctatcaaattacagcagttggtggtgaagtccagactaaccttggaagattaggccatacggctattagttttacgggtgcaaaggaggctaaattgcctgggacgttatatgttgagcagggcgattatcctgattttaaagttggtagcgtggtacggattatagctgaataattaacttggcagatgttattttgctctgtgtcgagttgagttaaggtcatgttttgaaagcggtagttagttttcgaagaatggctagcttctaaacatgcagacattgttggaagtatgcccctgtaaaacatacactaattactaaaattgtttaaaaaatgaatgtatgagatactaactttcaacagcgatggtggttcatcaaggcaagcagactagcgctgttgttgatctacaatgcgtttgaatcgtgattaagtggtaaaaagcatgagtttatgaccacttgaatgtaagcgtttgctatggtaatattcgtttattaaattgtgcgtaattaaattgtgcatgaaatgggggctttattatggttatgaaacaaacaaaacaaactaacatactagcaggtgcagcagttattaaagttttagaagcttggggagtagatcatttgtatggtattcctggaggttcaattaattcaattatggacgcattatcagcagaaagggatcgaatccattatattcaagtacggcatgaagaagttggtgcaatggccgccgctgctgatgctaagctaacgggtaaaatcggggtttgcttcggctcagcgggacctggtggcactcatcttatgaatgggttatatgatgcgcgtgaagaccatgtccctgttctagcacttattggtcaatttggaactactgggatgaacatggatacgttccaagaaatgaatgagaatccgatttatgcggacgttgcagattataatgtaacagccgtcaatgctgccacgttgccacatgttattgacgaagcaattcgacgcgcctacgcgcaccaaggtgttgcggttgtgcaaattccagtcgatttaccatggcaacagattccagctgaagattggtatgcttccgctaatagttatcaaacgccgttattaccagaacccgacgttcaagcagtgacgagattgacacagactttactcgcagctgaacggccacttatttactatggcattggagctcgtaaggctggtaaagaactcgaacaattgagtaaaacgttgaaaattccattaatgagtacgtatccagctaagggtattgtcgcggatcgttatccagcctatttgggttctgctaatcgggtggcacaaaaaccggcgaatgaggcacttgcgcaagccgacgttgttttatttgttggtaataattatccgtttgcagaagtttccaaagcgtttaaaaatacgcgttatttcttacaaattgatattgatccagctaagttaggtaaacgacataaaacagatattgcggtacttgctgatgcacaaaaaacgctggctgcaattttagcacaggtatctgaacgggagtcgacaccttggtggcaagccaatttagccaatgttaaaaattggcgggcttatctagcttcattagaagataagcaggaagggcctttacaagcatatcaagtgctacgtgcggttaataaaattgcggagcctgatgcaatctattcgattgatgttggtgatatcaatttgaatgcgaatcgacatttgaaattaacgccgtccaatcggcacattacttctaacttatttgctacgatgggagttggtattccgggagcaattgctgccaaacttaattatcctgagcggcaggtgtttaatctggccggtgatggtggcgcttcgatgaccatgcaagatttggcgacgcaagttcaataccatttaccagtgattaatgttgttttcaccaactgccaatatggatttatcaaagatgagcaggaagatactaatcagaatgattttattggcgttgaattcaatgatattgattttagtaagattgccgatggcgtgcacatgcaagcttttcgagttaataagattgagcaattacctgatgtttttgaacaagccaaagcaatcgctcagcatgaaccagttctgattgatgcggtgattacaggagatcggccactgcctgctgaaaagcttcgtttagattcggcaacgagttcggcagctgatattgaagcatttaaacaacggtatgaagctcaagatttacaaccactttcaacttatttaaaacaatttggcttagatgatttgcaacatcaaattggacagggtgggttttaaattcagctactatcgatgtcttgaataagtttgattgaattaatggagattatcaaataatcttatgttgcgattagggaaagaagcctaacttatttccttaatcgcttttatgttcatgttagatgtgctaaaataagtaacaatagagatggatatgggaggtgtctagatggctaatacacaattaagtgatgcgacgcatattatggcatatattgcgttgcatactgatgaccagctgaaaagtgagcatattgctagtagtttaaatacggatcctaccatggtcagaagaatgatgagtaagttaagaaaagcaggcttgttaacttcggttcgtggcgttgctagaccaacattagcttgttcgcccaatgatattaccttgaaagatatctatgtagcagtggtggctaagcgtaattttttaaacgttgatcataatacttcggagacgtgtccggtcgggtcggtaattccgcgagtgatggaaaaatactattgtgatattcagaatagtgctgaggcacgtatgtcgcgagtgacgctgcaagatattattgatgacattagcgctgttcaacaacaagcataatttaagataaagacttgacaagggtcaagtttttatttaggacatagttgtgctcagaaaagtaacaacaaaaagagggtaatggaaatgactaaaattaaagcaggacaagcattggcacaagtgttagtcgactggaacattgatcatatctatggtattacagctgactcgattaataacacggtagatgggttctaccaagagaaagaccacttgaagtatattcaagtacgtcatgaagaagttggtgctttagctgccgcggcagatgctaaattaactgggacgattggtgttagctttggttcagcaggaccgggcgccgttcatctcttgaacggattatacgatgccaagatggatcacgtaccggtgctagctttagtcggtcaatcagcaacatccattatgaatacgaacttctttcaagaaatgaaccaagatccaatttttgcagatgtagccgaatttcataaacaagtgacaacggctgaacagattccatacgtggttgatgaagcaattagatcagcatacgcgacccgttcggtttctgttgttattattccagatgatttgtctggtcaagatattgagtttgatggttttaaaacggcttcacttagcggcagtcaacaggtcttaatgccgaaattagatgacgttcagcagacgatagcggctttgaaagctgctcaacaccctgttttatggattggcaagggtgcctataatgcgcgtcaagaagttatcgcagtttctgaaaaatttagtttgccggttttgtcgaaggctccagcaactggtattatgccaactgaccatcctaatttcatgggctctcgcggtcgactaggaactaaacccgcctttgaagtctcgcaagcggcagatctagttttgtttgttggtactaactttccatttgcacgttacttgccacaaggaattaagtttattcaagtcaataataatttagcagatttaggcaaacaacatgatgctgatattactgttcttgcagatgcaaaagaatttttccaagcattacttcaatccgaagtgacaattaagccaactaagttcttgaaagctgctcaacgtgataagcaaaactggaaccggtggctcaagacaattgctactgatgatcaaggagggttgacggctgaaggggtgctagaagctattaaagacaatgctactgatgatgccgtctttggtctggatgttgggaataatacggaatgggcaatccgacagttaccattgaataagcaacagacttttacgatgtcggcttggtatggcacgatgggttttggtttgccagcaggtttggccgcccaattgaattatcctaagaagcaggtttggagtatttctggtgatggtggttatgccatggtgatgccagacttactaacggaagttaaatatcatttgccagtcattaacgtggttttagaaaacaaagtattaggctttattcaacatgaaaagttactcgctaatcaggcgccgtatgggattgacttgattggtgctgattgggccaagatggcagacaacatgggtgcgattggttttaaagtgactaaccttaaagagttgaaagcaacgtttcagaaagttactcaactacagcagaatggtaatcaactaccaattgtgattgatgcaaaaattaaaaatgttgatccaattgatactagttttgttccagtagatccagaaaactttgatgcagatacgattgctaagtatcgtgaacgatatggtatcgctgaagcggatcaaccggcacttagccaattattaaatgaattataaagggttatgtaaaggagattagtataatgacagttattaatggatatgaacagagtgatcgtgagcaaaagttaacgattttaaatttaccatcattggaagcagctgctaaaaagatcatcccgagcggaggctttggctatattagtggtgggtcagaagacgaatggactttaaagcagaatacaatggcctttaaccatgttcaaattgtgccacgagcattgacggatatggaacagccaagcacacagactcaggcttttggcatagatctcaaaacgcctattatgatggctccagcggccgctcaaggattggcacatgcacggggtgaagctgcgactgctgaagggatggctcaagttggggcactcatggctcagagtacttattcttcaacgtcaattgcggatactgccgcagctggtaaaggtgcgccccaatttttccaattatatatgagcaaggattggaatttcaatcagagtttattggatgaagcagtgaaggctggtgctaaggcaatcattttgactgttgatgcaacagttgacgggtatcgtgaagctgatattatcaacaatttccagtttccaatcccaatggctaacttgactaagttcagcgaaggggatggtaaagggaaaggtatcatagaaatctatgctgctgcggcgcaaaagattagcccagctgatgttcggcgtattacagaatatacgaatttaccagttattgtgaaggggattcagtcaccagaagatgccttgttagcaatcggggctggtgctcaaggtatctatgtttcaaaccatggcggtcggcaattaaatggtggtccagcttcctttgatgttttacacgagattgcgcaagccgttaatgggcgcgtcccaataatttttgatagcggtgttcggcgtggctcccatgtctttaaggcgttagccaatggtgcagatctggtggcacttgctcggccgattatctatggattagcattgggtggtgcgcagggtgtcgcttccgtagtgagtcaccttaatgatgagctgttgatcgatatgcaactagcgggaactaagacgattgaagatgttaaacgtgctaaattacttaggtagtagaagtaatgctgaatataatgtctgaaatgaatttaaaatacctgatataataacactttagcgttggttttggtggaagtaaattctgctgagatcaacgctttttattgtaataggaagatgttctgaacagaaatagctgaggaactaagacactgattgacgaattgaagctatgccggcgttgaagttaggatattgtcttaaaatgcacaaaaagcgtcctaaagcacccagctgagtttttcaagtcttaaaacggttattcagacatacctggcaatagtatactgtacacatgcgcacataccagttttatttaggaggctgaatgtttcataatctagttatgatgacaaggttgtaatcatgagttttgttgtgagttatttttctcataaattaacttcaaagtttcatagtaattaggatatttagagatcgatttttgattagtaaccatcaatgcatattatactgagctgaacatgaatactagttatttagtttttactgaatagctgactccttaatgtggacttacgccgtcaacaatgagaaaaacaaacacatagattcactgacgaataaataaacctgaattctttgaacgggagactttaatttgagtgttgaaaataattattgtaaattacaacaagcgcatgatcaaaaatgtcgagtctcattacggttttataaaacaaatgggcagatggccgagacagttggctatgtcactacgattgtaccgaaagcaattgcatttatggcaattactggtcatcggcaccttatccaactcaatagaatcattactgtgagtttacagtcccaagaccgccgttacgtcatgtaatatgttttggtttatgattttacacgtgtatcatgattgctagtattgatatttaagtggcaatattaacgataactagttggccttaacttgatactgggtgtgctttttgagtcgcagtctcttaaattaaaattggtctggaaagtaacttgttaattcaagttctttatcaagggctattaaatagggaaccttgtagggaaatcaattcattttatgaaattgatttctcttttgtttaaacaaaattattctaattatttctaattgattctataagcactttacttaacgatacataaaaatcgtgatacgattcagttgtagttttaaaggatattatggtcactaagttacacatataaatttttatggaggtgttgtaatatggcaaatttctacggaaatgatccttttttcaacaatgatatggatgatgttttcaatcaattatttcggcgcatggataatcaaaattcggagcgtgcacggtatttagttaatggacaatcgctgacaccggatgagtttgctcaataccgagcaactggtaagctaccccaaaataataaaacaatagaagtatctaaagatggtaaacaggctgttaaaaaaggggggattttagaaaagttagggactaatttgacggaacaggctcgtgatggattactagatccagtgattggacgtgagaatgagattcaagaaactgcagaaattttgagtcgtaggacgaaaaataatccaatcttagttggtgatgctggtgtaggtaaaactgcagtcgtcgaaggtctggcacaagcaattgtggctggtaaagttccagaaacgattcaagataaagaaatctattcgattgatttatcgtctttggaagcaggaactcaatatcgcggttcttttgaagaaaatattaaacagctagtaaaggaagttaaagcagctggtaatattattctattcttcgatgaaattcatcagattatcggcacgggcgccactggtggtgaagatggtggcaaaggattggctgatatcattaaacctgctttgtcacgtggcgagctgactgtaatcggggctacgactcaagatgaatatcgcaatactattttgaaaaatgcggctttggcacggcgattcaatgatgttgtgattaatgaaccgacggccgctgacactttacgtatattacaaggtgttaaaaagctgtacgaaaagcatcatcatgttgtattaccagatgatgttttgaaggcggctgtggattattcaatccaatatataccacaacgcactttgccagataaagctatcgatttgatcgacatgactgcggctcatttagcggctaaaaattcgcaaactaatgttgagacattggatcaacgcgttaaaaaattagaggcagctaaggaggccgccgttaaatcggaggactttacaaaagccgctgatatcaagaagtcgatcgaggaaaccaagcaaaaaattaaaaaaacggatcaaaaagaaaaaatcactgccacgattgatgatgtggcacaatcggttgaacgtttaactggtataccagttgctgatatgggcgctaatgatattgagcacttgaaaaatcttgataagcgtctgaaaagtaaggtaatcggtcaagatgaagcggttgaaatggtagcgaaggcaattcggcgtaaccgtgcgggcttttcagagggtgatcagccaattggaagttttctgtttgtgggcccaactggcgtaggaaagactgaattagctaagcaattagccttagatatgtttggaaataaaaatgcgattattcggctagatatgagtgaatatgctgatcgtacagctgtgtcgaaattaattggtacctcggctggatacgtaggctatgaagataatgctaatactctaaccgaacgggttcggcgtaatccatattccattgtattattagatgaaattgaaaaggctgatccacaagtattaacgttactgttacaagtgatggatgatgggcgcttaacggatggacaaggcaatgtcattaatttcaaaaatacgattattatcgctacttctaatgctggctttggtaatgaagcattaagtggtgacaagcaacgagatcagtcattaatggataagttagcaccatttttccgcccagaatttctgaaccgttttaatggaatcgtggaattttcacatctgactaagcaagacttaagtcaaattgtcgatttgatgttggcggatgtacaaaaaacgttagccaaaaaatccatcaaacttgaggtaactaaagcggccaaagattggctgatggaacaaggctatgatgaagcgatgggtgcgcggccattacggcgagtaattgaacaacaaattcgtgacaaggtaacggatttctaccttgaccacttagatgtcaaaaacttgaaggctgatttagtggatgctgagattgtgatatcggcagcttagcttaaatcagtgttcataaataactttatgtaagaggagattgcttgatagatctcctcttttcgttggttttcaccatttgatattaatctattgagtaatgtgaattagtgaaattaagtctagtttgacttgtaatctaaggaaaaattaagggggagtatcgatgaaactgatttatattaacgatctttttacatgaaactttagtttcgtatgaataattaaactgatgtatctttaaatgtttatttctagtcttaaaacaatattgaataattaatatatttatgtattcttttcaattaattaatactgttttaaactgttgatacaggtatgtatttgagcattataggagtgggatatggaaaagccagaacaaaaactattgctttataaattaagcgatcggttattcgctgcgattcaaaagaatcttcaactagaaatacggcaggcattactagttaaactaggcattgatactgtattaaatgttattcctaagctgataattactattatcttagcgttgctgctacacgagttggtcccagtgttagtttttatgggtagttttttagttttgcgtggctttgcctatggacgtcacttgaaatcggatttgttatgtacgatattaactatctttgtgtttgtgggtgtgccgtatgtgattggaactggtatttctgaagtatacagattgttattaagtttaatatttgtaataatcataagtatttttgctccagctgatacggtaaagaatcctattacatcgaagtcattgagaaaaaaattaaagcgacgggcaattggattgtcattaattttgagtttgttacaaatagttagtaataattattttggcacaatcattttaattgcgatggcattagccgctttattactaatgccctatgaaaggagggaaaattatgaaagaaaaaatgtataaagtacttagccatctttttcaatacgtaggtactaaacagttggttatgtgctgccatgggatattattcgaaactaaaattcctgatgaattaaaaagcaaggattagtgtagatatatgttaatgattgtcttccaagaattatctatctatttgataattaaatctttgttgagaaatatattttttgtgagactttttgatgttatattcttatccgtctgtatgctgatgagttatatttttttagcaaagttaggaattagtttttcttttttaatgttaatgatgtttatatttttcacttggtggtatgtacgagttctaagcggtgcactatgtataacatttcaagtgttcatatggtcgattatggttgaccatatttgtgatatattaactcgtttaatgaaagttcctaatgggtatgtggtagtgtttgtcatattgagtgtcgtaagcttaatttttcttaatattgtaatggatcgcacgaatttcagtcccacgtttagtaatcagagcttaaatcgcataaccgcactattattaatgataatatacttgtatattatgttgagtgaaggtctggaaaatcagttccaggttatattaagtaatttaattatattgtcagttgtaatggggttagtattggtgatttataacgaacatttaaaaaatgtaagagccaaatatgaagtccaaaagcaaagaatacaaatacaaaatgatactcgctatatgaatgaaatcgaagctcactataatgagttgcgacgtttcagacatgactatcagaatatgttgatttcgatagatgaatatttgaaaactgatgatttagaaggtttacaagaatattatcaaaagaatcttgcaccggtttcaaatcgggtgttaaaagaaaaatataatcttgaagatttgagtcgggtcaaagtgaagtcgattaagagtatcctatttagtaagttgagctatgcacaatcgcaagagattgaagttcattttgatttaaaggaaccattaattgacattactattaatgaattggatttagacattgcattagggattatgttggataatgcaatcgaagcatcggtaggacatgctgatggagagattatgagtgccatttttatcgaaaaaaatagtacggtgttcttgattcaaaacaatgtttttgaacagttaccacccttatggaagctgaaagaggcaggttattccactaagggcaagaatcgggggattggattgaatagtttaagtaagattgttaatcgcaatgagaacatgatactcgaaaccagagtcttaggagcggtattcttacaacgcttgacggtgaagcgagtatctcagaatgattagtgtctacatttgcgaagatgatccgaaacaattacaacaaatacggcaaatcattactaaggtaatcgtcgatcaacagctagacatgagtatctgtttagcatgccaagatccccacgaattgttagacaaggttaatgcacagcagcctcaaaaggcaatctatgtgttagatattgcccttaattcagatattaatggtattcaactagctagccagattcgtgacatgggccgtcgcagcaagattatttttatcacgacacacacggagttatctttgatggtgtttcaatatcaagttaaggcattagattttattcttaaggattttccagattccttgtatgagcgatttagcaaagttttacacgtggcgcaagatcgttttcaaaccgatgaaaatgaccaagacgactatgttcaaataaaaattggtgagacggtcagatcaattaatgttaaaagcattatattttttgaaagttcaaccagtccccataaaatcgtagtccatttggatgatggtgaattagaatactatggactgttaaaggacgttcctgatttgagtcctaatttctataggtgtcataagtcatatgttgttaacttgaaacgcattaagtcattggacaagcacttgcgacgattaaccatgacaaatggtgaaaaagtgctttgttctgcacaagctaatcgttatctagctaaatggcttgctaaaaagtcataatagttccaaggaagtcgcctgctaaattagtaggcgactttttatgtgctacgcgatgaaaattcagcgttattcgattagaaattgcagtgatatttgttagcattacgtgtactgggttcgttctttcctaaaccgtttaaaagtgtacttaaaacgattatcctcagattattcgtcttaaaacggtcggtatgtcccttgttcagagcctataataaagatgtgttcacggggtattggattggtcatgacagtaacgaatgcgtttagtttaaaggatgttgtgacaggcagaagttaatgtcgatcaatacgctgtgatgaattttaacgagagaggggcagattaggaatgattaggttatatacacaatcaagctgtcattcttctagagttgcacggcaatggttggaagcacatgggattgagttcaaggagaaaaattttagtgttgattcgcccacggtgcaagatctaaaacgtattttgagtttaaccgaacatggtgtagacgatattatctcagctcgatctaaagactatcctgaaattgcgcctaagttacccgaaatgccattgaatgaggcacttaaattgttgtgtgatcatccgaagttgttacgtcggcctatcatcattagtgatagtaaaattcaagttggctttaatgaagatgatattcgccaatttattccacgaccagttcggcgactaaagttcaatgcattgttgagtcgtctagatggtaatacaggggatcacattattaataaaaggatggtcgagtagtaagctatatctaagattttttgttaattaaagagcgacaagctagacttacacgatatgagtctaacctgtcgctctttagttaataaccatgagacggcatcatcattctttataacaaaaataatatcgcgctggataacatccggtcaaaatattaatcactgataatatcagcaatattcattcccagagcattagccacgcgtgtaccgtagtttttgtcggcctcataaaattgcttgatttcgagttttttgacaccaggcaaagtaacttggcctaacgcatctttgatagtattaattaagcgttcttgctcgggttctgacattaagcgatataggtcgcctgcttgagttgtgtaatcaacttgatagcgataaggctgtgcgcgtgtttcaccacgaacagaatcaggtgaaagtgcggcatccggcacctcttctggcccatgcagtgcattaggctcgtagttgacctcagcaccttgattattaattttcatgtaaccatcacgttcataattatgaactggaacaaccggcttgttcacgggtaaatcttcaaagttggcacctaaccgatatcgctgtgcatctttataggagaataggcgaccttgtagtaatttgtcgggagatggttcgataccaggaacaaaatttgctggcgacatggccgcctcttcaatatcggtaaagttattagtgggattctcatttaaagttagtttgccgactttaattagtggatagtctttgtgggagatgactttagtgacatcaaaaatgtcccatttatagtttagaccttcctcatatggcaagatttggacatacatcgtccatgatgggtaatttttttcttgaattgcatcatataagtcatcttgtaagtaatctaaatcttggctcattgctttttcagctgcttgagcagtcatatttttaacgccttggtctgagatgaagtgatacttaacccaaaactgttcgccattctgattaacccatttaaaagtatgggaaccgtaaccattcatggttcgataggacacaggaagacctcggtcgcccattaaataagtgacctggtgcaatgattctggagaatgagcccaaaaatcccattgcatattttgcgtacgacggttcgttttaggatcccgtttttgtgaatggatgaagtcaggaaattttaaagggtcgtttacaaaaaagaccggtgtgttgtttccaacgagatcataattgccttgctgagtataaaattttaaggcaaaaccgcgcacgtctcgaacggtgtcaggataacctttttcaccggcaacttgtgagaaccttaagattacgggagttttcttaccgacaccattaaataagtctgccttagtatattcccccatgtcgttttcaagttcaaaaaaaccttttgctccggcccccttagcatgaacgacccgttctggaattcgttcacgatcaaaatgggctagtttttccaaaagattatagtcttgcattaatacgggaccacgagctcctgccgtttgggaatgttcattgttagcccatggttggccggtttccgtcgttaatttttccgtcattttaatcgcccttttcacgtaaattacaagaaagctcttgcacaatttaaacgctaacaccttaacagagtgacttcaatcattatgcacagttaagttaatcgttcatgtggcgtagtttaattttaatcagctatcaagctgtttgatattttctaggccacccggaatcgtcacatgagaaatagtagcgacccatttattaaataatgtgttatatttgtctatcattatcgataattgtaaaatgataattataagaagtaatcatttatgaatcggcttaaatattcgtgtaattctattattgtatttaagcggtttaataagtctaggagggattttatgcattggttatgggttttgatcattggtgctattattggtgcaattgcaggtgctattactaataaaggtaaatcgatggggtggattagtaatattattgccggattggttggatctgcaattggggaagctcttttgggatcatggggaccacaattagccggaatggcaattgttccttcaattattggtggtgtgattgttgttgcgataacctcatttgttctgacacggatggattagtaaggagatgattgcgatgattaaaagcattttaaagttttgtttagctgcaaccttaatcgtaagtggtgttcttattggtgggaccgtacttactgctaagggaattgataacttgggtgataaattacaagataagttacatggataaaaattaattttacaatgagccactgatgggtgtactagttgacctgttagtggcttttagtatgagtaatatcattgagttcaaggaactaaatcaagagcgacgattttaaactaccttcaatcgaataaaagtaatatttacttttattaagaatgagggtatgattaaaatcaaaaaaagaggattggcctatgtctaaacttattgcgaaaaatgtttttcagttgccaaaaatgaatttattagtgctgactacatcggctttcttattggccttagacgttattttatacaaaattgctatcggaccagcgtattttcaattatcttttggctttttgtctatggcttgtattggttatctatatggtcccatttggggtggtctcttggagatgatctccgatatattaagctttactatttttggttccggcgcgtttcagattgcctttttgttaactgcatttttagggggatttattgacggtttgtttttatatcgtaaatcagtcaattggttatccgttgtgatgacgcaaatacttgtaatgatttttgttagtttgatgatggactcatggctaatttcagtgctatttggcactaattttaaagtgttattgttgggaagattggcacgcgtcatcattcagataccattacaggtgattgctattttttacttcattaaggcgttagaaaaacgacacgtttttgatagaatgaggcttagataatatcgatggatgctacaaaaagaggttgaacacggtatgaaacgcgctacaatcgttaaacaaataagtctaacttttctattgcacttcaagtctagttcaaccttttttaatattaactggccttattatgactgcggaaaaacaatttgggtatcgatggttgagttggtacccagcaaaataaaagagcggctatgtggtgggcatgataattcccttagcagctaaattgcggacacattctgctaagtagctggcgttgtgttctggatagattggtgttgttaatgcaataggagtgaggtgatcataaggcgggcaaaactgcccacgataatttggatcataccatattttattaggatgatagccgcgaagttgcatttcatccatcactaatacatgaaattgatacaacttgtaaggggaatatttgaaaacataattaacggttgcatgatttttaccccaaccattgcctctcaatgcggcaagctcacggtgttgacctagtaattgttgtcgtggtaattgatggattaattgttcatgccatagacgcataggccacactcccttatcgaattttaaaattaacaggtgaatattaaaaggaccaactcatcattatgatgccgaatatactgatacttttgaacgggtgatgattgtaaacgacggatagttaaagtgaatattcgcaattattatagcatagcgaattgatcaatagtttagtacaagatcaaaaaaacggccatagcaacaactgatatgatcaaacattccttagaatgcttaccttgaaagttgggttgagtaattaaaaataatattattttatgttgtgttagcagcagttcttaattttgatcacagcggtgtttgatagatgtttgacggtatgcaaataaaattattgttctgataaaaggaatcaatgattaataatcttgagcgtcatttttcgaatcatggcgtttttatattacaatggtcctagaaaaagtaaagttatggaggcgattaaatgagtgatttggatcagacaaacaactatcgatacgtcattgttggtggcggaatggttgctggctatgccatcaagggaattcgacaggaagatccagagggcgcaatcttagttatttcgcaagaggcggatgttccgtatgaacggccggcactgagtaaaaagctatggctagatgatgagtttactgaagagaacattcggattggtgctgaagattatcctaatgtgacttttaagttcaagacaacggttacggctattaatcggcaagataaggtcattacattgactgatagtgagcaaatcaagtatgaacagctattgctggcaactggcggagaacctcgacaaatccagggacctgctgatccacatgtgctagtctttagacagtggtcagattatcgcaagttacgtaaatttagtggtccgaacaagcgagttgtgatcattggtggtggatatgttggtacagagctcgcatcgtcactgactcaaaatgggactaaagttacgatgatttttccagaaaaagcgctgggcgagggtaaatttcctgagtccattcgggctgagtatgaagcaacgttcaaacgtaatggtgtcacactgatgagtggtcagtttgtccaatcatatcaacgccaaggtgatcatttgactctattgacaaaggatggtacggtgatcgcagccgatacgattattgttgggttaggtgtcacgccgcggattagtttggctgaagatagtagtttggatttagctgatggtggtgtgaaagttgatgagtatctcaatactagtgacccagccatctggtctgctggagatattgcctcttatccagatcacatcttgggtcggcaacggattgagcacgtggaccacgcccgactttctggtgaattagttggccgtaatatggcaggtgctcacatgagctatcaacataccccatacttctattccatgatttttgatatttcctggcaagcaatcggtaatattgatcctaaattgcaattgatttttgatcggcgaacgcatggatcgcttgtttatttcatagatgccggtaagttagttggtgttttagtttggaatgttaaggtgaaccttgatgatgttcgcgcattgcttgcgaacgctccagccacggatgatttggtaggttccattcgagagcaagagagatagtatctggatgagacatttgcgctattgtgaatgtacgtcaggacaaatcgaccatcattaacgatggttcagtaacaaatgaaaagtcagccgtaagttattttgcttacgactggcttttatttttaatgtctaaaattataaggcgctaatgaagcgttgtgcgatttcgagtggccgggtgatggcgcccccgacaacgaccgcgtggcaccctaagtcaaggcaacgtttcatcttctcgggcgtatccaccttaccttcagcgataacagggcgtgatgtggcttggaggacttcctttaagtaggcgaagtcattatcagcaatgttggcaccagtcgtggctggtgtgtagccgtgcatcgtggtcccaataatatcaaaccctaacctatccgctactttgacgttctcgatggtatcagtatcagccatcaagagggtatcagggaattctgttcgcatggtggccacaatctccgccaatttttcaccgttaggacgcggctgacccgtgacatcgcaggcaactacggcacagcccgtagcagcaacggctcgcatctctttgattgttggcgtgatgtaaacaggtgagtcgggatagtcgactttgcttaaaccaatgagcggtagatcaacttcgtcttgaatggcctgaatatcaacaacggaattagcgcgaatacccgcggccccagcttccttagcggcaagggccattcgtgacataataaatgaactatgcagtggttcattaggtaacgcctgacacgagataattaatgatcccttaactgtatttaagaatgtatttttcataaaaaagaccgctttctactagtataaattagattagttcttgaagtatttttcgtaaattgccgtagctcctgcttccatttcaggggttggatggctcattggtttcttaacgtaaccggcatcaacacccatatgtttcatgaccaatttaagcgttggataaatgtcgttggcaattaaatcagtaatcatatcgttactgatgttttgcagttgacgtgctttgtcaatatcgccagcttcaaaagcgtccatttcctcacgaacacgtggtgcatttaagttatacgttgagccgatgcaaccgtcgacattcaatgcaagggcaggcaaaagcatctcgtcaaatccagataagatgagtttgtctggaaaggcattgcgtacccgttcaagtaagtaaaagtctgcgttggtgtacttgattccgatgatctttggattttcaaagagttccgcaaattgatcggttgttaaggcaacaccagttaaagcagggatggaatagattaataatttgttgtcaacatctttaaggatttcgttgtagtagtctttgatttgttcaaaagtaaagttgtaatagaaaggcgttacggctgataatttcggatagccaagatcagtcgcaaacttagcgagttccttagcttcttttagatttagtgagccaacttgggcaaccaagtcaatcgcaccgtttgcttcatcatagacggtctccatgacttgtttcttttcgtcagtattcagcatgaaggcttcaccagtactaccacaaacatacaagccatcaaccttattgacgtcaatgttgtagcgaacgagagcacggatgccatctaaattaatattaccgtctttgtcgaaggctgtcatttgtgctgcatataatagttttttactcataagtataaaactccttaaaatttattttttgatggatttgtaataatcatctcaaaattcaaccgcttacaggaaatactatagcttctaataaaaattattgcaacacgcttttttggtaattattatcattatataaagaaaacgcttacgcaatcgttgctttcctgatattaaatttcttttttagttgataaaaaaataattattgtggtattgttaggccgttcatcttaacgattcgaccaaataataatgcaaggatgataattatgacaacacaatatttagtatttgatatcgggggaacaaccattaagtacggtctcattgacgaagtattacatctaagtcatgaaggcaagtgcctgactgagcataatcatgatggcctgatcttaaagcaactacagcgtgtaaccagggactaccaagcagagtattcgttagctgggattggcgttagtacagcgggaattgtgggtgcagatggtgcgattcaatacgcagggccaacgatctcagattatcagggaacaccaattaaagccgctttaatggcgcaaactggtctaccggtatttgttgttaacgatgtcgatgcggctttgctaggcgaacaattagcaggtggtgccaagggcgcaacttctgcatattgtgtggcactgggtacggggattggcggtgcgtatgtcgaagatggtcggcttatgacgggtgcccatgcgacagccaattcgattggctatacattgtatgccccccttaccaagacaaattatgaacagcgagcatcaacattaacgcttgagtatcaattagcaaaatatcagatgagtgttaaggatgcgtttgaagaagctaagcgtggtacggtcccgtatgtcgccatcattaatgattgggcagcagaagttgcgacgggattagcatcaatcctattattgtttgatcccgacattctcttgattggtggtgcagtatcgttacagggacaatatttggtcgatttactgaccaatgcgttgaagccactattaccgccagatttaattaaaacaaaaattaccacggctgaattagccgataaagcccagttatatggggcgatggcagggctgttgatacgataattatttttatttaaaaagaaagcgtttacaattatcgtattatgtgataagttgataacgtaataatcattcgaacagttcaaccgctactaaaaaatagtgcaagcagtgcctactgagtgttaaagcccagttttctaagcatgtttgcaagattttaagtagcggttttttattttgaaattagtgaagggtggactaaatcatgaagatcggaattaacaccgcaatttatgagtcacaagttcaggcaggagccactcaactggagtgcttaaaaacattagtaactcgttttgatgttagtgcagttgaagttcgcggtgaattcttcaaacccgagacgcgatcggcggaactgttagcaatcagtcagctttgtgaggaacaacactgggatctctattattcggttccagaggaactgtttagcagtgatggctataacgcaagtctagtgacaaatctagaactggcaaccaaatatcatatcaaatcattgaagtatagctttggtgtgcaaccaacattgcaagcacatgacttggaagcgctaactcagctgttagcaactacccccatacaagttacgatcgagaaccaacctaatgcgaatggtgatttggcgacatttgagtcagatgttgcttgggttaagtcacaaaagttgtcattagggtacactttcgattccggaaactggtattggattgatcaacagcctgaaccagcctttgcagcattgaagtcagcaatcaccgtatttcatttgaaggatatcaaggatcaaacaacggtgatgttgggacaaggggcaacggattggcacagtctattaggtcagttgtcacccgaaatcccagtatttctggaatataatattgcagctgcagatttatcgggacagattgatttggttaaacaagcattaagttagcgaggttcaataatatgaactatcttttgcaattagttttaatcttattactgacaaagttaggtgcgcatattgcggctacctttaacttgccaagtgtgattggggaactattagtcggaattttagcgggacccgcagtctttcacatcttaacgtatagtacttttattcagtactttgccgaaatcggggtcattattttaatgtttattgctggtctagagggcgatttgaaattgctttttcgctactggaagccagctttaactgttgcgacattaggcgtcatctttccaacggcatcggccgtcctactttgtgtgggaatgtccgatttctcactgacgacttcaatttttctcgggcttattttgagtgcaacttctgtaagcattaccgttcaagtattgaaagaaatggattatttaaatacacgtgaaggtgcaattattctaggcgcagccgtagcggacgacattatctgtgtggtgctattgggaatcagtacaagcctgtttggcactgctagtgcgcacaaccaatcgcttgtggcaatggttttgccgaaagtactgttcttcgtcgttgtaatcgcacttgctaagtggtttgtcccactctttctgagaggattcaataaggttaatgcatctgagaatattacgacagcggcgatggtgctctgttttggtttttcgttcttagccgttaagttaggaatgagcgatgtcttgggtgcatatattgcggggttagcgatttcagaaacacgctttaaggcgcaacttgttgctaaggttgaaccaattgggtatgccgtctttattccagcattctttgtcagcattggtcttgaaattacctttaagggaatgcaaaacgatctagtttttatcggattgttactagtgcttgcgattttaggcaagcaaattggtggtgccattggcggtaaattgtttggattgacctggaatgaggccaatattgtgggcgccggaatggtttcaagaggtgagatggcactggttgtcgcgaatgtcgctgtctcggcgggcttaatcgatcataatcactatacggcaatgattgtggtgactgttatggcgacacttattgcgccatcaatgcttaaaacatttattcaacatggtaaacgagctgtatcacatattagtttaaataaaacaagcgaggcgaaatcatgagtaaagttggatttggagttctgaattgggttgtcttaggagcatacttattggcaatgctaggtgtcggagcttattttaccagaaaagctagtaaaaacacggattcatttttcaaagcagaagggcatattcctgcttgagcggcggggttcagtatttacgcaactactttaagcgcaattacctttatgtcaactccagaacaagcatttttgagtgactgggcatacgctatcggaagtttttcgattctaattattattccaattttagttaaattctacattccatttttccgcaaattgaaagtaacgacagcttatgaatacttggaagaacggtttagcccagtcatgcgggccattagtagtttgctgttcgtactttatcatatcagccgggtggccattgtcatctatttaccgattattgctattacatcggtttcaaacatcaatccaattctaattgcctgtgttgtcggtggcctttgcattctctatacattcttaggggggattgaaggagttatttggagcgatgttattcaaggattcttgcttctaggtagtgctctgttaatttgtgttttaggaatcttttatatcaagggtggtttcggtacggtggttaacgatgtcgttaccaatcataagtttatctctggtaacgactttaatattggcaatctatctaagtttgtgccgttgatcttagctggtcaaatctttaatagtttgtatcaatatactggtagtcaagatgttgtacaacgttatcagacgacagctacgattaaagatactaataaatctatgtacactaatggctggttagcattgattaccattccattattttttggaatgggtacgattctttacagtttctatcaacacacagctgccttgccagcaggattcaatacgagtgcggtggtaccatattttgtcattacccaaatgccagctggggttgcaggattagtgattgctggaatctttgcggccgcgcaatcaacgattgcttctagtctcaacgcgatctcctcgtgtgtaattacagactttaaacaacgtttctttaacgataagttcaaaaatagtaatgatgttaccttggctcggggaatcattatcattgcaggcgtgttaggattagccgttgcgatttatctgttgatgggtaacgcttcacagatttggaacttattcttgtcggtcactggtatctttggtgtgccaattgccggaatcttcgctgttgggatctttacgaagcgtgctaatacggttggggtgttaaccggactagtgttaagtgtcggcttgtccttctgggtacaatcattaaacatctcttcattattggttgcttgcgttgccttcatttcagcttttgtcttgagctacgttgttagcctactcttcccaggtggtaatcatgatgtgactggattgactgtttcaacaattaatgaaacatacgtgaagaagaattaaaatgtccgacgatcttgtattaatatcgcttggttattagtctaacccatgatgtttaggacaagacgtagacgtaaatctgaaatctcgattgtcttcacatgaggatagtcgagattttgtgctcaatctgtttcaaggcaagttattgacacagattttaaggaggttatggaaatggagatacgcacactagctttaaaaacgcccgaaggacagccatttacgatgtggatctatcaacatgatcaattcacgctatttccggatgatcgacagtggccattagcgttgatttttcctggcggtggctttgcgggctactctgagcgggaagttgaagctgtagcacttaaatttattgcaaagggttaccaggcggccgtagtgaagtataatcttacgtcggatggcccgttttatccaacagctgccacgattggattagcggcattaagctacgttaaacggcatgcgcaggagttgaatgctgattctgatcacgttgttgtcagtggcttttcggcgggtggacatttggtagccgtgatgacagcgcttggcgctcaatcagaattcttaaataatcatggctttgaagagacaaagctagtaccatttgcgcaaattttaagctatccggtgattgatctgacaatgggttttccaactagtcatcatgagatgatggctgtgactacggatgaatcttactggcatgcgcaagagttagtcacgagtcaaacaccgccgactttcatttgggcaacgcggactgatgagcttgttccagttgtgaatagtctggtctatttagcagcgctaggtgagcataatgttccatttgagagccatatctatgcagccggtgtccacggattggcatttggtgatttagctgattctcgctatcatcaccctgaagatgtggtcccacgggttcaaaactggtttccaatggcattgggctggttacgtacattatatgctagcaagaatagtactgaaatttaggggggtgtgaaaatgaaatatgagcaattgagattaatgacgccgcaacattttgaatttaaattaacctgctattggaaagaccaacttaaaatggattatgatcctcggagatggccaatccttctaatttttccgggcagtggatttattcaaatgacagagcgtgaagcagaaccgattgctttggcttttagtgcacagggctatcagacaatggtagtggaatacaatctattggatcgcgggccagtttatcccaacgcaattgatgtcggtttgactgccttaaagtatgctaaaactcaaggaccaccacattatggtgatgcgaataagacgattttgatgggcttctcggcgggcagtcacgtcgcagcattaactaacgcgatggggaataacaccgagtacctcaaaactcacggctttggtgatagcccattgacgtcacgcttgcaggtcttaggttacccggttatcgacttggcggcaggttttccgaaaagtcgagaagaggcctttaaaattagtccagatgaacaatattgggctagtcagaacctagttactgatcagacaccgccaacgtttttatggaatacttgtgcggatgcggtagtgccaacaatgaatagtttattgtacgcagaagcactagctaggcatcatgtcgagtatgatattcatacatttacacatggaaaacacggtctgtgcttgagtacagttgaaactagtcgatataattacccagaagatattgagccacgtgcggcgaactgggttccgttagtgctaagttggttgagtgaaatgttagatttgacgcaagtggactttaaataggagtgacgaatgcaagataatgaggaagtattgggtactcgtttgcaaaatggaatgtttggtgtaccggatctacatccagatgaacaacaccgttatttagggaccttttacgaacgagttgaacttcaaatttcatttaagcaggctctgaggtatgactttacgtcagtactagtgccggtattgcggcaaccaagagactatcagcttttgttgaacggtcaattagatatggatatcatggggcgctatatgcggctagcgaatcagtatagcattttgtttactgtcaaaaatagtcacttttatcatcacaatctagatagtgcagcgattatcctgtgcgctgaccatgcacttaatcgaactgaagttgacatattgcagcgatacccacaaattgctcagagataaatcggaaaaactaccatcaagattagctgaaatcttgatggtagttttttagcgtttaccgaatttattatctgtaattaaatcgatcgtatgattcattcgatcacgatacttcgcattctctaatagcatggcggcgataatatcaagagcgtaggttatggcaaattgcgagttaacaaagcgcgagttgttgacgaatttgctgttttttacgagaatcgtaagatcacttagttctgctaagcgactgcgttcatcagacgtaatggcaataactttggcttgcttctttttggctaacgcaactgagtcgttgacttctgctgtagcaccagtaagagaaatggccaagataatatcaccaggttgcatgatgccaccgctgatgtacatgatatgggtgtcggtcatcgagaaagcggcaatccccattcgaattaagcgctgggtcatctcttgtgcggtatagcccgagctacccagaccgtacagatagactcggcgagccttggagattaaattaacggcggcatggagatcgtcgggggataatcgttcccacgttccactcagtattttcttgtagtaactatagacctggtccgcaacggtatcttttttgtcagtggttgttgcagggacaactggcccttcggctaattgaattttgaaggcgtaaaagttttcacagcccatttttttgacaaaacgggtaatggtcgcattactaacgtgaacgttcttagccagactagaaatcgtcattttttggacttctttcggctcttgaatgacctttaaggcgactttgcgttcttgtcgtgagagtgtcggatacgactcctcgacagtagttacaatactcatagatttggctcccatcatggtttccttatgttaacgctacaatagcatagtttttgccaaatagaaatagatcagaaatgaaagaagctataccaacacaactgttggtatagcttctttcatttcttatgaatacgatttagacatggttatcgttctacttcaatgcagtccatttccagttttcaacttctggaagatcagtaccttcagcacggatatagtcatgatgcttgtttaagatgctgttcatctcttggatgacatgggcacctttttcggcataggctggcgttgctaataaggcagctttaactaagtggaaacgatcgagttcgttgcgaacacgcatgtcgaatggcgtggtaatgtcgccttcttcgcggtagccatgaacgtgtaagttatggttatgacggtcgaagaagatggtctttactaagtcatcgtaagcatggtatgcaaagataactggcttgtctttagtgaagaaggcatcaaattcagcatctgataagccccgtgggtcgtccttcttcaacttcagaagatcgacaacgttaatgaagcgaatcttcatttcagggaagcgagcgtgcaagattgatacggccgctaaactttcagtcgttggttcagagccggcagttgcgaagacaacgtcgggttcttcaccattatcagtacttgcccaatcaaccacacctaagccatcacgaactaaatgcttagcttcgtccatcgtaaaccattgtggacggggatgcttgctggcgatgatcaagttaatcaattgtttactttggatcgccttatcaaaagttgcaatcaaggtgttagcgtcacctgggagataggcccgaacatattcggtcttcttttcagccaagtgtgagatgatacctggatcttggtgagagtaaccattgtgatcttgctggaaggcagttgatgatgcaatcacgtttaatgaagggacatcaacccgccaaggtgtttcttcgtgagaattccgtaaccacttgaaatgttgggttaacattgaatccacaacgcgtaggaatgattcataacttgcaaagaagccgtaacgaccagttaagttgtaagcttccaacatgccttcatccatatgttctgacaacatggagtcaataatccggccttgaggtgctaacaaagcatcgttaggttcgtggattggttccatccattgacgcttggtatcttcaaacgcagctcctaatttgttagataaagtttcatcaggaccccaaccgcggaagttcttgttatctttgtttaattcgattaaatcacggatatacttaccaagttcagtcatgtctgaaccgtcttccttaccgtgatccttgttgtccaaagcataatcatcgatatttggtgtaattaagtctttagttaacttgccgccgttagtgacgggattagcagccatacgagcttggccttcagggatgattgcggcaatttctggttttaaagtaccattttcatcaaataattcttctggtttgtatgatttgagccagtcaactaatttgtcggcgtgttccatgtgattgcgatcgacaggaattggaatttggtgagcccggaatgaaccttcaattggttcgccgtcccaactcttaggaccggtccagcccttaggtgcccggaaaacaatcattggccacttaggacgagattcatcattgttatccttggcgttcttacgaattgcgtggatttcttcaatgactttatccaattcttcagccatgattttgtgcatcttggcagggtctgtaccttcaacaaagtgtggatcccagcctagacctttaaagtagtcttcaagttcttcatgtgattcacgtgaaagaactgttgggttagaaatcttgaagccgtttaagttcaagattggtaagactgtcccgtctgtaattgggttgaggaacttgttaacttgccaagaagttgccaatgggccagtttcagattcaccatcaccaacaacagtagcagcaattaaaccagggttatctaagaccgcaccagcaccatgcaagattgagtagccaagttcgccaccttcgtggattgagcctggtgtcttagggtcggcgtgggaggcaacaccacctgggaatgagaattgcttgaataagcgcttcattccggccttgtcttgggtgattttaggatacgtttccgtataagtaccatctaagtaggagttagaaaccattacttggccaccatgaccaggaccttcgatgtagaacatgttgagcccatacttgttaatagcacggttcaaatgggcataaataaagttttggccggcaattgtgccccaatgaccgattggatggacttttacatcggtcgcctttaatggttcccgaagtaacggattatttaatagatagagttgaccaactgagatgtagttagcagcgcgccaataggcatcgacgcgttttagatagtcatcagaagaataatcaactgttttggatttaattgcttcactcattattttgcaactcctttgcaaacttttgttttatttatcattacggttattatgataacggtttcaatcataaagtcaaggtgaaattggcaaaataatttaagaacctggcatttaaaagtaagaaagacggttaggggcatggttttcccccaatcgtctttttttatttgccactaattaatgagatgtcggctaagcgaatttgtttggcaatctgagtgtccaattgttcatcggtgatgataacatccacatcattaacgtcggctgtcttgtaaagtgcatttttttcgaatttagtgtgatcagctaagataactttcattcgacaatgagacatcatctttttggaaacttccacttcttctatatagtggttggtgattcctgcttgaaggttgacgccgccacagccaaagaaaccaatgtcggcatagatattattgatattggcaagtgtgattggcccggacaaagaaccttcactagtccgcattgttccgcccaagagtacaatttgaatatttttaacaaactgtagcgagttgagaacgaaagtagagttagtgataacggttagattggttagatggctatgtttaatttcttcggcgatttgaaaagcagttgtaccgtaatcaagaaaaattgactccccatcatgaattaagcgtagtgcattggtggcaatttcatttttttcagcaactgcttcgtgtctacgcttaccatactttgtctcgttgacactttgcggggtagtagcaccaccgcgaattgcctgcactagtccttgtttatcaaggttgtaaatatctttacggatagtctcacgagaaacattaatttccttgctaatttcagcgattctaatggtaccacgttggtttaattgatctaaaatatacttttgacgctgcataacttccatatgaggtggcctccttgtaaaaataaaatttatttttcggtagtaatcatagcacatatttggcaattgtttgcaatctaattttgtaaagtgattgaaatctctatctaaatcctttatatgtaagcgcttaatagagtgctatgtcgaactttgtgagataattaacttgcttttgcgaacgcttatgtcgttgcaaagcactctttgcaaacgggtgttaaaaacttttttaaagaaaagtattgcaaaagatttgcaaaatgatacaatttaaactgttgaaagcgattacatttatataaatacgaagggagcgtcttattttgagtgagaaccttgttgaagtaagtgattatttgagagaccaacttatttttctacacacctcttttaaaacgtcgaaggaattatttacagcgattaacgcgaaggcacaggaaaatgggtttgtaactgatcaatttttaccgaaaataatcaagcgagaatcaacttttccaactggcttgcaactggaacatcgaggtgttgcaattccacatactgacgcggatacaatcaacaaagaatttgttgccgtggttgttaatgatgctccaattgcttttagtcggatggatgatccagagcaaaaggttgatgcaaaattagtttttgtgcttggtctgaataaaccacatgctcagttagagatgctgcaagcattaatgggaattattcaagatgattcattagtaaattcattggaaaatgccgagaactttaaccaaattcatcagttgttaagcaaataaaagataaatagaagaaatacgaggagagattattatgaaaaaattaaatgtattagtagcttgcggtgccggaattgccacttcaacggttgttatgaaaaaagttgaagatttgtttgccgaaaataatattgacgctaatttgattcaaattaagattgctgaagctgcttctaagcaggatgacgcggatatgttgatttcaacaactgtactaccaactgaatataagattccagcgattaaagcaatgggctttttaactggtcttggtgttgataaattgcaggatgaaatcttgactaaagcacgcgaaattcaagcacaataattaagagctagggttttaagcaggaggatgcattatgaaagtattatctgatgttgtacaaagcatcattaatgtcggccccagcgttatgcttcccattattatctttattgttgggttaatctttagggttaaaccgggtaaggcactcacatctgggattactgttggtatcggtatgattgggattaacctagtcatcaatttgttgacaactagtgttggtcctgctgcgcaggcgatggttaaacggtttgggtttcatttaacgattattgatgctggatggcctgccgtttctgctgggacatgggcacagccgatctcagctatcatgattccaattattttagtcgttaacgttggcttaattttgttaaatcttactaaaacacttgatatcgatatttggaattactggcatatgattgcggccgcggctacggcttatgtggtgacgaaaaactggtggtttgcaattctttgcgggattatctatgaaatcgctgtcttaattattgctgataaaactgcgccaaaagtcgctgagttttatggcttggatggcattagctttccaactggttctgctgcggcttatggcctaattggtattccaattggatgggttgtcagcaaaattcctggaatcagaaaatgggatgtggatccacaaacaattcaaaaacggtttggggtctttggtgaacccatggtcatggggattgtcattgggatgttactagctgccttaggtggttacagcgtaccgaacattttgaagcttggaatgtccatgggtggtgtgatgttcttaatgccgcgtatggttaagatcttaatggaagggttaattccaattcaagaaggtgctcaaaagttacttcaagagaagtacgggaaccggaagatttacttaggaatggatgctgctctttcaaccgggtcaccagctactttggcaactggactattaatggtaccaattacgttattcttagccattattttacctggtaaccgggtattgccattcggtgatttagcaacaattccgttctttgctgccttgattgttcctagtcgtaaaggaaatatcgtccactctgtactctctgctactatcgtaatggtatttgcattgttgatggcaactgactttgggccaacgttgacatcaatgatgcacggtattgttgcctttccaaagggcgcatcagaggtcactaacttggatacgggtggtaacatcttgaactggttaattttgaaactatcacagttagtacaaccattacttaattaaaggattatccgtagaaaggaaaatggattatggatactgtaaaaacaactaaaactgacgaattaaagggcgctaaaactatggaggctgtcgttaagacggaatctggttacgacaatatggaactgaagcaaattccaatccctgaagtaacaggagacaaagttttattaaaagtggcctacactgggatctgcggtactgatattcatacatttaagggtcagtatgccaatgcggtgacaccacttgttttgggccatgagttttcaggtgaagttgttgaagtgggaccagatgttaaaacgctaaagcctggcgatcgggtgactagtgaaacgacttttgcaacggatggcacatgtgtttactgccaagataaagaatataatttatgtcctaaccgtgtaggaatcggaactaaagctaatggttcaatggcaaattatgttctaactcgtgaggaaagtgctcacattttaccagataacgtttcctacaagatggctgcaatgtcggaacctttagcatcttgtgttcatgctatgtatcaaaagacaccattcacgttacatgacactttattaattatgggaccaggaccaatggggctactctcattgcagattgccaaagaaattggtgcctttgttattgtttctgggatcactaaggatgctgatcgtttacaaattgctaaagagttaggtgctgacattattgtagatacccaaaaagaagacttggccaaggtcgtgatggatgcgacagatggcgttggtgttaccaaggtttatgactgttcaggtgcaacaccagcggttaactctgcattaccattgatccgtaagggtggaactttccaacaggttggtctttttgcaaagccgatgaatgaattagatgaacgttcaattattcagcatgaaattacgtatcgtggctcacggtcacaaaacccgtatgattgggcgattgctttacatcttgaaagcaagggtgctattaaccaagatgcaatgattacgaaggtctttgatcttgaacactggcgtgacgcttttgatgcaatgatggccggtaaagagctcaaagttatgattgcctctaatcctgatgatccagatttagcagactaaactaattgtagttgaatgacagaatattaaaattataacctccttaatttagagcgctgagatatttgtcttggtgctcttttttgggagcaggggggttctttatgaagtatcaaaatatcttgttcgatattgataataccttgattaattcagcagacttaattgctaagttattgaaggagggggcagttcgcgagggtgttgatatgccaattgaagaatatcgtaagagaattggccagcccggtgagatgatcctgagagaatttggtgttcaaaattggcagaatgtattagccagatatctaattgaatttaacgagaatatgaatgaaataacgtattttgtgggagttgaacaaatgttagatgatttattggcaatgaatctcacagtgggagtggttacatctaaggatcgtgttcaatttgataaagaagtcagtcattttccgattatcgcaaagatgccaattgtgactactgctgatttaactaaaaatccaaagccaagtggagagccgattacctacacattagagagatttaacttagcacgtgaaaggacgttgtatgttggtgatagtatctttgatatgcaggcttcaaagaatgcaggcgttgattttgtagttgctaaatggggagcattaccgaatgtcgattttaataatgcgaaatatcaagctaagaccccgaatgatatcgttggaatagttcagtaagtaaatgagattagactggaaagagcgcattatttaataataaaaaatcctttttaactctaaaagcagaggccaagatagcaactttcgtttcttggcttctgcttttagatacattaataaatgaaatgaagacgagctagttatctttatacaaatatctgaataagtcccttttattattcaaatgatacagattagttaaccaatccttttgttgtaattgtgtcatcaagtcactgatgaatgatagatgcttctcgtaatctatgggggctagaccaataattacatggaccattttttgatttgtcataacaggtagcggcttatcaagtaaaaagaaagtagcaccgagattattaacgccatcacgtggagcagcgtgcgccaacataacgcctgacccaataaccatgtatggtccgttactttcagttaaatgaatgatctgatcgatataatttttttcaacactatagtcttcaagtaggggggacagtgctgtacgcaccgcctgcttccaagatttttgatgatttagaaaaccaacatgttctggcggcagtagtttgattaattctgataaattttcttggggtgcggctaatagtggttcctgagttagctgggtcaaatagtcgttgagtgcgagtttcagacccataggatttcttatcatagcgtagttgcctacaatatccaatagtgtatccacattaaataacttgagtgtgtcagaagttgccaacccagccttaataatagcattatcgatgatcttccactccaactcggaaggaaaagcagatacggtagttattggtatgttgcgctgggtgtttaatttgattgtactgatgacaagctgaacattacttagatctgaattttcgtattgaagcacattcattggactagaaaaatgaataccgcggtaacggctttctagttgttgaagtaatagacgactggtaccgatgccactagaacaaacgacaagtacttcattttgtgttggggtgcttgttttttgctcacgaatagcaccaccaaagtaaatggcaattaatgcgatttcatcatcagaaagtgtgtgatgaatatattgttcaaatggtacgacaactttacgagtgatttcaaaagtgtggtgataatgctgttgaatactttttaagtcggggtattcaaatggcatattatattgagcacgatagtaggttgaaagcaagtgaaccgttaaactgtcactaatcgacttgattgaaacatgtgcgccggagaggtggttaaaactagaaatcattcgaactgagaatggttttaacttttgaatcaagtcgtcattccaattgacatgagcaaattgactagaattgatcaacttgactaagtagtcaacctcattagagttatcgatatgataatcgttcaaaaaacttttagcccaaatgtgatccagtgttaagtcagtttgtgcggatataacatcacttagttggttattacagtctctaatgttagttaagtaccaatataaaaatagtcgaattgtgatacttgcatcgtcggttaaatattttccagttattctttcaaagagtttaatctggtcgtttatggtagtgggcttaatggtagcccgcctagtttgttcaatgagtgtcttcagttgagtagcatgatcgtacacccatttgcgaactgctgtcggggaacccgtgattattttaccggattctgtattggtgatttgtaaatgatatagcgctagttgtgagtgtagtactttgatatctctaataactgtgttcttagaaatattaaattggtaagttaggtccgctaacgagcaaccactagtgttgaggatactaaatgcaattagtagttggcgttgcttagcattgttggtcatgatcttgctagaagtttctttttctgtcattttatgcagaaatttgatcgtgtcagtcggaaggtaatatcctagttttttaacattagtaatcggaaattctgcatgctgatcaagctcatcgtttactttatttattagatagaataggctacgacgtgagatatgtagatgttgttgtaagaagttagctgtggtgtagcccgatgacgttaatagaatttctaataattcattaccatgttttcgtttgctgaaatttacacgcaattcagtatcctccctgtattaagtctactaaaaaattaaagcattaaggtaccaaagtgccaaagttgcactattctcaaaaacattgttgcacttgtggcgctattattcaagtttatactggtcattgtcagataaatagcgatatcaagaaaggaggatgaataaaaatgctgttggatttattgaataaacagactgtgcaagtatcagaaggcacagggctagattggaagcaagcaattgaattagctgcggaaccattgattaataataagacgattgaagatggatacatcaaggaaatgctcaatgtggtggaatcagaaggcccgtacatcaatatcggaccacaaatcgcactcgcacattctagaccagcgggtaacgtccatgaaatcggattatctatcttaaaaacaaatcatagcattagtctagtcaatgatgaacaccccatcaatttatggttcgtattggccgcggtagataataacagccatttagccgttattaaagagttaatggagttgttaaccgatgagtcggcggtgacagctatgttaaatgcaactagtgaagttgatattttagaagttattgcacatgagcaagaattacaaaaataggaggatactattatgaaatttttagctgtatgtcaaagtggtctgggaagtagttttatggttcagatgaacattcagagtattttaaaggacgagaatgttaaagaagatatccaagtggatcattctgatgttgggagcgttggcgctgattcagcagattacttctttgttgaatcaacgcttcaaagtgcattaggaagtattcctgagaataaggttgtgttactaaaaagcttgattgataagcaagaagtccggaaccatgtcaatacaattctggatcaagaaaatattgaacatgattagccgctgaaaaggaggagaatcacatgaagactgttttgaacttatttgttggtattgtgacccaaccgtctattttagtagcgctaattgcgatgttagggctactacttcaaaaaaagaaaagtacggaagttgttcaaggaactattaagacctttgccggtttcttagtcttaactggtggtgccggaattcttcaaaatgcattgtcaccctttgcttccatgtttaagtttgcgttacatgtgcaaggagttgttcctagtaatgaagcagttgttgcaattgccctggttaaatacggctcaacaacagcactaattatgttagttgggatgattgttaatattttattagctcgttttactcgctttaagtatatcttcttgacagggcaagcaatgttatatgtttcttgtttaactgcagttatattggtaagcgctaacattggcacgggttggcaaacgattgtacttggtggtctatttgaagggacattattaacggtaacaccagcattgacacaaccatttatgcgtaaaatcacgggtggcgatgatgttgctatgggacacacgggtaacattggctatgcgctctcaggattgatgggtaaatggtttggtaatgcagaaaagtctacagaggatctagaaatccctaagagtttgggctttctgcgtgattcgacagtttcaattacgattttgatgagtattgtctacattattttggcgattgtgacaggtccagcttacattgaatcgaaactgagtggtgggactaattatattgtttatgcattagtacaagcaggaacatttgctgccggtttcgtggttgttttacaaggtgttcggatgattttggccgaaattgtgccagcttttcaaggtattgcgaccaagttggttcctaattctaagcctgcattagacgttccaattattttcccatacgcaccaaatgcagttttattaggattctttgtcagtttcattgttgggacgctaagtatgtttatcatgattgcgctaggaactactgttattattccaggtgtagtggggcacttcttctgtggtgctgcagcagcaatttatggtaattctactggtggtcggcgtggtgcaatcattggcgctacagtaaatagtttgttgattagttggttgccattgtttattttaccagttttgggaagcttgaaattagcagcttcaacgtttgcagataccgactatttggttccaggaatcttgttaggaaaattagggagttacggaagtgtagcagttattacaggaattatcttgtttacaattattgtgattctttgcagtatttttcttacccggcgtgctaaacgtatgactgatggaactaagtaatcagtaattatgagtactactttcaataatttacgaaaactaataataaaggagataaatctaatcatgaaatttttcttagatactgcgaatactgaagatattaaacatttcgcggaacttggtttagtagatggggtaacaacaaatccaacgttggtgtcacgtgaaggtcgtgattttgaaaccgttatcaaagaaattacgcagattgtatcaggtccagtatccgctgaggtaacggcaaccaaggccgaagagatgattgcccaggctcgcaatgaagttaagtgggcttcaaatattgtggtgaagattccgatgactgaagaaggacttaaggcggtcaaactattaagtggtgagggcattaaaacaaatgtgacccttgtattctcagtttcgcaaggcttattagcggcaaaggccggtgctacttacatttcaccattcttaggacgtcttgatgatattggtggcaatggaattcagctagttaaggatttacgtcaagttttggatacttatggattcaagacggaaattatcgctgccagtgttcgggggccacaacatgttcaagaagctgcgttggctggcgctgatattgccacaattccagccgcagttttcggtaagttatggtctcatccattaacggacaaaggtttggccagttttgcttcggattggaaagcatttcaagcaacgcaaaagtaatcataatagcagcttaggaggtaagtataatgtttgataaagttgacgagctgggtgttaatactattcggacgttaagtatcgaagcaattcaaaaagcaaattccggacatccagggttaccgatgggagccgcaccaatggcctatgtgttatggacaaaacatctaaaagtcaacccacaaacacacatgaattgggttaatcgtgatcgtttcattctttcagctggacatggttcagctatgttatacagcctgttacatttagccgggtatgatgtttcgattgatgatctcaagcattttcggcagtgggacagtcggactccggggcatccagagtatggacataccgatggcgttgaagtaactactggtccgttgggacaaggcttcggtatggccgttggaatggcaatggcggaggcacatctagctgcccaatataaccgacctaattttccaattgttgatcagtacacttatacaattgtcggtgatggcgacttaatggaaggaatttcgcacgaagctggttcactagctgggcatcttaagctgggaaagttaattgcactttacgattcgaacggcatttcattagatggtaagacgtcgcaagcgtttactgaaaatgttggtgacaggttcactgcttatggctggcagcatctggtggttgaagatgggaatgatcttgatgcaattgacgcggcaatcgaacttgcaaaaaagacaactgaccgtccttctttgattgaagtgaaaacggtgattggttatggcgcacctaaacaagggactaatgctgttcatggtaacccaattggtgcggatggcattaaagcagctgaaaaagtatatggctggaattactcggattttgaagtgccgtcagctgtttcagaccggtttgaagtaactattcaggaaaatggtgcgcgtgctgagcagcaatggaaacggctatttgaagaatatgaggcgaagtatccagatcaggcgcagtcttttaagcaagcgttcaacggacaattttctgatgacttgaaatctactttaccgcactatcaattaacagatgcattggctagtcgggcggcaagcgctaaggcgattaacgctgctgccaaagtaatacctagcttatggggtggcgcagccgatttgtcgagttcgaacaaaacaatgattgcggaaacatcagactttcagccagaatcctacgatggtcgtaatatctggtttggtgtacgtgaatttggcatggcggctgcgatgaacggaattgtattacatggcggcactcgggtattcgggggaacattctttgtcttcactgattacttacgtgcggcagtccggttgtccgcactacaacacgcaccggttatctacgtcttaacgcatgattcaattgcggtcggcgaggatgggccgacccacgaaccgattgaacaattagctagtttacgatgcatgccgaacgtacaagtgattcggccagctgatggtaatgagacttcagctgcgtgggagcaagcactgaaaacaactgataaaccaaccgttctggtattgagtcgacaagccttgaagacattacctgtatcagttgatacggcctttgctggcgttgaaaagggtggctatgtggtcagtgctgctcaaaaagaaataccagatggtttactaattgcgactggttctgaagttaacttagcattggaggccaaagcccagttagcaaagcataatcaagatgtcgcggtcgtttcaattccgagctttgatcggtttgcgcaacaatcaccaaaatatcgcgctagtgtgcttccgagtgcggtaacaagaagggtgacaattgaagctggatcaacatttggctgggatcagtatgctggcgatcatggtgctaagataggtgtggatcgcttcggcacttcggcacctggtgacttggtacttgataagtatggctttaatgtaactaatgttgtgaatacttatctgaaattaaaataattattgaagaaatagaaacggggcgttgctcggtttctatttcgtgttcgataaagaatgaggatggctatgatggaaaatattaagatgattgcgattgatatcgatggcacactagttaattcaaaaaagcaggtgacattgcgagtcaagcaagcgattaaaatggcgaaggaaaagaagattaaagtggttatctgcacgggacggccattaacaggtgttaaagcattgttgcaggagttggaactcgatgctcaagatgatcaatacgttgtttgttttggcggtgctgcaacctacacaactagtggcgaactgattgatgaacgaccgattagttatgaagattatattgacttggaagccctagcacgtaagttacgcttgcattttcacgcggtatctgaggatcggctgtatacggccgaccgtaatattggtgattatacactctatgaagctaatctcgtttcaatgggtatctcatatcggacgccagaagagatgcggaatattaaactgattaaatcgatgtacgttgatgaacccgaagttttagacgctgccattaaacagcaaaaactatttgaaccgttgaaaaagcaggttactttcacgaaaagtacaccattttattacgaggccaacactaatggtgttagtaagggcaacgctttgcaagtactctgtgaaaagttaagtttgactgctgccaatgtgatggcaattggtgatgaagctaatgatttgagcatgattaagtttgcaggacatggagtagcgatgggcaacgctattcctgaagtgaagcaagtggctgatgaaataactgtcgataatgaacatgatggggttgcaaaggctattgaagaaatcacgagataaggataagtaggtataacagcattgttatatcggctataagggttacaattgattattgactcttaaagtgtttggaatagattaaattattttagagatgatttcatgaaaaaaactttattttttcagcaatgatcttatactaaaaagatgtaagcttattggcttatcaaatctaaatattattttcgaggaggattactatttatgtgtactgccataacttatcaatcttataataattacttcggtagaaatttcgattatgaaatttcatacaatgaaatggttacgattacgcctagaaaatatccactagtatttcgtaaggtggagaacttagatcaccattatgcaataattggaattactgctgatgtagaaagctatccactttactacgatgcgatgaatgaaaaaggcttgtgtattgcgggattaaattttgcaggttatgctgattataaaaaatatgatgctgataaagttaatatcacaccatttgaattaattccttggttattgggacaattttcaagtgttagagaagtgaaaaagaacatacaaaaactaaacttggttaatattaattttagtgaacaattaccattatcaccgctacattggttggttgctgataaacaggaatcgatagttattgaaagtgttaaagaaggactaaaaatttacgacaatccagtaggtgtgttaacaaacaatcctaattttgactaccaattatttaatttgaacaactatcgtgccttatcaaatagcacaccccaaaatagtttttcggaaaaagtggatttagatagttatagtagaggaatgggcggactaggattacctggagacttgtcctcaatgtctagatttgtcagagccgcttttactaaattaaactcgttgccgatgcagacagagagtggcagtgttagtcagtttttccatatactagggtctgtagaacaacaaaaagggctatgtgaagttactgacggaaagtacgaatatacaatctattcttcttgttgtgatatgaacaagggagtttattactatagaacttatgacaatagtcaaattaacagtgtcaatttaaaccatgagcacttggatacgactgaattaatttcttatccattacgatcagaagcacaatactatgcagttaactaaaagccactactgtaatagttaaaattgtttaaaagaggaaatcagtttgttatcagttgatttcctcttttatgtatcactgttttcagagtaagttccaatggctggcattgctgttaatatgacactagatgatataagttatcatgttaagctcgatggtaagttgggtttaattgatagaaaacataatagttatgagatgcttgaaatacctactaaaatacattttcaccaaattttatatgatcatgttttgaataaggggattaatttgagcgactggatagacattaagatattaatgacaagtttatttaggaaaagagcacgttaatatatccaatagtaattgaaataataaacaccttaggagtgattggtatcctaaggtgtttattaaagttaaggattaaaatattaagctactattctcgataacagctactgtcattatcgtaagtgagtttaacaacatgatcagacaattcaactgtgatctgctgataaactggttgataaccgtgatgagtgagttgcacattaaccttgttatgatcaacggtaattgtgtaattgttccattcacctgactgatacttaaagtcacgtccattatcttgatagtgttggtaggtcccttgagtaccaaatactctaaacgtcatcgctttcaacggttcatcgctaatgtggctaacagcgggtccccatggcaaaatggtgttttgttttacaaataatggtagtttatcgagtggggtatcgactacaatatcctgattaccggcatactcagcaccgttccaaaaatcaacccagttcccagctggtaaataaactaaccgcttaaattgagatttttgaacaacgggggcaactagtatgtcgtcaccaaccatgtattcgtcattcaagtcgcgtacacgagggtcctgatcgtagtttaagacaacgggacgcatgattggtaagccagttttggtttccttagcaaataaatcgtatagataaggaatcagacgataacgcaatttgagatacttgcgataaatgtttaacgttggctcgccaaatgcccatggttcttgttggcgagtccctaatgctgcatggttccgtaacagtggactgaaaattgccccttcaatccaccgtgtcagtaattcagatgtcgtgtctgaggcaaagccaccaatgtcagttccagtaaaactaaagccacttaatcctagattgcagagttgtgggatcatcatttggatatgtggccacatactgcggttgtcaccggtccaaacagtcgagtatttctgagttccggcgtaagctgcccgtgtgatgacaaatggtcggttgccattttgctcttttagtccagcataggttgctttagccatattatggccataaacgttatgcatcttcttatgtgttgaaggcgtgtcttgatcattaaagaccacgtcatctggaatcggaccttcgaacgtagcgggttcgttcatatcgatccaaataccagcgacacctaaatcagttaaaaatttaccgttgttagcccaccactgacgaacttctggacgaccgaagtctggaaaagcagcgttacctggccatactttgttaatatagacatcaccgtcagcagatttaacgaaatagccttttttaagaccctcggcataaatgtgatagtcagaatcttgtttaacaccgggatcgatgattgggatgaccttgagaccctgttggttcaacttggtaataaacttcttgggattaccctggtatttatccttgtcccaggtgaagacccgataaccatccatgtaatcgacgtcaaagtgaatcgcatcgcatggtaagtcgtactttgcaaggttatctgcaattgcttgcacttcttcttgactagcactgtagccccaccgtgattgttggtaaccgagcgtccacttttgaggtagtggcgttcgaccagttaaataggtgtaattggtgacaatgtcttttaacgtggtaccaccaataatgtagtagccgaggttaccttggacagctgaataaaagtagtaatggttgctttccttacccatatctaaatggctctggtaggtattgtcgaagaagataccgtaaggatgtccattctttagccccaacatcactgggattgacttgtaaatattaggtaggatctccagctggggagcggggttatcaacgttccaattatcataggcaaaaccacgtttgttcagatatccggtcttgtcaccaagtccataaagatattcatcaggtgctagcgatttaatgatttcgtagtaaccttgatcagatttagtaggtgccttagtcactgaatggccttctgcctcaactaatcgttcatggactttgtcgacgcctttcaagtgaatgcgttcaccacgataatcggtaatcaaggcattgccatctttatcaaaggtatcaagatgccgttcggaatcgaggtgaatcgttaaagctgatgtccggataatgtaatgatcaccagcactttcaatagtgaaatcagtcgcctgaattttatgaccctcaattgcataggatccaccttgctcaccgcgattaataaagacgcggatgatttccggcgtaacaatagttaattgtaatggttgggcgaaagcaaacgtgatcgtttggccgttctgtgtgtaacttggtaatgcactcatattaaaaaacactccttagtaaaatgacttttatttagttggattctctgacaaatcttcttgaggcttgtcttgcttaataatactaatggcaagtactgcgatgaacattgagataccagcaataagcatcattccaggcatcgaattaccaacgaatttaaagaccataaagctggcaacggatgcgagaatttgtggcaagcaaatcgtaccgttaaaaattccaatatatgagccttcattggcaccatctagtgaagaagtaaagatattaaagggctcgacatgcaccgtaaagaagccgataccgattaaacagaatggggcaattaataggtactggttgtgaatgaagaatacccaaacgaggccaactgcgaagctagctaagccaaagcgataccaaaactttcgcttgtatggattagtccgtgaaagaactaagaaaccatatagaacggcggccattgattgaatgaaggtcaagattccataccaattaccggcagcttgatagccagccgaagcagcattagttgtgtgccaaacgttttcggcgatagcaccagtagtataagtccacatatattgaataccaatccaggcaaatagttgaacgagggcaacttcccagaaagctttcggggcttcttttactaattgccaaataggcttggtgtgcttatgttgttcaggatcgatatgatgataaagtgcgtacgtgtcaggatcatattccttaaccgtatgaatagtatatgctgagatgcctaataaaataatggcaccaatataaaacgcaattcttacagaaagagggacaacgcctttttgcgccgtgtttgcaacaccaaagtaagttaggacgaacggtagaatagtagcaagtacgcctcctaggttactgaaagcttgttgccaagaccatgctttgtccttctgattttcattaaccatatctccaataatcatgcggaatggttgcatgcaaacattacttgataaatccataaataaaatagcaatagcaccaaatagtaatgcagcagttgaagcgtagccaaagccgaatgaaccagcatttggtaataacaccatgaccaacgccgctaatggtgcgctgaatagtaagtagggcattctacgaccaaagcgcgtccaagttcgatcagagtatttaccgactagtggttggacgaataatccagccaatggcggcagaatgaagaagagtcctagtttggtgggatcagcgccaatggtctggaaaatccggctcatctgtgatgattgtaatgagaaggccatattaaccccacaaaaaccaaaggtaattgcaaagatggtttttaatgggaggttgggcagcgaattagcaataatagatgtcttaggcttactggaaacatcagcgattggtttattcgggtgtactgcaggttggttcatgagaatccatctccttaaaagttaatcacttttcaacagggcaatactagcacttaacgtaaacgtttacaataccgttttaataataaagtaaacgtttacgcttttggcaatgatttaaccggcttttagcgctataattaatttaaatcggaggggagctggaaaaatgaagccaacaatcaaagatattgccgctaaaactggcttttcaattgctacagtgtcacgagtgttggcgaaaaaacagggtacatatagcgacaagactcaggagcgtattttaaaagttgctaaggatctcggctatcggaagaatacactagccatggaattggttaaaaagaagacggacgtgattgccgttattgtcaacgtcacgccgacgaatttttcaagtggaattattgatggtattcaacagcgcgcgactgagatcgggttacaggttattattctatatgctggtaatcggaataccgagttacaacatcaagcaattgtgaccgccttggaacgtactgtttcaggtattttgttaatggcgattgaaccagataaagcagacttacaattattaacagaatcaaagacaccgttttgttttgtttcgatcaatctagcagatgaacgcgtcaaatccgttagctctgacaattatcaggcggcctatttggcgacaaagtatttaatttcgcatggtcatcggacaattggcctagccggaatcgaccattatcatacaggtagtcaacggcttgctgggtatcaagcggcgttaaaaaattattcgattcatgggcaagctgaatgggtgcaacccggagattatagttatcaggctggttataatgtttttaatgcttatcaagagctgggcattactggggttgttgcagctagtgatatgacggcggccggactacaaaaggctgctcaggagagtaatgtgaagctacctggggcgctttctgttgtcagcattgatggaacgctcatctgcgatattgcgactcctgcgttgacaagtgttacccagaattttgtccagattggtattgaaagtgttaattgtttggttggcaaatctgccacgcggttagtcccagtcacattggttgaacgtgagagtgttgcaactatataaagcgtactgagaaataattttagcttcgctgacctgataatcgagaacttgattgtcaggtcagcgaagctttttggttacaacgagattattccgtcactttaaatacgttctcattaacgttagtatattgtcggtactaagcgattgttttatgcgaaaagcagcaaagtgattctcaaatcgatgaaaccgctttatttcggatgctatactacagcaaatgaagtcgaaagtgggggagactatgcaaattgataagttaacattaaaagatgtggcaacgacgaatcggcagtatctggagacgatttttgccttgggtgatggtcacatgggtgttcgggactcagtaccgtttacaggtaatcaacaagcaacactaccagtgatgctcatcaatggctattatgcgacgaatccaatcacatatggagaaagtgcctatggatatgcgaaaaatcatcaaacgattatttcattaacaagcccgcggtacttagactttgcaactgagaagacaagttctgagattcctggtgactgggatatgacggtcgacgatgccgtgcttgattttgatacgggcgtactaacggaaaagtttcagattgttacctccgaccaccatcattttgaactggtcgttaaatcaatgattgcgttggataattcgcatcaactattcttgaactacgaactgacttcgcttgattatacggggacgttgcggttcacgcggccgattattcatgatgtaactgcgacgacggcggacgcggacgatccgcgagtggcgcaacgacaatctgggttaaccaaccaatttataccagctgatcgtcagcagcaaatagagtggcagacgttggtagcttcaacacaccaacaaataacgcaacgggattggttgaccagctttccgacaggctttgaagtatatggcgatcatgccggttttcatggcagtggtaccatcgaagtacagacaacgctgagctggtcgtttacgcgccaaatcagtgaaattaatcaagcgttgccggataagataatgggttggaccaacgatattgtggctcgtaatcggcagattttaacggacttttggcaacagtcgcaagtgcaaattagtgataaaaagttacaaactgggattcaatataacttgttccagttatttcaatcagctggtcgtaacgggttaacgaacattgcagctaaagggattactggaccgggctatgagggccattatttctgggataccgagatgtatatgttaccgttcttcatttatacgcagccacaaattgccaagcaactgttgcattatcggtttagtattttgccgcaagctcgagagcgggcgcggagcttgggtgtgacacggggcgcattgtacgcatggcgaacgattaatggtgaagaagcaagtgcctattttcctgctggcactgcgcaatatcacatcaatgcggacattgcgcatacggttaagttatattttgatgtcactaatgatcagaacttcttgcgggaacaaggtgcagcagttgtcctggaaaccgcacgtttctggttgcagtttggtagctggcaacagcgtgatggccggtcgcaattttgcttatacaaggtgacggggccggatgaatataccgccttggtagataataattactatacgaatcggatggttaaggaaaatatggcttttgcagcttggctactcgaaaagcattatattgacggcgatgctgatgaacaagtgcagttcacaaaggcaagtacgaacatgtacctaccgtatgatcaagaacaacaagtcactgcacaagatgatcattcaccaaagatgccggtgtggccctttgcgacgacggcagcgacgcaatatccactgttgttacattatcacccgctcatgatttatcgtcaccgggtcaacaagcaggcagatacgttattagcagaaatgttgttcccagaagatcaatcgcttgaacaactacgtcgggattatgcttactatgaaccaattaccacgcacgattcttcattgtcacgttcgatttttagtattctagctagtcggttagatgatcgtgataaggcttttagctactatatggatacgtcgttgatggacttagttgatttacaaggtaatgccaaggatggcttgcatgaggccaatcttggtggtagttggttgggattaacatatggatttgctgggatgtatgtcgctgacggcaagttacacattaccaatcatttaccaactcagatagcacatcttagttatcggttgcgttttcgtagtcgagtactagaagttcaactatatcaagataaaacgcaagttaagcttgtcactggcttaccgttagcagtggtagtggctggaaaagaatatgatgtattgcaaggtgtccgtagcgaatgatgaaaacttatagcgaattgaccagatggaagtagtacaaaaaatatttacacacggttgataccgcttacaattgttgctaatatatacagcataaataaaagcgtgttactgactcgatcaggcataaacctactcataactgtattcatagtctctttggtgagatgtgatactttttaagtaggttttttgtttgaaatccaggaggcgtgagtggtgaaatttctaaagaacttcaataataatgccgctttagtggtagatgatcaggatgttgaatggattgtagttggtaacggtgtaggttttggtaagcatcagggtgatcagattgatgatcagaaaattcagcggcgtttcgtggcaactttgaaacagaatgttgatattgatgactttcaggatttgaaacctcagtcttttgtgattacaacaaaggtggttcacctagtggagccgctgttgaaggtcagttttagtgattatcagtactttgtgcttgcagaccacattgattttgcgttgaagcgagccaatgatggaatcgatgtcgataacggtacagtccgttgggaagttaaaaaattgttccctaaggagtttcacgcagccagtcaagcggtcgatttaattaatgtgacggcggacgtgatccttcctaaaagtgaagtggtttttatgacttatcacttcatcaatgctggttcagatggttccaagttgcaggaaacgattaaaattacgaaattgatcagtggcatcattgatatcgtgcaatatcaataccagatgcatctggacccagagtccttcaattacaatcgtttcattgcgcatttacgtgcgctaatggtgcaacgcgttagccgcagtaatggaactgggagtgaattagatcagtcattactgcagttgatgcaagtaaaatatgcgcatgcctatgcaacagtggagcggatcgatacatttttacaaagtaaggctggctggcgactagagccggacgacaaagtctatttgacccttcacatctggcgcgtcacccaccgacaaaaaagtgaataaataagattattaacggtgtgttactggttatgcaggcattaacccaaatatcttttcttgagagcagcagtcactagggccctagtggcatggtttgaagaaaggacatttgggtttttgtttactcaaattgcaattattgatttatagataaatgaggaggaacaatgatggcttatgaagatttaagtaaaaagattatcgccggagttggcggtaaggataatgttaagagcgtggttcactgcacaacccggttgcggtttaagctcaaagatgaaagcgctacccatactgatgaattaaaagatacagatggtgttattacagttgttcagtccggtggtcagtaccaagtagtcattggaaatgaagttgcagacgtttatgaaacgctcattcgcgtcggtggttttgccgatggtggtagtgtacctgatgattatgaagacggagaaaagatgagtatctttgaccggttcatcgatttgatttctggtatttttactccgatgttaggtgttttatgtgcggctgggatgatcaaagggttcgttgcgatgtttgtcgcgttcaattggttgtcagagaattcaggaacatacaagattctctactcgatcggtgatggtttcttctatttcctaccaattgttttgggattgacagcagccaaaaagtttcatgttgatcaatttgtcggaatggcgattgggatggcactttgttatccaagtatcgtcgctttgaacagcagtaaaacagtattaagcacgctgttcagtggcagtatttttgaatcacagattcacgcgactttcttaggtattccagttgtgatgatgagctatacttcttcagtaattccaattatcttggccgtttggtttgcatctaaagttcaggcatttgcaaaacgaatcgtgccaacggtagctaagacgttcttagtcccatttattacgttattaatcgcagtgccgattacctttttaattattggaccagttgcaagttggttaagtgatggtatttcaacagtatgtgttgcaatctataacttcagtccgatcgttgctgggcttgtgatgggtgctttctggcaagttttcgttatctttggtgttcactgggggttcgtagctgttatgatggccaacctagcctcacaaggctttgaccctattttaggattatcattagccgcttcgtttgcccaaactggagttgtattaggcattctattacaaacgaaaaatcaaaagacacgcggtattgctttaccagcctttatctccggtattttcggtgttacggagcctgccatatatgggttaacattgccacgtaagcgcccatttattctgagttgtgtggccgcttcaattggtggcggtattattggttttgcaggtacaaaaatgtatatgatgggcggtatgggattattctcaatcccagctgcgattaattctaaaactggggtagacggctctgtatatggcttaattattgcgatggccattgctgcagtccttggttttgccctacaaatgttatttggttacaagagtgttgatagtaatgacaagcaaactaaggtcgtagaaactgcggcaactgctgatccagtcatggtcggtggtgtttcagtagaaacgacaccaactggtgcagcaactaaagtagaaccaagcgtcacttacaatgcggccactaagttaagtagccccgaaacgggccaaatcatcccactaagtgaagttaaggatgaggtcttctcatcaggtgcaatgggcaaaggtgttgcaatcgaaccaactgatggtgtcttatacgctccagctgacggcgaagtagcactcgtattcccaactggacatgccgttggtttaaacacaacagatggtgctgaaatcttgatgcatattggaatggatactgtcgaattagagggcaaaggttttgaaacgctagttcaaaagggcgagacggtcaaagctggtcagccgctagtgaagtttgatattgaagcgattaaggcggcagggtatcccgttacaacgccaatggttgtgactaattctaagaactatcatgacgttaaactggcctttccagctgctacggaagttaatgcaactgaaccattattacaattagactaattaaaagggagttttcaattatgtattcaaaaacaatgccaactggctttccaaagaactttttgtggggcggcgcgactgctgccaaccaagttgaagggggttggaacgttgatgggaagggcctaacaactgctgaagttgttcagaaggctactgaccgcaaagtaatgtcgatgaacgaggttactaaagagagtgtccaagctgccattgatgatcaaacggataagctttatcctaagcgccgtggcgtcgacttctatcatcactataaggaagacattaagctattcgcggaaatgggcttcaaggtataccgcctatccttagcatgggctcggatctttcctaaaggtgatgaaactgaacctaatgaagctggtttgaagttttatgacaatgtttttgctgaatgtcacaagtatggtattgagcccctagtgaccatttcccactatgaaatgccattaaacctaacattaacgaataatggctgggcaagtcgcaagacaattgcagatttcactcgctatactgaagtgctattcaaacgctataagggtgttgtgaagtattggctaactttcaatgaaattaacgcttcaacttggggatttactggtactggtgcaattgatagtgatctaagcttacatgatcaaatgcaattacgctaccaagcgctacatcatgagtttgttgcaagtgcaattgcagttaagcagtgtcacgagattgatcctgaggcccaaattggctcaatgcttgcgcggatgcaaacttatgccaatacgcctaatccagctgatgttcgggcggcccaattgcaagatcaattgaatttgttctttactgacgtacaggtacgtggtgaatatccagaatatatgaaccggtactttgcagaaaacgggattgaattaacgatggcagctggcgatgaacaattgttagctgaaggcaaggtcgattacttaagttttagttactatatgacgacgattacttcggcgactgatgatgttgaacaagccagtggtaacttatcaatgggtggtaaaaatccatacttgaaatccagtgcctggggctggcagattgacccagttggtttacggattaccttgaacgagttctgggatcgctatcgggtaccattattcgttgttgagaacggcttgggtgccgaagatgaaatcagcgccgatggtaagattcatgatgattatcggattgactacttacgtcaacatattgaacagatgaaagaagcagtcaaggatggtgttgatttgatgggctacacgacctggggttgcattgatgtcattagtgccggtacatccgaaatgtctaagcggtatggcttcatctatgtcgatcaagatgatgaaggtaatggtagtttgaagcggatgaagaaagactcatttgactggtataagaaagtaattgcttcgaatggggaagatttgggatagttattaataattgatattcagaccaatgattgattatacttgttgtaagggctatcattattagctaactagaaagggtgttgattaaatgtcagagttcccagaaggatttctatggggcggcgcgactgctgccaaccagttagaaggtggctaccaagaaggtggtcgtggcttatcgattgcggatgcgttaccaggtggcaaagaccgatttaaaatcgttagtcaaccagattttgactggacgatcgatacagataagtacacctatccgaaccatgaaggtattgatttctatcatcattacaaagaagatattgcactgtttgccgaaatgggtttcaagtgttatcgtttctcaattgcatggtcacgaatttttccaaacggtgatgaaacgcaacctaacgaagccggattaaagttttatgatgatgtgattgacgaatgcttggccaataatattgaaccagtgattacaatctcacattatgaattgccattgaacttggccaaacggtatggtggctggaagaaccggtatttgattgaattctacgaaactttcgcgcggaccatcttaacgcgttatgcttcaaaggttaagtattggatgaccttcaacgaaatcaatagtgcggcacattttccggtgatgggccaaggattagtgccatcgacgggtgctaatgacaaaaagaacgtttttcaggcatggcacaatcagtttgtggccagtgctaaggcagtcaaaatcgcccacgaattgcgagacgatattcaggttggctgtatgattctctatgccactagttatgcttatgattcgaacccagttaaccagctggctaatttgcagcataatcaagatttcaacttcttctgtgcggatgttcaagtacgtggagcttatccgacctataccaagcgactgctggctgaatataatctgacctttgatgatctggagaccacagatggcgacttggcattactacaacaatatccagttgattatattgggtttagttattatatgtcgagcgcggtggaaaccacgggtagtgtaaccgatactgttgctggtaacctgatgggcggcgtcaagaatccatttttgaaggcgagtgactggggttggcagattgacccaaccgggttacggattgcgttaaatgagctatatgatcgctatcagaaaccgttgtttgtggttgaaaatggcctaggtgcgattgataaacctgataagaatttctatgttgaagatgattatcgcattgattatttgaagcaacatattgaagcgatggctggtgccattgatgatggcgtcgatttgatgggctacacaccatggggttgcatcgaccttgttagtgcatcaactggcgagatgagtaagcggtatggctttatttacgtggacctagatgatcagggccacgggacgttagctcgctatcccaagaagtcgttctactggtatcaagatgtgattaagcataatgggttagcggagaaatctgaatagttgaaatgcaattagtgatatctgacagcaatatatcattgatgagatgatagaaattggcatttaacgcttgcaatcgttttccgaaaccgctatactagctaattgtaaataaggattgttaccgctaacattagctagtgggcaaaacctaattaatcgattgtattcgtgattgatagcacggatgcagtgggttattaggtttttttctttatttaggtatgagagtcgaggagcgtgcgcatgcgaatcaaaaaggtttttaataataacgtcctattggctgaaaaaaatggacgggaagttgtcttaattggtaaaggaatcgggttcaaaaagcatactggtgacgatgttgagcaacaacagattactaagatttatacgccagaaggagataattggattagtaatttccaaagcttgatggcagatattgaaccggaatattttgaagttgcttcgcaaattattgagttggcagaacaacaattgcaaacgacttttaatgtttatttgttgatttcattgactgaccatattcactttgctgtctatcggcaccaccatcagatggatattcataatgaaatcttgtgggaaactaagcgaatttatcaccgtgagtttcaagtcggcatgcaagcattggcactgattaaaaagcattttgatgtgacgttgttggaagatgaagctggatttattgcaatgaagtttgttgagaatagtatggctgactctaacactgatcaaacacttgcaatgactaagttgattaatgatatcttgaatattgttaagtatcagctgtcattaacgatgccagatgagagtgttagtttgcaacgatttttagttcatctacgcttttttgcggagcgtttaacgctgaaacgacctgatcaatcccaaggggcagatgatgatttcttatttgaacatttatctaagcaatacccccgagcctttgcctgtgtccaaaaaatcgctgtttttgtgaagaagtcgacggaacagactgtttcggtgaatgagcgtatttacttaatcatgcacattcagcggatgttgaacgagaatcaataatatttttgggattgtaactattcgattaggcaaaacccaagtagcaaccagtcaacctgtgtttttagtgttgataacgggcctacttgggtttttgtcgttttataaagggaggaaaaagtgtatggattattcagaattagcacaatcaattcttaccaatattggtggaaaagataatattagcaaagcatggcactgtgcgaccagactacgtttcaacttaaagtcaacggacaaagcgaatactgaggcgattgaaaacttagatggtgtcattacggttgttcaaagcgcgggccagtatcaagttgttattggtaatgctgtggcgcaggtctttgccgttttagcagatttagcaggattagcaaatcctgatacggcggctgatgcagctactacaacggaagatacgggtgaaaagcaaaacatcattaatcggtttattgcttttatctccggaatctttacgccgtttttaggtgctttggctggtgctggtattttgaaagggttgctagctttagcggttgcttttaattggatgtcaacgactagtggggcttataagatttggtattctgctggtgatgctattttttactttttacctgtctttctagcatttactgctactaagcagttgaaggttaaccaatttgtagcggtgtcacttggtgcagccctgctatacccaactttagtaactgttatgacgaattcaacaacactacatttctttggtattccggtggttccaacaacatacacgtcaacggttatcccaattctactggcagtttgggtattgtcgtatttggagccagtgctggacaagctatttccagcggcaattcggaatattttcacgcccctcttttcattaattattatggtgccattgacgctgttagttgtcggcccaattgggggactcattggtaatggattagcaagtggtgttatggcaatttataacttcatgccaattggtgctggtgttatcatgggtgccttctggcaagtctttgttatctttggtgtacattggacgttcgtaccattgatgatgaataatattgctaagatgggttatgacccgttgttaccaattcttagtgcggccgtattatcacaggctggtgctgcgttagctgtttttttgaagtcacgagatcaaaaaatgaaagcattagcagggtcttcttttgtcacagcattgtttggaattaccgaaccgacgatttacggggtaacgcttaagttaaaacgaccattctattgtgccgttgtgggtggtgcccttggtggtgcaattattggcgccgctggtacgcacgctagctcatttacactccctagcttattagcggtaccaacttttctaggacatgggtttatgggtgaagtcattggattgattgtagcattcttaggtggtgcgatcttaacgtacttctttggattcgctcgtcaacagcaggctgatcactcagtagtaagtgatcaaagtgataacacagtaatggctccggttgaagggacaattattccattgactagcgttcatgacgaagtatttgcgtctgaagcaatgggcaaaggattagccattgttccaaataaagggacggtcacagcgcctgttgatgggacaatcacggcagtatatcccactggtcatgcgattggaattacggccaatagtggtgctgaaattctgattcacattggtattaatacggttcaattaaatggtcaatacttcgaaacaatggttaagcaaaaccaagtagtcaaacgtggtgatttattaactaaatttgatgtggataagatcaaaacggctggttacgatacaactgtcatggtcattattacgaatacggctgactatcaaatggtcaagccaactgatgcgacggaggctagtgataattggattttagaattacaacctaaggagatcatggaaggagcaccagctaatgtataaaccaacttatcctaaaacgttccctaaagactttttgtggggcggagcgacagcagctaatcaagttgaaggtgcctggaatgaagcaggtaaaggcctgacaacggcagaagtagtgaaaaaaacgacggatcgcaagcatatgtcaatggatgatgtaacgatatcttcaattcaaacggcgctagatgatcaaactgatacaatgtatcctaagcgtcgaggtgttgatttttatcatcattacaaagaagatatcaaactatttgctgagatgggatttaaagtttatcgtttctctattgcttggtcgcgattatttccaaaaggtgatgaactcaagccaaattcagatggacttgctttctatgatcgagtcattgatgaattgcgacgctatcacattcaaccattagttacgctgtcacattatgaaatgcccattggattaacgcttaagcaaaatggatgggccagccgggcaaccattgccgattttaatcggtttactgaagtcgtttttaaacattttaaaggtcgcgttccgtattatttaacttttaatgaaattaataccggaacttgggggtttcatgccactggagctgttgatactgagaattcggcgcatgatcagatgcagttacgttaccaagcgctgcaccatcaatttatcgctagtgcactggctaccaaacaattacatgctattgacccggatgctaagattgggtcaatgctggcaagaatgcaaacttacccagccacacctaatcctgcagatgttcaggctgctcaagtggaagacgataagaacttatttttcacggatgttcaagctcggggagaatatccagaattcatgaaccgtttttttgcagagaatgatattcaactgcaaatggcaccagatgatcagacgattttagcgaagtatccggttgactttattagttttagttactatatgacaacagtaactcaagctgatgcgcctgaacaagtgaacggtaatatggctactggtggtcgtaatctttaccttgaggaatccgattggggttggcaaattgatccggtggggttgcgagtgacactgaatgagatgtgggatcgctatcgtaagccattatttgttgttgaaaatgggctaggcgctctagatcaattaacaactgatcaacaagtgcatgatacgtatcggattgactatttacgtaaacatattgcgcaaatgaaagctgcagttcaggatggcgtacaactaatgggctatacgatgtgggggccaatcgatttgattagtttttctacctcagagatgtccaagcgatatggttttatttatgttgaccaggatgatgctggtaaaggaagtctgaaacgttataagaaagattcattttactggtaccagaaggtcattaaatctaacggtgaagatctagcttaattagttaatgatggtgaatttacgtgatataagaactgacttgccgctggtgtgatcaactgatgggaaatgatactgttagcatccacccagtttaaaatagcatgtgaattgcagaaatttgctttgataagttggattaaactaaaaaggtctatctcgaaattattaaaatttcgagatagacttttttataatcagtaacatattttttactatattcaatccacaaaccggaacttactccaaggcttaataaagtcaagcagtaacagttcctcaggtgcaatccgaccaatccgattctttcggggttcacagtggggttgtaagacgatttgcaattcatttttataaatgccgaagttgtcgttgcctactaatacgtcgccacgctgaaattccacatcattatcgtgtggactgttgggcgtttccttgtaggtcacacggggcatggttgaacggatgacatttgggttaatatcgccacggcgaaaatgttgtggggtcaaggcaatggttctttcgattgcattcgtctgggcttcaaattcaatgtgaaattgtacttgataccgattgattgctgataatgcggccagttcggcttcactcgcataagcgttaccgataattacatcgtcgattagtccggaagcgaagagatgcttggcctggacggcgattggtaagcgccgatcagcttctaatgttggcagaccatcgttgacgttccatggccccatcgtaccaacctgacttgccacgaaagcggcggagtgaatgccgaacttacgaaaacgttcgctacacttaacgaaaaagttgtaaggtagtgcggttccaacttggggatagaaattatggcagccataaataaatgggacgtttgcttggtagctgagaatattattcagataatcgacgtcattactcatattaagttcgatgatcaagccgtacggattatacgagagcagcgcctcggtcgcgccatcgaaaccctcatctagtcgaataccggcgacgtgtaaatcagcgaaaaactttagatctttataggaaattcctagttgtttaaaaatccgtggtgaaacgtccaaaatcgtttggtaacccaactgatttccaacgtcaatgattttctggtacttagctttggtttcggcgaccgtaccagatacttccagcatgctcataaaaattcgagtgaagccgtagtgttggcctaatttgagataagcggcgttttcttcaaagtcgctatgatcgggataaatggataaacctagttgacgcattgtcatgaattaatttcctcctgagtccaccggtgccaatagatgacggcgtgggcgttgttagttgtaatatcgttaaatgcaattgttggtattgactggtgcactgtcgtcgttaacgtgtcgcggaccaggcgattgtgttttaaaacggaaccagagagggcgacccgttgtggccgggactctgcaaaccgctgatataaggtaacgacttgttgtgccagtgcttgggctgacgtgactaataccgtgatggcttcagaattttgttgctcggccagtttggcgattaactgtgctaattgagcgttagtttgtcgatcttgagcgtaaaatttctggacggcggcagcaacatcggtaactttaagttgtgccaataggggagctgttagttgactagtttgaccgttatcagtctgggtcagaaccagtttaagtgcccgcttgctaatgtcgtaggcactgccttcgtcacctaaaacgtaaccccagccgccaacgcgcagaaatttcccggcttggcggccataaacgaccgaacccgtgccggcaatcactaaggcgccgtctgctcctgcaagaccgttcagtagggccagttttgcatcgcttatgacctgggtattagcgtggtaacgttgggtgatggttttttggacctgatcagcccggccagcagtttcaatgccagcaattccgattaaaatcaacccaatctgactagctggaattgcggcagtgagctggtctaagacagtggttaagttagtaacggcagcagagtagtctaggacaacgttaccagggccacccgtaacgctttggaccagatgctcgggggctgtcgtccaagtttgaccaacgatgtgcgtgccaccacagtcaacgccaattaaatatgtcattttagacctcctcattgcagtgcgagtgcgtcacgaacgacaccgtgtgcgcgctgtaaacgctgctcggcgtcgctgacagagacgccagccaagtccatgacaatcgctgtcttaacgttttgatgagctgcagcgaatagttcgctggcttcatcggcagaaacgccggtggccagttcgatcatgtgtttcgcgcgaatcacgagtttttcgttagttggtttaacgtccaccatcaagttatggtaaactttgccgatcttggccatcgaaattgtcgatagcatgttaagaaccatcttttctgccgtgccggctttcaaacgggttgaaccagcgagaacttcagggccgggggttacttcgatggcaacctgagcgtgttgactgattagtgcctgattattgcaggctagactgattgttgccgcaccgattttttgtgcgtagtccagtgcaccgataacgtaaggcgtgcgaccacttgctgccaggccgaccacggcatcattagcagttaaggccagatctttcaagtcttgtgcgcctaaattaggattatcctcagcaccttcaacggcgaccgtcatagcttgagctccgccagcaatgagtccttgaaccatctctggttcagtaccaaatgttgggacacattcagcagcgtctaaaactcctagacgaccgctagtaccagcgcccatgtaaattaagcggccgttagctttaaaggcagtgacgataagggcaatagcagcggcaatttgtggtagttcgggtgtgatgctttgactgactttagcgtcttcttgattcattaactgggcaattgccaggatcgacatttcgtctaagtcgttactggcaggattacgaccctcagtagtaagttggttaatatcagatttcaatcgttttccctcgtttcttaaaatatgtacaaagaggactgcagccaatgcagcagtcctcccagaatcataatcataatggctaattacggttggcgctaaagttagaccgattgtcagcaaataagcaatcatgttcattgaaagtagtcgttagtttaagcataccgtaatgacaaatccgtgtgattttggtgcaatctattattcggcaacggctgctggagctgctttttcagcatcggctttagcagcgtcttgttcagccttcaattggttacgatcccaaatcttgaagaatgggtaatagataaaggtggccacaataatattaataatacatagaacggctgctcgccagtcccaagcagtggtcatcaacgccccaattggtcctggtaatgtccatggaactaaagctaccgtccgactaacgaggtgtagaacagttgcagcccaagtgataatccccatggttaacggtgcgaggacgaatgggattgcaaagtatgggttcatgacaattggaacaccaaagataacgggttcgttgatgttgaagattcctgggataatggtaacccgtccaattgttttaccgtaagcggacttagagaaaaatgctaataagatacagagagacagtgttgccccagcaccaccaatgtagacgaaccattggaaaaattgttcagtcatgaagtgaggaaccgttgcagcagttgcacctttggaaatggcagctaagttatcgttcaggtttggataccataatggccagaagattggggtggctaaagcagcaccgtgaatcccgaatagccaaacaatatcagttaagaggattggtacgataactgaaagtaaattgtcacgaccaaagtaggctaatgggctgaagacccattgtaggaaagcattaacgtcaaagttcaaaccaacgtgaatgacccaagcaccaacgattaagaaagtcgcgggaatcaaagctgagaatgaagctgcaacagccggtgggactccatctggtaatgtaatgacgaggtgatggtcgcggcagatccgagtcacttcggccgttaaaatcccagcgagcattgctgtaaataaccccgcagccccgaagtgtgttagcggcaccacggtggcagcggcctttagtcctaacgctttgaaagctgctggagtggtcgtaattggtttaactgccaacaatagaaagaccatcactgagacgaccccggttgaaatatgatcgaagtgataatcttcagctaaccgacctgcaatggcaaacgcggcgtaaatagccataaaccccattgaaaaattaattggaattgctaaaccagcggcatagggtttaataaagtttgtccaagcagtaataggtagttgcgtgacgatcgtaaagaatgagccaacgatggtaactggaataatgacggccattccgtctcgaatagcacgtaaataacggttggctgcgatcttactcatgacatcaatcgtcttatctttccacgtacgtgaattatccataattcattcatctccttaacaaattagtaatgacaagttagtgttgaattaagtcctccctttttgatttgagttaacacattaacttgatttcatgagtgagtatagcataatataacagtatagttaacgctttcattgttgttagttaattgacatgggtaaattttgattaagtatagacatttaatgtattaagttaataataaggggggcagccatgagtcgtaaagaaccaatttatcaaaccattttaagcgccttgattctggaattgaacacgaaccattttcgaaagaatgatccgttttatagtgagagtgagctacggaagaagtatcaagtcagttccacgacagtcgtgcgggtactgaatatgttagccgatcagggttatatctatcgtattcagggtaagggcagctttgtttccaaatttaatcgggggactgcggtacgaattacggatacccatacatacgatgttgatgaggaacaggttgcaatcttagtggccaatcagacgacgccactaccaacacgggctaagtttacggctgaatcgacaacctggtatttagagcgattacgcgaaattagacacgcaccatttgaattttcgcagtcgtggtatttggcgacgctgattcctgccacagcaatgaagaagttacgggccgtacattcgatttatgcactaattaggaaacatgcgcagcttgatttatcacgccagccctttgagcaagaatatgcggcgacctgcgttcctaatcaacgaattgcggattatttgcacgtgagtctggatacgatggtgattaagatcgaacggtgggtatttcaaggggaagaaacgctggaatataccgttagttacatgttgcctaactattttgggctggcgctaactagtgattccaagtcggtagatcctaaccgaattcgatgatcgatgcataaagagaggagtggcacacaatgtcaattcatagcaataacttttattccaacgtgttacgacagtcagtgcaagtccaagttatcttgccggaaccagtgaacgcggtcggacaaattttaccagactacagtagtggtgaacagcaacttccaactgtgtggctgttgcatggcttaggtggggacgcaacgtcgtggttacggcgaacggaaatcgaactactggcaacgcaataccgagtagcggtcgtcatgccggaaacggggcggggattttatacgaatatggtccatggtccacgctattgggattacttgacccacgagttaccaacacgaatgcgttatatctttccgttgtcggcacgaccggaagacaattatttgttggggaactccatgggtggctatggggcattacgttatgcctttacctatccgcagcggtttgcggctgtcgcggcactatcaccggtgacggatctcaaaaggtttcacgtggaacaatcggcaattatgccagaccttgagctggctttctcaccagcacagatgcaagggacgccagcggacttgtcttacttggtacagcaaccgacaaactgggggacgttacgtgttctaatggcgacgggtgatcaagatatgttacggtcaatggatgaagccttcaagccagagttggcggctgtgtttaaagaccagtttgaatggcagttacaaccgggtcaccatgattggcggctctggaatcatcaattaccatttgcgatgcactggttaattaagggaggttggcgcaatgtttaatgttaaagatgagcacggccactataatttgtggcggcagacgggattagctttattaccgctattattggcaattatcgcatatccattgctacctaatcgtgtctacgtgccaaccgctgtcaccagtctgacgccgtggggaatcaagagcaatatcttcatttatcccgtcttttgcctgattctgtggttctttatctggctatttatcttcttcaaccggttatatgaaaaaaatttcaaggtaacccgccaaaaatatcggccaatggagaactactatgtgtggagcagctgggtgttggatattctggcgactttgatggtggtggttcagatcttggtgagtgttagtcggtgagtggtttgttaggtgtgaagttggcactatgagattaacgatattattgaatagtaaaatggctacagattgagcaatcaagttcctcaatctgtagccattttactaatttttatgctgttttacatagaaaacttgcgatttcgaatcatcaaaatgataacgattacaagactgagtagtgtcacgccagtatcgatttcgaaaacatgtagaacactgacagctgtgtcatcaatgatgaagctagagactaatggacctacaaagaatgtcagtgcagtagcaaaactatagtagccagtcaccttacctttctcagctggaaagtattggcttagtaaagttaatcctaattgccaaatacctccggctgcgaagaagccaattgcaatggcagttaaccgagcaccgtcagcactagggataaccaccatttggagtaatgctaggaacgaaatcagagtgtaagcaaagatcaacttgattggcttaatgcgagttactaatgaggaggtaataaaaacggatactagtgaggccattgcataccatgaaattagtgatttagagctgtttagccccaactttaagacgctactaccgaagtttggtgcgtattgagagaaaatgtaaaacgtaaatgaaagtgtaaaaccaacaattattagcaaactaccatcaattaacatagaaggctgattgccactaggattaatggttgttttaggctcgtcgctaattttagtgtgtttttgagttaatgtttgtggtgcgaagctggcaagtccaattaagatgatatctaaaaccatcacaactaccatgacgactagtgtgatttgagcgtttggctgagcagcaacaatgaacggcaggacgaattgtgcaagagacatggccgcttttactaacgaattcatgctagcagcttgctcttggaaagcatctgtcagtgctggataactagctgtatcaccaaaggaattggttgcgcccataaagagtgcagcgatgcaagcactgatgagattagtactaaagaacaggcccataagaaatagaatttgtgcaaccataccgattaacatagttcccttacgccccaagcgatcagaaagataacccgcaatgagaattgtcaataagcggccaattccaatcattgcaatgacagttgagagccctttaacatcagtgtgccatagtgcttggaattgagtcccgtattgagacacaataatagtagccattcctaaaatagcataatttaaataaattccggcagctaatggtaaatatgtcttatgtttcatggttatatcctgcttttctttaagttccatagtatcacccaccaattcttattttcacaaagtgtgcatttttaaacgttataagcaacaaaaatggcatttttaatatccaatataaatgttgaaaaatcaatcaagtaaacggtttataattattaatatttttaattgatactaaattcacaatcgttgattcacttcaaattttaacacggtctcgagaagtgtctaataacaaaatcgcattcaatcgatagctagaagctattaatcgaatgcgattttattggttcagagttaaatattgttaacagagagtgttttgctttgatcacgaacgaaggtgatgaactcttcaacagcgggttgaggtgtacggtgcttaagggtacccatgtacaaaattcgttgccatgttggaaatgacaatggaataatcttgactggcatggtttgaagaatagacatattaggtacaacggcaattccaaaaccgctggccactaaaccggcgatggcctgatcttcttctacggcatatgcactaatgggttgaccgccacagtcgttaaatagtttttgcataattggatgaagtccactgcgttgcgaaaaagtgatttggggataggctaatgtttctgccaaattgatactggagcggtttgccagtgggtgtgtagttggtgtgatgcaaaccatagtttgttcagcgacgggaaaaaactcgatatcgctaaagtgatccatctttgagcaaaaagcaacatcatatttgttgttacgtaaaccgttcagaatatctggggacaggccagtatcagtgttgaattgaaattggacagcggcatgggggcttagttgaagaaaacgctgggcaatatctggcaaccacttaatacttagtgttcggagtgcggcaatacgaatgggggctttttgttgatcaaaacgtttaatattagtcacacttttgtcgagtagtaggagtgcggattcgacatcactagcgaaaaccttaccagcaggagttaaagtaacactacgtccggctttttgaaagagatcaatgttcaattctgcttctaaggagtgtatggctttagttaaacttggttgtgtaatatgtaacagcttggcagtttgtgtatagttttcagttcttgataatgcgacgaagtatcgtaaatgatccaaattcatgatagaaataacctcccgaagttcattctgacgggtaacgattgatactcaaaagttaacaactacggttaatataacagaattaataacttttggctatggatagccccaactaaaagcaattggacgagtcgagtgatagcgattacatttaacttgtaaaataaattatgtgaatcacaaaacatgcatgtgtcgaatccactatttggaggaaattattatgacaaaatcacatccaattacaattagttcctggacacttggtgatcaatgtacatttgaagatcgttgcaaagcggctagtgctgctggttacgatggcattgggttacgcgctgaaacttacgtggatgccttgaacgaaggtttaacggacgatgatattctcgctattttggataagtataatattcgttgcaccgaagtcgaatatattgttcagtggtgtgaagcaacgcgcacatacgaacaaaaatataaggaacaggcttgcttccatatgtgtgaattatttggtgtaaagcatattaataccggattgatggaagattatgatattgactatacagcaaagaagttacaagaattagcagcccgggcgggtgatttaattattgcattggaaccaatgccttacagtggcttacctaacttggacaagacttggaagattatgcaaaaagccaactgtgacaatgtatatatgttactagatatgtggcattgggtacgagccaaccaaccatatgacttgttgaccgaggaacaagcaaagcgggttatttcaattcaaattgatgatgcatatactcggccatatgctgattctatcttacgggatgaatcaatgcatgatcggttggctccaggtgctggtgatttggataccgctgggtttgtcaagatgataaaagatgcaggtgttgatcctaaggtgattggtgtcgaagtaatctctgatcaatacatggctaagggtattgattacgttgcggattacacctataagcagactgtgtctgttttaaaggaagcgtggcctgaaattttaaaagacccagttcaagcttagatatttgattataaggagtgattattaatgaataataattggttaggattaacggataaagttgttgcaattacgggtgctgttggtggtatgggtaccaagttctgtgaagagtttgctaagcagggtgccaaaattgtcttgattgatatgattgcggataaaaccgaagcgtacgcaaagaaattgacagaaaagtatggcgttgaaacgttggccgttaagtgcaatacgactaacgaagaggaagttgatgctgctgttaaggccgtgactgataagtttggtgaagtcgatgtgctagttaatacggctgctattttacgcttctcaccacttgaagacttgcgtttggatgaatggcaagctgccttgaatgttaacttaacgggttacttcttaatgtcacaacggtttggtcgcgtcatgattcaacagaaacatggtgcgatggtacacatctcaaccgtagcgtcacgttatcctgaaacatatagtggggcctatagtacaactaaagcagcggttaatatgatgtctaagcaaatggctgctgaatggggacagtatggtgttcggagtaactgtgtcttaccttgtctggttaagacgccgttatctgagaacttttacagtgatcctaaagttgaagagggccgtgagcggttagtggctagtcgccgcattgggactttggatgatattgctaatacggtcttattcatggctagtgaccgttctgactacactaatggtggtgaagtgaccgttgatggtggtttgaatatgatgatttctgacatgattccaaagccaggtggtcgtcgtcaatacgcgattgatcatcatcaaccagcgaaaaaatagaaattaattcagttacatgaactcgtggatgagactgggacgactgtctcggtctctttctttattaattaagaggagataacaattatggaaaaacgaatttcaggtaccactggtttatttaccttactcggctctccagtaggtcattcaggttcaccggcaatgtataactttagctttcaagagcaaggattagactatgcatatttagcttttgatgttaaaaaagcacaaatgccagaagcgattgatgcattacgattatttaaggttcgcggtagcaacgtaacgatgccatgtaagggcgttgccgcaacacttgttgatgagttgtcaccggccgcaaagattgtgggggctattaatgtcattgttaacgataatggtaagttgacaggtcatattacggatggcattggttttgtacgcaatctgaaagagaacggtgtagatattgctggtaaaaagctagtcgtgattggtgctggtggtgctgctacggcgctacaagttcaatgtgcattagatggtgctaaatcattggctatttttaaccgtgaggacgacttttatgcgaatgccgaaaacactcaaaagaagattaaggaagcaaagccagaagtcgacgttaacgtctatcatctagaagaccaagacaagttaaaagctgagattgagaaggctgatattctggttaacgctactattgttggtatgaagccgctggacggtcaatcattagtcgatccaagctatttacgttcagacttggttgttgcggatactgtttacaaccccctaaagaccaagttaattgaagacgccgaggcattaggatgcacggtagcgccggggaaaggcatgttattgtggcaaggtgatgcagcatacacactctttacaggtaaggctatgccaacggccgaatatcaagcctacgaggcacgtcaagcagctaagcagcattagaaaggggcaataaaaagatggaagcacgaattgatggacacacaactatgctaggccttttcggctcgccggttggccattcaggcccaccagcaatgtataactacagttttgaaaaggcaggtattaatgatgcatacctggcttttgacattcaggctgatgaaatggccagtgcgttaactaaaatgcgcgttttaaatatgcgtggtgctaacgtaacgatgccttgtaaaaaggttgctgcagaattagttgatgaattgtcaccagctgcagaattaatcggtgctgtgaatacgattgtcaataatgatggcgtgttagttggtcataatacggacggtgcgggctatgttgaaaatctacgccagcatggtgttgacccacagggaaagcgccttacggtgttaggtgctggtggtgctgctacagcaattgccgttcaaatggcactagatggcgctcaggcgattcatatctttaatcctaaggactcgttttatcaaaatgctgagttaacggctcaaaagatcatggataaagttcccgcatgccaagttactgtaggcgatattaatgaccaggaagtcttgacacaagcaattgcacaaagtgatattttggctaacgcaaccaaggccggtatggcaccgaatgttgaacaaactaatattaaggatatgaccgtttttcgttctgatttagttgtgacagatactgtttataatcctgttaccacaaaaatgttagcagatgcagctgaacatggaagcaaaacaattggcggtaaggggatgctggtttggcaaggtgccgcagcgttcaaattgtacacaggccaagaaatgcccgttgaagaagtaacgcaacggttcttctcagatgatgggggacgttaagatgacaagtaacacaaattcaaaccgtaaatattatgtaacagcattggcattgtactttgcttactttattttaggaattgcctcttcaataatgggacagtataaaactgagtttgcaaaggcgtggggcgcatccacgctggctaacggaaccattgatgttagtatggtagtttctgtcattgctgcctatggtctgggacggctgattgcttacccatttgctggtccagtctctgataggattgggcgtcgtatcagtggtttcattggaattgcgttgtacgccgtattcttttttgggatgatcacagttcacagcatgtggtgggcgtatgctattggtattattaacgggattgctaattcgttcttggatacctgtgtgtcaccaagtgtgatggaaatctttcctaaatcggcctcaattgcaaatctatttacaaagtttgccataacggttgctcagtttgtattgccgttcgttattggtttggttgctagtgctcaaatgtcatatcgagtcatttttatcgggtgtggaattttaatgattgctgatgcaatcttagttctggttttaccatttcctaagcaagataaagcaactgctgaggctaaaacgactactgacaaaccgaagcatcgtttcacaccagctgcgattgcatcaattttaattggttttactagttcagcgacgtttatgatttggttgaattgcaatcaagagctaggagctagttacggaatcaaagaccccagtatcctgcaatcattttatgcggttggtgcaacggtagcggtcttattaactgctcagtttatccatatggggctgaaagagacgaccgtattagtactatatccaagtatttcaatcgtcatgttaatgttatgttatttcattaataatccagtcattctctatattggtagttttgttattggttacgctgctgctggtggggtactacaattggcgacctctacgaccattggtttctttccagatagtaaaggtctagcgacatcccttgtaatgattgcctcaagcgtggctaattatgctgtattatcagctgcggcatacttgacaaaagttaccggtgctgatgcgccacggatgataattctaatgaacattgtgattacgttaattggggttggtttagcattgattgtgaaacatggtggtcggtcaacacgtacgtcggctgcttccggtgttgaaagttaattaaaaattgcgccttcaataaaggcgcaatttttagattgatcgttcttgattagtgtaatgttgccaacaataactgcgaataaactcttggaaacggtggacggcaggtgtaataaaaccactgcgacgaacgactaagtaaatttgatgttgtaatggctgatcagctaagtgtttgatttgaacacgctcgggatttaaaagtggtaagtagggcattaacgcaacacccatattgtaacgaacaaacccagccatagtatgatcttcttctacttcataagctaccttgggctgaacgtgggctgctgataggatttggtcgattaatggtcgcaagccgctattctgtgaaaataagatcattggataaggtgctaggtcttcaacgtgtagcggatttttttgtaccgcgggatgatcatttggaacaactgcaacaatttcttgttgaactagtgggataaagtcaaagagatgggcagttagctgctcacccagtctatcgacgttagaggctagaacgatgtcgtatttttcatcggctagtgcttgcaggagcacaccggagtttccttgaccaagctcaaaagtaattgcttgattttcgctttgatttttgaaatgggacagtaactcaggaactagttgttgtccaagggtgtaggtaaatcctaatttaacatgaccggtatctggatccataagttgtttgacgagttcgttgccttgtgataaatcatttaaagtagcagtgacgtatttcaaataaacaccgccaattgatgttaacttgatattacggccatctgcttcaaaaagtggaacacccaattcgtgttcgagttttttgatggcataactcaacgaaggctgtgagatacctaagttttcggcagcctttgccatatgttgtgttcgagctagctctttgaaaaaaactaaatgtcttaaattcatgaggaatgctcctttactcatagataactttgatgatttaaacaactcatccatatttattatattaaactaatttgctaacataacaagtgaattgagtaacaaacagataaaaataatatttaggagtggtttttcatggcagaacgaattgatgggcatactttactgattggtttaatggcgtatccaattcgtcattcaatgtccccaactatgcataacaatgcttttgctaaattaggactaaattacgcttacttagcatttgaagtgacgaatgaaacgctgccaagtgcaattgagtcaatcagaacacttgatatgcgtggctccaatatttcaatgccaaacaagcaaaaagtgattccattgcttgataagcttgatccagcagctaaaatgatgggtgcggttaatacaattgttaatgatgatggtgttttaacaggttatacgactgatggcatcggatttatgaaagcgctcgtggatgaaggcttggatattcgcgaacataaaatgacgctagctggtgctggtggtgccgggactgcgatcgcagtgcaggctgcattggatggtgtcaaagaaatatctatttttaatatgcacgatgcaacatgggcaaatgccgaacggaacgttaaactaattaatgagcagaccgactgtcacgccactttacactcattagaagatcgtgatgatttcaaacgggaaatccaaagctcttatatctatactgattcgacaggtgttggaatgaaaccacttgaagataagacgcttgtggacgatcctagttggttcagctcagaccaaattgtgtttgatacagtatatgcaccacgaacgactaaattaatgaaggtagctcgtcaagcaggattgaagcatgtttacaatggtttaggtatgatgcttgaacaaggtgcagcagcctttaagctgtggactggcgaagacatgccagttgattacattcatcagattctgtttagtgatgatcaggataaataattgatgacaggaggcaagttaagatgcaaccagcgataaagctacgaaatattgaacttggtagtggtcgacctaagttggcagtgcctatcacaggaacgacgattaatgatattttagcagcgacgacaccgattttagctgcacagccagatgtcgttgaatggcgaattgattttttcaaggatgtaattaatccagaaaagttgaaatcggccggtcagcaacttcgtcaggctttaggtgatattgccttattaactactttccgaactaaaggtgaaggcggcgaattagcactatcagatactgagtattttaaactgtgtgagacggtcttagatggtgggttcacggatgccttagatgttgagcgttaccatgacgaacaagctgttaaacaaattgttgcagcagctcatgagcatcaagtagttgtgatcatgagtaatcatgattttgataaaacgccggcggttgctgagatcgttaagcgccttactagtatggtcgattatggtgctgacgttgctaagatggctgtgatgccacaatcggtggaggatgtcttaacattactgacagcgactaatattgcacgccaaacactaccacagccagtaatcacaatgtcgatgggtgacttaggaaaagtgtcacggcttgctggtgaagtgttcggctcttgtttatcatttgcaacggtcggggcggcttcggcacctgggcaaattgcacttgaaaatttacggccggaattggaagatctgaagttaaattaaagcataactgaaagaaatcgtgaggtcagagtgatgattgggacacaaaaaaagtatgtttcacaatttacgatgatgggaaccgtcatctcgctgacattatttgagccgaatcagttagcggtcgaagcggtctatgattacttgcagcggatggatggtgtcttttctgtcaatcgtgccgattcagaattagctgcgatcaatcaatatgccggtattcatccagttttggttagcactgaatgctttcaactagtgtcggatgctattaagtacacaaagcaatatgcggatagttttaatgtgctaattggaccgttggttaaactttggaagattggttttggtgggcatcaagtaccagcggccaagggaattagccaacgattagccttattagatacgcacgaagttatcctagatgaagcccaatcgagtatctacttgcgtcaatctggcatgcaattagatcttggtgcgattgccaaggggtattttgccgatcaggtcgttaagcagttacagcaggctggcattaccagcgctattgttaatcttggtggtaacgttaagctattaggggccaatccgctaaccgataatcggcgttggcaagttggaattcaagcacccgaagcgccacgtggctatccagcgctacaggttgaaacgcctgctagaacggtagtgacgtcaggtatcttcgaacgatattttaaaattggcaatcaccgctaccaccatatccttgatccgcgaactggttatccggttgaaaatcaagttgatcaggtgtcgattataactgaacggtcagaattagctgaagtgttatcaacggtggcctactttgaagggccaaaccgtggttgtcaactaatcgaacagttgccacatacggaagcaatttttattgatcatgaacaacaggtaacagttaccagtggcttaacgccgcgacgcaaaggagtgtttactattgagtaaaaaacaaattaccggccaagcaatgggccacaacggtattatcaattatgaagttgacgtgcaagataataagattgaggatttgaaaatattaaagcattccgaaacgtcggggatctttaaccaagtcattgataaattgaaacaaaatatcattacggaacaatcattcaatgttgacacaattagtggtgcaacggtgatgacccaagcgttacttaagtcggcagataaggctgtaaccgatgctggtgttgatgtgcagccagttcctaagaaaaaagcccccaagacgcaaaacttgcggaccgacgtgctcattattggtggcggagaagcgggcttagtcgctggctgtcgagcgttgacaatgggtcagaaggttatcttagttgaaaagaacggctatcttggtggtgcgacgattctgaatggttctaacgttgttggtaccgggtctgatgttgctgcgcaaatttttgataataatcatgatacgccagaaatgttggcacaagatgttgctcgtgaaagcttggagacgaactatccagctttgaccgacctaatggtgcataacattggtccagccattgattttattagtaagtttgcagatttacattatcaaaaagcacagacgcaaacgccagaacattcgattaaccgtcagattgaactaccttcagcaagtagctatgaattcattcaaaaagtttcgaaggcgtttgctgctgcgggtggtcaaattatgttggatactcgagtcgagaagcttatgttggacaacgataaaaagttacgcggtgtgattgctgctcaaaaggaccaaacagtcaacatcaaggcacgttcagttgtgcttgctgcaggtggtcatggcgctaaccaaaagatgcgtggtactgaaagcgaaggcattgattattatggcccaatgacttccactggggatgcctatcaatttaatggtgatttggatttgcaaacgcacgatttaggttggtacaagctgtatccacatggtgttgaagtggaaccaggcgttgctaaattgaccacgtacgcgtcgaaacaagcaactgatatgggtgcaatttacgttaactctaagggtgatcgaatcgttaacgaatcaaatgtttatacgacttttcggaatgccatccttaaacaagcggataaagttgcttacctagtaatggatgaacggacttggaagaaagtttacgacctactgatcctgcatgatttcacaccagaagaaattaagagcttctttgagaataagggtaaacggccagtatttgttaagggttctttggaaagtgctgctgagcaggccggaattgtggttgatgaattagtccaaacggtcaaaaattatcaaggctatgttcaagatggtcacgatcatgatttcggtcgtgatccgaagtacttgcaccaatttgaaggtgaaacattctacatcattgaacaacgtgatcgctttgcgacgactttaggtggctatagtgttgatgctgataacttgcaattggtaacgactaaaaatgcaccggtagctaattactttggtgcgggggaaatcatcggcggcgctaacggacatgattcaatgccaagtatgatgaatacttgggggatttcgtcgggttacgttgccggcgccgcggctagcgaaaacgctcagcggcaggcaaccgcgggcgatgacgaagccaatattgtggctattgtggggactaacgcttcaaaatcatataaccgtaagttgttgtatgccatgaaagaattatttgaaacgcaagttaattttgaaatttgtgaaattaaagatttaccgctattcaatgaagatgatatggattgggaaccggcaagtgtaaaagcgttagccgctaagattgaagccgctgatggtgtcgtctttggcgtgccagaatacgatcattcgattccagctgccttgaagagtgccattgaatggctgtcctgtgcagaacatccattcaaagacaaaccagtgatgattgttgggacttcgttaggtattcaaggtacggtacgtgctcagatgaacttacgacagattttggactcacccggtgtggatgccaaagttatgcctggtaacgagttcatgttacctcaagccggcaataagtttgatgagaacgatcatctgaatgatgacggtagtgaacacttcttgaagcagtgctttgggcactttttagaggggcttgaattagcatctaagaagacagtgacgaattaactactatctagactaaaagaacgtacacaactcgtgtacgttcttttagtctagattttagttgttaaatcttttgttccacatcgtcgattgtgacaaccagggtcgcgcgaatccaatcaaacttagtatgcatttgatcgaaataagcgccactagtttcaaacttgccggtaccatgaatgtggaaaccacagccagtaccagttgtgccgggaaccttgtaactaccgacagcaattgtaatgtggttgtcggtagcaaaatcggcctcaattgagtgcatgccagccgatgggatcaatagggtatgatcatcgataagttgcatataatgactccaggtgttgacgacgtgtgctggtgcggcgttgaccgtaacgatggttgcgggggtcgtgtctttgataacttcaataaatttagggtccataataagtactcctttacgtttatattctcataatatattgtaattgatatatataaattatcaagcgagagtgttcgatgtctcaataatcttagcggaggtagcatggtaaaaccaggcgttgctttttactaatgaaagcggtaactttaactaggaacgaataacgagagggtgtttaatatgtatcaagcaagccagaagcgctatgaccatatgatttataatcgagtaggcaatagtggtttgaagctgtcagcaatcgggctaggtctttggaataattttggaagcgttgatccgatcgctaatcaaaaggcaatcattcatcaagcttttgatttgggaattacctactacgacttagccaataactatggcccggagcccggcagtgcagaaactaattttggtcgtattatggctaccgatatgcggccataccgtgacgaaatggtcattgctagtaaagcgggctatgtgatgtggccgggaccatacggcaattgggggtcacgaaaaagtattattgccagtgctgatcagagtctgcagcgaactggtttagactactttgatattttttatagtcaccgtcctgatcctgaaacaccaatggaggagacggccactgcgcttgatcagctagtacggcagggtaagacattgtatgtaggcatttcaaattataatggcaagcagacggctgctatgaccaagatatttgaatcattaggaaccccatacattattcaccaaccacgctataatatgtttaatcgacaggtggaacaggacttgttccccgttctacaagcaactcataaggcggcggttggctttagctcactatcacaggggttattgacggacaagtatctgcacggaatcacgacagattcacgggccaataagcaaacaattccatttttgagtccagtccaggtagaacagacactagctacggtaaagcgcttaaatgaagtcgcgcaacaacgggagcaaagcttagctcaaatggctttggcttggaacctacgtcagccagccttagcaagtgtcttgattggtgctagccggccagagcaggtggttaataacgttgctgcattggaaaagttgaaatttagtgaatcagaattagcaacgattgaacagattcttaccgaacaaccggcaattgattggaatgctggtcgatcatagcgtttgcacaattcgctatagtcaatgttatagagccgcaaaagaaagggccatatccgaggatatggccctttctgtacctaatagttaagttaataataacataattttgcagatttgcacgcacaggggggcctttactaaataaattagtgtttaaattcgccaattttcacaattaatgataaagttttacatgatagttatcacgattatgcgttgaagttcggcgcaatacttgaaaattaaaataatttgcaaataaatcatgcgatagcgactttagatggtagtaagaattagtttgaatttaagggggccaattcatggcggcgacgctaaaagatattgcaaataaagttggcgtatcattggcaactgtatcgcgcgtgttaaacaaagatcagtcattgtctgttagtgatacaacgcgccaacgaattctagatgcagcagaagcattacagtattcaaaaaataaacggcatactgtcacgacggcgcgtaagcgacttgctattgttcaatggtattcggaatctaaggaacaagatgatttgtattatatgtcagtccggatggggattgaacgtcgtggacaagataatcagtttgaagtgactcggatcttccaaaataatttacaagaattgggaccagacgtagatgcagtgattgcagttggaaagttcagcgagccacaagtcaaggacttggcatcagtaactgacaacttagtattcgtagatgatgatcagtttgatgctggttttgatagtgtcattactgattttcggttggccacagaaaaagttgtcgattatttttggcaacgcaactttcatcatattggctttattcacggtcaagaaatgacaaccgaccatcagttagcggtagttgatcgacgcatgctaggttttcgggccgcgatggaacgacggcatgcgtttgatcctaagttcgtttttaagggcgattatactagtgaatctgggtttaaaatgatgcaaaaagccattcgtaagttgggagatcaactaccaggagccttttttgtggcaaatgatccgatggcggcaggtgcgcttaaagcgttgcaagctagtggcatccaggtgccagaacgagtgaagctatttagctttaacaatacttcgctggcgacattcgtttatcccgaattaagcgcagttaacgtagatactgagttaatgggggcgaccgcagttaatttggtcatcagtcgactagcagggcgaacaacgacacaacgggttgagctgggtactaatctggttgagcgagcaagttccaagtagtgaagggcgatctgggatagaaaccagatcgttcttttagtattttaactaaaagttttactcaacttcaagaaattctggtatacttctaaatgaaagcggtttaaataacacggaggtgcatgattttggaaactaaaaaaacggtgtttgaccaactagatggtcaagatgtaatgcgttatacgctggtcaatgaccatcaaactcgtatctcggtccttagttatggtgggacgtggcaagaattcgtcgtcaatgaagacggcgttgaacatcccttgatttggggccttgataacatgactgactatcaacgagtgggatactgcctatgtcaatcaattggtcgggttgctggccggattggcggcgctaagttcaaaatcgatgatcaatcctatcaagttgatatgaacgaacaaacccattcgctacacggcgggaatcatggttttaacacgctgaactttgaaggtgcttttagccaaaccaatgatagtgtcagtgtgactttgaagaagcatatcaacgccagtgatgataattacccgggaaatatggatgtcgctatcaagtttacattagataatcaggatcaagtatccattgcatttaccggtgatactgatgcagcaaccctctttaatccaactaatcacgtttattggaacacaactgatgatcggaccagtttggcccaacaaaaattacagattacgagtgcagctcacttggaatttgatgatgaaaaagtcccaactggtaagaaattagcagttaaaggcacagcgtatgactttaaccaggcacaaccagttgaaaaggcattagaccagctgaagactgagaatggtggcattgaatttgacgatgcgtatgaagttgccccaagtgcggcagaaccaattgctatcgttggggatactgatgataagcgccaagtaaaaatttattcagatcgcaatagtcttattatcttcacggctaatccgtttgatgctgataaggaagacgcgcatcaatataatgcgttagcgacggaagcccagacacttcctgatgcaatcaatcatccagattttggtgatattgtgttacgtccaggagcaccagtgacgcatacgattcggtaccaatatgaacggttaaattaatactagttgaggtgtcaggcgagttctgcctggcgccttttttgtaaacgtatgagtaaacaatgtttaatttagttaacaaagtcccgagcatctgattaataccgtgattagtaaaacgatgatcattggtaagataatgagtactatactgcttaagcccttggaaagcgggcaatcagtgtcgataggcgcattagcaggtcctaatcaaaagcggtatagataaaacttttgaacaaattttactaaaaatcattgacattacttctgaaaacgattacatttaaacttgtaaattattcaaggaagatgtgaggcgagattatggatgcagagacaaagcagagtaaaggtcgtaaaataacatcgcgacttgcttattcgtttggggcgtttgggcacgatgccttctatgccactttatcaacttattttattatgtttgtgacctcccacttgttcgataagagtagtggggctcaaggaacacaaatgattgcttggatcaccatgattattgcaggtttgcggttcgtggaactagcaattgatcctttgatcgggaatgccattgataatactaattctcggtggggccactttaaaccatggattgtcattggtgggattataggttccgtcgttttagcacttttattcacgagtttaggcggattaaatacctcaaaccccattctatatttaattatttttgcaattttatacattacaatggatattttctattcgtttaaagatgttggtttttggtcaatgattccagcaatctcatttgactcagcagaacgtgaaaagacggcgacatacgcccgggttggctctaacattggtgccaacatcgttggggttatcgttatgccaatcgtcttaatgttttctgttaagtctaacagtggtcaaggtgacaaccgtggttggatggcatttgggatcattattgccgcaatcgctttgatttctgccttagttgttgcacttggaaccaaagaaaatgattctgaattgcgtaagaacactgaaaagactagcttcaaggaagtcttcaaagtgttagcccgtaacgatcaattgatgtggttatcattgatgtatgggatctacacggcagggattgccattacgaactcactagaactttactacttcacctatattttgggtgacgcctcgaagtttacactattaggttcgctaaatgcgattattgggatttttgccgtattggccttcccaccattagcaaagaagtttagtcgtcgtaaagtgttcttcttagcagttgttattatgatgatttcactgatcatgtttgcctttgctggtcagtcattaccaatgatcttaacagcggccgtattattctacattccacaaccattaattttcttagttgttttgatggttttgagtgattctgttgaatatgggcagttgaagtttggtcatcgtgacgaatctttaaccttatccgttcggcctttacttgataaattaggcggtgcgatttctaacggtgtcgttggtttaactgctgtttgggctgggatgacagctggtgccactgctggtgatgtgactagccatggcgctgccatcttcaagttaatgatgttcggtgtacctgctgctatgattttgattgggacattcatcttcttcaagaaggttaagttggatgaaaagatgcatgcacaaatcgttgatgaacttgaaaaaacatggtcaactcacttggaaaccgatgaaactcctgctgaagttgaagcagaagccgatgccaagacgacggtttatcaagatcctgttgccggggaactgatcagtttgaaagatgttgctgacgaatccttcgcaaacggtagtatgggtaaaggtttcgccattaaaccaacggatggtcgcgttgtcgcaccatttgatggtgaagttgttgcaaccttcccgactcgccatgcaatcggattacgttctgataccggtattttaacgctaattcatattgggattggtaccgttaagatgcgtgggactggatttgttcagtacgttgagaagggcgaccatgtcacacaagggcaagaattaattgaattctggcaaccagcaattgaaaaggctggcttggatgataccgttatggtcgttattacaaactataaagatatgcccgaatttacgtatcttaaagattcaggaaccaccgtacaagatgatgaagatgtcttacaattatcgaatgtcggcttaccggatcaagcatagtttctttacgaggagagctattaatgacgcgagccattaatagctctttttgtgaactgaaatagaaaaagctaatagcgaagggaagattttactatggcagtaacgttgcagcaaactttaattgacattgatgaagaacaacttgtctttcacctgcataacgatcaaatctcgtatattctaggtgtggagacaggcaacgtgttggcccacttgtactttggcccacgggttcggggttatcatggcgagcgtcagtatccccggattgatcgggggttctcaggaaatttaccgaatacgactgatcgaagctattccaaggatgatttgccacaggaatacggtggcaataataccggtgattatcggcaacccgccgcgattattcgcgcggccaatggtgctcgaacagttgattttcgttatcaagactgccggatggaagccggtaagccggaacttaagggcttgccacaaacttatgtcgaagatgaggatgaagcccaaactttgattgtgacgttgcgagatgccacattaggcgtgacactcgaattagcctacacgatttatcgggatcggccagttatcacgcgtagcgcccggttgattaatcacagtgagcaagctgtcgacttagaaaaagtggcttcgatgcagatggacctgccaacccaaccattagatgccatttcgttacctggaagctatgcgcgtgagcgccagcttagtcgtgaacggctccatcgaggtgtaactcagtttgaaagtcgccggggtgctagttctcatcatatgaatccttttgtggcgctagctgatccgaatactaatgaatttcaaggcaatgtccttggtgcattgctaatttattcaggtaaccaccagattagtttagaacgggacccaattggtcagacacgcttgactatgggaatcaatgaatataacttcgactggcgattggcggccggtgatagtttccaaacgcccgaggttgcaatggtatactcgacgacggggcttaatggtatgtcgcaaacctaccatgatttattgcgtgatcgcgtggcgcgcagtcgttacaagcacgatctccggccgatcttgatcaacaattgggaagccacttactttgactttgatgcggacaagattcaatcaatcttggatgctgcagcaccactgggtatcgaaatgtttgtgctggatgacggttggttcggtcatcgaaatgatgataatagttcgctaggtgactggtttgttaatcggaacaagttaccaggaggcttagcggatattagcaaacggacccatgataaagggatgcggttcggactttggttcgagccagaaaatatttcagccgattccgatctttatcgggcccatcctgattgggtgttaggcgtaccagatcgtggccgaacgttatcgcggaacgaatacgtgcttgatttcagccagccggatgttgtcgacaatatttttgaacaaatgaccgcagttcttgataaggtgcccattgattatatcaagtgggatatgaaccgcaatttaacggaagtctattcgccacatagcgattcaactcatgaaggtgagactagccaccgctttatcttaggtgtatatgacttgatggagcgtttaacaaaacgctatccacagatcttatttgaaggctgctctggcggtggtggccgcttcgatgctggtttaatgtattatatgccacagagttggccatcagataataatgacccgattgaacggctcaaaattcaatatgggacttcactcgtttatccaatttctgcaattaccgcccatgttgggacgagcccggatgaattgttaggacggtcgacgtcgatgaagatgcgtggtgctgtggcaatgagtggtaccttgggctatgaactggacgcggcccaactaagtgatgcggacaagcaggccgttaaaagacaggttgccttctataagcagcaccgtgagttagttcaatacgggaccttttatcgattagagagcccgtttgaatctaatacggtggcgtggatgtttgttagtccggatcagaaagaagccttgctgttcaccttcgttattttaggtgcagttcaaccagaaccgcatattacgaagttagcgggattagaccctcagcagacctacgttgagaccgacacaaacaaaatgtacggtggcgatgaattgatgcaactaggactctacacgactcccgttcaaactagtgactttacggcgcaggtacattacttcaaggctaaggactaagctcagccattaaacatattaaaacttaatcatcgttaatctaaaagaacgctctggcaaataactcgccggagcgttcttttgaaatcaaaataacttttagaaatgaatattaaagctgaagtcaatgtcttgatcagcggggatatgatatggggattctacgtctgttccccaactatcaatgccaccgaccccacgaacggcaccgtagattgataagaccgttcgccgtgctaatggtaattcttccatgtgcgttgcgttttctagttcagcggcggtatagggaaggcagctgaaggcgaatggtgcatcggcttggctaaatgtcaaactgaacggtgtgttgtcgtggtcagcgttattttgtgttgttgatcgcgttactgtcacttgttcagtttgcatgtgcatgccgcattcttgtgggaccaagtatggtgtgactggcagactgtcaacgtggaatcgcccgtgcgttgcgccggccagccggtcaggataagtctcaccggacaaaccggtatagtcgaagccggtcgcggtagttggtatgataaaccgcagaccaaatgagggtagctctggcaaatcagactgaccgctataatgggtggcgatattgatctgaccgtctgctgtcaccgtataagtcactgtgacgatggtactaggaacggtcgtggtaacgaagtggtaagccagtgagactttcgtggcgatttcgtgatccgtgtatttgttattgagtggcgcgattggtaacggtgtgactggttggtcgtcaaccgtcaattcgatatcttgacaagttgagaacttatcggccgcgtaccactgtgcggatttgactgaaaagccgctaccgtgatcattatcggttgtcgcccgccaaaagatgggcgtgggtgtacgatagagccattctttatcgttgacgacgagtgattcaagtccgccacgttcgtagctaaagaggtagtggaaattagccccctgtagtcctaaactcccgtcgccgtaaataacgtgtagttgattatttgtgtaagccataataatatttcacctcttgcattgctggttttggcgtccggtcagcaaacattaagccgtcaccggagaattcataatcggagtggcgttcgtcgaaatcaccgccataccggagcacatcttggtcggtaattgggtcatgaacgaagagggcttgatcaataaagtcccaaataaagccaccttgatacatcggatacttgtcgatcaaatcattatatgattgcataccgcccagagaattccccatgtcatgcatatattcacaatctaggaaaggtttggttgggttatcttccaagtaagctacaatattttggggtttttcgtacatccgactttcaacatcagaaatgcgatcttttaattctggtgtgtggacaacaccttcgtagtggacgagtcgtgaatcatcgtgttctttataaaaagcctgcatcgccgcgatatcttcgccagcatacgattcattgccaagtgaccaaaaaatgatcgatgggtggtttttaaaccattcgtagtttgaacgggcccggtcgatcaccgctgctaaccagtgtggattatcgccaggaacattgtaagaaggctcgatagcccctatcttttgccatgacccgtgcgattcgaggttgttttcggccattaggtagataccggcctcgtcacataattgataccaaggtaattgatcaggataatggcaggtccgatcggcattgatattgttagctaacatggtttggatatcagcgcgcatatcagccatactgataacgcgaccggtgtgggcgttccattcgtgccggttaaccccgttgatcaccaaccgtttattgttgacgtaaatgactttgtcatcgcgcagctcgaccgtccggaacccaaactgatatgggacgacttccaagagttggtgatcagcatcgtaaacttcaattgtcaattgatagagatacggcgtttgtggtgaccacaagtgcagttggtcgaataacatggtatcaaaggttacactgccactaccggtttgcgtttgactcgtcagtactcgcccgtcatggtctttaacggtcagcgctaaagtggctggttcgccggttactttagtagtgatgttgagctcaccacttttgagattggcatttggaactggtcggatgtccaaatcagtaatatggctagcaggctccgccagtatattgacgtcacggaaaataccagagaaacggaacatatcttggtcttcaataaaggcagcagtactgcgtttgtagacccgaaccgctaaaacgttaccttggtcctgaatatacggcgtcaaatcaaattcagaaggggtgaaactatcttcagcgtagccaataaaatggccatttaaccagacgtacagggcttcttctaccccttggaactgaatgataatacgttgccctttaaaagcatcgtcgagatcgaaggttttgaggtacgagccgacggtgttgtccgcagcgtcactgaataggcctggtgttaattgatcttgattgagggtatacggtgggcgacggtaaattttaccttcccatgggtatagcgtgttaatgtattgaatttgaccatagccggctagttcaatatgaccgggaacctgaatcgtatcaaagtcggttgcatcgaaatcgggttgataaaaatcaactgggcgttcagccggtgtcttggcgaagttaaaacgccaagcgccattgagactcttgatgaagcgactacccgttttgaattctgctgtgtcgtgataataatggtgatcactatgtgcaggtaattggttgacccggaagacttctgggtcatctaaccattgaagattagcttgcatgaggaagctcctttcaaagttacataaataaaacgcttacaattatcataaaacaaaatattaaatttgtatatgtcgttttagttaaattttaactaaatgacaacaactactgacaacgacaacgggcgataagaagaatttgaatcgataacgtgataaatttgtaaagcgttaccaaatcttgttctaaaggtcttatggggtgttgacaacaatcaaaaaaagcattatagtcaaactaataaaattttagtaaaactatttacggagggatttttcatgaatactagcgacttaaaacaggagtttaccgaagcctttgataccaagccagaacgggtctttttctcacctggtcgaatcaacttgatcggtgaacatactgattataacgggggccatgttttcccatgtgcgattacaatcgggacatatggtgtttatgcaccccggacagatacgacagtgcggatgtactcagctaatattccagatgctgggatcgtcacgtttgatgtcaacgacctttcatatgacaaagccgctggttggacaaattatcctaagggaatgatggacgaaatcgcgaagaccggcgttaaattcgatcatggttttgatttctacgtccatggcaacatgcctgatggtgctggattatcatcatctgcgtcaattgagttattaactggaatcatgttaaacactggttttaatctcggtattagccaattagatcttgttaagattggtcaaaagtgcgaaaacaactatgttggtgttaactccgggatcatggatcaatttgctgttggaatgggtaaaaaggaccaagcaattttacttgataccaacaccatggactattcttatgcacccgtaaagttaggcaacaacgtaatcgttatcatgaatacgaacaaacggcgcgaattggcggattcaaaatataatgaacgccgctccgaatgtgaagaagcattacgccgattacaaactaagttagacatcaaatcacttggcgatttaactaacgaccagtttgacgaagcggcctacttaatcaatgatgaaaccttaatcaaacgtgcccggcatgccgttttcgaaaatcaacgggccattcgcgcaactaaggccttggctgacgatgatttaacgacctttggcgaattagtgacggcttcccacgtttcactacactttgactatgaagtgactgggaaagaattggatacgttggccgaaacagcttggaaacaaccaggcgtgcttggtgcgcggatgactggtgctggctttggtggctgtggtattgccatcgttgataaggaccaagtcgatgtctttaaggaaaacgtcggtaaagtttatcgcgacacgattggttacgacgctgatttctacattgctgaaatcgcagacggccctaaggaactttaataaaagaattgatttaaaatacaaattagcagtaagcattgagaaatattgaggaggaattagaatggcagttttagttttaggtggtgccggctacatcggttcacacgcagttgatcggttggttgcaaaggggtatgacgtggcggttgttgataacttggtcacggggcaccgggcagcggtcaatgaacacgcgcgtttttatgaaggtgatgtccgggatacggcgttcatgaataccgtgtttgaccaagaaaacgttgaaggtgtcattcattttgcagctttctcagttgttcctgaatcgatgaaggatccgctcaagtactttgataacaacacggcagggatggttaagttgctcgaagtgatggctaagcacgatgtgaagaaaatcgtcttctcatcgaccgcagcaacttatggtgaacctaagcaggtgccaatcaaggaatcggacccacaagtgccaactaacccatacggtgaaagtaaattagcgatggaaaagatcatgcactggtcagatgtggcttacgggattaaattcgtggccttacgttactttaacgtggcgggggctaagcctgacggcagcatcggcgaagatcacgcaccagaaacgcatctcgtcccaattattttacaagtagctgctggtgaacgggatcaattacaaatcttcggtgacgactatcccactccagacgggaccaatgttcgggactatgttcacgttgtcgatttagctgatgcacatatcttagccttggaatacctaaagcaggggcacgatagtgatgcgtttaacttgggttcttcaacgggcttctccaacaaacaaatgttggacgctgctcgtgaagtcactggtaagccaattccagcaatcatggcaccacgccgcgctggtgatccaagcacattggttgcagctagcgacaaggcacgtactgttttaggttggacacctcagtatgatgatgtgaaagaaattatcaagacggcttggacttggaaagaaagtcatccggccggctatgatgatcggggaggccaagcataatgacgagtttggatcaatttgtcacggcggtgatcgcgtcgccttcgcaatatactgaattagatcggatctatgtgcataaccgggttcttggtttggtcggcgagggtgatccgattgcggcaagcgatgaccaattaacaagtttaaccgatgccttggttaaaacggcgattcaaaatggcaagatcgaagcgacccaatcggatgaagatatcttagcggatcaattgatggatcttgtgaccccgttaccatccgtattaaaccaacgtttttgggataagtatcaggttagtccgcaaacggcaaccgactatttctttaacttaagcaaagctaatgattatatcaagacgcgggccattgcgaaaaacgtggtctttccagcaaaaacgccatttggtgacttagagattaccatcaacttatcaaagcctgaaaaggatcctaaagcgattgcggcagcgcgtaaccaaccgcaagatggctatccactttgccaactatgtatgcagaatgaaggctatctaggccggctcggttacccagcacggagcaatcaccgaattattcggttaacacttggtggcaatacttggggtttccaatattctccatatgcttactttaatgaacactcgattttcttggatcaagagcaccggccaatggtcattaaccggcaaacttttaccaacttacttgaaattgttcagcaatttccacattactttgtgggcagtaatgcggacttgccaattgttggtggttcaatgctgtcacacgagcattaccaaggtggtcggcacgaatttccaatgatgaaagcgccaattgcacgcacgattgacttaggtatcgcgggtgttaaggctgggattgttaaatggccaatgtcgacgattcggctgacgagtcaggacttggttgcattaacggatgccgctgtgaagattcatgagacgtggaagaattattcggacgagagtgtggatgttcgtgcttatacggatggcacacgtcatcacacaacgacaccgattgcacgcaaagttggcgatgactacgtattagatatcgttttgcgtgataatcagacgtctgctgaatttccagatggcatcttccatccacatcaggatgttcaacatatcaagaaggaaaatattggcttgattgaagtgatgggccgggccattttaccagcccggttgaagaccgaattagctgaagtcggcaaatacttgttggatcagcctaatcaaatggtcgcgatgcatcaagcatgggctgatcaattgaaggccactaataccatcaccgctgacaatgtgacgactgtcattgatacggcggtcggcaacgtctttgcccgggtcctggccgatgctggggtctttaagtgggatgacgctggtgaggcagcctttgatcgttttgtcgcagcaatgcacgattaagttgttaatcaaatgaagacgtggggcaacggggtgttgcagacgcgatttaccgatgagtcatgattggtgaatagtgtcacgcccagttgccccacgtttgttattcagtgctaattaattaagagaaaagaggaatgacgatggccgtaacgttaaaagatattgcgcaacgagcagatgtctcattggcgacggtatcgcgggtcttaaattatgacaagacactatcagtgagcgagcagacacgcaagcgcgtgtttacgattgctggcgagctgcggtacagtaagcgtaaacgtcagcatataaaggcgctaatgcggaaaaatatcgctgtgattcagtggtactctaagattcaagaacatgatgacttatattatttagcgattcgtaaaggaattgagcatcaagctcaagtgtgtggttttacgacgactagtatcttccagaataatttagatcaggttggcgatgatattgatgcaatcgtggcggtgggaaaatttagccctgtccaagtacaacagttgagtcgtttgtcaagccagcttgtttttgttgatgacgatcactttgctcagggattcagcagtgtggtgactgattttacgtttgctactaaccgcgtcgttgattatttttggcggcgtggtatccgagatatcggtatgatttatggcaaagagtggtccactgatcagcaggtggagattcccaatcaacgtcagcaaagctttgaacaggcgttgcagcggcatcatgcctatcatgctgagtatgtattagctggtgattacactagtcaatctggttatctgatgatgaaacgggccattgaaatgttaggtgaccgcttaccacacgctttctttatcgctaatgatccgatggcagccggtgcgctcaaagcgttacagcaagctgatattgctgtgccacagcgggtcaagttgtttagtttcaataacacgacgctggccgaatatgtgtatccagagattagctcggtcaatgttgagactgaactgatgggaaagacggccatcgatttgttggtgagccgattccaagatgatcgtcaagcagcccagcgcattgaactgggaacgacgttggtagaacgtgaaagcaccaaatgaaatcatcgagtgttcgtgaaatttggcagaaatatcgtaattaattaatgtgccacccgattgttaaaaagtggtgcatgactttgatgggcactggttggtattgaatagcgcacgtgaatgggttgattggtcatgctactactttctgattagttggtctgttttgctaaggtgtgaggccataataacgacaattgtacccttcaagggtataattgtgagtgaggtgatgaaaatgaaaacaactgccacaatccttaaggagattcggcaacattaccaaattagtcaggcaaagctggcaaagttactcaacacatcggttagaacggtacagcactgggaacaagcggactaccaaccaagtggcaccgcggtacgtttgattcagattttggctacggacgatgcggtgtataccgcactgacaaacctcgaggaggagaatacgattatgtatttagaacacgatgatcagaagttcaccatcatgggtgtgcagtttcggaatcaagaggaataccgggcgaccatgaatgcaattatcagcaatatgtatgagggttttgagccgactaaggaagatgttcaagacgctcgtcgtttctatgacgaaggcccgattagcgcacaagagatgctagcaagaatacgtacttcgaccaatcgtaaagccgaatgagaaaggtatgggcggactacctacaaccaaacggtactttgaaaaatcgcttaggcattactgaagcggctactttgcagaaaattgagtacaaagtgagtacgcaacggcaacagcaattatcccgcaatcactatcttctgccagactctcatcaattgacaggacgtcaaattggagagctaaaattgatcaatgggtttttgctcggtgaaatttacgactgggccggtcactatcgcgaagttgatttcaacaagaccgcgaatggcgtagtgacgttttttcacccggtggctttatttggtaatgctgagatagatattcaacgccaactcgataattttgcgctgttaccggatgaccgggaacaagttgcacaggcgttagggcaagttgtcaccgaaatcaacatgtttcatccgtttcgggaaggtaatggccgcacgacgcggctgtttactgaggttttggcttggcagcatggttttgacatcaactatacccaggcacagcaggatgcttacatgcaagcgtcaattcaagatgatgctgagatgatggcacaggtgttcctggaagtactaaccaaatagatcaattattgttagtcgtgatactaagaatggtcttaaattaaaacaacaagtgcactcggaaatttctaatctgagtgcacttgttgttttagcttagtgagatatatgacgtttgtcgcagcggtcaattttactgcttgagtgggccactaacttttcgtttatattcggatggggtggtctttaggtattttttaaacagacgaaagagtgatgaggtgttttgatatccgatgatgtcgcaaatgtcagcgagtgtacagttagttttgatcatcagattttgggcagcagaaattcggcggcggtcaacaagttctttaaaggtcttgcccgtcgcttcttttaatttgttacccagataattcgtattataagagaacttggcgctgacatcacgtaatgtcacgctggcgaaattctgattgatgtactgaatgattggcaaaagattgtcgtccgtattgtcagaaaagttaatgtattcttgctcaatcgattgcgataattcaagaattaatgtagatagcagcaggcccattgatttattacgttggcggctctttgtaaggcccttgataattaaactttcaactaaattgatggcaacttcttggtgtgttaagtcaaacagaataaagttgttgtgcaacgtattgatgtgggatgcattatataaaaattgagtgatttcattggttgaaacggcaatatagtcgaaaagttggttcatcgttgagtcattcttgagcaagatgttaatcaaaatatcattactgcccgttgattcaatttgctgaacaatgtctttatccatcaaaattaggttgtgctgatggagggtcactttttcgccattaatatactgagtacaagtgccagcatacatataattaagctcaataaagctatgcgtgtgagctggaacataggaaaagcgattatttttggtaacagcaatatcaccgtgcttaaaaaaatctgagcggggcatctggggaatcggattattcacatagtctaagtccatgtagttaacgttaccatgtgattggcgttgctttagctcaaccggtgtcagagcaaataattcgtaattgagaaatttactagtcattaatactaaccttctttaatatttatcgtttagtacaacctgtgattttgcacgatcattcatgtagttgagatatggtaccccttacagtaatcgcttacaatattcgtataaataaagggaggttcttcatatgaataacggcgagacgtcaacttcaatggtgaaaaaatatcggccattagcagtagctgcaggaattggttccattctaggatcaggaattatcgttggcttatccgcgactattacagtgtggcagaacggactaggtcttactaacagtcaagttggtattatttcaggtgcactaacttttgcaattgcaattggatccttattagcaggacagataacaaaatcttttggtctggttaaatcgtttaattggttaaacctgatttatgcgattggcgccttgatctgtgttttctcgaataattatatcatgcttttgattggcgtcatcattaccgggttagcttcgggtgctgatttaccaattagtttaaccgtagtttcgcatgatgcaccggatgataagacctcggctagtttagtatcgtcgacgcaaatcttctggcaaattggggttttcatgtcttatgtttgtgcctttattgtttctaaaatggccggtgcttccggtgctcggattgttttttcgattttagcaatttttgccttgattacttgggcatggcggactttttcaactaagttccgagcatttcatgaagaaggtgaacaacggcgtattgatcgcgaagcagcttcacagacaacagagaaggtctcgattaagacggtcttcgctggtgccaacaagggacgctttatggcattcttcttcagtattttaatcttctatgtttgctggaatctactggccaatacgttcggacagtttcaaacgtttacgctggttcaagcacatgcgagtcaaagtttcgcaactggtgctgggatagtcctaaactttatctcgttgttggcaaccatggcttttgcatcagtcgctgggggtaagtatcgtaataagttcttcttagttgggattaccgttcaatttttggcaatgctcggactagcaatgagtagtcattcgttatggccaattgtcatcacgattggctgttacaacattgggaataatattgctggtgaagcgatgtataaagtttggacacaggaagcatttccagttgaagttcgggcatcagttcaaggatttattaatggcttttcacgggtatgttgtggcctatttgccttaattacacctgcgttagttgtgccatcagcaattcgtaacacgatgtttgggttcgctgccattgtctttattagctttgtagcagggctgacaatgatgcgattggaaaagaaacatggtattaataacttttaaacaaagtatttagaaagcgagtggaagagatggcgtttacttttcaaatcaataatgatgttcaatttcggcataatcaagcattattagacaagtcggcaagctatcggccaatactgaaagaaacccaagttaaggcggcatcgattgtggcgctcgagcgtgatacgcaataccttgaaggatggggtgttaaacaaattgcacctattgaacgattatcaagttatgagttgaaacgtgacgaccaaattatcatagattttggcgatcatcaggttggtcaatttagtattaatattaacgctgttggttcaccaatggatgcaccactatgttttaagattaagtttgctgaaatgcctgcagaattagcacgcaagagtgaagattacgacggttggttgagcaaatcttggattcaagaagaaactgttcacttagatgtgctgccaaccacgctgacgttaccacgacgctatagttttcgttatgctgagatcacagttgttgatacgtcaccaaaatggcgagctgtttttagcaatccagtggtcacggcgacaagtgcggtagacactgcgacagttcatcaaccggaattagccgatgcacaattacaacggatttatgaggttggcttgaaaacattagctgattgtatgcaggatgtctttgaagatggaccaaagcgcgatcggcgattatggattggtgatcttcggctacaagcattggccaattatgcaacgttcaaagatacagatctggtcaagcggtgtctgtatttgttcggtgcgatgcctacaacggctggccggattcctgccaatgtttttactaaaccaacggcagttccagatgacaccttcttgtttgattacagtctattctttatttcaattttggctgattatgaggcgtttagttctgataaaacagttttgaatgatttatatcgtgttgctaaaaatcaaatggatttggcgttggcacaagttacttctgaaggtaaattgaaattgactgaagaaaatccggttttcatcgactggtcaaatgattttgacaaagaaacggctgggcaggccattattatttatacgctaaaacaatttattacgcttgcggaactggttaatgatacaagcttagagacctatacagcgatactgcgtaaattaaaccagtacgctaaaactcaattgtttgattcgcaatcggggttatttgtctcaggggatcagcgtgaagttaatgtggcaagccaagtgtggatgacactagcacatgttttggatcctgagcaaaccacggcgcttatgcaaacgaccgtcacgaaactgtttccaattactggtattgcaacgccgtatatgtatcaccatattacggaagcattatttgaagcaggcttaaagcaagaggccgtccaattaatgaaagattactggggcaaaatgattacgctaggtgcggatacttattgggaagcatttgatcctaatcaacctgattattcgccgtatgggagtcccattttaaatagttattgtcatgcttggagctgtacaccggtgtacttgattaataagtacctcgtttaggaggagtgtctgcgatggttgacgaaaaagtaaagctgagtaaagcaaacgtactcttaataattgttgctggtctagcttcctatatggatgcagcgttgctcgttagtctgggagtagcgctacctatctggacaaaatatttagcactgaatagctggatggtcggactactaagtactatgctgacggtcgcggttgcaattggttcatttgtgggcggctggctgtcggataaatttggccgggtcgcggtgtttaatgctgatatcttttttgtcgcgattggctcgtttattattgcgattgcacaaaatacgacgatattgattattggtgttgtgattgctggtttggcctctggtgctgatttaccaacgtcattggcggttatttcggaacggatgtctagtaaagtttatggtcgggcaatttcttcaactcagattttttggacgatgggcattttgttgtcacagtttattggttttataactgctaacagtggtatgggaagcccggcagccttatttggttggattggattagtggcaattattaattggtgcgtgcgggtcttttcaaagcgttttaaacagattgaaacagacttagttgaccatgaacatgtggactgtgcatctaacggtcaatcggttaagaagtatcgattaggtcagctattgcgaacaggtggtttgttagtaccaatgattctactaactgttttttatctattttggaatttgccggccaatacgtgggggtcatttgttaactatttcttagtgactgttgatggccgtacgcaagcctattcgacaatcgtggcattaattgccaatattgtgtgtctgttagttaacctgatctatttaaaggtttcagacactaggtatcgctaccgagtgatgtatttaggtattgccgtagcattgctttcctttgtgactgcagggatctttagcgatgactggcagattttcaccgttgtttatattttctactctggtagtacagtattatgtggtgaggctctttataaaatttggagtcagactttctatccagtggatgcacgggcaacgatgatgggcttttcttatggcttagttcgggtgctgaccgctgctttctcgctagtaacgccaacattaatgggatattcgccgcaactattattatggattatggttggatgtacggtgctattcggtgcctgtgcagtgatcattgtcgctattattaagaagaccggtttaaaagacccaacgatgaaaacggtttctgaataaactgattaatattactaagaattaaaaatgtaagccgggcattgccgggcttatttatttaaaatcaaggaggataatgctcatgtcaaaagaggctgtttggttatggtatcctggtgattttgaaatccaccaagggatgttacaaaattttaaacgtgaagaacgtgggatgggttggcctgcctattggtatattgatgattgcaaccgtaatgttaattttaaacggcactatgatttaaaagaatccacacaatttacagtactcgccaaaggaacgggctatgttgatgttaatggcactaagtatcgcttaaatcatgcgattaattgtgatgcgggtgcgactgatattcaagtgtttgttggtaacgttcagggattgccgacgatttatattgttggtgagattatcaaatctgatagtggttggctagctagcaattttgtcaccacattacccgctggtcacgatattctctacactgaccgtaaccaggatcctaatgtgattgaatatcggacagaaaaagtagtggccaaagcacaacaagcagttgatggtggcgttttatatgattttggtcgcgctgtgaatggaactgtcacagtcaaaacgaatgggccagttacactatgttacggggagtccgaaactgaagcacgggatgttgagatgtgttattacaagcagtcggacgttacagctacaacaaaggttcgtaaacgtgcgtttcgatatgtctttgtgcctcattgtcagttaggtgacattgaattaactgctatgcacgaatatattcctaaaaataatccctccagttttacctctgataataagttgatcaatcaaatttggaatgtagcgacggaaacgttaaacctttgcagtgacttgttctttatcgatgggatcaaacgtgatcggtggatttgggctggtgacgcgtaccaagctaattttatcaatcaatattctttcttcaacgaagatattgataaacggacgttattagcgttgcgtgggcaagatgatattaagcaacatatgaatacaattgttgactattccatgttgtgggtgattggtgttctaaatcattaccagatgacgggtgaccgtgaatttctcaaaattatttaccctaagttagagagtatggtgcaatactttattcaacagacaaatgagcatggttttatttatggtcggaaaaatgactggatctttgtcgattggtcagaaatggataaacagggtaccgtggcggctgaacaaatcttattacttgaggattacaagacaattatgacttgtggtgaggtcttaggcaaagatgtggcgggctaccaagcgaagtatgaccagttgtttaagaacttaatgaaatacttttgggatgatgaacaaggagcatttattgatagttatgaatcgggtaagcggcacgttactcgtcatgctaatatttttgccattttgtttgacgttgttgatgagaacaaacaacaattaattttaaagaatgttttgttgaataatgcgattactcaaattaccacgccgtattttaagttttttgaacaagatgctttatgtaagctgggggaacaacaccgtgtttaccaagttttattagactattggggcggcatgttagatcgcggggccgtgaccttctgggaagaattcgatccgtcgcagcatggcaaggatatgtatgccatgtatggtgatccctatggtaagagcctgtgccatgcctggggagccagtccgatatatttattaggtcgtcattttgtaggattacggcccacggctccaggataccagacttttgagatcaagcctgagttatcagaatttcatcatttacacaccgtgttacccattaaaggcggtaccgtgactgtcgtaaaagatcaacaccaactatcagtcactgctagccgagctggtgggacattgattgtggatgggcaaagacaatctttggaacctaatagaactgcggtggtcccagtgtaaatctataaaatgagtcgtaatagtcatcttctattttggaagatgactatttatttataatcaaagggctgttgagaagcagaaatcagcaaatatgaggtggatttaatgcccataaaaagatactgtgattgtaaacgctttagatgtaaaatgtaaacaaacagactaaggatgtggctactatggttagtatcagagatattgctcgaatggcgtcggtgtcaccagccagtgtttcgagaatcttaaatcatgatcaaagttttagtattaacgaagaaacgcgaaagcgagttattgatattgccaatcaaatgcattattcaaaggatgcaagcaagaaagggcctcgtttcaatcatgacagtatgcaaattgggctgatactcagacatagtcgagaatcagaattgaatgatccgtattttcatgagatccacagaggcattgaattggaagcagccaggtggcgtatgcgtgtgataacaccatttggaatgaaggataaagcaaaagaatggcaaacgttaaatgattttggtgccattattatggttggcgaaatgactaatgaaggcgttgaaatggttaagaaagtcaatgacaatgttattctagtcgatagttattctgaacatccaggagtagatgtgataaaaactgatttttcggaaaaaacacaagaaattctagatctattatacgaaaatggacaccgcaaaattgcatttattggtggatacaatagcgttgtgcgcccagatggtagtgtccttagggataatcatgaggtgcgtgcagttaattatcgtaactggatgaagttgcatgatttacaggatgggatcaatgttaaaattggtcgatggtccgccgaagatggcatgacacttgcaaaagagatattacaaggcaatgatcgcccgactgctattattgtcgctagtgatccgatggcaatgggtgtttataaagctatcagtaactttggattaacgataccagatgatatttctgttgtgagttttgatgatgttgagatgaatcagtatttggtgccttccctttctagtgtccgtatggaagctcgggaaatggggaaaatggcggtgaaattggcgcgggatagaatgattgaaccgagtggtatgccgatgcaacttatttgtgcaagcaaattaatgattagggaatcagtgaaaaatataaaaatttaaatctcctattgtgtaaacgtttagtaaacaaatacaatgttcttgtaagcgcttaccaatataaagataggagatcaagacagtgaaaaaatttagttctggttttcaagaaaagatgtcctcggcctcacaggctattggtaataatcgatatttattaagtttgcgagacggtttcatggtcgctttcccagctactatgtttgggtcaattatggttattcttcagaatttgccgacgacttttggatttgacaaagttattccaaagggagttaacacatttctgacagattttttggggcctgttagcaatgcgacaatgtcaattactgccctatttattgtttttgggattgcgtatcaattagctggtcattaccatcaacaaaagatatttgcaggggcaattgcactttctagttttatcatgttgttaccaatcggtaatgatagtaagcttggggcatttattccaatttcaaaattaggtgcgcaaggcatgtttgttgggattatcgttgctattatttcaacggaaatttattgcaaaatcagtgcagctaacattacgataaaaatgccgagctcagttcccccgatgattgcgaagtcatttatcgctatcatcccaggggcagcaccactactattctttaatattattcgttacgcatttacttttactaagtggggcaatgcagttgactttgtatatgaaattttacaacagcctctgatgggactaggtagtacgctaccggctgtattgattgcggttgctgcaactcaaattttttggtggtttggtatccatggaacgttacttgttaactctattattgatccaattatgggtgcgttagcgattcaaaattatgaagcatataaagctggtgcaacgcatctaccacatattattaacacgactttcatgggcgtttttgttaatcaagggatgcagttaggatgtgcaattgtttttgcgtttttcttagctaaatcagtccgaatgaagaaaacgatgaagatggttttcgcacctgcaatctttaatgtttctgaaccaatgacttatggattgcccatcgttttaaacccaatcttgtttgtgccatgggttttagcgccattggtttcaacgaccatttcttactttgcgattgccattggattagtaccacgtccgattggtgcgacagttgtttggacgactccaattttcttagccggatggttaggtaccgggtctatcgcaggggctatattgcaattagtagatgtcgttgtgatgacattgatttggattccatttttgaaggccatggatcgtgaatgggtacaggaagaattaaagcctacacctgatgacttaactgaatagggaagagtgatggtattgagaactgacacgctgtcgtataaatatcgctatcgagcactaaaatcggagttatatcgtacgcttatttcagaacaattaaaatattttcaacgaacggataaaagtattcaagttctaacacctggaacgacaatagtggcaaatttacagacaaaaatgcatcaattagtcacacaaaatacgatgaaagtgaatattatgaaggcagatgatacatttcagttggaaacacaacagccctcagggaaaattattcaaacgtataaatttgatacagaacgttccggagcgaaaatcttggtttattcagagcaaaatgtgtttgaaagtaatcgtaatcaaatgaactttatgatttttggtttgatgtataagtatttttataaccgtggtgtcaggaaacggatgcgatatttagatgatttagcgcaaagcgtcgaataataaaccgttcgtataaggagctcatgacattggtttgtgggctccttgtacacactaaatgaatggtttaaaagtagcagaaaagggataactgaaatgatagtaagtggcacgacaaataagatgtttgaaataatcaatggacagacttttcatttatataatcgtaaagttagctatgtgctaacgattatggaaaatggtcaattagggcatttatattatggaaaaagcttaggtcccttgtccattgcggatgtggattatctgaaggctcagaatagtaaatctgctgggactgtcaagttttcaccagatactggcaattttacacttgctgatcgggctcaagaatatccagtatatggttcttcggattttcgtaagggtgctattgatattagttataatcaggaaccttggtatctagattttaagtttgctgattattcgattacgtcagataagccacggaatttgaactgccctgaatcgtacgcagttggcagttttgaggcgacacaattggatatgcaactgatagatgaggaacatcatctagagttggttgagcattttacaatttttgataatcaaagtgcggtggtgcgaagcacaactattaaaaattgttcgagtaaaacgattaatattgaaaatataatgagcgcttcgctggaattaccagatgacaagtttcaaatggttaacctatcaggtgcatggctaaaagagcggcatgtaaagctgcacaacttagatcaaggaactgtttcagtagaatcattaaagggcgcatcaggacatcaacataaccctttcattgcgctgatacgaagtcaggacttaaatcaaggagaggtctatgctagtaatttaatctattctggtaactttgtgagtcaagttgaagtaaatgaatggcacaagacacgtctaatgactgggttgaacccaacctattttgggtggaaattggaaacaaacgaaagcttcaaaacacccgaagccgttatttattatagtaatcaaggaattaacgggttgattgatgcttccacaaactttacaaaaaggcatgtaattgatcgtcgctggaatcaaagagagcggccaattgtgttcaataactgggaagcaacctattatgattttgatgagcaaaagcttttaacactggctcgccaggctaagcatatcggaatggagtgctttgtcgttgatgatggctggttcggtcatagaaacaatgatcgaagttcattaggggattggcgagttgatccgcagaaattcccacatggaattgacctatttgctaagcagattcatgagttgggattgcaaatgggattatggtttgaacctgagatggtatcgcctgataccagtttatacaaagaacatccagactgggttgtgcggcacccttataagtctgtgtcgattggccgtggtcagtacgtattggacttcgcaaatcctgaggtagtcacatcggtttatcaacaaattaaaccagtcatattagcaactaaattggattacatgaagtgggatatgaatcgtaatattacggaagcgtactcaccatacttaaataggtgtaacattccacaaactgaatttttccatcgatatgctcagggcgtcaatatgctataccaattaatactaactgactttccagacatgctaatagaaggttgtgccggtgggggaggtcgctttgaccttggcaccttattttatagcccgcaaatttggccgagtgatgatagtgatgcagttgaacggttatcaatattgactggaaccaccttggcctatcccctatcgtcatttagtaatcatgtttccgccgcacctaatgaccaagtaggaagacaaacttcactcgcttttcgacaaatggtggctgactttgggccactaggatatgaattggatatttccaaattaccgttggatgaattaacacagataaaggagaacattgaattttatcaggtccatcgacaactttttgtgaatgggagattcagacaattgcaatcaattgatccctgcactaatgaggtaatttggagtgtggaaaattctgatgatacagagatttttgttggattttatcgtaagctggctacccccaatgctagtattctgaattatgtcaaattacctatgattaatccaaatctaacttatcaaattgatggtcgtgaaaaggttagtggcgctgtgctacagcagttcgggttgcgacaaccatatcaatttaatggtgttaatcttgacacggcagaattatatggagattttcaatcccatttatatcacattgtcagtattgaatagctaggagtgtgttgcatgaataagttagaactggttaaaggctttttacatggtggtgactacaatcctgatcagtggttaaaacgaccggatattttggaccgggattatcagttgatggatcagtcgaagattaacacggttactgttggtgtttttgcttggggacggcttgaaccggaagaaggtgtttatgattttgcatggcttgatgatgttttcgataaaatgaatagtcgaaatggccacgtgattttagcaacaccaagtggcgcacggccacgatggatgagtcagaaatatcctgaggttaatcgagttgattctgaaggtcgtcgtcatactcatggtttccgacataatcattgctattcgtccccgatttatcgaagaaaggtacatgaaatcaatatgcgcttggcagagcgatatggagacaattcagcgcttgttttgtggcatgtctctaatgaatattctggagagtgttactgccctttgtgtcaacaaaagtggcgggagtgggtccagcacaaatataagacacttgaagcattagatgacgcgtggtgctcgagcgtctggagtggtttatacagtgattggtcacaattgttgccaccatcactattgggtgatagcaaagttcatggcatggatttagactggcaccggtttgtgtcagatatgacgattgatttttatcagcatgagattcagcctttaaagaaagtaacgcccaatattcccgtaacaactaattttatggctgagagcttaaaagaagggcagtatacaccgctgacagggttagattatggtagatttgcaaagtctttagatataattagttgggatagttatcctagttggcataatcgctatgaaattactgcggaaactgccatgaaaaccgcgtatgttcatgatcagttttggtctttaaaacaacaaccatttttggtcatggagtcaacaccaagctgtgttaactggggacagtataataaagccaagcaacctggcatgcatcggctgagttcatttcaacagattgcgcatggctcggatagtacgttatacttccagattagacaggcacaaggtaattcagaaaagtatcatggtgccgtaattggacatgatgatagctcagatagccgcgtttttaaagacgtgcaacaatatggacaagatttggaaaaaattgtagaagttaaaggggctattaagcgtgtaagagttgctatcctctttgactgggatagcaactgggccctgaaccgtggtggcggctttggtcggccaactagattgggaatacaagtacttcaaaaacattatgcaaatttttggcacaaagatattgagtgtaatgttataacgagtgatatggacttttctcaatatgatttgttaattgcaccgatgctttatttaatacgacaagatacgatgaaaaaattgcaaaaatttgttcaaagtggtggcacattggtatctagctatttttcaggtatggttgatagcaatgatcgtgtgaatttagatggctggcctaaaccgctacaggatatttttggaattgagccaaaagaattggatactttattaccaggcgagcactaccatgttagttttaatcaaaaagagtatgaaactaccgattatgatcaaataatgaaagttaaaaacgcatcagtgctgggatactacacagacaacttctatgttggaacaccagcaattacacggcatcagtatggtaaaggaacggcctattatattggtgcacgcttgtctgcggaattcattgaagacttttatgatgacattattcaaagccttaatttagataatagttttgtcgaattgagcaatccggtagtatcagttcaaactcgttataatgaggattatgcctatcactttgttatgaatttttctgaacaagtacaaatggttaattttcgacgtccatcctttgatctgcttacacagcgagaagttacgaaatcagtgcaaattgataagtatggggtcatgattctgaaggaaagacagaacaatacgttgcactagatgaatatcttggtgaactgatttagagttttggaaagatgttcatgattaggggttaagagaatccaaattaaacatgactactagatatagcgtgtaaagtcactaagactgttgaataattcattttactttcgttactagagactctaaattaatcatggcagcataatcaacaatgacttataaggattggttgtgatcaaataagcactgctcacaaaatagtgggcagtgcttatttggcattcattaaattgtttaacaagtacggtacgggttagcgtttcatcggtacttccatgccagtgctggtctttgcccgctgtaacaacaagtagtgggccgtgccaaagacggcaccaactagcgcagggactaaccaatccattccgctgctggcaagtggtaagaagctttggacatgcgccattgcttggccgaaagtactttggctaacaacggcggggaaagcggcaaccatatcaaagacggcggggacgacggtgaagacgacgacccaaacatagacgacacttgacttgtggaagagtggcgaaaggatcgataagaagattagtgccatggctaacgggtaaaggaacatcaggacgggggtggaccaggcaatgatctgatttaatcccacattagcagttaaaaatgaggcgaggcacgtgattcttaaccaggctttgtaactcaagaaaccgaagtgcttatggaagtcctgagcgaaggcggcgacgagcccgatagcggtggtcaaacaagtggtaatgatcaacacggctaaaatggcttgtccgacattacccatgtagtggttaacgatttggtcaaaggcgaccccgccgttatcggataatttgaattgacctaacgattgcgcgcctaacaagattaagagcacgtaaatcaagccttcaaaggccattgagaagaagccagctcgggcggtcacccacgcggctttgttcgggtcggtttggcccatgaaattaacggcagtgacgatagtgacacctaacgccaacccagctaaggcgtccatcgtgttgtagccttgcaagaaaccattggtaaagcctgcggtctgataggcagcagttgcactggtgctaccggcatgagctagcggactgctgaaagctacggcgaagatggcgactaataatagcaaaaataatggatttaataatttgccgacccgagccataattttgctctgttcaacggacaagtagtaggcgagtccgaaaaatgcggcggaaaacagcagtaatgcgagtgattgatactttgctgggaaaaacggtgccagaccaacggtgaatgatacggtggccgtccgtggtgttccaaagaaggggccaattgtaaagtgtatgagaaccatgaagacaacggcaaaggttgcgcctagtggtttaccaatgtcataaacgcccttagatttagtgacacagacggctaaaaccgatagtaagggcaataaaaccgccgtgatgagaaagccggccgcagcaatcccccagtgaccgcccgctagctgacccaagtgaagtggaaaaatgaggttgccagccccgaagaataaggcgaaaatcattgaacttaaggtgacgtaatcacgtttggttaagtttcgcttttgaactcgatttaacatatcaacagcactcccttatttgattgagacaataatcattaaataaaagttgcgattaaccaaaaaacgtcctgatatctgagttagactcagaaaccaggacgtttgaacacgtgttaccaccttagctttgtgactgccttacgacgaatcaccttaaaaagtacggcaagtggccggccacttgcgatacttcggctcaataatgggagcaaccaacagcaactaacatcaagctcgtcactgccactcagaactgattttcaacgatctggtcatgatgtcattgcaccaaactgacactctctaggcatttccagaaggtttactttgttcatcggcgtgtttgttaatcgatttttaatgtggttctaatttacaaccgcgattagtatttgtcaatcttttttcaaaaaaagttagttagctagtgcggattcttaaataaagatggataatagctgtaataaggaaatttgtgaggagggtccgctgatgaccaacaacaatgaggaaaagccccaatggcaagtgaatcagaaccgccatacccgttttcggacgattgtcagtgtcttgcggcgctataacgttttgagcaaccttgcacgtcagaaaaatcctgatcaagtgcgcgcggcgtttgaagaacttggaccgacgtttattaaaattggccagattctttcttcacgtacagatatcgttaagccagaatttgctaacgaattcaaaaaattgcaaaataatgtccgggccgatgattttagtgtggtcaagcaaacgatcgagcagcagacagggaagccaatcaatgaaatgtttgcccagtttgacgagcgaccgtttgcatcagcatcaatgggccagacgcaccatgcgacactgctcaatgggcagaaggtcgtggtgaaggtgcagcatccgggtattgacgccgaggtggccctagatatttcgttatttgagcgggcgttacccctattgcgatatattccggagtcttcagttgttgatttgcgcgaaatggttggtgaaatcaaacggtcactattcaatgaattggataccagtattgaggtaaaaaatggattacggttttaccgattgaataatgcggacgatattattcgggtaccccgggtttatgcgaagtatagtacgcaaaaagtgcttgttaaccagtatatgccgggaacgacgattcagcattttatggcgcaaatgcttgcggccgatgaacacggaaatcaccagtatgatgacgaacgccgctatttggcccatgtcttggtgcaaaatttcttgaagcaggtttttgaagatggcttttttcacgctgatcctcatccagggaatatcttattgcgggaattgcaaccagatgatattgggtatcacgatacggttcccaagcatggcgggaaaattggcaaacggcagttaccaccataccggttagtttatctggattttggcatgatgggtgagatcagtccagctttgatggcaggaattgctaatgttgtcgtggcagtgacaaccgaagatacccatcaagtcggcaaagcaatcttagcgatttcaaaccgaactggcgtggttgatgaagaagcgttctttagtgagttagcaccatttttaagtcagtattataattcgggactgggcgacattgattttcaaggcttgttgtttgaaatggtcaaggtttgtcgcagtaataatattcaaatgaatccagcggttaccatgttaggtaaggcgtttggaacgatcgaaggtattgtggagacgctcgacccaaccttatcaatgatggacgtggcgcggccgtttgcgcgcaagtacatccgcgagaattttaattggcgcaatgaactggaagatggcatgttggctagccttcaaagcctgcgtgatgccccgaagattccgtcacgcttattatcagctctagatacgtttgataatggtcagacgcgggtcaacttggtctttgcacaccgcaagatgtttattgatcggattgattcgatggtcaataagattgtactgtccgttattctggcagcgctgattgttggatcatcactactagttcaaagccatcctgataatagttggattacaaacattggtattttgggctatgtttcagcagttgtcgtcattattggcctattgattggaacgctccattcctggtacacgcattggcgacgcaagtaaaacttggcgtagggttaggctatagggccatgcgtcatgagaagttggcaacgtagattcgtctaattgagactgcctaaaatataagcatacgaaaaacagcggtaccgtgatgattccaagccataaaatcatcacggtaccgctgttttattaatcatgtttcagtatcaaattgatcgtggttaatggtacgactgtcaattgctaactagtcttctgatcccataacccgagcacagaatgcggccaagatggcgccgacttctggtgctaagatgtagacccatagatgtgataaggcgctaccaccagcaaaaatagcggggccgattgaacgggcagggttcaaagaaccgcccgttaagttgagagcgacaataatcaagaatgctaaggtcaccccaatggtcaaaccagcaaagtctgcgttaccatggtcattactagtaacgttcagaataaccattaagaataagaatgtgactagtgcttctacaaagaaggccataccactgccgatttttggaaaatcggtttgaccaagcgatgttgcggataagcctaatgcactgacaaacgacttaactgctgcggaagcaacgatggccccaatgatttgggcgatgatatagccaatggcatcggcggcatcgattcgacggttgattaacatcgcagtcgtaacggcggggttaaagtgaccaccagaaataccaccaaaggcataggccgaaacggtaatcgctaacccgaaggctaacccaatagcgaggacgtcacccttagcaatcacaacggttgcagtccctaagaaaactaacataaatgtgccgagaaattcggcgagatacttgcgcatagttgcacactccctttttgaataattgctaacttaacctattttacaatacctgctcgtgaaaacgacggaatttgtttgatttgtgaatatttctgataagatttttataattatattaattgataagatactggtaaaacgttggtataaaaacgttttatggcagttgtggattgttaaaactataataaataaaaattttatttttgcatagtcactattgatagtagtcagtatgattggtgtgtgatctaacgtgactgtgaacgctaattgtcgataatggtggcttctgttttataatggttaggacaagtaagctgatgtttttgaaaacgaattaaatttgtttcacgtggaacagtaaaggaaggtttaattaatggcgttatcatatcaagctctattaacagcagttccggtcgttttaaaagcggggaacgtaccgaacattgtcggtgaagccgggattggaaagtcggccttggtagccgaggttgctaagcggatgggggcgcaattatacacgaccgttgtgagcctgtccgaaaagggggatttagcgatcccagtcccaccactaacgagcgactcatttattcaaacgaagcgctatggccagttggctgacgtgcaattcggctatgcacacacgttgattgaaattattcagtatgctgagcagcatcctcagcagccaattctgtggtttttagacgaatttaatcgtgggacgcaggctgttcaaagtgaattgatgaatctggtcttgcaacggacgattaacacattgaaattgccagaacaggtgcaattgatcattgctgaaaatccagatgctagtatgactggatttgaaagtagtacgtatggcgttactgccggcgatgcggccatcaaagatcgtaccgtgcgtctagttatgcgagcagatgcggcagactggcttgcttgggccaaacaagtggatgagcacatgaaccgaccaaacattcatccactcgtccagcagtttattagtgaagatgtaacgcggcttaatcaggctgatgtccaggctgatttaacagcgacgccacgtgcgtgggcgcgtgtttcggctaatttatatgagattgaaaaacttcctgtgcatcaacaaacggctgtggcactggatatctttcaaggagatgtgggtactgagctagggcttgtattcgagcaattcttggaacaacaagccattcatctgacaccagcgatgatttatgacagtcaaccagtgggggccgtggtgccggcaccgattcttaagcagtttacggcgatgaatgaaattcaaaagcgaacggttttggcaagctgtttggctctaacaaccacgtatccgttgacggacgatcagcacgctggtcggttcatgcaactcctacaaacactcagtcaagatggtcagtttgcattggttcaacaaatcggccatgaacgcgacttattaaagcaattatatacagcaaatgttgccaagcaaagtccgtatgtgaccgctttgtatcagtatttacaacaggtcgccagttggtcaaatcagtaagaaagcagtgagtcatcatgattaacaatgccaatgagtacacacgttggcaacaagcgatgttagtgacgccaacagcagacacgatccaggcaggtgcgaccatgattgatcgggccattattgagttactagccaccgatcaattttatggcgagttgctgacccgacttcccagacagttaaatacgacgttaacgacgccgtttatcttagcttggcagaataatcagttggtcttacaatatgcgccaacagtaattgctcgagctttttcacagttttcttacttacaagcggggttaaaacacgtggcactacacattgtctggcaacaccccgttcggtatcgtgatcaggtcaagcagcaaccggagttagtgacgttggcgaccgacctggccgttaaccaatatgtcgacggtctgcctaaagatgcggtcagtttaacgactgtccagccgttagtcgatgcccagctaccgcgacgagcagattctggctgttatttgaaattattacagcagcagtcgcggtcgcaacttcagccgaatggcgcgcccaccgccacttcgcgaaataaggaccagcggcagccagcaaaagggtctggcgaccaaaagtcgcaacagttgatcgatgatccaagtggctggtcagcctctgaacagttaacgaatcccaatttggcaactgcccgtttaaaacagttggcgaaagatgcttggcagcaaacaaatgaagctggccgagggttagtggccggcaatgttcgagctcagctcactgtaatgacgcagccggcccagcttgattggcgacaattactagttcggggcctgggtcagattccgagcggtactaaggcctcgcacgcgcgctttaatcgacggcaacccgcgcggatggaaatacccggtcaaattggcgatacgcgcttggacttgcaagtttatgttgataattcaggttctatcagtgatctgatgctgcaacgattactggcacaggtggctactttaacccgattatttgcagcaaccatcaccgttaagccgtttgatgcaatcgtacagcctggtcaaacgtatcaggtgagtttgccacagcagattcgctttacgcgccgtggcggtggtggaaccgtttatcaaagtatttttgatgatttactaacacatcataagacgaatgcgacgaccttggcgctgatcttaacggatggccgtggtgaacggcacgtcgagtcacaccgttttacaaatgtgatttggttgttagcgcgggctgaagatcgattgtcgattgagccagcaatcggtcatgtagttaatttgaacttggaggatgaataatatggggacaccacttaatccagatgatatgcaatccttgttgacccatgaccgtcgttatcagcgggccagtgccatcttaacggatcagtggcaacgaatcatagccgatgaagatttggcttaccgacaacagattacgattgacgatttacagtttgctaaggcgttgctagctagtgagacgctgacaagtcaatttgaatttgaccattacgcgggtgtgcaacggttgcgacaacattatggtagtcaattgacgagctcagcacagcactggttagtgcaaaaatatttataagtcaatcgctagttatgacccaaaagtatgactgtgacttatatatagatgaaaaaataaagcaagcttttcccaaaatgttcgggagaagcttgcttattttatgcgctgattaactgctttaggttcaacgacgtgctagaaaagccatccaggcttgttgctgcgcttgaatatctggctgactgccttgacggagtcgcgtttgaaggccaatgcgggcttctagcagtgcctgagctaatgtcatactggactgattattgataatttgctcgttagcttgacctttgaggatgaccgcagccatgagggtcaggtagtcgtcataaaaccagctgacggcttgctgaacatcagtatcagtagtaccaaattcagcgacggcgttagccattaggtcaccggctgtttgttcggctgtcgttaaatcgtggctaaagagcatactcaggatagctaagggggcggcaccatcctgctctaagcgttgcattgcttgggtacaacgcattaaagtttgttggtgatagcgctggagtgcacgcaggtaaagtgtgtgcttgtccccgatagcgttatataaactttgcttcttgacgccactagttattacgatttcgtccatggaagtatgataatagccttgctgccaaaataagtgcatgattttttcgataacttgatcgtcttgaaatgtctttttagcgggcatgattcgaaccgcctttctggttaaaaataagtgttttaagtataccacagcacacttcattgtttggtaaatgaatattaacgtttgaaattatttgattagggggcttttactgtttttaaagccgattttaattagttgattgtgttgcactttaaaattgataaaagatttccacattaaatcgattacataattttataaattgaagataatttatgtaatagcttgctgttacaacgatattctaaatatatataggatttcaatatttataattatcaaaatttttaacttatgtgtggcctcatcaaagtctaacgataatataatgttgacggtttgtttagttgaacacgccaactagttggacctaatcggataaatgaaagcagtaggaaagcttgccgttaaactgattacagtagtttatattaaaatatttgtaatcactataatattaaaaatggctcagaagtccgttaaaataggaattttaatcaatagttaaggggtgtcatcaattgacagcgattccaaaaccatgatatattttcgttgctgatagggttactcacaacgattcactattggtactaagcgttaataatgatactaagcttaagtcaatatctggaaaggatgtggtcatattaattggatgggcagctttcaagacttaggtattagtcagctagtcaagttaccactagtagctgatacgcaatcaggcacttaccacttaacgatcacttctaattcaggtggcaatgcggcggccgataaaattgcgagcccgctacaaggtgtattaccgcaaatgaatgggacccagcaatggattctgttcggtatcggcgtatgtgaacttagtttattaatattattaattctaatctggtggcgcaaccgtcaaacaataaaggagcaaccaaaatgaaaaaatatctcggaactctcgttgcaggcatgacactaatggcaggattaccacttgttggccaagctgcagatacggagacaacgaccaaagctgaagttgaattaatccaggatgacactaataaagatattaccttggatcaagcacctggtgttagctttgggaccgaaaaaatcactaatgacagtaaaacctatgatgctaagaacgttactggcgacttgaaagtgaccaactctgggaatacggacggatggttagtacaagttaaaggttcgaagttcatgaatgcagatgatactcgtgaattacggggcgccgcgttaacttttgcacaagttaatgcaactgcggatgatgctaataacatctctaaagcaaaagcttataaagtggatatcactgaccaaaatcaaattatcatggacgcagaagctaatgaagggatcggtaagtttacgagtaagtatgcaaccaatgaagttagcctgttgatccctgctggtaacgcggctggcgcttacacttcaaccttgacatggacattaggtaacgcccctagctaaccagttaatgcgccagaggagaactgaggtgtgaccgatgaaaaagggattgttggtaacaggtcggttattaatgactgtgataggttgtctcatcattagtaactggggctggtttatcgcaacgcaagctgcaacgacacagtcacaggtgcaggtagaaatgaccccctcggatgatgacaatgcagtttctccggtcgaccctgatgatcccagtaaaccatacccgggtgacccggtcgatgaagacaatgtcgctggtacgggctcacggggaaagttaaccattgatttcgtcagtaatttgaaattcaatgcaattacgaccgcgggtgggccgtttaagacgactgccaagaatgagcgggcgatgattcaaataactgatcgccgcgccacggctgctggatggacgttacaggtcacgccaagcgggttgcaaagtggtcagcagaccttaacgacgtctttaaaattaggcgcagtccaattacggcccggtgctggcaatgttagtactgcacctaacgttgttaatactggtgaattagttgctggtttagcgaataatgtcgtgattgccccgcctaatactggtctaggtacttggctggtcgttctgaatcgcgggcaggtacccacggaacttgaagtccatgatcgccaattgcgtgctggcgactacacgggtacgctggcttggtcattaacgaacgcacctagttaattaaatggtttgatgtgaagctgctacttgtaaagaatggcagcttcaatcatacatagctcgtcacttaccgttgaataaaggaagggtaaagcctatgaaaaaaatattttggcagttaattgccgttgtgagcatcgttatggcaggtttgacaatgactgctagagcggatgacctcaattacacggtccaggctgatttgcctgataaccaaattaatcaaaaagtgtcctattttgacttgaaggtcacaccagggcaaacgcaaaatctcactttaaccattaaaaatagtgatagtaaagaacatcgatacacggtatcacctaatctggcggttacaaataataacggtatcatcgattacagccaagcaaaggctaaggccgatgactccttgaagtttaacatcaagacagcactttcaaagtcacaggtcgtgaccgttcccgctaagtcaagcaaaaaagtcactattaaattgacggtacccgagaaaaagtttgcgggcgtggcgctgggtggaatcaatatcatccaggaactcagtaccaaggcgaaacaatctagtagtggcatggccatcaataatcaatatgcgtacgtgattggcttgcagttacgtgaatctgatccaagcggaatcaaacctgtgatgaagttgcacgcagtaaaagccaagcaacgtaactatcgtaattacgttacggctaatctgcaaaacaaccagcccgttattatgcatggcttaaagatcaaaagctacgtgactaaagctggttcgtctaaaaaattattgacgacgactaaggaaaacatgtcaatggcgccgaatagtaattttgactttgcagttggtgacgggacgcaacaattgaaggcgggcaagtacactttacatttaacggcaacggctgataagggtaagtggcaatttacaaagaactttaccattactgataaagaagctcagactttaaatgatacagctgttacagaaaaacaatcgaactatttctggtggtttgttgcgttgggcgcactgattgttgtcctattaggcgcaattatctggctactattgaaaaaccgccgtcgtcaggactaactagcgagaggagttttcaacatgtggaagggaccgaaacaaatactagttgcattaactgcattaatgggattatgggccgggaccgcccaaattcaggctgctgacgaagcgacgttggcaacggcaccgtctggcctgaatcagttggataaactctttacgctaccagcggcattcagtagtggcattagtaatagtgcgaatattgggaatgtgaccaatgcaagctcgccaaatacgcaggccgttcaggttattaacggcaagaagcaagtgggtggcttttggtcgaacgacgccaatcgcctagatttaaataaagatgctacgtttaaaatgtgggtgtatttgggaacatccacgagtactagtaaggccggcgatgggatggcttttgtcttacaaaatgatccaaatggtactgccgcatccgcacaagtcagttcgtccagcattattggtgagacactcggtgtttggggtgttgatacggataataaattgaaggacggcgaagaatttgcgaaaacggccatccaaaatagttgggccttagagtttgatacctataccaatacttcaactagctatagtaatgctggtaatggtgattcgtttgatgatggtattaagaaacaacacattgcgaccgggtatcctgggctggctagtcagtatgaaaatcagtctgtcaggagtttagacgttaccgggataatttggtcaacccggtactactttacgcaaaaacataccaacctagtgacgaatatgtcattaggagatagcaagtggcaccacctggtgatggactggcatgcggcgactaaaacgatgacgtacacttataatgacatcaatccagatgggtcggcgacgggtagcggctttactcagagtgaagtgttagatactagccaattcaacagtagtgatggcctggttcgctggggattcatgggggcgactggtagtaattctggtaataacatggtcgtgattgaaagcgcgccgaatttagttgacgtacaggcggcggttaaggttacggataagaccaagaatcgtgaaatcaagacaggcggccagctcaaagctcagcataaagttcagtacgactatcaattgacttaccaaggtggtcaaattgactgggataacattacggctgaactcaatctaccacagcatattacgtttgacagtgccaaggtaacgtatgcggatggtagtgagcagactttgacggcgccaacgagtagtgatactaaagttgactatactctagataaagcagtatcggctagtcaaccgaccgcgacgatcacgctcaatgggacggccgagaatgtcgttgtcaatgaacagacaactgcaacgacggcgacatttaaaaataaggtgtttgaaacaacgacggaagcaccggattatatgattacagtcgatcagccgctataccttaaaattcgtaatagtccgtatactgtcgccaatggggaagacgtgatcatcagagggattgttgcagccgaggattcggaacaattaactaacggtcaagtgacactacacccaacgcttaatggcaaggaaatgccaacggttcaaatgtcggatgatgacgaacaaggttacttctactacaaggtcaaagcagaggatttacacgtcggtgatgacaatgagattgaactatgggcatctgaccgttacgagaacgtctcaccagttgataaagcgcagattattgttactgcaggtgaacttggttttaagacggttgccaaaagcagcacgtttaaaaccattactttagatggttcggctcaaacgacagaccgggaagacgattggcaactagttgtacgggatagtcgtggtaagggctctagttggcaactacaagctagtgcgactaattttaaaacaaccggtggtcagaatttggcgggcgacgtgattttccgcgacggcgagcagacgaccacgctgaattctgcgggtacggtgattgacagtcacacggctactagtgataacgatgattatgatgtcttggcagactggacgaataagtcaggcattttatatcaaagcaatgcgggagctactccgggttcttacacgggggatattacgtggacgttaacagatgcacctaagtaatgatcgggttggtataagagaatcaaaagcactcacacgcaagattgtgagtgcttttgctttctagttattagccataatggttaaagataataataattttaattaccacagttaagtgaatgaataatcagcctgaatgactgagaacgttgtaatcaaggcatttttttatcgtgtgattagtgaagtatttacacttttttacgtgtttttggttgcgttttctttttactttagtacaatgtaattgttaccaaatacatgttgcacaagcatgattgtgaatataaacacatttaaggagcgatttaaaaatgaaagttattgtaattggttgtacccatgccggcactgctgccgttaatcagattttagcatcaaatccagatactgaagtgacgatttatgaaagaaatgacaatgtctcgttcctatcctgtgggatcgcactttaccttggcggccaagttgctgatcctcaaggcctattttattccagtcctgaacagttagctaagttaggcgcaactgttcatatgcaacatgatgtgacggatgtgaatactgacaaacatgaaattacggttactgacttaaagactggtgaatctaagactgatcactatgacaagttagttgtcactactggttcatggcctgttattccaccaattgacggcatcgatagtcccaatgtctacttatgcaagaactggacgcacgctcagaatttatgggaagcagccaaaccagctaagcgggtcattgtgatcggtggcggttatatcggtactgaattagttgaagcttaccagaagcaaggtaaggaagtcacactaattgatggtttaccacggattttaaataaatacttagacaaagaattcactgaccgggttgaacaagactttgttgatcacggtatcaagatggctttgaatcaaatggtgcaaggcttcagtgatgatggtaaagaagttacggtcaagactgacaagggcagctacacagccgacatggcgattctttgtgttggcttccggccaaataccggcttactcaagggtaaggtcgatatgaacgctaatggctcgatcaagaccaatgactacatgcaaacttctgatccagacatttacggtgctggtgactcggttgctgttcactataatccaactaagaaagatgcttatatcccattagcaacgaatgcggttcgccaaggaaccttagttggtttgaacatcttcaagccaacgcggaagtacatggggacacaatcaacttctgggttaatgttgttcggccaaaccatcgtttcatctgggatgaccctagaacatgcacaggccgaaaatgttccggcagccgctgtcacttttgaagacaactaccggccagaatttatgccaaccactaagcctgttttaatgcaattggtttacagtcctgaaactcgcgaaatcctaggtgcacaattcatgagtgaacatgatgtttcacaatcagccaatgtgatttcagtgatgattcaaaatcacaataccattgacgacttagggttcgtagatatgttcttccaaccaatttacgaccggccatttaactatttgaacttacttggtcaagcagcgattgcccatgcggccgaagctgtcactgaataataagttaaaataacgcgatgcttaccttgcttcatgaaggtagcatcgcgttatttgtttattggtgataattgaatgttaagtggtcggtggtactaaagttaaggccagccagtatttgtgccattaggtcatcgtgctttggtaaaatcaatgtgagttggttcaactttaactcaacggtaccaaatgccaccaaccgttctaagatttccctgagcgtagttacttgctgataagtagcagtcaggtcaacactgagagttgcttcatgcttagccgtatcgattggggcaaagccgacctgaccgacgaacgcgttcgtgtctcgatccgttacgccccaaacaagctggtggtcatgaaaaatctcgcgcatggtgtggttaatttgtgcagcggttgtttccatagtggctgtcgcattgctggtctgatataagttgaaaacgtcgataacgcgcacctttgttaaccaatcgaacgtatagtgtggcgttagaatgggatgatacttttcaaattgtgacatagtgcctcctttaaaatgcgtcatgaatatttagtaattcctattgtactagttaaactgttatgaatcatgattaaaacgtgccattttttgagttcaaaatcagccagtttaggttcgctggaaacagttcgagttagcgtaaacttgcttagttagttcgtcctacgccgacttccaggcatttctgccaattgccggaacgcagtggacacagatttaagccgaagaccacgtcttaaatactggtcttccactaaccaagccaaggacgcttgctaagtggaatttcaccgctgagcattggccgaaacgccttccagtcgggacagtattcgaatggcggacatgtgcgtactcagtttttgatggctttgtcgttgtttcttataaacagtaattttgtcaatcaactgttaggctaaaaatgatattgtgatagctcgttattctgaatcgccgtagtaacaactgaacgttttggcaaagtgaagaaggcactctgatatttcacctaaagttccaatatcaaaatagccaacgacaaattgtaccaagttaagtggctgttcatctgccattcgagcggcttaccgaccggaggggttgggtgacaatgctcagtagccaaattattcttagtcggaagtgggttgcttccggcttagaataagactcgtatttgagatgacgcgggctgggcgttagctcaaatcgacgtcggcttacgttccagcaattgtcacccagccccggaggtcggaataggacactcaccggctgacgaacagtaagccaactaaatggcacgttttaatcatagttaatgctagttgttttcgatggttaccagtgtccaaatatgctgatttaagcgtcaagtggactgggattgccttgttgatgaccctcgctgaaaatggcgttaggtcgactaataacgcgtctgctggtgtgatttgcggtgcagtcgtgattgagactgggtcacagtccaataacgatgtaacggcatcagacgacagttctattgtaatatactaacgcgtaatttgaatgaataagacccataatgatggaacagataaaagaccgactaacaagcaatcgcaccgcttgttagtcggtcttagtgttcattgattaaagctttttaccagattttgacccgcttatctggtgccaaatacatggcatcgtcgggttgaatgtcgaaggttgtgtagaaatcatctaagttcttaggttgtacgtttgctcggagcttagctggagcgtggacgtcgattgaaagtaagagttgcatgtattcagtcgtggccttcatacgccaaaccatggcccagttagtgaagaacgcactcaaatcaacgtcatcttcgcccttagcagcttcttccgcgcaacttaagcctcccgcatcggcgatgttttcggatacggtcaacgtcccgttaactttcgcaccagcaaagtctaagccatcgaattcactgatcatggacttggcaagttccttgaagtgggcagaatcttcctcggtccaccaattatgcaagttaccgaattcatcaaatagggcaccattgttgtcaaaagcgtgcgagatttcatgagcaataactgcaccaataccaccatagttagcgctagaagattgttctaagctgtagaaaggtgcttgtaggatagcagctggaaagacaataatgttcataaatgggtggtagtaagcattgacggtgtccgcactcatttcccaacgggtccgatcagtggcttcgccccactttgagaacatgtcttggcgtgccaaacggttaaagtggaggacattgctcaatacgttgccaccttgttcgggcgtgtgcgtcttgaatttcgtgtaaatcgtttctagtttatcagggtaaccgacttgaatgccgagtttatcaagcttggtcacggctttagcacgcgtatctgcgctgagccaagtgttcgcttgcaaccggcgtttgtagacggcaatcatcttttcgaccatctgatgaacgtccgctttggccgcttcaccaaaatacttgtggccgtaatagagtccaacgacttgatcaaaagttccggtagctagatagtaggcactcttagcttggttccgcggttctttttgaccagacaatgcccgtgaataagtcgtggctaatacccgcatttcatcactgaggtaaccactgtaccgttgaacgagtttagctttcatccagttcttcatcagaccgaagttatcaggattgactacttcgttaaagtgatcgaagaaggcgggttctggcaagatgacgaggtcgggattaccatcgatgacggagtaggtgatggcggctaagtctaaataacgactagtgttaacaaaatcgttgaatttgcgaggattatacatcttactgtaatcagccgactcttcagcggatttgatccacggaacgatcaaacgatcgaattgcagcgtgtcatcaacgattttttgtgcttcgtccttttcgtaaccagttttttgcaacagttcggtcatcattttagcgtaaattgctagtaacttagggccggcctggttgccttcgtcgtagtatgtcttgtcgggcaagatagtcccaggtgcttgggcaaataaggcgttgaccttggtatttttcatatcagcgtcgacatccaagctgaatggtaatgggaggccgtcgtagatccaatcgggcatccgttgttgtaagtcagcaaagtcgcttaaactatcaatttgcttgagacacggcagaattggttccgcaccattggcattgcgttggtcgaaatctttagctaagcggtaaaacttaatgaattcggttagctgaggatcgtcgggggtaactgttcccgccgccattgcatcaaagtcatgcattaacgttttttcaatggcatcaactaagtccataaagcccccggttgaagaatggtcatccggaatgacggcggttttgagccactcgccgttgacggcatcgtagagatcttgttttactgctgcttgattaatggttgccattaaatccactccctaataaattttctaatactaagttaattataccttagattattctcagtggtatcatctggtaccgactcagtaaaaaatgatactaatcatcttaatagtcctgaatcagtagctgatgggttgtgaatgttaatgtaaaggtcaagattacttctgaattatcggcatgcaggagctgttagtgcctgtaaatcaccttatgaggcagcgtgatggttgacgtaaaagcccccggatgactaacagtgatttcgctagtcatccgggggaagggataatttaattagtagtcattattcagttaataatagctggtcggcatcgttaatttcgatgaccttgccaggcttttgcgtaattaggccttgacgctcgaataaggcgagcttacggctaatgctttcaggggtggtgccgaggaacgtcgccaggtcctttttctttaatggtagtttaaacgtgtcggttttgagcgctgccgctgtttcagtgatatagttcgctaaacgggcttcgacggattcagtggccgtgctggttgtttgacgctccagttgactgagacgtttgccaaagacgtttaagacgttgatgctgatactgggatatttttgcatcaagtcttgaaagtctgaacggcgaatactgcaaacatccgtcggtactaaggcttcaccgaatgaggttcgccgttgattttcaaataaggcagcttcgccatcgatatcaccagtttgtaatagatatagtaactgctcgcgaccattggcagctagctgatagactttaacctgcccattggcaacaatcatcagtgaatccagtggatcgtcagcaccaaataaagtgctgccggctggatagtggtggtgacgaacgatcgattcgatagtgtctaattgttcactaccgagttcgctaaaaattgggactaactgcacacattcatgttctgccataaggcccacctcctgaataaattcaccctaactataacagattttgcttggtagatagggtttgacgttttaaatttcctactgttttaataactatattgtagcgtaaaacttttttgaatttcttgacggccgtcaagttctggtcaatcaaatccggttatgatagaaccatcaaatgaacgacacggaggtaattgattatgaaaattattatgcaattaggaacgttgacttgcccatcatgcatgaccaagatcgaaaaggccgttgctaaccatgacggcgttgagaatgttaaggtgctattcaatgccagcaaggtcaaggctaactttgatcctgaagtgacgaatgccgatgatttggcacaagttgttaccggacttggttacgaagttgaaaacgtcaaggttaagtaggaggaataaacgatgagtgaactaacgatcgacgaacaatacgcagcggaattaaaacagagtgacattgatcaccatgtcccaacagcgggcgcaatgacgaatcacattttatctaacttaatggttgcttacgttaagttgacccaagtgaagtggtacgttaaaggaccacaatcattggcattgcggacagcatatcaacgtttgttagatcagaatgtccgtcagtttgctgaattaggcgaattactcctagatgaaaaccagaagccatcttccacaacggctgaattaaccaagtattccatgttggaagaaaatggggctttcaagtatcaatctgttgatgaactcgtggccgcaacaatcaaggattttgatacggaaaacctattcgttgaccgggctatcaagcttgctgaaaaagaaaaccggccggcactggcagcttggttagttgcttatcgtggcagtaacaatcgcaatattcgggaattacaagcttatcttggtaacgatgctcgaactggtttggatgaagaagatgaggatgacaacgattaggtcgttgtcgctgaagaattaaacgctctggatagcgattgtgtgggcaaactatccagggcgtttttgctattacaacgggcctgcgctatactaacgacaattaaattatatgggagggcccgagatggcgattagcgatattgtgatgtggacatttgtctttattattgcgactgggttcgtaacggtggtttcaacggcggtactgttgaagcgagcaaaacgagcgcccaaggatgccgagcagtcccacagtgatgacgacgatgactggaaaaaagatgattggaaccatgatgactggaaaaagggcgattggaaagattgactcgataagttgcctgacagatacggtgcttaactgagtcaactggcactaaaaagacggtataaccaactgagattggcgacaccgtcttttttggcgttatttggtttttagcagtagatccaaggagtgttcaagattctgaacatcagccgtggtcatcgcatctacacaattattaatattacgggcgatgacgagtttcatggccttgtcgatacttgatttcactgctgaaagttgaactaagacatcttcgcaaggacgattttcgtccatcatacgtaaaacgccgtccagttgaccagccgagcgtttcagccgggtcttgatctgcttgctagtgacatattcttcagtagttgccatgattcatgatgcccccttcgtaattaggcaagtacttttttgagttcggcttcaaaatcaggcttaggacgtgctccgaccatgtgactgacgacttggccatctttcttaatcaggaaggttggaattccttgaacttggaattgactggccgtagcttggtcatggtcaatgttcaatgaaacgaagttgacctggtccttgtaagcggggtcttcagaaagggacttaagaattgggtccatcatgcgacatggtgggcaccagtccgcgcgaaaatcaataacggcgataccagtatctgtttctttggcaaaatcttgatcatgtatttctttaatcattttagttgactcctttagtaagtatttgtcactaaacaatatacccccataggtatacacgagcaagtattctgcttctggccgtggagggatttaaaaaggactgatgtattgggtaattagataataacgatttgttgtggaagctagcgtcacctgagaatcttctagttgtgatcgcgagcattaacgttgaagatctcatgttgacgcgagcgtgttatactagcgcttcataattatacaacccagggtatctggtagaattatgttgaattattagaaaccgcttatttaagcaaaataaagcgtttacataaacggttttatctggtatcttcaaattatcatagatgctcggtaccttacgaggaggatttacagatgacaggttcatgggaagcacgctacgccgctgaattttttggcacgctgatcctagtactactaggtaatggtgctgtcgctaacgcattcctgaagaacacgactggtaacgatgatccaggactcgccaatggaggatggctcctggttgcatcgggatatggactgggggtcatgctcccagccatgatgtttggctcgatttctggtaaccatttaaaccccgcgattacgattgggcaagccgtgattggaatctttccctggacgcacgttgcgccttacttacaatttctaggagcaattgcaggccaatgcttgattttggcactgtactggccccattatcggcaaacgactgataatgaggcagtcttagggacgtttgcaactagtgatcatgcgaacagtcagttaaacggttttgttacggaaatggtaggaaccgcagtcctgatttttggtgccatgggattatatcgcgggatgttttttcatcaaaatatcgatatcgccaatattggcgttggacttttgattgctgccatggttatttcgttaggcggtccaaccggtccgaccctaaatccggcccgtgacttgggaccacggctagtacacgcgttattcccagtaccgaacaagggtagttctcactgggaatatagttgggttcccgtggttgccccaattgttggtgccgttattggaatttggatttataagatcttttttggtttataatcgcaattaattaaccgagcgtatttatgaaattattattggtctatcatttttgattgcaatatgataaaacggtccgccgactagctggggaagactagtcggcggaccgttattggttgctaggcctgtaaccaagttggggagacttgattaagctgtggctgcttgaatggttttagttggttggtgtttgtcgaacttggtttggaaattgattaaccgcatagcgttgaagataacgactaagatactagcttcatggacaaacatcccactggccatgtagatataaccgaagattagcccaatcagtaggaaggccacggtggcaatggcgatgaagatgttttcacgagtgttcaagacagtcttcttggcgagaccgtgggcgtgtactaatgcggggaagcttgattgcatcaagacgacatcggatgtgtcgatggcaacgtcagtcccactacccattgcgattccgatatcggcgttagcgattgaaggactgtcgttgatgccatctccaataaaggcgaccgtgttaccggctgcttttagtttcttaacgtattcgactttttcttctggtaagaggttggcgtgaacttcatctaggttcaattcgttggcaacggcttgagcggtgagttcattgtccccagttaacataacgagtttcttgattccttgggcttttaatgcggcgagggaatccttcacgcctggacgaatcgtatcggcaatcccgaagatgagttgaacttgtccgtcgactgccatgataacggttgattgaccaccagcttgtaaaccattgagatctttgagttgggtaggatttagtttgatattatgagccgtcaacattttttgattaccaatgacaacttcttgttgaccgacttgtgcacagattccttgacccttaacggtttcagtgtcatctaggacgggagagacccccgctgactgctggtcggcataactgacgattgcttggcctaacggatggtcggaaacgccctcaatagcggcagcgagagctagttgattatccgcgttgtttgtgtaagtgtgcatggttgtaacggcagtgttaccttccgttaaagtaccggtcttatcgaagaccagggtatcgactttggcaaaagtatcgacgacttcaccacccttgatcaggatgccgcgcttggcaccattcccgattccggcaacgtttgacactggggcgccgataactaaggcacctgggcaaccgagaaccagtaccgtgattgctaagcggaagtcacgggagaaggcgaagactaagactgctaaaacgaggacggcaggcgtataatattgagcaaagcggtcgatgaacttttcagctttggacttggtatcttgagcttcttcaaccaattcaataattttggcaaaagtcgtgtcgtcgccaacctgagtcgctttgatcttcagatagccattttcaaccattgttcctgaataaaccgaatcatcgagttgcttgttgatttggcgtgcttcacccgtaattgaggcttcgttaaggtaaccgttaccttcaacgacgatcccgtcaacgggaacctggctcccggttttaactaggacaacgtcaccttcgtccacatcatcaacgtcgacttcttcggtgccatcatcagtaactaaagttgcggtagttggtgacatgtcagtcaagcctttgattgcggtccgcgtcttctgcaaggtcttgctttcgagataggagccaaacaagaagaggaaagtaacgattgcggattcgttgaattcaccaataatgaatgccccaatcactgcgatactaactaacagttcaatactgaaaactttgttccgaagtgcgctccaagcacgaaccgcaatcggaatgacggcaataattgaagcaactgctaaaatgacttggtaaccgagcgtaaattgtaagagatatttactgagcatcccaaggacaatcagaatccccgtaactaatgtaatttgattcgtatgtttagtgagaaataattggaatttcataatttgcaactccttatttgatttgatgaccctagtatagtgagttcagcttgatggcaacttgataggcgtcaagttttgcaaaataacagtattaattctggattgctggcagtgattatgattaaaacatgccattttttaaattcaaaagcagccagcttagacccactggaaacagttcgggttagcgtaaacctgcttagttcgttcgtcctacgccgacctccaggcatttctgccaattgccggaacgtggtgggcacagattcgagccgaaaaaacacgtcttaaatactggcctttcactaaccaagcaaaggacgcttgctaagtgaaatttcaccactgggcattgtcagaaacgccttccagtcgggacagtattcgaatggcagacggagatgtacccaacttttattggactcatcatttttctttataaacagtaattttgtcgagcaactgtcaggtagaaggtaacattttgatagctcactatttcgaaatcactatagtaataatcgaacgtctcgacaaagtggttaatgtaaccttaaagtctcgtttaaaattccattatcaaaatagtcaacgaccaattgtaccaagttaagtggccgttcatctgccattcgagcggcttcccgactggaggggctggatgacaatgctcagtagccaaattattcttagtcggaagtgcctttcttccggcttagaataagactcgtatttgagatgacgcggtttgtgcgttaactcaaatcgacgtcggctgcgttccagcaattgtcatccagccccggaggtcggaatagaacgctcaccggctgacgaacagtaagccaactaaatggcatgttttaatcatgtttcatgacaagttaacggaagaataggtaggatgatcaagtttgagtaaacaagaggtataggagggaaaaacgtggattatcaaataacgcaggcaaatcagcccttgatgccggcatactttcaggggcgttgggcggtcaagcaaattgcggatcgagacgtgatgtatagcactaatttgggtgctgaaatcgattttcaagtcactgatgctagttttgtgcggttgacattcttgccgttggcgtatgagctaccgagttgggtggcgattcagattgatggcttgccttttcaacggcaggcggtgacgaatgaccccctatggttgacactggatggtcggccccacgtggtacgggtagttttgagtggtaatactgatgaggaccgtgtgtgggatggcaatcaaggttttgcagtgaaagccctgacgacagatggtgagttacagccagttcagttaggccgacacagcgtgacgtggattggggattcactgacggccggctgctgggtcatgggtaagcaacctgccgaagattatcgcgcggaagctaactatgcggcggttgcgagtgacttgttgaatgcacggaatgtccgcattgcttatagtgccgttggtctcagtaaaccaggaactggtggcgtaccggtactgccggaggttttaacagccgtggatagtaaaacgacgtggcaaccagtacccacggatttagttgtgattaatgtcggtactaatgatcggcatacggatgatacgacgttcacggtagttttgcgccgcttccttaatcaggtgcaggcgctttacccgaatagccggcttgctgtaatgatcccgtttaatcagaattttgcagcgattattcgtgcggtcgtggccgaatttatgcaattgcaactcattgaaacggctacttggcaactcagtaccacggacggggtgcatttagatttagctggctcccggatggcgggcgaattaacagcacaagcgttgcggacacagtatccagatgtttttaaatcgtgatcaacccatcttataaaaatcccgttttactgtagcaatgttctgctgcagtgaaacgggattttttggtggcactactagattttaaaaataaacgttaacgctggcggtgtagtgattgcgactgtaaataccgggccgcagcgagcacttcttcgggaatatccacatgggcgatgaagccctgaccacggggaccataaccggtgggggtatccactaggcgttgaaattcaccgagtaagagttcagtaaaataagcgggttgccagccagctactattgtgtttggcgtaaagtgcattggttgtagccggtttaattgcaaggtcgccggcgcatagcgaataaagttggcattgggccaattggctgagaacgttagggtagtccgccgcgcgagtaacgggtcttgtacgagtagaacgtggcgccaatcggtgggggctaacgcgcgggcatgcgtggcattgctaccggtattggtagaagtcttgtcgaggcggatactaccttgatagccagtctttcgaacaagcgtcgccatcaactcagcctcactaacttgagattttggcaggtttaagttttgccgcaaatacttagtggcgtggccgataccgcccgcaataatgagtagtggtaattgatagtcttgggctaactggcccgctgcagtggctgttgctgggaggctgttgccacaaaggaccaggccatcgaggtgctcaggcaaggcggtggtgtgtgtcaaccaagccagacattgattgaaagcggtcagttcgtccaattacttggcctccttagtcccaaagtgagccgctgcggccccaaagttgaaccgttggaagtgaacattttgaaagcctgcttgctgaaacatcgttgctaattgttgatagcttgcaaagtgacgagtggtttcctgtaaataagaatattcctgatattgatgggcgaataagcgcccgaatagtgggactacttttgtgaaataccactgccagactggtttaatcaatggttgatcgggttgagacgtctctaagcagaccaagcgagcccccggttttagtacgcgataaatttcagttaaagcttgggctttatcaggcaagttgcggagtccgaagccaatcgtgacgaggtcaaaggtgttgtccttaaacggaagatgcatcgcattgccgcggcgcaaccagacccgatcggcaaccggttgctgggtcacttttttttgtgccagttttaacattggggctgaaaagtctaatccgatgacttcaccgggtgcctgtaattctttagccagcgcgatcgtccaatcacccgtaccacaacagaggtcgagaacatgggcgttaggcgctaaatggatttgggccatcgtttgcttgcgccaatgacgatgcgttccgagactgatgatgttattcatccgatcatagttcggcgcgatggtgtcgaacaaaccttggacattatgtaaatagcgatttgccataaatgatacctcctgatagttgctttacttactactatagcagatgttagttgccagttaccgtgaaaaggaatgataatcaatataaagctacgatattgatttcgttgctgttaatattgttcgtgaataaaccgttaaactaaagttaaaataacataaaggcagtctcgattggtatttattaagtaccaagcaagactgccttttttgacagcgcgttcctaatcgaagccttaacgtcaaaacgagtacgctagtaatagcttaaaaatcatcatctgcaatttgagctaacaggtcacgtgatggaatgaagaacgcttgtccggatagtaaggtggagaaagttagtaaaaagtcactttggtcgaccatgttttgcagcatgcctttggtaaccgtccagtgacgggcataaccaatgaagtacgtccctgtgttaccagctgctggattggagtacgggacattcatccgaacgattttttgttcgacaccatcaatttccaattttgaagcaacgttgtgagcattcttaaacttgtctgcgtcttctaactcgaagtcgctgaatttttcacggcccacggctttttcctgatcctcggtgtgcatatgttcccacacgggcatatcatgttgccatttctgtgcaaaggcgtaagaaccgttgatgaattggggatcttcgtcaccaactaaggcataatcagcggcatcttctacggccggcgcttccgtaccgtcgataaagccaatgatggcccggccctcgaagtaacgaaagcccttcgtctcatcgaggacggtcgtgattggcgctaaaacccgctggaactgcgtttggcattcgtagacgaccgcttcgttgcttgcgcgaatgtggaagaagaggtcgccgggtgttgctggcatagtgtatttgggtccacttaaggtggtgtaagtttctaattctttaggtttgggtgccagtttcaggtttggcgtctcggatgcgtaacgagcgaatgatggcttgtgaccgatctgcaaattcttgaaagacttcacggtcgtgttgctgatcctgacgatttaattgaagaacggtaaattgaacgtgttcaccgacatctttccagacatcttgggcgcgatttggattgatttgcatggtatatttcctccataaattgtttgatattgttagtgtacatggtggtacggttagcgtcaaataaaggcaaacggtgggtgtggataatgacgacattcgccagcatcaggggtaggcggccaaactaacgtggtattaaaacatgagtaataatgattatcaaataagcgcaaagctagtttcaaatttgaaactgtattagtgggtcctgtgagctatagctcacaggacccactaataatttaacaaaaatgaaactttatctgtcctaattgcggataattgtaattaaatatctgtgtaattactaagtaacttgtaattcatcgtttttagtaagggatagtttgagacatttagacggctattacaagtatattaataactaaacggattagtcagttggaattgttggtgcttgtaagacattaggaattaattgaataaatagccggtaagtctcaattctgctgagtgttggctgcgtggtcgcaagttgccaagctaactggtgaagacagttgccaagataggttgccataaaatgccgttgcttaggatggatggctaagctagttagcagctgttgggcaaaaccaacttctaatgggatgacccgatcgcgacactgtgcccatgacacgagtaaggggagatccagatgtgcgcgaagcgtcgtgacgattacaccagcaatggttgcgtaagatgtggtcgttaagtcatttaacgcttgtcctaactgttgtaaggcaattaagtattcaatcacgatgatatcttcaatatcctggtgatgacgataaaaagtggcacgtccaacgtgggcatccagacaaagttgtttgacagtcaactcgttgaaggtcttttgagccttgaaattcgcttgcagggcagtaatcaatttacgatgagtttgatgagttcgctgatcaatatgcaattgattgttcataattaattttgtcatatgtcaatgatacaccaacttgtgatatgtctcaaaacgtcccttttttagcatgtgaaagcgtctataatagctgtcacagttagatatagctgaccaattaaggagattgtcgactaatgaaattaattaccgttgaagagcattttgaatcggcagctgtgactgccgcaatgcgtcaagctgttggtaacgctgcgttaccaacagttagtccagcgctacgccagtacatgcgtgacaatttaccgagtcctgcaattatgcaagacacccagcatgaacgactggcatttatggctcagtacgcctgtcgttcatctgaatggtaataaggcatacgtggaactaccaactacgacgcatatgcgcatgatggtcaatggtactttagcggaattagaatcatatcggcgactgatttaccgtgtcgaacgccgtgatactaagtggaagattagtcgattgacctcaattaacgaaagtgataatttacgaccagtcattgcgggacagaatttacacgtgatacctcaagattttaacggtttacggccctcgtatcaattcctggcctatgtccgacaagctgccggtggtcaaattagtcaggacttattagggacggatcgaccagaagaagttgagcgattgtacaaggaaacgagtgcgtggttgcgagctggagtatagttgaaggtaaaataaaaaaagcgatatcatgtaaaatcaaatacttttagcaccttgtaaccagcaataaaaataatttagtacattcgttaaaacaacagaccgttactttgataaacacaagtaaatgatggtccaaaaaataaggtgtgttgtaatcaatttcgattgcaacacaccttaattttcgacgtctattaatatggaccctaccggatttgaaccgacgacctcctgcatgcgaagcaggcgctctcccaactgagctaagggcccaatacaacttttagtataccgcaaaatgctagtcgtgcaagtctagtttcgttatcaatggcggctagcacgatgattttgattaccacgaattttatgcactcgtcgtttgtactgtgctttttggttgctgacaaacttgaagtgttgcattttgccgccgaaaacttgcccattcagccttaattttagccaatcttgcatgacggccatcattgaattaatttgggtgatacgtaatttgtcgtgttgttgttgtgctagtggtaataaattagtagctaactggttaactaatttctgatggtaggccattaattcgggtgttaatggggcatcagtataagtattaaataatttttgaattgtttgaagcgcatctttgatgtcggttggttgataataacgatcgtctgtattcgtcaagttaatttcccctttgtcattttagtatagcaaattttatttaaaaagcatggtttagcgtggtcaaagtcagcgatggcggttacaatagggataaatttaggaggtgcgcatcatgaccacagtaaccgcattggaaactcaagcaggccaagtcttggatcagtcctacgcccagtttaaacaagcccagttggcgctgggcaaagagcagatatttgctaacgctgctcagatttttactgttggtgaaattgctgctgcgacacggcaatatttatttgacgaagagatcgcacagcaagtgatcaagttgcaagaccaggtattaccgaccatgtatcaacagggacaaagtggcgaattcttgaagttgaactttacgggtaatgatattcgatggctattaggattaccgcgaacgcatcatcgccaacgaatatctaaatagtccaaattaaccgaacgtttggtcgtaattaaattgaaatttaaccgaatttccaggaattgtcactggaaattcggctttttaaaataaaaataactttttttcgtcaaagttgctaaatggtctcaaattttagtaataaaacgatgccgatatgatagggtttcagcgcggaaatgttacgatggctaattattgttacggttttgtaactttcgtaacatattgttattttgctggtattggtatgtaacacaaattgagtagtatagacgttggcttgaagtacatacgtgacattctttttggagtgatcattattaaagtgaaagtaaatattaaacaagtgatgttaggaactgctgctttagctggtatgttagttactagtcaagcagttgccaatgccgattcaatgacaatcaaagcaggggacactgtttgggcatacgcacaaaagtacaatgtttctgttgacaagattgctgaagctaatggtttaagcaatcctaatatgattattgctggtaagaccatcaatattcctggtgttaagaccggtgaaaaggttacggctaagaagaccgctgctagtgcaagcagtgccaagtcgactagtgctgcaacttcaacgagttcacaagctgctagttcaactactagtgctgctgcaaccagctcatcaactactagtgcaagtagtacgagccaagcagtatcaagtagctcagtagctgcgcaatcgagtagtacttcaactgctagtgcaagcagtgtaacttcaagtgcttcaacgagttcagtagtttcacaagctagttcaagtgctgtaactagttcagcaacttcacaaagctctgctagccaaagttcagcttcacaagcatcacaaagctcaacttcagtagcatcgtctactagcacgcaatcagctgctacttcaacgagttcacaagctagctcaactgcaagtaacacaacaacgaacagttcatcaacaacgactgctgctgcaacagcctaccgtgcttcagcaacaactagttcaactgcatcatacagttcagtaattgctgctggcaagactttcattggcacaccttacgaacaaatggattgctctgcattcacgcaagctgcctttgctaaggttggtcgttcaattggtcggactacttatgcccaagcaacgattggtactcacgtatcattcagccaagcacaagctggcgacttggtcttctggggttctgattcagcaccttaccacgttgggatttacttaggcggtggccaatacatcgcatcaccaacttaccgcgaatctgtttcaattaagagcactgcttactatacaccaagctttgctatccacatgtaattaacgttccttaaatggacaaatagcatcatcttagttcgtcagaattaggatgatgctatttttgtatgcgtgagcgatattaattgttttctggagtttggctactttattcaaaataacgtgatgatttagtgtgtgaatccgtatttcttaggtgccgcgtcatgatgatagacaatgtgggcttggtttaagtcatggacagccttggtcaggtcatccatgaaatcgtgggccatattcatgccaaagtcagcccgaacgacgattcgttggatgacttgttgttccaggttagcaggtaaaggatacgttggtacttgccaaccgttcattaataggcgatccgataaatcataaagggtccattcgcgatcttcgcgcggggctagttggtaacaaatcagagggagttggtgtccgttattgatcatcttaaactcaccaactttatccagagcggctgccaggtagcgggcaacatcgtgagtctttgtttgaatctcgcggtaaccgtccataccgaagcgaatgaaattatagtattgtccaatgagctgggctgcgctatgtgagaagttgatcgccattgtcggcaactccccacctaaataactaactttgaagactaattctggcggtaaaaactgacgatcacgccaaacgacccagccgaccccgggataaactaaaccgtacttgtgcccggaggcgttgatcgaaacgacgttagccaaccggaagtcccagatgagttgcggctcaataaatggggtatagaagccacctgacgctgcgtcaacgtgaatgtagactggtaatttgggatgctgatgattgtagtgagtaacgaccttatcgagtgcggctaggtcgtcatattgaccggtataagtgatgcccatgataccgacgataccaattgtgtattcgtccacgtagtctaagacgtggttaacgtcaagggccatgtgttgctcatccattgggaccacgtgtatgtcaacgtcccagtagacacaaaacttttcccagcaaacttgatagccagccgaaataacgaggttaggtcgatgggcattcagatctaaacctgccgcttgagcgcgtttacgccaggcgaatttcattgctaaaccgcctaacatacaagcttcagaggagccaatcgtagaggtacccgtaaagtgttcgtcatcaggtgcgtgccacagattggcaataatgttcacacaccgattttcaatctcggccgtgcgggggtactcagatttgtcgatggcattcttagccagcgtatccttcatcaattcaacggcttcgggttccatataggtctgacaaaaagttgccaggttcagtcgtgaattgccttcatctaataattcatcacgaactaagcgatcggcttctcgaggggataatgaatgctttggtaaccgatacttaggaagatcatgttgttcagaaggcgcaccaaagactggttccaagtattcttcagcttcatgattgtgtttaccgtataacattgccatgttggtcacccttatctttataagttgtgccgagtatagcacgaggtgataacagggtaaattaaaatgcaatctggatggtaggtaacaaaaaaactggtcgaatggacgaccagtttttagtgaggatctttgccccaattaggctttatcgctgaactagcagttaagctttggctttgctattcatgaatttcttcaacagttgcaattcttcctgagttggcgttgcttcaccagatttaatgttgtgaatccgttcaactgataattgactgccaaacgcaaggtcgttatctgtaagatggtgctcgcgttcaaaactgatgagcttttctgataattgacttaatggtagttccatgctcctcaccccgatttttagaattcgtaaaagttcagtgccatatacctgctacttttattataaccttaattggtctgaagcggggaacgaataccatcctattttgtaattggttgttttaattgatcttgtaggtggactagaatatcagtaatctcatggggaagctggtcatgattgttgtgttgatattgatcaatgaagttagcccgaattcctaaacgagtggcgaccaagttacggtagtctgcattggcataatcaactgggaaatcagctaactttaggttttgcatgtgctccaagcctgcgaatgactcccacttggtcgtatcattgacaatggcttccagcgcacccaaggtaatttccttaggaatcttcttatcgccaaagaagccagtattcaataggtaacaatctaaatggcgttcttcgaagagtgccttgaaatcatggtaatcttctgatagtggatagaccctaaatgggtttgcaaatggttcgatcactagggcgttacggtcgacattaccaataatattttcggccgagctccgtttggtcgctaaagtggcgccgaatgtcgctgctaatacgggatcatctactttaatcacgggtggtaagctatcatctttcataatccagaagattgcattgatgggagcggcttccttatcaacccggttagtcgaagcgtaccgtgacttgatcgtccggccgttaccgttgcgtaggtcttcagtgacaaggaccttgcgaccctgatcgtctaaggtgacgccgacgttttggatcgtcataaaatacttggtctcatcggacgtcatcggatagtcattggttttgtcaaagtaagaaggctcgagggccacggaactaccatccttgcgattgatgacaaaggcgtcgtcgtggagaacggtgatatcgtatttatagccgtgtttagcgtgggttagtgttgacttaccggaacctgataacccgaacatggcgaagacttggtcttgcttgttcttgaagtggaaggccttcaagccaccgtgacaagcaacgaagccgtgacgatgggcgatcgaccaagctaaggtcaaagtcgatttcttcaactcaccaaagtatggcattcctagaatggcagccgtattatgttgcggatcaaaaatagccaggccgtctggataatctggatcatggtaagtagggtcagcgtaaatgtaaatatcgccttctggataggcaacggaccgatcgaacatttcttgataagcagtggtgatgggctggaagttaagcatgtaagaaagtagattattggcaaagccgtccggaatcgcgaggtgggcccgcacgatgaaatcttcgtctaaaccgactagaacgtccgtcgtgatgaagtccttgtgagcactagcaaatagtgcttggcgtaggcgtccggccatatcggcttcactaacgcccgggttgcctagaatccggcgcgcttgtgcggttcggccaacaaccttacctgtattggcaattaacatttttgcatcagctggtaagcctaaatccgttgcgcgatagattgggaggtccgtaataacggttccggggtccttggtggcgcggtggtaggcggcggcgacatcatcaacgtggtgcatattgttaccgtaaaaggccgtttcaacggtagaacggatctgtgaaaagatcggattatgacgaccgatatcggctaattgataagaatttttagtgctcatattgtagcctccctgcaagttgataagttaattttagcacaaactttcacataagaaagcgttttcttttttggctgatgaatagctgctagtgcgtttagacgattaagacgttaagccgcagtggttgttaactaacttgtagttggaagtactcgcggattttattgataagtaatgatcattttgatagttgaggctgttattaattaactttccaattaaattatcacttgcgttcaaagctatattagtatagtttattaaaagagaatgattgaaaatcagtgatagggaggcacctttcttgccacgaagaaggaacacgcaacggcgaatggagattgttaatacagcgtttcgcttgtttgccgagcaggggtatgcgaacgttcagatgaaggacattgccattgcctgtgatatcagtaagtcgttgctacaacactatttcccgaagaaaatcgttttattaagtacgatgttaaatgagttgacgcttagtgcttttatctatagtaatgaacagctgaccatgctgtcttcgtatcagcgaacaatgattcaaatgagctttgttttgcggatgttagatgaaaatccgaccatggaacactttattcaggacatcttcgagagtccggaactgacgactgagatggtgctagtgacactagactggctagaagctatcggcgtagaaggtgaagctgctatgattagatacgcgttgaacttcgcgttatctggtggtatggctgtttttttcaagcgtaaaattctaagagctagtgttggcatgattgcagaaaatatcgaccaagcgttttacttgttattaggtgagaatactgagaaaattgatcaaatttatttgagcacagccaagtataatactgactattattatcagcaattcatcacgtatctgcataaacacgcgacccttgacttgagtactgaaataaaaatttaatattaaagtaatctaaattacttgtatttcgtaaaatatactagtacactttaaagcggggaaatgataaacgacgcttactaatttatgaaaaaagtatggggcgaattatgattgggaatttaatgataattcgactagtgaaagggagacttgaataatgaatgaagatatggaattttttaatcgctttagccatatgtatttacatggctttaaaaacttatcagatatgtttgctgaacctgcaacggaacatgggattactttggatgaattttacattttatatgatattgctgaagcaaaaggtaagatccgtctgatggatattgccgaaagtcacggtgtgacgcgttcagcaatctcacgcttaattggtcgcttattacggaaagattacttatatcaagaagctgaagaccatgaccgtcgtaacaaagttttaaagttaacaccagaaggcgctcggattgaacatgaagtctttactgaattgattcaacgcaaccgggaatggcgtcaaagcttcagtttagctaaacaatatcagactttgaacttggttgaagagtttatggacaagtttgttaatgaagatgctagcaagcaaactaaaaagacaacgtatgctgatactgatttgaagcgggctgaagcttaattgggtgtcagttacaattaaagataattacaaaaacaaccctgttggcgtcttttggtgctaacagggttgtttttataatcattaatgaccactgatcgtgattcggaaatgatcaagacgataggtgctatgaagtctcgatggtaataggtgtcaagctggttgtttgcgctatcagatataatccgtgcttgtacttaaaataagacttattagtaattatttttggaaaaagtgagcgcttactgtttgtatagtagtcacattgattgggtgatttgtataaataagacgagcggacaaatactcgtcttactcatatgaactttggttgccttttaacctaatagcgcgttcaaggtttggttaggagcttgcttgatattgcagaattaatatcaagtttaagagtgattaaacttatatgcgaattttaaaacacaaaaaaatattttattgtacaaagtaaatatcctatttattcttctttataaaaaatttgattcaactcgcgatatttactcggagtaatatcgaattctttttgaaactggcgtgcaaattcggcgctattgtagaagttgattctttctgcaatttcacctataggaagatgggtattaattaataattgctttgctcgctgtaatttagcgtggcgaatgtagaagttgatggtaaaccctagttctttacgaaatttacgcttagtgtattcaggatctaacgtcagttcttctaagatggtatttgctcttaatggctcatcacaatgattatcaatataatagacaactagcgcgacttgcttagagaggcgggtaccatcaattggaatatcaagtgtatcaagattgctaaaataattgttgacgattgactctaaaagtggcataaaatcatcattcgttagtgttgttgttgtgaggtaatgcaaaatgtcctttcttaagttaacgaatgtgatcatgttcaaataatgataaaagctgacacttgctagatcacaggttagtgaaattaaggcttcttttagaatgagtgggcggacgttgtataagttatccttgattttgtgattaaatctattgatatgttccaaggcgtagtcaagacaacgcttttcgaaaaaataacttaaatcatgttccaatatagcaaaatcaaaattgaaatcgcgttctgtttgagaaagtttgagctctggaaaattcaatggacagttcctcccccataagttacaaaaatagtgaattttatacaaatagtaaacgtacataatagtgtacttgattaactttaattagttcaaggataatgactgatttaagttatccagtatagacatataaatattcttcgtcaattagtttgctaaaagtttattaataaaggtgaatttataatattgatttaaatattaatatgtttgtacaaaaaggtattacgcgctattgatgaagaagattaatatgctaattaaattttagggggaattgacttatgacaaagtcacgtacgctcaaagcagctatgctggtttcagtagccagtattgcttgtttatcattcaataatttaggagcttccgcggacaccttgccttcaactggaaagtctcaagcagatgtttcgtttacgtctaacggtggttcgactaatcctgttgatccagacaatccggataatcctggcggcggtggtactgggaacaacgggccactttcgttagatgcggtaccaacgtatcttaattttgggacgcatacgcaacctaatgttgatacggcctacactttactttcaaaagatgctagtcaggagagccttgcgacagctaatgatgataagacccaaaatgtgacgactagtggtaagaaaaatggtaatgatatcatttacacgcaagtttctgactcacgggggactggtgctggctggcaattaaaggcacagctttctgatattacggcttctgacggccaagtgttaacgaacgcgtcagttgttttaagtggtgggacaccacaatatctgacaggggaagctaatcaacaatcttgggtcactgcggcggatgcgaaccaggcaaccgttgcaacaccaattgtgctcaatgccggcgcttcatcgacaaccgatgttgcaacagccacggcagggtctaaagttggtgacggtcgaggtatgggggtcaaccaacaatactggaatattaataatgtgcaattacatgttaaaggtggtcacgcagccgctaagaattattcagggaatattgtttggacattgaactcgacaccaacggcttaatgaacgaaaacgagtggctatgttgaatagttaactcgtttttttgaagggaggcccttttatgaacggctggaataagaagctattattagggatgttaaccctaataatgactttgttggctggtatgactgtgattggccatgctgctgacacggccaataatgcggtaacttttgatgttcagccaatgcttaatgaaaagcaacaattatcaaaggacgcttattattgggattttaaaattcaaccgaagagaacatattcgttagcgatgcgtgttaataatcgctcaaatcatgaaattaaagtcaaaaatcaattcctacaatcgtatactaatgcgaaaggtgttattgattatggtgctgctaatctgaatgatgatactagtttaaaagtaaaactagctgatattattaccgtaccggatgaggaaacgacgatcccagctaataaatcacggatcgtgcgggcacagttaaaaacgccaacgaaattgaacaaagggattattttaggaagttggcaagttaaaattgcagatcaacatcttaaaaccaagggggcgacgttaactagcgaatatgcctacaatgtggggatcaaactaacgtcaaatcgtgatccattgccaaaattacgcttggctgatgttcaattaaaaaagcggagtggcatcaagacagttatcggtaatattcaaaattactacgcttcaattctaggcaaagggactgtcactgcctacgttagcaaagctgggcagaccaaaaagctcgcggtggctgatctaaaaagtagttcgatggctcctaattctaactttgacttaccgttaaagtggcgtactaatcgggggatcattttacctgggacttacactctatacgtcaagtatcgaactacggatgaaaagttcgctaagccgcatgtctggtcgctaaagcaagattttgtagttggcgctacggatgctgttaacgtcacgtctccaactacttggggttggttgattggtatcgtgttgttagtattattgctcattgctttaatcatattctgggtaattaaacggcgtcaaaataagcgctaaggggtgatactatcaaaaagctaagagcaattgttgtcatattgatggtattgttacaagtcatagccgctggtgcaacggtaagcttaggcgccgatatgaccgctcaagcagctacgttaccacagttaacttttgcaaaatcaacggctagcgataatattttaacgaatcaacattttgatgttgaactacaggttggtgatacggcctctaaaataaatacgattgatttaccgaacgaggttaatttagatgggccagaggagtttaagcaaataaaacgggttttcgatgatagtcagtacacaacgggggataatggtgcctttacaattacggctaagcatctgacagttgcgtacaatcctgataagcgcaggataacggttcagtggtcagatgaatatccgcaaacgaaggtaccaattagattaacagctgttaaagcagaaaaactggcgttagttgctgtagccgatgatcaaaaagggccggcgttgaatgtcgagattaagcaaccacaaacgcaggctgatcaggccagtacgagttcagctagttcttcagcggcaaccgatacaaatagttcgacggcatcgtcaagtcgacaagcgacatcatcagcagcaagtttggacagttcacgttcagctgcaacgacgctttcaagtcaggcggtaaaccaaacgagtgctagcagtagcgagccttcacaagaaactgctgctaatcaatcgtcagcggtcacggaatctgcgggtgagacaactgatagttcggccagcatctcgtcgtcatccactgctagtcaagtgttctcatcagcaccaactaagcaagcaacggcgagtgccaaatctagtccattaataccagtcactcggttagctcagctgagttcgaatgtggttgatgttagtacatggtctcaattagtcgatgcttggaagaatgtgagtgttgatgaaattaatattacggctgatattagtaatccgactgccgctgcagggtctttggactcacgactatccggtaatattattgtgaatgggaatggacatagcgttaatactggatctgctgggtttcacactaggtacaacggtgctaccagtagtacgaaatatacagcgacctttatgaattttgcatcattaatcggatcttttggaaatgatgcggggttgattggctcatccaccggtggcgatggtgccggaggggctttgaattggacatttaatgttagtaatattacggtcccaagtgggactagttataccaatacaagtcggcgatttgttagtgcgcaagggaaccaagtcaatattaccggcaattgccgagtaacaacggttcgagaaaacatcttatgtggtggctttgatgtagctgctggacagacattcactggatcgaaaatagccaatggtgatgataattcatttatctggtttgtttatgactatcaaggaactggtaatcggcaagttaatgttgaagaaggcgcgacgctaaattgtattcgacgacctgctagttctacgtcaaccgcctatactacctatccggttatttttgatgcgtatgaaagtattaatgtgggtaaaaatgccacgtttaatgctagcgtgccaggaaatgcatactctaacaagtacttttatgggtcacaatatcatcgtaatttttacgcggatactggtagcaccgttaatctaacgtcactagctagaagtcaatcgccaatctctttttctgataatgcaacttcgacgattcaaagtagtagtggtgccaatatttatgtaattgctgctacgggagcaccgcttatttcgggaaattacgcgcgtttggctactgttcgatttattaatccgaacaacttggatttacgtaatagctcaactggaacgactgcagcggctagttcgattaaccaagataatgtgggcacttttgaaatccaagatagtaatattagcttgtggaaattagcatcatcggttacgggcggtgcggattattcgtatagtaacgtatctcagttattacaacagggttcagcagtgacggccacggatagtaatttgcaaagtaattatttatcttctaaaatgcgtcggattagtgccactaaccagaagccacaattagcatttaataatccgtatgatgggacaaccaagctaacagatgcggatcagaagctgcggacgcgagtcattgtggcgatggttcctgatactaatggtgttcaagatgacggaacggttaattatattccacagtatgctagtgcagggcaattaaccgtgagttatagcgttaatggtaagacaatcactgcccaaactgatagtaatggctacgcaacagctaatgtcgggacctttttaaaagctggaacgacggtcacagcatcgactagcaataccagtggaacgacggtcacggctaccgggacggtggttgatgtgacgccgcctaatccggccacaatggtatcaccggaccccattagagtttcaacaggaacggtgagtggtcaaaatggagaaccaggtgcgcaggtcacattagcattgaatgggcagattcaaactaatgtcaaaacggttgtcaatgccaatgggacttggtcactgaacttaaccggattatcgttaaaaattggtgacaagattattatttatatggctgatagtctaggaaatcgtaatcctgatcctaatagttatccaaatgggcagcagtatcatgatgcgactttccaaccagcaccgatatttacagtagctaaggatttaatcgtcaatccaattgatcctgatgatcctagcaagcctgggactggcgggacgaacaatttaggcccattatcgttggacgctgtacctacacatttgaactttggacagcacagcattccaacaatggatacagcgtacccattgttgtcaccatcagccgctgaagaccaattggctactgctactgatggacagaagtatgcaacagttggtggtcagaaaaatgggcaggatagtgtgtatacacaagtgactgatacacgggacaccccaagtggttggcaattgacggcccaattatcagcgttgacagctactgatgggacgaccatgacgggtagttacgtgacgttaacatcaggaacggcgcaatatttgaatgccagtactagtaaatgggttacggcaactgaccaaaatcaggcaactttaccagccgtgattaagttaaccccaggtgctacccaacaaacgtcaatagctgggacgactagtcaacaaggcgtcgggactaatcaacaaatttggaatgttaataacgttgcgttgcacgtcaagggtggtcgtgtgatggctaaaaattattctggaactatcacttggcaattgaatagtttgccaagccagtgatcgttatttaatggtatgcttcaaggcttaaaaagaatcggacgacaaaactgattgcagttttgtcgtccgattttgagtatccgagattaataattagccaaagattgatttgaaaatagagctgaagaagttaacaatcgcgctccacattttttggagcaagttttgattttctttagtattgagtttgctgaagacacccttggcatttgattgaatgttcttcatcaacgagttggcttgagtcttaaagcttgaagaatctaatgcacctgaatcacggatcttgactaacaaattaataatttcagtcttttgattattagtaatgacatttgttaaattgttattggtaatttgttgattgacaatggtcgtgatttcgtttttagtgatgttacttcctttttgggccatttcctttttggcaccagccacagcgttgttcaactgggaatcagtataaccatccttgctcttatttgcttgagtgatgccactgagagtacttaactcatcttgggcggcggttacttgcttcgtgtttaagctgttaccagattttgcgtacgccgcgtaaacaccggctagtgcgcccgaaccgtcgattggagtagctgatgtgacgtaaatattagcatcggtaatcccagccgttagggcggcgtttttatactggttagccgtaatagtggtgatgttattactaccattataatttaaaattttgacattaattccagaaccagaacttgttttttgaatcatcgcactggaccacacacctgagctacttgtgaaactttcaccggctgggttgaggtatttaactagagtatcgccgttaacagttagcgtctgataatcggcaccgttcaagctagccgttaacgtgttgatcgtcccagtcttttgactgctagtcaggctactgcctaatgtgacaattggttcatcgctgctactgtcagcgtgcgcaaggacttgccagctgccaagcccaacgatcagggtggcaacgagggcaacccatttaaatttgaaactcattcgtttcgtcattttcttttcctccgcatcttaactaatgcacctaaatcctaacatgaaccgttcgctcccgggttgtacagtggcaactagcgattgcaaggttaggttatgtcattattatagcagaccgtggtcgtaagttaacattcggcgcgtaaccttgggagagtcctaagtattttaacaatttgtttattatttgccgaagtaccagactttcgctatactcgaaataaatatcgggggaggttataacaatgacacaaaatcgggtgattaacgcgttgagctatttaagcattttattcttaccagttttatttccattaattgtttggttgctgacgagtactaatccagaagcacatcgggttgcaggacgggctttttggttacatttgttgccgacaattttaggaattacactgctcgttattttaggcgttagcggtatttatatggacagtatcgttaatagtggctggttggccgtggttcttttagcggtatttggattagtcgcagtggctagctacttatggtcgattattcgcggaattcagtatttaattgctgattaatgtagtagcgttaggttcaggagggtttagcatggttgttaaggacgcatcagtggttgaaacagcaatgatgattcaattttggcagcgtggttattatcaaacgacagttgacgacttgctcaccgttagccagttgtcacgaacgcagttttatcgccagtatcacagtaagcgggttgcgttacgccgttcacttgaacgctatcaaataacgttagatgaacaacttgatcaattgattcaacgtgagcgggcgcggcaaacaccattgcccgctttaattgcggcttgtttgcgactgccgtttcagagtgaacggtggccagcaggatgtttgatggtgaacctgatggccgaaattgggtcgcaggatgcgtccttgatggcccaactgcaaacgatctatgctgatttacagacccgactcgtcggtttactttcacctcaggctaaaaccttaccgaccacggtcgctgaggctgcagcaagtttaatgcaggttcgcagcggcattcagttattggcaaaacaggatcctagtggggcacagctaaaacaacaggcccaaacgagtgttaatctgattatgggggcagtttaagatggttgagattaaagtcattcacggtgatattaccaaaatgaccgttgatgcaattgttaatgcggccaatacgagtttgcttggtggtggcggcgtcgatggtgccattcatcgggcagctgggccagcattgctggctgcctgtcgcccattacacggttgtgcaactggtgaagccaaaattacgccgggctttcgactaccggcgaagtatgtgattcacacgccgggtcccgtttggcaaggtggccagcataatgaattacaattgttagcgaacagttatcgcaacagtctgaatttggccgctgagaatcattgtcaaacggttgcttttccgtctatcagtaccggcgtctatcactttccgctatcaattgcggcaccgttagcgttaaaaacgttacaagcaaccgcgcagacaacggcccacacggttcagacaatcacgattgtttgttttgatgaccaaacgcaaaatgtatttagtacggcgttggcagcgctgacaaattaatctttaccaaaaaaatacacatggacgctactatcttgagtagctgcttgctataatgttgatataccggccatcggggatggtcgtaaatctttatgtattgggattatcaagcgataatcattgccaacaagaaaggaatccattgtgttagatatttttaaagcggtaatcttggggattgttgaagggattactgaattcttaccaattagttcaacagggcatttagtcctagttgacgaatttatcaagatgcaacagtccacgcagtttacggatatgttcaacgttgtgattcaattaggggcgatcatggcggtcgttgtcctgtatttccataaactaaatccgttgtcaccacgcaaggataccacggaaaagcgaaatacttgggttctctggagtaaggtgttattagcggtcattccatcagtgatcgtggggttaccgttaaatgattggatggacgaacatttaatgaattgggcggtcgtttctgccacgttgattatttatggggtcctattcattgtgattgaaaatcataataagcgcttaacaccccgattcgctaatctacaaacgttaccttatacgacggcattgttcattgggtgcttccagttgctctcgttgattccagggacttcacgttccggtgcaaccattttaggggctatcttgattggaacttcacgctacgtcgcaactgagttttcattcttcatggcaattccaacaatgtttggggcgtcattattgaagcttgtgaaattctttgctcacggtggttctttagctggtttgcaaggagcagtcttagccgttggggtgatcgtgtccttcgtagtcgcttacttgtcgattcgtttcttgttggattacatcaagaaaaacgacttcaaggcgttcggttggtaccgaattgtcctgggggtacttgtgattggctactttacgttgattcattaaatactagaagcgtaacttttggctaagcttgttgccgcaaatatcatgaataaataaagtcagcgactataaattagttgctgactttttagattatatcattctagtaatggatggaccgtcataacgattggataagtgataaaccaatcgttatgacggcttttttgaagtaatcgtgttaccgatgaactaatttatagttggttacgccgtacctttgattgaatgtgattctgacaatttgtccgcgtttgaatggggctggatcagcagcaactgtattaaaatgaagatactttttttcgcccttagaattagttgctagtccttggtattgatacccagtagctgggatattgaccggtagtgtaatgggggaagttccggtactactcgatattttcatgtagtagtaatgaccgccatatcgaaaaataaaccaaccaacatttatcagaattgagattattaataataaggtgagcagccattcgatgagatgattagacttagtattcattgtaatattctcctcgtatactactttttaaggcttcgcaatcacattgaaattgcagctgtagaatcgtaattaggcagtattttaattgaatttacagttttgaaaaatattaatgaaggtcataattttatgccaatcttaccaagggtatttttctttttctctaagcttattttgtcagtatctaaataataaattgagcttttctccctccaagttagaaaatctcgggttaaatacaattattattgtaaatgttgcaggcttataagcccacaatttgaactatattagacctattaacttacttttattgtaagtacttagtaaaaggcgttatctattttttgctaatcatttaagaagtctaacagctgaaaatcaagataacgtggtgtcattttgctaaccgacaaagatgcactagctgatttttctgattaaacaaagtgtaaagtaatgtgattgataaattcagcgacgagaaagccaattgcaatcacgccagcaataatgacaacttgtacaaagtactggtaggccaagtctggttgaccagtgaccaagttacgaacgactcgataagactggccaccaggaaccagtgggaccagactagggatattaaagatgatcatcggcattcgtttgtagcgtgcggccataccgctagcgacgccaatcacgatagctgcgacgagattaccaatcgcaagtttggcgtcgattcctaatggcaggatgtgatagaggacctcatacgtaaaccagccagcagcaccgacccaaccactgaggttaacggcgcgacgcggaatattgagaagtaccccaaaaccagccgtagctaagtaagctaagataatttgaaataaaccggttgttaagagccaatgtagcatgtcacgcctcctttagtagaaaaatgaagtcagtgcgataccaacaccaatcgcacacgcggataaaacggcctctacagcgcgggcaggaccactcagcaagttacccgtcattgtgtcacggacggcattagtaatggcgacacccggcactaatggcattacagcgccaataatgatggcgtcgggatgataatgaccgttagtgagataaaagccgagtagggtaattagaccaataataaaagcgcccataaattcgctgagaaaccgaattgaccccagccgattgatccaataaaaggcagcaaaaccagccaacccggctagcccacaagtgatcaagtcggcaggagttgtccgcccagtaaaggcgaccatcaacggcacactaacgacaacggccgctagacataaccagctgaatgggaaggtcggtacggcttgattgacccgttcgagggctgcggcaaattcagttaaatcaatatcgtgattagcaaactgccgtgacaggctgttgacctgatccactttttcgaggtccataccccgattatggattgctcgcacttcgctagtggcattttccggcaaggagacggtaatccctgttaacagtacgaagacctgcgcgtcagggtagcccgcgttggttgcaattcgttgcatcgtgtcttcaactcgtttgatttcagccccattttctagcaaaatggcgccggccaataacgtggtttttaacataactgccgtatcgctcatcaaaacccctcccacatcagaatgtttatattttctcacgaattttgcgtatcgtcattagtttggaacagaatgtttgccggaagtggtcggttatgggtagaattatcttaacaaataaattcttggaggcatttttgatgactgcattgactaaactcaccgatacgtacacgttaaataacggcactaagattccgattgttggttttggaacgtggcaaacacctgatggtcaggttgcttacgattccgtattagccgcattaaaggcgggttaccggcacattgacacggcggcggcctatggtaacgaggaaagtgtcggtaaagctattgccgatagtggtgtggcacgtgaagacctattcgtcacgaccaaattatggaatgccgaccatggctatgacgctgccaagaaggcgctggatacctcgttggctaagttaggtttggactatgttgacctctacttgatccactggccaaacccagccgcaatgcgcgacaattgggaacaattgaacgccgatacttggcgggcaatggaagaagcttacacggcacgtaaagcacgggctatcggggtttctaacttccggcctaagcatttagacgcgctgcttaagacagccaaggttgtgccagccgttaaccaaatcttcctcaatcctagtgatatggaagatgaagttgtggcctacaaccgcaaacatgacattttatcagaagcttatagtccattaggtactggtaagatcttcagtatcccagaattaaagacgttggctgataagtatgataagagcgttgcccaagttgtgctacgttggtcattacaacacggtttcttaccattaccaaaatcagttcatgcggatcggattaaacaaaatacggaattatttgatttcgaactcagcgatgatgatatgaaggtcattgatggtttccacggtgttgccgggttagctaatgatcctgatcaagttaatttctaagtttcatcgttattaaggatgcagccactggcagcatcctttttatttggctaatcacctaattgtcggagtcagctagttaaattagaaaattcgttgttatcgtaaaaagtgtggcgcggccgcttaataatatgaggtaggccccctaattagactaatgaaacgtcataagatgtccgattgttgactagcaacctgactatcacagcgattggactatggtacactcagttttaattattaagtctgggggcctgtgaatgttactgatattagcaattttaccaattgttgtgacggtgggattaggcgtgtttgcggggctacggcaccaatttgcgccaacgaccagtgatattttgattcagttggtcatgcattacgccttgccgttaagtcttttcggaggaatcttgtcattaaagcgcgctaccattattcaaaactcctcggtcgcgctgtggttggcgctaggcatgctaggtggcatggtcatcgtcattgtgagccaatgctgtttccatcagcaactagaaacggggacgttacgagcgctagtgatcgccagtccttcaattccattcatgggtgtttccgtcttactggtggtttttggtaaaatcagtgttttattggtcgcgttaggcggcctgtacatgaatttggtacaagtgccagtgagcgtgttgctgttaacgctagcgggcggttcgacacctgagcaacgttggcgagccggttggcagaaactgtgtcgtgcgagtcggcaaccagtcgtgtgggcgccaatcagtgcttttctcttgaatttggccggattgcggttgcccagtgcttggctaacgaattttacggagttgggacaagcagctgggggcgtggcgttatttgcgctggggcttctgttaacgaccagaccgtggcgactgacgcgcatggttgtcttaaacgtgctactgaaaaatttaggcttaccggtgctcatttgggggattatggctagtctaggtgtgtcattaggtaaccaacaattagttgtcttgacactcgcaatccccactgcaaccatcgcgaccatgttggccgtccaaaaccacttggcaccagatgagtatgtggcgacgcaaatgttaagtacggtcattgcgccgctgaccatgggattcttaatgtggggattgcagctcgtatgacgggcaccttttgattaccatgctgggtttgtgaggtgctcacaaaggagggcacgacttgcggtcagtgctgttatgattcccgattgacaaaggttaattggcacggtttaacgacgatgctaaaccaaacgttgtgaacgtcagtatagacaaacccgctcaaatagggcatatttgagcgggtttgtcgcgttagtcttaatagtgaacttgaaaattagtcggttgcgttgcgttgacgacgggatgttgcgcaaagtagtcggcaattaatacggtcatatcagtaggtaagcgccggataatcttagccgtttgatacattgggtaattcccaccgccaccagcgcggtaatgattcagagtgaccgttaatttttggtcagcggtgactggggccccatgataatcgagttggacgacacgttgaccaaagggtttggtaaggtcgaaagtatagtcgatgccactgtaaatatcatagacatagtggcgcaacttagggtgcatgaactcgggattgacccgaacgtgtccgtcttggaggaaaaagtaactcgcacaacgttcaagagcggcgcgtaaatcagcaccagtaatggcttcaacggcaagtttgtttgggtagacgtaactgttcatgacttcccgcatcgtcacgtgttgtttgaggcctggtacgtcgtcattaaataatgctgttgcggcaatatcggtaccggttgcggccatttcaacgcgattaataaaatcgatgtaaggatgattatgcagccgtgcttgaagatgatcgtgtacgagcatattgccgttaatttggccaagtggtgtgtctaaccagtcttccatctggtcattgattggtccaactagttgcattacctgggtattgggggtggcatctgcgaccggatagatttccggatgactggtcgtcacttgatgattgcggtcgagctcaagggtaatcatagcaacattagtacctttcataccaggttgtgtcacgggaacaccgtgaaccgtaacggctaattgtcgatgctggtggccagtaatcatggcatcaatgccgggtacttcagctaatagtgcggatcctcggttttcaccattcatgcgttcggttggacgatcagtttggggatcgcgttcaagaccaccgtggtaggcgatgacaacgacgtcagccagttggcgcaatttgggcacccaatgtttagcagttgcaaccacctcctcaaagtgcaggccggcaatgtgatgtggttgttcccagtgggcaacgaattgtgtcgttagtcccaaaattgccactttaactccggcgcgttccagaattgtgtatggtttggagaataaggtgcggtgcaggtcatcatgaatattggcggccagcatcggatattggcggcttgattcacacaggtcgaggtagtcgagcccgtagttgaattcatggttaccaaaaataccggcttgaacgtggttgcaatttgcaaggcgcgagtataacggtgcagcttcttggtggtggcgagcaatgaaataggtcaacggtgatccctgtacgtagtcgccattatcaatcacgattggccagacatcagccgtatcttcacgtgacagttgatgaataacagtagcggcacgactaagactaaatggtgcgatgttatcacgacgactgtagtcagttggcgcgaggtaaccgtgcacatcactagttgagattaatttgattttcataacgtgcctccaaggaatatttgtgttctattataacaatattcatggctggtaacttgattttagtcataaattgaacagttttttgatgatgacctgtggttaatgtttaatggctgctttaattgtacgttctaatcttcacgactttttcacaatttgtacgtaaaacgacaaaatgtttccgctatcattaatagtgacgaatgacaacgataatcgaattacggaggaataaacgatgcagaattatcagaatgcaccattcaaacctacccccgagtccggtttaacgaccacagcggtgacgacccagctaactaaattcggcaaaaatgaattagtggctgcgcgccccgtaccgttatggcgtaaaatttggcaacatatgagcgacgtttcatcgctagtattattatttgcagttggtttagccacgtacttggctcttgcccagaatgggggctggacaaagaccattgtgattggcgccattttagttattaatgtctgtattggtttgtaccaagaagcttccgcagaaaagtcgttggcggcactgaagtcaatgagtttacccacagctaatgttcgacgggatgggaaggtacaaacgattgcggcaccagaaatcgttcccggtgatttagtgctactaaaagcgggtgaccaggttccagccgatgcggtcgtgttagaggccacgaacttagccgttgatgaggcagtcttgacaggtgaaagtgaagctgttgaaaaaagtatttatcaggacaccggtgagttggatgataactgtcaagtgtatgcgggaacggccgtcacagccggtactgcattgattcaggtcttaacgaccggaatggccacagagttaggtcaaattgcaggtttgttgaacaagacgaagcaacgggccacgccattacaggggcggcttaatcggctatcaagctggttaacgacatttgccgtcttaggtggtattacgatttttgcgctgagtgtttgggtgcaaaaccaaggtttggccgatagcttgatgattggggtttcattagcggtcgcggccgtgccagagactctgccgatcatcgtgaccattagtctttcacacggtgttcgacggatggcagacagaaatgccatcatgcgccgagttagtgccgttgaaacgattgggagtgtcgatgtaatcgcgtctgacaagaccggaaccttgacgcaaaatcgaatgacaattacaaagtattggacgccgaccacgggcattatgacgaccgaacagcccttgccatcagcgggacaaacattgatgcgttacttaggattagcgacgaatgccgagatcaaccacgttgacggtgaagaacaagctattggggacgcaacggaattagccgttattcgttggctggctcagtatgatttagatcggcccagcttggaggcgcagaccccacgaattgcggaagacccgtttgactcaactaagaagatgatgacgacggtgcatgaattagcgcatggtcgacggttagttatcgtcaaaggggcttgggatcggttaccactgaagcctgaccaagctagcctagctgctggacaagtggcccatgatgaatttgggcaggcggcgcttcgcgttttagctgttggctatcgcatcattcccgcggatgtccaaactactgactgggacgacctgacagctgacctccaattggcaggattgattggtttgattgatccaccacgaccagaagtgattccggccattcgagcagccaaacaggcgggtatttttccagttatgatcacgggagatcatttggttactgcgaaggctatcgctgaggaaattggcattttaacccctgagctgcaagcaattagcggtgatgagttacgccaattgagcgatgaagaattgacggctcaaatcgatcagattgcagtgtacgcccgagtgtcgccgagtgacaaaattagaatcgttcaggcttggcaaagtcttggtaagacggttgcgatgaccggtgatggtgtcaacgatgcgccggcattgaaagcggcggatgttggcattgcaatgggaattacgggtaccgaagtatctaaagaagccgctgacatggtgttaacggatgataattttgcgacgatcatggcagcagttaaggaaggtcggacagtttatcagaatatcattaaagccgttgaattcttggtaggtgtcaactttgcacaaatcttcttgatggttggtgcagtcctcttcggttggggggcgccactgttagcagaacaattgctgattattaacgtacttgctgatgggattccaggattctttattagccaagagccaggtgaaccccaagccatgcaacaaccaccagtagccaatgacgaaagtattttagctcggggccttggtcaacggttgtttatccgggcagctacttttaccgtactaaccctcggaatttacgcgtttggccgctttggcttaacaaatggtcaagccccagtcgggatgacgatggtctttctagtattggcattaggatcaatgatcgacatctatgcaattaaggatcgccgaccactcagctggtcaagcatgacgcgtaatccaatgctgaaccgaggattgctgttaggaattctggtggtcttggcaattgcagtgataccaccgttccgtagtttctttagcttagtgacactaccagcgttaggatggttaacggtgctagtagctacgctgattccaacattcgtgctggaattgaataagcgctggcaggcgcggcgacagtcacgattagtcgtgaatactgctgaataaggatgatcaattcaagttagttaaaatgctgcttacaaacgttattcgtttgcaagcagcattttttcgtgtcattaagttgtgtgcctaaaatactggccggtgagcgggcttagaacgtaagtcatcacaattgtaggcagataattctttcagaccatctttactagcatcgaaataggccgttaatccttgggcaatcattaagttgagttctttattcgcatcaaactgaacgacgatgacgggtgtcttttcagccacggccgcaccgatttcaaacattgtgcccgaatctggctcattggttgcactagtcatgtcgaagtcaagaatggcaacaacgacatcggcccgatgaacttgacgcatatcggatgcgtagacgtattgttgccaagcacggctaccaaaaggttcttcttcaaattgatgttcttctgggatgaagataccatcggggttgatcgtcgggttagccaacagcgccgacttcacttgttggatgcgttccttctgagcctcgtcaaaaaacggtgcagctaggtaaacgttattcataatgatttcctttctggataacaaaatttggataagcctattttagcggaaatatggggtggctttcaagccttgatttggcgtgaatcattattaaaagatccttattttgaaagttcaaaaatagccagcttaggcccgctggaaaaagttcgaatcagcgtaaacttgtttagttggttggtcctacaccgacttccaggcatttctgccaattgccggaacgtggtgggcacagacttgagccgaaaaatcacgtctcaaatactggcctttcaataaccaagcacaggacacttgctaagtgaaatttcaccactgggcattgtcagaaacgccttccagtcgggagagtattcgaatggcagacgaagctgtacttaacttttgatgaatttgccgttgctttttgtaaacagtaattttgttaatcaactgtcaaactgaaaatgatattgaggtagctcattaatcctgaatcggcatagtaagattcaaacttctgacagagtgcctagtgcaccctaaccctttgtctttgtttaatatcaaaatagtcaacgataaattgtgctaagttaagtggccgttcatcagccattcgagcggcttaccgaaaggtgttcggtgccactaaagcctgtgcttgctacgccaatggactaatgccaaaaccgcattaatccgttggcaggcaatgctcggcttcaacccgtggcccctcgcaagcttgagactggaggggctgggtgacaatactcagtagccaaattattcttagtcggaagtggtctgcttccggcttagaataagactcgtatttgagaccgggcgggttttgcacgggctcaaatcgacgtcggcttacgttccagcaattgtcacccagccccggaggtcggaataggacgatcattgctgacgaacagcaatccaaaaataagcaccttttaataatttttgaggcgaataataattagcagagtggatatatagattataattctatttataacaaggtgatgattagatattgttgaattaaaatctaaattgggctaaattaaatagggtagtgaggaggattggatgatggaggaatttggatcaactagtaactatttactttcgtgggaagagttgcccgcggtgcccgtttatatggaacagttgttgcaacttgttaatgaaacaattcagccgctggggttacctgccgtaacgaagacgatgattaatagttacgtgaaacaacattttttcagtcggccggttggacatcggtatacccggaatcagattgtggcggtactagtcgtttcaattttgaagactgatttttcattaccagtaattagtaaagcgattttgcaaattcgtgattcgcgtcagattgagccgcggtaccagcaatttcggcaagcattcgagtctacgcttgctggacaaccggtcgtcttgtcgacggttgacccgttagcacgggcaattcaattagcagctcaaacggtggcggcacatttattaacgatccgagcgcttaacgaattggtagattgagttgagataggcacataattgagaatagcgtttgataatatcgctatggctgcttgtagcgtattcgaattaaagcgaattaggcttagcagatatgattaggtatgaaagagagaaagagaatatgacaacacgcaaaaaatggacaattgcgctcattgcattcttgaccgtgatcgtcattggggtcgcgggcggtagtttttatttatatcactttgcatttgaacccaccccgaaagttttgaaccatagttctagtaagagtaaaagtaagttgaagcagaaccaagcgtggctgaaacgggtcaacaagcagacctggcatgagacgtccgcaacggatcatttgaagttagttgcggactatgtaccagctgcgcaccgaaccaccaaaacgattattgtggcgcatggttacatgggtaacaaggagcagatggcgagctatattcgattgtggcatcgccaaggatataatgtgctggcgccggatgatcgtggcaatggtcagagtcagggggattactatggttttggttggcctgaccggttggactatctaaagtggacgcgacaggtgattcgccgcgtaggccaaaatagtcagattggactctttggcgtttcaatgggtggtgcgactgtcatgatgatgagtggcgagaaacttccatcacaagttaaagcgattattgaagattgtggctataccagtgttggtgatgaattgggatatgagctgaatcaactatatcacttaccgaagtttccactgctgtatacggcaagctgggtagctcaagcgaaggcccacttcaactttatgacggcgagttcagtaaaccagctcaagaagaataagttgccaatcttctttattcatggtgctaaggatacttttgtccccacgaagatggtatatcagaactaccgcgctacgacggtcaagtcaaagcaattatgggtggctccaggagctggtcacgcggaatcatacacgcgttatccgcaactatatcaacaaaaagtaagccagttcatggcaaaatatttgaagtaagagctaacggaatagaataactaataaaggtcaccaagcagcgattgctgattggtgacctttattatggttaaaatatgctagtcggattagtgtttgtcagccggtccgcgtcctggtccgatctccgggactaagctgatagcttttgaacttgataaatagcgcggttaatcaaccgagtgttttgcaaatgggtgccgcatacttggtataaagatcagtacgccgatgaagttaagcagtaatgacaaggcggtgaagataaagacaccgttgtaatcgaaccagccggagacggcgccaccaagtaaggagccgagcatgctgccagctgcttggaaagattgattccaactgaaaatagtgcctgttaactcgcggggtgtatttttggataataatgtttgcaccgttggaaagagggccccgtcagagatcccaatcatgaagcgcaatagccctaatgtccacacactggagacgaagccttgtggaaagtacatcaggatggcaaagacgaaaccaaagacaaggatacggtcagcccccccggtgatcaccgagccgtccgagtcgcggcgccgataatagcgtcgaaattccgggtagagcggcaatgattccagcaacgacggtgattgggccgacgttatgcatcagttctttgacatatagactaataatgggcgtgatggaattattccccatttgaataatcatcgtggagacgagcagtgtgataatcaacgttggatttttaaattggctgagtagactgccgtcacgtttagcaatcggcgcgtcgctgggtttaaagctttcgtggacgagtgtcagactcaatacgaagacgatcagtagcaaaattccggtgataatgaaagtcaaacgaatagagaaaacttgggcgagtacgccaccgagaatcgggccgatcaagttaccagacacgtagccagttgttaggataccgattgcggtcccactactttccttgggagtttcggtggcgattagggcgctagcattgggaatgtagccggcacacaggccttgtaagaaccgaagtagaatgagtatccaaatgttatggacaaatcccatcgcaccgataacaaaggccatcccaagcgaagaacgcagcagcatgattttgcgaccacgccggtcagcgagtttaccccataatggtgagacaacagcgacgacaaaaaaagtcactgcgtatgtaataccactatacatcgtgagttcgtttttggagaaatcccccatttgaccaacgtataatgataagaatggcatgacttcagaaaatcccattccggcgataaatgttcctagccagagaacagcgagattccggcgccagcctgtcaatgcgcccttcacaatctgtcacttccttaattaacttattaagattattttaatgcgaatttaagttttgtgcaattaactaacttagttaaataggattgaatggcgactgacaatgaaccacaatgagacttaaaatagcccgtatagcagccttttattaatttttgagtgtaataagacacaatagggcacaaataaaatgcaccacaagtgcaccaaaaatgcaccacaaaattagattctcataattcactcatataacgagctagtttagaagcagtctcgttcttttgttttttggtgacgtgtaaataaatttgttcagtgattttaaggtcagcatgtcctaacgtcttagacacttcgttaattcccgcatgagcttcaaaagctagtgtgcagaatgtatgtctgaacgcatgaatctttatatggcgcaaaccgtattttttacagatactccaattaaaatagttaactgtactaggtgacatcagtttgttttgttggttagtaaataccagttgactaggatcattagcgttgaatccaagttcaaaacattgtctggcttgggtcatcttccacttgtgcaaccattgtgcagtgtctgggtcaagtacgatagtgcgataactggtattggtttttggtgtctgtatgatcgtacgccaacgtttacctactgcttgggttttattaaccgttagttcgttagtttcaaagttaatatcgctccattgcaatgctaatgcttcgcctcgccgtaagcccgtaaaggccagcagacgaaagaacataaatgcttgggggttctcgtgttttgacgcacaatcaagaaaatgcagtagctccgatttttcgtagaaatcaacgtgtggcgcttgtggctttattttttgtttaggaatactagttttagccattgggttacgggtggttaattccatccgtacaccaaaatcaaaaacactaatagcgtacgtcctaaaccgacggtacgttttgaatccctgattaagccacttatgcacgattgattgacattgggcgacagtgatacgtttaacccgttgagagcctaattcgggcaaaatatgcaacctaaagatgtcgtctgttatcatgtacgttgattctttgacttgttccttgtaatcctcgttgaaccatttagtatagagttcggcaaaggtgatattatcgtttgctatgaaaccattcttagtaaaatctgtctgaacattggaagtccataattgggcttctttttttgtcttaaaaccacgcttgtgcatccgtttggctttgccgttggtatctttacccacggatgtaaaagcctcccagaaagcaccggatttagttttatactgcttgaatgtagccatattgattattcctttcataccggctggcgggcaagtatgtaaggagaaaatacaatctattttataaaattaagtcttttgacatttaatcttttggaatagtctccccatggaagtcgtacaagtacggacacttcatttttgtttaagctcaatagataatcagttaccgatttacgctttttatgattcttaaaatcagcatctcttgtttcgtaggtgtattcccgcaatgcatcagaaattttgtttaatatcatattcgttacttcgtttttaaaaactacaggtaactcattaaaaatatttatgatttctttatcattagaattttcctcttctatatcaacgtataaatcaaaagtatccaatggtgccaattcatcaaaccagagactatcaataataaatacaggctttagttgatacatttgttctgttctaccttttaatacatcaaatagaatcatcttttcattagcatacgattctgcaaaacccaatcgaaatttataaggactaaaagaaaagaaatcagacggagtgacttcgagatagcggcataaagtatcaatagtttctgttgagatatttgaattaatattattagtgatattcgagatagtattgcgtgagatttttgtttcgtccacgacttgcttaattgtaagttgtctttcagcaagtaaaacgctaagcctatttgctaacataaaaactcctccttgataaatctgcattaattatatcatttatcaattacattgtgtatttaaacattgaaataatccaagaaccgtgttagtctatatttgcacttgggaatttaaaagtacaaatacacattacgaggtgtaaatatgaataatttatctataatcttaggagaacgacttctaactattggttatgtttcaaaaaaaacgggtttgagtcgtggaacaatctctactatttatcatcgcagagctgattcagttcggttggatacgttaaaaaaaatttgtgactgtttacagattccattaagtgagctaattgagtacacaccaaaggggggcgactaatgaacaatatagtcacactgacatcacagcgattggacgcggaagcatatacgactggcgatgtgattgcggagtatgcgggaattacccaccatgctgttaatgtaacgatcaatcagcagtatgagcggttggcgcgtgcaggtaatggcaaggtgtcatttaaaatgaagcctatgctaagtggtcaaaaagctaaggtctatttactcaacgagcaacaggctaccttgctgatcacgttcttaaagaacacaccacgggtagctgatttcaaggaggaacttgttagacagtttacagttatgaaacgtgaattgattttgcgtcaggctaagtttgaactaggtaaggatttttctaagtcattgcatgaaacgattaaagaaagtccggcgctgggtgagcatggtcacttatacgtgaatattaacaagttagtgtataagcaggcgttaggggtcaacgtgaatgagttacgcaaagctcgcgatattcctaagaccgaggctattactcactatttaagttctagtgaggcggatgcagtcaagcggattaaacagcaaattagaacgctgcttgaaatgaaactggactaccagcaaatcaagcaagctttgcagattcaaggcgtgatttaccgtattgagttgcaattgccagctaaagcatccgtcaaatagatgaaattagtgccgctgacaatggaatcttattgataaggattgaaaggcgcttcggttaacttgcccgataatcggatgaattagctgggaatgcgattcacaccttttatgcgggtgctacaagtcattgataggtggtgaggacgattacagaaccgattaaggtgttattaagtgatgaacaggcgcaggcactacgcgacttcgtataccagctgactacggattcaatcagtcaggccaagcgtgatgtgggtgctagtcagcagtggttacgcaagaagaaagcggcggcgtatgcggatgtatcagagggaacgtttgcaggctggacgaagcaaggattagtaggtcacgtcattaatggatcagtgctatttaataagcacgacatagacttctatatcaatcacaatggaaaaatgaagtaataaaatccggctggcgggcaattgcggttgatgaacacataataaattggattggagtggtaactatgattggaacactattgatgagtttagttaagtttatgattatttcagcggttggcaacgtgtcatttaaattgattgctaatccgggtaagtatttcggttaggtagattaaggagctagaacatgaatgagcgtacaaaaaaagtccgtgtctttactttggcgagtaacacggacagcctgaaaacactactgttatgggctttttgtatactcattttactacaaaatgaggagtaaacacaatgggtaagccaatttatgaactatcaaagttaaatgatattacagatacatgcaagcgggcaaacattaccatagaacgggctaaccgtgatattagtagcatcctagcgattagtgatttaatcgtacctaccctaaaaaatatcgttgaacatgcttcaagttattttgaactagacgccgataagctacgagaagtaattaatagtcgtgaaacaactatttacagcgtgatgtgcgtactaactgaaatgggtacactagcaatgaatattgatgaggagacagctagtttaaatggggttattgatgacattaatagcactgtaaacgggattaatgacggtattaactccgttttgaatggtggtaactcggattacaacgatgataactcacagggggcgactgatcatgaataacgtgcaaacccggctaaaccatgctaggacgaccttacaaggaactttattgcaactggactacttacaagagctagtcaatcaaacggtaatgcgtgatagtcaacgggctaaaattagtcagcaaatccataacattgaagtgaacaaccaaggcgcattgaaacaacttgcatccgtctatgaagtcccgttagtcgggatagcaaaatagggtggtgagcgaatgaaagcaaacgacagactaacgagagcgctgcagcttgctcgtgatggcgttgcggtttatcccttagcaagtaacagcaaagtgccgttaaaaggcacacagggctataaggacgctaccacggatgtagaaacgattaaaggttggtttgagcatgtcccaagggcgaaccttggcatccgtttagaccaagctaagttaatcgtggtggatattgaccgacatggtgatattgatggcacggaaacattgagaaaacttaatcagcaaggcaaacccttaccgagtgacacttatattgagcagaccccgaatgatggcttacattacttctttaagttgccggttaagctagatatgaaacggcgaacgggtctatatccgggtattgatgtgctggctgacttcgtattagtagcaccgagcgtgattaatggtagtgcttatagggcgattgaaccaactaacgatattgctacggtgccccagtggttacttgatgatctgttacccaatcaacggatgaacaaggcaccgcagcacgcctcacagattcaaaagacatgggcgggacggatgcttgatgacttagtggctggtactggcgagggtagtcgtaacagctacctgacttcgttattaggcaagttactacgaactggctgtaatgggatgacggcctatgagctactgcaatatgctaacgagcgattgcaaccgccactaccggataaagaggttaataccatttttaaatctattattaaacggacgtaggaggtgtcaatgtgtcagaggataagaacttaaagcaagccatccaagagcatgacaagcggattaataacgtcacagctttaaagggtgatgattggcaagaccaactccgattaacgacccaaggggctattcggcggagttcgctatacaatattttactgtttattgaaaatgacccgaatttaaaaggtgtgttggcctataacgagttctcggatcgagtggtgaaattacgttctaatgataaaacgggactaaaaaaaggcgattggcgagatacggatgattccttactacggttttattttgacgcacaatataacattttgctgtcaaaggataacttgctggatagcattgttaaagcgtcacaggaacatggctttgacccgatgaaagaacggattgaaacggtgaagtgggacggccatccaagggcggaaacctttttcattgattaccttggtgccgaggataatcactatacacggatggtaactcgcaagtggttagctggggcgattgcacgggtttatcttcccggagtgaaatttgatattatcccaatcttagagggtgttcaaggacttggaaagagtaccttggtgcgccagttagcgcccgattactttagtgatgatatgaagagcatgaaagataaagacgactatcaaaagctaatggggagctggattattgaacttgctgaactgtcggccatgaataagactgatattgagagcattaagaactttactagcgcccagtcggactattaccgcaacacttatgcacgccggccagaacaacatccgcgccggaatgtctttatcggttcaactaaccatcgcgactatttaaaagacgctactggtgagcggcgcttttatccgattaaatgtgggatacagcccgttactaagaacccactaaaggcgaagcaagctgatatgttacaaatccttgccgaagctaagacatggtttgacgctggcgaaaagctttattttgaccaacagacacttaatgaggccaaagcctaccaacaagaagcccaagtcattgatcccatgagagacgctgttaacgattatttaaaaatgctagtgccgactaattgggacaagttatctgtaagtgtaaagcatacctactatcgtgacttagttaatagtatgcggttatctaacgaaattgaaagtcaattaagtaaggaacgtgagccactacagcaaacctcagtacgagagatattgtcagttgtctttaatcaacaagtagatgattatttggccgtgcgaactaatagcaattctaaacgcgttaagttgttgttggataatttagaagggtgggaatatggacgcttgcgattaaatggaaagcaggttcgtggctatcatcgaatcctttaacacaaactttttgtggaatttactgtcacactgtcacaaagtcttttaaacgttgatatagaagcctttttaaacaaaatttactgtcacattactgtcacaagctgtcacacactgtcacagtctaagctaaaggtgtgacagtaaatgacagtgatgtgacagcgttgtgacagtagaaacgttgctatggcggtgcttatagcgattgtgacagtgtgacagtaaatttgaactaaactttaaagaattgcatttaagatgaaacagaaaaggtaggtgccattaaaatgacgttatcaatgactgaatttaaagtattaaacatgttgcctcgtggtgctggttacccaatgacaacaccgaatatctgcaaggtaaccgggcttaaagaacgggatgtcagagaagccattagtatcttaattaatcaacacggcgtgccaattgtcgctaaccggagtggtcgcaatactggaatgtttattgctacggatgaagccgagttaaatatcggggtcacttcatttaagaaccaagttactacaatgaatgcgcgtattagagccatagagcaagccgacttgaatggctgggaacaagccctaagaccagagataaaacgcctagacgcaaaagtaagccacaataaggaggcgaactagtatgcgagtgctttaccctaagttagttgaagaagcctataattacattgctaaggctgaaccagccgttaagaatgcgcctaacgctgttaagtcagagatatacagtaagatggttaatgacgggataattgatgagaatggcgagccaacacagacagctattgatcggggcttcgttgatggtgatagcgagctagattatgaacctgatacgctggccgagtttaaagcaatgcacccatgctataaggagtatgatgatagccatttcagccatacgaagcaaggctgggtgattgacagctatgtgatgaagtcgttatcacttaaagcactgcatgatccggacagtagcgaagaacaacgcgcattcgcccgtcatgcgctacaagagattgaacggtttagttaataagcataaacgagtatcgtgctaaaaagtacgatgctttttttagttgagcgaagttgtcccgttagttatttatatgaaaatggattgttatatcaatggttaaaaggctttgatggcaatataaaatattggaaaataatggaatcaaaatgttagaaaatgttagaaatcaaaaacgggataatgctaacaattgctaacctaaaagccgaataggggtttacagaagtttacaaaatgagcagtattgtgcagatcgaactaccttataaaatcttatgtggaactacctattaaaacctattattgctttgctatgtaaactgcttgtttctgctaatgcgtggaatgctcgttggattgattgtaggtcgaaaatttcgacttaccctgtacatagttggttacagagttaaaaaaagtgatcgctataattgatgcacgtctacaacctgacaaaacatgacattgttttgcaatttaatcgtattcaacatgtcatgatctggttgctacttaacaaaacttaacattggaaatatagtgacgcttgaaaacctgcaaaaacctgcatattaacatagctatcctgacagttctgacagttctgacaccctaaaaaagaggcgggcaaataattatctaatgaatatagtcagtggcattacaaaacaactcatagggtgcactccataacaccgatatttcgacaatatggtgcaaccctatgctggtaaatgctagtattattcgtacaaaacggacaccatataataagcgacaagtaacccgacacagttagatggtatatttggccggagtgctgttatatcaacgcttgacggctaatgagaactcgtaaaatgtcggattatgtcggattttttacttgaaaatactggaaattgaacatcgctagttagttaatagcttgaatgcttgttatgactggccttagagctgttttaaataaatgaaaatgttggaaaatgtaggaatgtaaaaacggatgagtatgtcagctggcttagatggcgttgggttactggttgggttactggttgggttactggttgggctactggttgggttatttgtgtgcatataatgcagacagctgttcggacagtcagacgtgctataattaactttgtgggaattagtcgtagttgtagtcagcgatgacagcacacgcaaagagagacgttcgcaaggggtggctgaacgtctctctttattgtgttgaggagtgatcgataatggagcagtggtatcgggacgcacggagttacttaaaacagtaccgcttttaccacagtgttgttagccaaccatttgaggactggctgggtatcggtaaacctaagaggctgcaacaaatggagttgtattgtcagcgggttactaatgcaattgatagcatccgtgatgaacgtcaagccaatctattgcgtaatgagttcgtagtggcggatggtagccaacgggtggcctatgaactatcgggactaagtaagtcgcaatattatgtcatccgcaagcaagctatgcgtgaatggttgcagttaatcaatcaacacaaataagttagagaaaactggagctttagcgtgttttggattaatcgtaaacactgatatagcaatgccattgaaccctgttatcatagccatagcattgttattttattaacaaccgtacagagagtacgcctgttgtaccgatcctaaaatgttaggaaatgttagggtgcaagtgtaaccggagttacggttgtaaataacggcgcaacaaaaaagccatcctagaattaatcaaggacgactgatgttatagaatgattaacaggtcaggcttacgccaagtaatatgccaaccttagcaaaagtctatcaaaaaatttaatcacaagctaaagaaacgcgatagctacctagcaattaaaacgtcaccatttggcaaggtatactgtccgcctatttcaccaagttcaatggttgtgccgttgagctgagtaaacggtgaatttagtataataatctgcggatgaagtggattaagaaaatcaaactcaaattgtgctttgccagttattacctcgccagtgctaagtgtatgcttaaatagtaaaacgccagcgtcttcgtaagacggaaatttaacatgaatacttttagtggtcaaaggctatcactcctaacaaatttgtcttttcaattctattgtgccagttgtaggccaattgtttgatctggttaacaataaatttaccaatacttaaatttataaaacatcagccgcacttattatatgtattgcccgccagcatgattaatcggtaaatttatgtgttttgaagataaaatgcaccaaaaagtgcaccacaagctatttttattgttgaaaacggcctattatcgttgatatataagcattcttaaaaaatcactgttcaaactaaatagacttgaccaagcgtcactaaaaaaactacaatggaaaacattgtagaaagggtgaacgatgtgcagcaagagtcaaagtatcaaatagaagtggtggcgcctaagcaccgacacatgtctaattgggacatgtttgcaacttggattggcgccaatgccaataatggcacgtggtacgttggtggtgtattggctgcgtgtggtttattgacggcgcttaaagtgattgtagcatcgtccacgctatcgtatttatgtttatcgttagtcggcttcatggggtataagaccggggcggcgacgatgagcttgattcgtggttcctttggtgtgcggggcagttacgttccgtcctttgtgaacttgacccagtatattggctggacagcggtaaacacgttcattgcagcaacttctgtcagctatttattacacgatctagttggctggccagtctatggtaaacccggtggggctaaaggactgatcctcggaattattgtcatgagtgtgttgcatttattgagtgtttcggtcggtcaacggtcggttcagatgattgaacgtttaggtattattcttgtcatcttatttgttttatgggagacggtcgtcgtgttccagacggtctcagtgcatgatttgttaacgtggcaggcgccgacacatttacatatgacggcgggggctgggatggatacgctagcggcgttcaatttgtcttgggtgacagcgggtgctgattttacgcggtttacgcgcaaaaagagtggcgcgactggcatgccatttttaggggcctttaccggcttgttctggttcgcctttatcgggcttgccgcgacgatcagtatcgcgattacttctggaacttatgatcctaataactctgacccgagtaccattgcgagtcgactaggcttgggggtattagcactactggtgattgtcttaacgagtatgacggcgaacgcggtaaacttattggcggctggttcggcgctgtcgaatatcttcccacggattcggttacgaccagcactgtgggccgtgacaatcattgccacgttagtcacactgattccattaatcatggggagttttttagctgcattcacggcgttcctagattatattgggatggtgcttggaccgatgatcagcgtgatgttagtcgattactattggcggcatcgtcagcactatgatatcaacgaactggcgagctctaaggggcagtattggtatcatcatggggtgaattggattgcgctattatgttgggtactaggtgtggccatcttcttgttattgaagcacattgcttggattgcgacggtgactggtgcaaccttcattgacatggcgcttatcggggtcatttacgtggctttaatgcgaattttctacccgttacctgccaaacgtgtctaattggattacaatagataagtaaacgaaattagaacgaggggtgtcatgatgtttaaattaactgagatcgatgacgtattaaataatttaggtgaccacgcagactttgccacgattgccaaaaaagaagccgatttgggcgttcaacattttcaatatgatgttgctactggtgccacaacttactttggtgagaacggttatctcgtggaacggcggacgaatggcttagcagtccgggtcgctcgtgaagaagatgccgcggcagttgaacaaatcgcgaagcaatatattgctggccagctggctctaacagacgctgtcaagcagtttgccaaggctgggtgtcaagcttggactgctaacttaaaacgccacattgtcgattttagcggcgatgaaggtaaaataatggcagctgtaacattctaaatcaataataaagtgcaaaaatgcagactatccacttttaaccgggtagcctgcatttttgcgttccattaagtttaatagccagcttgatgatattgcttgcttaactggcgttctaagctaagtaaagtcagcggacttagccgccgtaactgatcagagtgatagcgcatgactaattgttcgggactattgattgtaatactagtgacgccgtttaggccttgaaaagcgctttgaatggcctgctggagctcgggatgttggggccagacaggggaggtcagcataactagaccatgttcaggatgttgatacgtaatctgatatttgttgagataacgttgaaacatgtcttctgggttcatgagcaattcctcctcggattggttactagtaacggtgagccgcagtttagtttataacccaaaccagacgacccaaacaaaaaagccagccaggcacaatagcgcaataccaatgagtgcccagatcgtaccgttcagctttttggtgtggtgatagtagtaaatactgagtatgccacacagtatggcaagaatgatgctggtgccaataattaaaccaattgtcaattccataaattactttcgactcctcatattatcactttaattgtgcattaaaatgcgataaagtgcaattatttatcaggattcttagtatggtaagaacgctaagcattgcatggtgactgagtagtcttgggtggcttgctgatgagaagccacccaagactacttcaatgataatcgatcgtaaaataaaaaaactaggctgcttatgattaacagcgctagttttgattaatgacagttagttagtcgtttttttagacaaaagggttgcaagcaacaaaccggcgagcgctaaaataaacgtaaagtagaacccgtaatgggcaccgttgacgaacgcgctagcagcttgatgacccccattggcgtagtaagaagcttggccaatgcctaataagctcgttgcaatcgcggttgaaatggcaccaacgacttgctgtagtgtgttcatgattgtactaccatcggcggcaattggtcccgttaaggaatttaaaccatgcgtctgtgaaggggacatcgctaatggcgccccaatcattaagataacgtgggccaaaataacgtaccacgttgcactctgcgtggttgtcagtgccaacatgagggcaccaaccattgaaatcaagaaccccagcattgctggagtgcgggcgccaatcgagtcatataagcgacccgagacggccgacacaattgcgttcatcaagccaccgggtaacatgatgaccccagtcaaggcaacgggaatcaacagccccttttgaatgtacattgggagtaaatacatggctgataagataatcccaaagttaatcataacgaggcatgcgccaacccgaaaaccagagatagcaaatgtcttaaggttcagaattggcgattccatggtgagttgtcgatgggcataccaagccagaataaccagtcccaaaattaaggcacctagtacagcgggcgacccccaaccttgatcactagcaagactaacgccaacaacaaggctaccaaagccaaccattgaaagtaaaatggataagaagtccactttcggccgggttactttcgcaatgtttttaagtgaagtgacggcaaagataaaggcaataatcaagaatgggataaagagccaaaaaatccaccgccatgaagctagtcctaagatggctccagcaatcgttggacccacggccggtgcgaacatgatgactaaaccgaccatccccatagctgcccctaatttgtagggtggaaaaatctgcatagccacggtaaacatgagtggtaagatcaggccagttgcgataccttgaatcattcgaccgaataataacacgccaaagccaggcgctgaagccgaaataatcgcaccaacggcgaagtcaatcagggcaaataaaatcacttggcgggtcgtaaaccatttggtaattaagcttgaaagtggaaggacaatcccaatcataagcatgtaaccggttactagccattgcacagttgccgttgacacgtgtagctgagccatcaattgggggagggcaatgttcagtgatgtttcactaaacatcccaacaaaaccaccaattaacatccccatcatggctagcatgggatgggcaacgggaacgcgggcccgttgtttagcttgcgggctactttgtactgaatccattatattgttcacactcactttcctgaatacaatgggttagcataccagaaaattatttttttcgtaagtgttttttctgaaaaaagaggattgatttacggtagtttgaaaaccatcactcaactagtgcgtctgtgactgcaattgtcggcagtttcattgagcgagaaaggtagcacgtaatggttgttaaaatagtgtttttgtatgtaaataggccacctcagtgtcaaactaaggtggcctattataggtggttgctaagcaaaatcaggtctgcaggcggatcagttatgttcaacaatcgttatgttttcatccaagcacgatggttacactttagcttcgaattggtgtccacattgggggcaagttatccgaacgcgaccatgatgacgcggaatccgaatccgttggtgacactgtgaacagcggaaaaagcggtattgccaatgctgcttgacctggtattttaaacggctgaatgggcgaataatcggtgaccaaaagcgctgaaagccgcgattgatcgcaacttgctgataaatctttttagagaacaaacgccagtaactaataccgatgagcatcacggcaattaagagtagccacccggtgcgaatgaaaaaactgatgacgatcaatagtaaagcgagattgtttaaaaagcggtttaacgtatcgttttgaccgtaccgcccacgcatccatgatcgtagtcgctgtaatagttttgagtttggtttcaaatgctgaacccccgtcactaaaataattaatatttagtagcataacatagtttttcaacagataaataatacctgtttgtgccactaacggtgtatacttaagcatattacagtaaatagagggaaaaacatgtcaacacaatcacaaatcacgcaaacgcaggttctcgatgctatcagccgtgcggcactgatgttggagcgccaagacgcagcgcaaagcgggttacaactgttgctcaatgaatttcggcggagtttattgcagacgagcggacaggccgccacgacggtattgtatcacggcaaaatcaagagttacctattacaacatccgagcaattatccagatagcgtcgcggcgttatcatcattattagatcattttgttgcggctcagtaattagggccgtttttttgcgccaatcaagttattaacctaactagtgatgatttgggtagtggttaatggcagtcaatgttgttattagaaagaaaattgcgctatgctagatggtgaaccatgcgagagtgatagttgcttttttacgtttacggttgtaaactacagttaatttaattcgaagggtggtcaaaccattggaagcacaaactaaaattgaaatcagtgatgccgaatgggaagtcatgcgggttgcttggacgttgggcaatgtcacgagtagtcaggtcgctgagatcatggcggataagatgggatggaagacagcaacggtcaagacactgcttggacggctcgtcaaaaaaggtgcgttacgtgctgaaaagaatggtcgagcgttcaattattatccaatggttgaggaacagccatcgatggatgaggccgtgggcaccctcttcggtcatttatgtcagatgcgcgttggtcaaacgttggtggaccttgttaaccaaacggaattgagtcaaacggatatcgccgctttacaggcagtattggctgaaaaagccaaggatgcgccagaaatggtggactgcgattgtgtgccggggacgcggtgttaatgtggttataaacgaatattgaaataacactgaatgtcatgtttggattttcttaatctgaacatgacattttttgagggaaatgatcttaaagatacttggctaactgaacatggggcattcgtgcaggccttaatcggaaccatcagttatagtgcgcctaatggaagggacttactttcaagataggatactcagaaaacagatgaatggcgacaaaaagtcaagaaagtgtttttcttgacttttatcgtctacaattgtaaactttagccataaattacagatgtagacaatccgactaggggaggtcgctattatgaaagacatggatatgcaacacatggcgcaccatgattcaaatgacatgggcgatatggatatgggtaacggtgagatgatgcacatgggcaatctcaagttgaagttttgggtagcgttagttctgacgattccgattatcattatgagtccgatgatgggggtcaatttaccatttcaaatcgtttttcggccatggtccgattatatcgtcgcaattttaggcacaatcctgtttctatacggtgggcaaccgtttttcagcggtgccaaggcggaggtcaaaaatcataagcctgccatgatgacgttgattacaatgggtatcagtgtggcgtacgtttacagtatctatgctgtggttgccaatgacttgttaaatgcaaaaccaatggtgaccgatttcttctgggaactagcgactttgatcgtcatcatgttgttaggccactggatcgagatgaatacggtcatgaatgcgggatcggcggtagataaactagcaaaactgttaccaagtacggcacataagttagttgatgggcaggtccatgacgtggcaattgctgatctagctaatggtgatcaagttcaggtccgggctggtgaacaaattccagctgacggcacagtgttaaatggtgcgactagtgtgaatgaagcgatggttactggtgaagctaagttagttgaaaaacgcgctaaggatcaagttgtgggtggttcagtcaatggtgatgggacgtttgagatgaaagtcaccgggactggtgaatccggatacttagcccaagtcatgaagttagtcagtgacgcacaggcggccaaatcgtcgcaagaaaatatggcggataaagtggccggactcttgttctacgctgccttgaccgttgcaatcgttgcctttatcgtctggttactcgtgggcaatctggcgttagcactatcaattgcggtgacagtgctcgtgattgcttgtcctcacgctttaggattggcaattccattggtagtggcacggagtacggcgattgcggccagccacgggttactgattcgtaatcgggatgcgatggaacaagtcaaaaagttgaactacgcgttgatggataagaccgggacattgacagctggtaactttaaggtcgctgattatcaaagtatcgccgaccggctaactgcggacgcagtcttggcgatgatggccggtttggaaaatggctctagtcatcccttagctgtcggaattcttgctgccgctaaggaacatcagttaacccctaaggttagtcaggatgttcatcagattactggtgtcgggttaagcggcacgattgatgggcagacgtatcagatcgtttcggcagcttacttggataaacaaaatttagcctatgaccagcaaacgttcaatcgactggcaagtgccggtaactcagtcagttttttgattcaggagcagacagtcttaggttttgtcgctcagggtgaccagatcaagccggaagccaagaacttgatcgatagtttgaaggcccaaaacattaccccagtaatgctaaccggtgataatccgcagagcgcccaagtcgttgctaagcagctcggaattacagaagtgcatgcgggtttattgcccgaagataaggctaagctcgttcaacagtatcaggctgatggtagccacgttatgatgattggcgatggtgttaacgatgcccctagtctggcccgggcagatattggcgttgccattgggtctgggactgacgttgctattgattctgctgatatcgttctcgttaagagtaatccaaatgatgtggtcgatttcttggctctggcccggcgaacgacccggaagatggcgcaaaatttatggtggggtgctggatacaatgtcatcacaatccccttggctgctggtattctcgcaccactcggctttattttgaacccgatgtttggtgcggtagtgatgtcattaagcacggtaatcgtggcaattaatgcgatgacgttacgattaaaagactaaggtaaactgattggcgtaaattaatttgtgcaaatgtgtgtttataatgggtttagatgctagaataatagtatttaaatcaaggatgtgaaacccatgtgtactagtttaacgattcaaaccacggcgggtgatcagtttttagcacgcaccatggactttgcttttgaacttggtggtcgaccagtggcaatcccacggaatcaccactttgacagtgttaccaatgcggacggttttgatagcccgtatagctttgttggaacgggccgtgacttaaatggctatatctttgtcgatggtgtcaatgagcacggggtcagtgctgctgcactctatttctcgggacaagctcactttactcagcagactaaggctggcaaggttaacttggcaccccacgaagttttaatgtggattttaggaaacgtgaagagcaccgctgaattaggcgaacggattgctgacttgaacgtgatggaagccgccgcaccactattgaatattgtggtaccactacactggatcattagtgacaagagtggttctacttacgtcttagaattggaaaatgacggtgttcactacatgaagaatccggtgggcgtcatgacgaacacaccagattttgaatggcatctcaagaatttgagtaattacgtcaacttacaacccggccctcatcctagccgtcaatacggtgacatgacggtgaatcctttcggtcctggaactggggcgttgggaatgcctggtgactatacgtcagttgcacgcttcgttcggacggtcttcatgcgtgaacatacggatgcagtaacgactgatgcagaagctgtcaacgcattatcacacatgctgaactcagtggagattcctaagggcgttaagatgcaagataacgggacgccagattatacccagtaccgcgcctatatgagcatgaatgaaccagcattttacatgcaaccatacgcggatcagacgattacgcgggtcgaattgacaccagctttaatgacggccgcgcaaccgactgaatttgaattaaagacaacccaacagttccggttagcaaactaagttggaatatattagggtcaaaatatgaaagcagcaccgttagcattttatgctaacggtgctgctttttttgattctaggcagaatagcactttcaatgacctataataattattcaaattaactttaataattaaatggtggtacactatattatagtttagggatacgtaacttatactcgataatgattacaaataagccttgcattttctttctgaaagatataacatttactaggtaataatgattataaagtatctacggaggcggcaaacatgaaaaaaagaatgtctttggcacagcgggttaatattttgcgagcaagtgtcatgggagcgaatgatggaattctatcagttgccggcattgttgttggcgttgcgggggcaaccaccaatagtttttcgattttaatatctggactagccgggatgttggctgggacgatttcaatggccatgggtgaatacgtctccgtgaatacgcaaaaagattcacaaaaaatggcgattactaagcagaaggcagcacttgccgatgattatgaagcagaagcgtcgctagtcgtacaaaaatatgtcgatcaaggaatcagtaaaccgttggcgcaacaagcaacccgggaaatgatggcggaagatgcgctgactacgacggtgcgtgaacgctatggtttcaatccgaaccagttcatcagtccgtatgcggctggtattgcgtcgatgattgcctttcccactggctcaattttgccattagtttcgatcacctttttcccaccacgggtgaaggtgttagcaacggtgttggctgtcggaattgcattaatgattacgggatacgttgcggcgatgctgggtaatgctaatcgtcggcgcggaatggttcgtaacgtcgttgccgggttattgacgatgatcgtaacgtactttattggtcacttatttgcttaattaaagggtcaaggggagcgagcttatgcaactgacaaggacaaagtctgagaagaccaaacaaacgatggatgagaagttaaactcattacgagcaggtgtcttaggttctaatgatggtattttaaccgttgtgggggtgctgtttagtgtggcggccgccacgactaatcagttcacgatttttattgctggattatctgatttattagcctgtgctttttcgatggcgtcaggagaatatgcttcggtcagcacgcagaaggacactgaaaaagccgtggttgaaaaggagcggcaattgctgaagacggattttgagggtgaattgcatgctgttcaacgccactatatgactcttggcgtgacggaagagacggcgatggcgattgcacgcgatttattaactaaaaaaccattggcaaccgttgtcagcatcaaatatgatatgcaactaggacactatatgaatccttgggatgcagcgtttgcatcgctattctcagcgtcagcaggaggcgtcttcccgttgctcgcgatgacgtttgcaccggctcattggcagtggccggcaacaattatcgcggtgtccgttgccgtggccttaacaggatatttatcggccgtattaggtaagggcaatgtgaagacggcggtgattcgcaacgtgctcgttgggatcgtgacgatgttcattcactactacgttgggacgctcttttaagtacttctgtcttggtcagttcggactagggattgtcaacagtgaaacaatagctaaccaaacggcacttgaagtacggtgtgctggaaacggcatcagtatgggcgcaaattgttaggatcggtacgaacttaaatagcactggggcgggcaattactgtagttacctgccccagtgctatttagttgagggcggtttccgtgtaattgcgcacaattagtaataaaagttcggatttatcgttgcttatagatgatagaacttgattatgataaagattactgaatcttcctaaaaaacaacgctcgattttcagtgagttttaattaagtctcggtataatattgccattaattaaattgaggtagagcgaaattgaaaaatatgacaactaaccgttatatgaagggcatcatgtgggcgatgttggcctcgaccctgtggggagtctcaggtacagtgatgcagttcgtatcacaaaaccaagccatcccggctgattggttcttatctgtaaggacgttatctgctggaatcattctgttagcgattggatttgtgcaacagggtaccaacatcttcaaagtctttagatcttgggcgtcggttggacaattagtggcatacgcgacagtgggattgatggcgaatatgtatactttttacatcagtattgagcgcggaacagccgctgccgccactattttacaatacttaagtcctttgtttattgtactaggaacgttgctgtttaaacgggaactgcctttacggactgatttaattgcgtttgcggtctccttgttgggggtgtttttagcaatcactaagggtaatattcatgagttggcgattccgatggatgcactcgtctggggaatcctttcgggggtaacagcggccttgtacgtagtcttgccgcgaaagattgtagccgaaaattcaccggtcgtgattcttggttgggggacattgattgcgggaatcctatttaatttatatcacccaatttggatcggtgcaccaaaaattacaccaacgctagtgacttcaattggcgccatcgttttaatcgggacgatttttgctttcttatcgttgctacatagtctacagtacgcgccgtctgcggtggtcagtattgttgatgccgtccaaccagtagtgacttttgtactaagtattattttcttaggcttacaagtgacatgggtcgaaatcctcggctcgttattggtgattgtcgcgatttatatcttgcagcagtatcggagtgatccggctagtgattagttgtaatgatagttatcatttttgtttagtgagggcccttgaataagggctcagcaggacttgaccatttgtgaaatgaccaaaaataaaagctgcgtgtcagaattttaacattctgatgcgcagctttaatcataatttgagtagattaaagttatcttgggggacgatggttggtaagttgtgctacgccaacaccagtttccgggcgggggcgtgcattttaataacttcggcacccaggtcaatataaggctgaccttccgcaatcaatccgaacttctcgtaaaacttctgggcgtgcgtttgggcatcgatttcaatggtggcggcgctgtaatgcactttaagaattgccatgacgtgattcatgagttgcttgccaaggcccgtcccacgatagcaactgtcagtcgttatccggccgaacgaaacgaccccagcatgttcgtaaattcgtgcataagcgacgagttgcccctgatcgtaggcgaagacgtgacgcgcgtccaagtcagtatcatcagggtcttggtaagaccgatcttgttctttaataaaggtcttggcacgaagttgataaatatcgtgcagttgggtggtggttagaccattaaattgcttaacgtaccatttcaaattcaagtgaaagcctccttgaaaactgaagaatatcgccagttattttcaaattgagtctataatttaacacttgtatttttgaccgtcaattgcaaagacccgcgatttatcaatggttacaggtattacttttgatgaaaaaaacatgagaacggattgctggttataccagtgaattgatagcttgattatcagtcatcgttagttaactgtctagatattatcatttttctcataatttgatggataataaaagaaccaccacgcattgcctattgtggtgattctggttgatctttaaattgtttttttgacggcctggtaattaattaataccaagcaggtttgtcaccatcggtattaggtttgttaacacctaaagacgtgcgaatgttacttgtgggatcttgggttaatttaacgacgagtgccgcaatgctcttacgagaaacttcagttcccttaaacggatcgtgtcgctgggttatttcgtagtcgatttcgtccttattagtcaaccacgcagggcgaatgattgtgtagtcgagatcggaattttctaggacttcagccgcggcgtagtagcgcgtcaggtagctacccaacgttgcgttgttccattgaccgaacttgccgggaacttcgtcatagatccctaaagttgagatccaaatgagccgtttgaggccgctggtatgcatggcttttaacacggtttcagcctgctgtttgatgttttgaccagccaaattagcataaacgacatcttgtcccgtcatcgcctgggttaatttggcttcatcagtcgtatcaccatcgataatcgtcacccggtcagattgttggtctgcgacccggctactattacgtaagtaaagtgtcaaattatcagttgtgttggctaaaaattgctgttcggctaaacgagcaatttggcccgcagcccctaagatcaatacatttgtcatataatcccctcctgaacatattaactgtaaacttaattattacagaattcaagtaagcaatttcaaaaaagttaagcaaatttgtgccactttttgaatttagacttataatgaacatgtagcgaagttgtacttcgctgtccaagataaaagaggcgataatcatggcacaaaagcttagcaaggaacaaaaaaaggctatgattcaaaaagccgaagaagaacgtgcaaagcatccaaagaagaagagtggcgtttccggtttcgaaacgatcgatgaagatgctaaaaagttatctaataactaataattagcgtgattcttcagttagggcgagacattggtcgcgcccttttattttgtccaaaatgagtgcacgggatcgcctggtgatgattgactggttcgagcaaaattgcagttggcacggagactgatggtcggttgttagcagtgctatgacagccatccatttgaatagctgtcacagcagtcttgcagtataatagcggtaattaatgatgggggtgacgcaaatggatcaatttacagtgtttatggcgcagcttgataagacgttggcacaagagcaattatcgtctactgatctggtgtacgtgccagtaacctttagcttccataatcagcgcttacaggttgccattaatatgctccaaacttcatttaatcagggtaataatgtatttggggtgcctgatattctggatcgaatcagaatgttggtcggtttggaattagctgattgcccgcagtctcgctggcctacgaagataacgacccagcaactaacaatcacgccacataaaatggtcagggtgatcccagttgatatgcgggcatatcaagtggagtgatttagcactctaatacggagagtgctaaattgttgcaatcttgatgaaagtgcttattattaatgatgtaaacaaattgaaagggtgatttcataatggctaacgatatgatgaattggcacaatgatttatttgatcggttgaatgactggactaagatggacgatttggttaatggattcggtcggacattcttaaatgctggtagtcatgggtcggtcctaaagactgatattaaagaaaatgacgatcagtacacgatgaaagtcgatgttcctggaatcgataaacagaatattgccttgaagtatcgggatggcacattatcgattgctgtaaaacgcgatagtattagtgatgaaagcgataaagatggtaatattatcgcgagcgaacgtcaaactggtcgctttggccggcagtattctttacccgacgttgatgttgacaagatcgaagcacgatatgaaaatggggtgttgcagttaactttgccaaagaaggcagctgcggatacccatcatattgaaattcagtaatggtttatatgacgacttgccgcgattggtggcagggcgtctttttattgtatttatagtggatgaaacggttacaaaaatttgtaaatttttgatgaaatctggagtcagatactcacatctttgctggatttctggtacaatttaatcctatcgatatatcaattgaactgaatattgataatgataggatatgtttgttgtcggatttgtaagaaagtaggaatgcgtgatgacggaaggttttagaccgagtcaccctaagattgagattgacgatgatcctggaatacgggctcaaatcgaagctttgactggtgaactctcacaacaacaattggctaaatgggcgttaattatcgccaagaaagccttgcagtatgttgataaccaacagaaatatgatcgacaattgcgactcgcaattgatgctaatgaattgtggcaagttaatcttgttagtggctaccaggtacggcaggcactggcacgattgactaagttaagtgcaacgacgacgagttccattggtgcggcggcactggactgcgttcgctgggccgtagcttccgcagatgcggatgaaaatgcgctgcgggcctcggaccaagcaattaaattggttaatttaacgcaaccaaatgacatggttgcggtcactgccgagcgtcagtggcagtacgatcagttagctggattagcagctaacattcagcaggggttacgccgtatgctataatcttcacagagattaaattaggtggggatattttatggcaacggtacatgcagaagcaaaggcggagttgttacgtcagtatcaagaaattgtaacgaagtatttaacgaatatttcggaaacagtggacgtgaaggcgcattttgaattaaaaaacgaaccaggatttaattattttgtggattatttgtttttagccaatgtttgttaccaagcgagtctggatattttgaataatgaagatcaaaaatatccagatattaataagcggctagcagaggtcatcttaaaataccccgagtatttgacattggccgttttcaatgccgatttccaggatgaaagtgtgacggatcactacgaaaaaacactcgtagatttggctaacactttggattaatttgtaaataaggtggtcacgaacttcggatagacgaagcctcgtggccttttttggagggttagtaatgattgaatgggatgcggcaacaattaaagattttcagacgacgctattagattggtttgatcacgaaggccgcgatttaccatggcgacatgaccatgagccttaccacgtctgggtctctgaaattatgttacagcagacgcaggttcaaactgtgattccttattatcagcgctttatggcactttttccaacggtagcggacctagctgccgcacctgagtcacagttgttaaaggcgtgggagggcctgggttattattcacgtgtccgcaatatgcaacggtgtgccaaacaattgttaaccgattacgatggacagtggcctcaaactgccgctgagctgacggagttgattgggattggcccgtacactgcaggagcgattgccagcattgcgttcaatgaaccagttccagctgtggatggtaatgcctatcgcgtctttagccggttgctcaagattgacgcggatattgcgaagccccagacccgcgctgtttttgaacgggtaatcagtcagattatttcacaagagcgacctggagattttaaccaggcgattatggacctcggttcaagctacatgacagcgcggcaaccagatacggctcattcgccggtcaaacgctttaatcaagcttatttggatggggatgagttagcctatccggtcaagacgaagaaaccgcggcccaagccggttgcttacgtggcggtattagctaagatgcaggatcagtggttgatgacgaagcgaccgagtaacgggatgttggctaatttatggacggttcccttgattccgattgcagatttagacttagatgatgattaccaacctgaagaactagttacggcggtagaaaattattttaaacgtgaatatcagctccagctaacggcccattatctgaccgggcagcctgtgacccatacgtttacgcatcagaagtggaccattcaaggtttgagtggtcaagttgggttaagtgacttagcctactttgctggtcagacctttacgttgattgagcggcagaaacttccaatgcctaaggttcaagaaaaaatttttgcacgctattcaattgattaattcagtcaacattaaatacttttcacccttcagatgtgctatggttgtggtagaatatagcaaatcaatattgtgacggagggtcgcgcatgttaaatgtatttgatatcgttaagttaacaaagatagaccataaagaagtcgacagtaatcaagtggttgttacagatggtaacggtaagcccaatgcgattttgacagaattattgaatgatgttgtgggaaatatgcggatctttattaacatggaagatgtttattcggtcgatgacttaatgcgcgcattggccgcccatacgccattgccacaagatgtcttagaagaatatgaaaaggtattgcgggaaccgatttataacattaattttgtgccgaaaaggggccaagttgaagttgtgatcggtgaaggctaacgtgattgtcataatcatgataagatgttagtcaactcattgtgatgaaaatcagggccattcgtgggacctgatttttttgtgctgaattgatgatagtggctgtcacgaggactgatcaatatgtggttgcgggaaagtgttggttcgatttaacgataccggcacctgcgttataatggagtcaacttatggtcatgaaatgtgataggttattgtaaatggtcatagattgtttaccgcatcgtacgataggaggagtgctcattatgcaattaaaattagaacggatttacacgaaaccagttgatacggatggttatcgggtgttggtagatcgcttgtggccccggggtatttcgaaggttaacgctcagttggacaattgggtaaaggaaattggcccgtcgaccacgttacgtaagtggttcaatcatgaaccggcgaaatatcccgaatttgtcgatcgttaccgggctgaattggatgagaatcccctgacggccagctttattagtcaagttgctgaacaactgacgaagacgaatgtgatcttattgttcggtgccaaggacgaacaacataatcaggcagtggtactgcgtgattacctgaaggatagtggtcaattaccaaccgcttaatataaattgcgtaatattggtatagatgaaattgggattaggcctgcaataaactgcgctcatcaaattattttaattattttttgaaaacgctagcaattagctgcgaattttgctatgattatgttgttaattaatggcgtcaactattacagtgcacaataatgggggctgcattgttaggcaagcaagattggggataattttatgataaacttatgtgtgttaccaagtaccgcaagttgtcgcaaggcccaccggtggttactcgaacaccggatcccgtttcatgaacgtaatatgaatgcacagccgttaacggagactgaaatcaagcacctgctacagtacacgtacaatggcattgatgatttgatcagtactaagtccaatgcttatcaccaactgagtaagacgacaccgattgaagatatgccattaagcgaagctgttcgggtattaagccaaacaccgcaattattgcggcggccaattatttttgacgatcaccgacttctgtgcggctttaaccaagatgagattcggatgtttattccacgtgaacagcgcgtactcaagatgcaagcaatgtcagaacatcagatggcttaaaatgatcggcttatgagttgatgccgtgtttttggggcgaaacattataaaacagtactacttacttgccagcataaactgattgacacagttaagcggtactgttttgtgtgtaaattgacaaattatagctatttagttagtatactaactaaatagcggaggatgaaatggataatattggttatttactaatgcagttttccaaacagttacgttatcagctaaatcaacggctaattgctaacggattgacgattcaacaatgggctgtgatgcaacaaatcagtctttgggtcgaaagaacggcgcaacagccgactgccaaccagctgtgccacgttctcgatatggaccggccgacgatgtcaggaattcttcgacgcttagctgccaagcaattggttgaacaggacgttaatccagcggatcagcgagcaaagctactacgcttgacccaagttggcatacaagaattgcaggccggtcagcgtattagcgatcaggtcgttgcgacggggcttcagaaattgacggctgctgaaaaacagtctttaagacaactgttaaaaaaactagggagcaattaataaaatgaaaatactggtgataggtgggacgggaaatattggcttaccgttaattcaatatctagatcaacaggtgggggtgcaagttgttgctggtgcccacaatttgcataaagacgagcaactattggctgcgtattcggatgttgaaattcgacgctttgattttttggacgagacgacctttgatgcggggttacggggaatccaaaaggtttttttcgtgcggccaccacaacttgctaaacccaagcaagatatgtggcccttcctaaaatgcttacaagcacaccacattgagcaggtcgtatttgtttcgttgatgggtgttgagcataatccaatgacgccacatcatcaaatcgagcagatgatcgaacagttacagttaccgtacacattcattcgaccgagcttctttatgcaaaatttgaataccacgcatcgcgtcgacattcagcaaaatcacgatttgtttatcccagccgggcggtcgaagacgagttttattgatacacgtgatattggtgagattgcgggcgtggcgttactagatacacaatatttacaacagaaattgactgtgactggtccagaagcgttgacttatcagcaaattgcggcgctaatgactgaatcctgtggtcacccggtaacgtatcatcgaccgagcttatggcggtttcgccgcgtgatgttgaagcggggaatcaagaaggactatgttaatgttatggtaatgctgtatttgattacccagttgggcaatgctaaacgcgtgaccgatacggctgaaaaagtgctgggtcacgccccgcatacgatgacaacttacttacgagattatgcagatcagttacagtagttaggtcgaggagtaggcatgtcatttggcagttgtgggttaatttagtggtgagcatggtcaacaaaaaaacagttacctcattttgaagtaactggtttttagcggacatatccagtacagactagctaattcaagcaaacaggcattgaagtaggatgtctgctgatttttataagcgataacgactagcaaatacaatgcttaggcatacttatgtgcaattttagccgcaacggccgccgcaatcgcaccaactaggtcatcaataaacgtgttaacaacgcctgacttatcagtatctaacttcttaatgacgccttctttaactttatccacgtaaccataattagtgacgccgatggtgccgtaaatattcgccatattaagtgctaagccttcatcaacaccgaagacgccggcgtcactggcaatgatagattggagcggctcgtttagctggccttctgtggcaagtcggtcgagttctaacgcaaccatcgcattgttcaatagttcgcgcttgtgcagtacttcttgcgtctccatttcgcactcttcgatcgttaagttagggacgtattttgtttgtaagttataagtgatatgcgcaatttcatgataagtaatcccttttgaggctaaggcttgaatgacgaactcatacgcagccttatcaggatatttaaacgttggtttttccatagttaccctccagaaataaacaatttgagtaggttagttatttaacctagtaagtccattataacgagatggggggctaaagaatatgatttgggttcaatattcgttggtgcgggttaaaaaggcgattgttgaaaacgatgactggttattttaattgaaacgcgtaaaataagactgttaaacataatgaagggtaagataattttgatgaaacgttggcgaacggtgattcaattgttattgattgtttttgttatcggtgcggctgtgattttagttggggcccggaatcatgataccaagattacgaaagtaacgagtcaattgacaccgcgttctgcacgaatattaaagaatcaatatgaccagtcaaagacagcgacggtctttttacatggctacaatggtggggcgtattcgacgaactatctgattcgtaaagccgaaaaagcgggggctgcccaaaaagcgttagtggtgcacgtgtacaagaatggtgtgatggcctttaagggttattggcaaaagtcaatcaagaatccgatggttcaagttgtttttcaagataatcacgcttcacaaaaagcccagatttattggttacaccaagtcttagtccaactaaaagcgaagtatggcgtcaaagcttataatgcggttggtcattccctcggggccaatgatattgtcaatcaggcattgaagtatgggcatgacaaacgcttaccaacgttgaataaaatcgtgacgattggcggaccgttcgatggcctgaccgggtttctgagcacgcagacggaagcaacggtccggcgcttggatgttaaaccaagtcgtttcacgaagcatttttcagaaatgctcaagtatcgccacaattttccagacaacgtgaaactactcaatgtctatggagatacaaacacggggtataacaatgatggttttgtgggtgtcgcttcagcgcgctcaattcggtacttgttgcgcggaaaattaacacagtatcaagaagctttctacagtggggaacaggcggcgcattgcgcgttgaatcagaatccaagtgtcgctcacaagatgattgcctttttgtggtaagtgttattgtgtcaggatgggtgcattaaataaatgaggtcgttcgggtaaatgctcgggcggcttttttcgtagcgccaaattaggcggtcaaacgcagaaactacagctttggtgacgttttcaataaggaagacagctttagaaaacaaagtattgcgacctattcgtcgttaaaaacaggggttaacagttaaaaatcgcaattaagtgaaagctagagcgtgctataatgacacaacattaaattttaacaacaaagtcattaaaatttgtggaggggtcttatgaaaataactaatgctgatggcacgatccgggcgcttagtaaccggcatgtccaaatgattgcaattggtggcacgattgggacaggattatttcttggttcagggagtacgatttcaaagacgggaccgtcagtcatgtgggtgtacttggtgttgggcttcttcttctttttaatgatgcgggcaattggtgagatgttctattctgatcctacccaacacacattcgtggcgtttatttcccgctatttgggaccgagtgttggtcattttacagggtggacctattggatcggtttgatttttgtctgtatggctgagctgacggctacggcaacgtacgtcaaattttggttaccaaatgtccccgcctggctaattgagattagcttcctgttaattttggcgggcgttaatttaacggctgcacggttatttggcgaagcagagttctggtttgcgatgattaagatcgtcgcaatcgttgcactgattatcactggtattttcatgatggtgggacatcacccaaccccattaggccaggcttcaatcggcaatttgttccataattatcaggtctttcccaatgggctagctaactttatctcggcatttccaatggtcttctttgcttttcagggcattgaatttgtcagtataacgattggtgaggccaagaaccctcaccgcgttatcaaaaaggcggtcaatgaaactttgttgcggatcttgttgttttatattggtgcgttaattgtcattatgggcattattccgtggacatcactgtcacccgatagcagtccgtttgtgcaagtcttcaagttggcaggatacccagcagcggccgccatcattaactttgtcgtcttaacatcggcagcctcatcgctaaatagttgtttgttctcagctggacgtcacttctatcagctagccactgaaatgccagttacgagtcgcatgcaccaaatctttggtcagatttcgaaaagtggtgtgccagcagcagcaatcgtgttgtccgcgatactagtgctagtgacccccatcatgagtttaagtgctgcaacaacggcagtttttaccgtcgtgaccgggatctctagtgatatgtacctgattgtttacacgctggcgatgctggcccaccggaagtaccggctatctaatgactatctggcggatgggtttaagatgccggcgtaccgaatcacgagcccactgacgattgccttttttgttctcatttttgccagtctattcttcattcaagctgatattgtcggtgcaatcggtgcgattatttggacgttactatttggtggcatcacttttgcccaccaagcgcgcttgcgagctgtaacacggtcgtaatcttaaaatgagaattatattataaaatggcttgacgatgataaaaaatggtggtattgttaatcacaagttaataactgtacgataacgttacatcaagtagacatagtggtaggtgtcaggaagccggtggttgctgcgaaccggtcagctactatgattgaaatacggtaaccgagtttcgactgaacggataataactagaaccgttatcttctagtgagtggtggattaagtgtcaataatccgcaacctgggtggtaccgcgactagtctaatcgtccctgttgttcatatgaacaatggggacgatttttttgatgaagaggatgagaataatgacaaatcaacgctgtggtgggattgcacgatattaaaattttgatgatgaatatgcgtcactggaattttatcaatcgaaggggtaataaattatgaacaaaacaaaagcaccacaaattagtaccttagaagcagtcattgtcttactggtcgtcctcggaattatgagtgcgggtgtgattggttggggattatcgccccaagttcccgtattactcgcaatgggcgttgtcactgcttgggcgatgttgcgcggttttccatggtcagcagttaatgccgggattaaagagggcattgataaaggaatcgtgccaatcttcatctttattctcattggtgcgatgatttcaacttggattgcggcgggaacgattcccacactcatggtgattggattcaaaatcattaatattcagtggtttttgccatcagtctttattgtttgtaccctagtcggtgcggcggtcggcagtgcctttacggtaacatcgacggtcggaattgcctttttcggcatgggcgtgaccatgaatctgaatccagccttagttgccggtgcaattatcagtggtggaatcttcggcgataaattatcaccattatcagaaaccaataatttagcttcagccgtagtggatactgatctttttacgcacattaaacatatcttatggagcacgctaccggccgggctcatttcattaggcttgtttgctatgctggggcacagtaatacggagacaagcttagccaagatcaatcaaacagttgcggttttaaatggtcatttcagtatctcagccttggcattattaccaatcgtcttagtcttcatttgtgccgggtttaaaatgccagccattccaacgatgcttttaaatatttttatttcggcgggcttgattctatttgaacagcctgagttatcactggcgaagttaaccgccattattaacacgggatttgtttcgaagacggggaatacgagtgttgatacgttgctttcacggggcggaatcgtcagcatgatgagtatggtcgcgttaattgtggttacgctatccttaggaggattgttggtcaagtttggactgatcaatcaaattatgactccggttgctaagcacttgaatagcgatggcaagttagtattgtcgggtgtattaacttgtattggtgtcaacgtgtttgttggtgaacaatttctttcgattatcttaccagggcgcgcttttcgccaggcattcaatgatggtggcttatccggaaatgcactggggcgggtccttgaagatggcggtacggtaatcaattacctagtcccgtggggcgttggcggcgtcttcctgacgacgacgctgggagtaccaaccgtccaatacttaccatttgttttcttcagtttactttgtccagttatctcggtaatcagcggtttcactggtgttggtatggcgcacttgaatcagcgaactgcagtgaaaactaagcatgtgactgcaacggaggtttaatcgttggtcgatcagttcactttagggaaggttgacgaatggctgttaaaatagttactttatgtgggtctagaaaatatgcggcagtatttgaaacggttgagctggctctgagtaaacaaggtgttattgttttaaagccagctttcagtgatgaagtattaacaccgattgagcttcagaatttacgccagacacatttgaaaaaaatcgacttggcagatgaagtagtagtcattaatgtcgctggctacattggtgagcggactaggcaagaaattggctatgcacagcgtcaacataagagaattcggtattacgcagttacggaaaacgagcattaattaaaatgaccagtatcgaagaatatcgatactggtcattttgcgttgatttagtaatctttacttgagtttagtagccgcttgaaaatctgcgtacatgggatggttcaaattgatcccgcgtgatttggcaatgaaccaagctaagacttggaacgggataatcgcaagtagtggggctttatacggatcagcaacggcttcgagctggagggtttgatcatcattgatggtcggctggtcaccagtgagactgatggtataaatgtggggcgttaatcgcgattcgtacgtcttgacggcctgtaattgggttatgacagctggatctgtattgatttcaagatagaactgacagtgatcttcatgcgtccccataaagccaccgtgggtaaatgaggctaatgagtaaccatgcgttggtacccggaggatttcggtgaatttggcttgcatttcagttagtgttccagctaggacgttagcaccgatagctgtaaattgaggggcgttagtgaaatcaatagtgaacttacggtagaagtcgttcgcccgttgaacagttggattcatgctttcaatcagaaaactgaactcgtctaattcttgattgattgctaattcggttaaccgtgcttgaagggcagcactgcggacggcaagcaacattaaagtgagcacgatggcttgaaagcttagtgtaatatagggcactgattctttgccagttagtaagtcacaagttgcatcggccattgcggtcagagcagtcgatttttgattagtcacgataatgacatgagcttgactggccgtgtgggctttttcgattgccgcttgcatggttggatcatcatcttttagagaaatcccgataacaacatcgacactgggatcagcttcctcataagtgacgtagaggtcggccgcagcaatggtcacttggagggcggccgtcttttgcatgtataagcgggcggtgttggcggcgttgagtcttgaaccagttgcgaggatcaaccagtgttgtggatgatcaggggtggcagtcaaggccgccgtaatctgtttgggataattggttaacaaccgctctagtactggctgttcccgacgaatgtatgagagcatggtcggattattcatcatcatcaaaatcatcagctcctaaaaaatagttatgtatattaatattaatttagctttattgtaaacgtaaatgaacttatagtcagcaaaagaatgtttaaaaatatgactgttgattaatcgtagcgggtccgctttaaatcaaaggcgactgctcgcaaatcattataaaagacgacttaacggccgacggttttattcacgggcttgccattatcggaacatgttgcgtttcaatgtacgcagaacaacatcctaatcagcattctggttagatggcgtcaccagtaagggaccttgtcgcaaatcgtatgccgttcatttaaaatgccagcgctgtttgtggcagacccgacattgatttaggtgaatattcatgtctagttctaagttcattgtaccaatcatttatgataattagggcttgcatgtaactgaaaaggctggtaaagtaaggaacaatttatcaatacaactaattgcctatataatgccatgatatggatggcgagtttctacccagtgccgtaaacactggactataagcgaattgagtcgatgggtctacactgcttaatttgccgtgtggacccgtttgctttctccgtaggcagactgactagtgaggagaaaataacgatgacgaagacagttgaaatggtgattactggtgcacaagtgttaaacgtttatacccgtgaatttgaagccaccagtttgtggatcgatcacggccggattattagtaacttgcgtgacgagccgtacatagcggcccagcatgtcgatgcgaccggtcagtggatcgttcccggcatgatcgatgcacatgtgcatatggagagttcgatggtggcacctagcgagttgggaaaagtcttactacagcacggcgtcacgacaattgcgactgatccacatgaacttgccaatgttgcgggtattgctggcattcagtacctaattgatgatgcgcgccaaacaccactagatgtctgttttatgctaccgtcatcggtaccgtgtgttccctttgatgataacggggcaacgctacatgctgctgacttgcgcccactttaccaacagtcggaggttcggggactggcggaagtaatggactatggggccgttgcgcgtggtgatactgacaccctggctaaaattagtgatgcctatgcgtatggctatcatgcggatggtcacgctgccggtttgaatgcgcaccagctcaatgtgatgcgcaatgcgggactggatactgatcatgaatgtatgacagtggcggaagcacaggatcgtgtgcgggctggtatggctgttttcttgcgtgaagggacggttgaacgcgatgttttgccgacgattggtgcagtgaccgaagctaatgctagccggtttgctttttgtacggatgataagacgattagtgacttgctcacagaagggtcgattgattataatgtgcgcctagctatgcagagcgggatgcgtcctgaactagcctacacattggctagtctcaacggcgcgatggcgcatcgtttaagtgatcggggtagtctgtcagccgggcagttggcagatttagtggtcttagatgatctcgaacacgttaggattgcgcggacgatgaagcggggacagtggatattaccaagcacgacaaaaccattgccgtttactgcaacgcgtgttcagcaccatgcacaactagccgacttccaattaccactagcgaccgggttggcaaatgtaattggtgtgcagccgaaccatatcgagacggatcacttaacactcccgattgatgcaacgcagaattttgaagcggattgccaacgtgatattctcaaaatggttgtcatcgagcgccatcataacacgggcaaggtgggcgtcggcttagttcatggcttcgcacttaaacagggagctatcgctggtacggtggcacatgatgctcataatattgttgcggtcggaacgtcggatgccgcaatcttacgggcggtagcccagattacccaagataacgggggaattgcggtcgttgacgatgaacaagtgctagcgaccatgccgcttgccattgggggcttgctgtctgcagcgagctatcaaaaagttgctgaacagttggccgaacttaaacgagcgtatgaggtcattagcgagcggccacttagctttgatccgttcattacgctatcgtttttgacattacccgtgattccaacgttgaagttaacggcacgggggttattcgattacgcgacctttgactttattccagttgcgattcaggataaccagcgtcaaacagtttaagtgcaatcgttcggtgactgaaattaggctatgatgtgtctgctactgaacaacgatgtagtttaaggtttgtgccgaaatatgtttaaagccccgcaatagctaaacgttttagttagctgctgcggggcttttactgtggttttaatgggctaaatggctgctactgtgaagcgtcattaatgcgggggtagctaatgggattgccactctcataagcgggaagatcagcgattccgcggtaaacggctcgttcaatctgctgcagcccgccgccatcagcaatcgtcattttaataccgtaatgcttgacagctttattcagtgttttggaagtggcgtgtttattctgattctgaatcatgaccacgaggtctgcttgaccgatttgccggtaatagaagttggtgctattactgtgtttaaaagcatcaatcaataaggtgtgcccgttgtgctcatcaatgagttgcgtgatctgtgttcggcgcgtaccaacgtcgcccatgacgatggcaactgttttttcgtgcagatcaaagtctaaggtgcgcagcgtcactggcacggtggttgtgtggatagtggcctttttagctggtttggctgctttattcgaggtcggttgactcgagctatgatgaacgtaacgaataaccaccttctcaggccgctccttataccaagccaggtcgactaattgaccattactgatgcgctgatattgcgcttcttgactagtgaacgtaacatcgttcattgccggattgagcgacgataaggttgtgccgttataatcttgttcgatgtgataagtatcatcggtgtcttgataatgaacaacgaaaaatggtgcgacagtaatcggatccgctgtagtagcgtgactaacgattttatcaatataaggttgtcgatgttgccgtaaattttgttctaacaggacctgatcatcgtggtgaatcaccagttgtcgggccaaaatttcatcgtagtggtagcgtggtgtgccggtcggatcattggggtcgactaaatcaaacccctttaaatcgcgctttacttgcatgattgtttgcccattggattgtgcagaagttgttttgacggatgatgatgaatcttccgcgtttgcttgcgtagcgtggccgctggtctcattgtgtgagttactagtggctagtctagctatgcgtgcattatccgaatctacgatggtatcaggatcaagcgccaggtttaagatttcctgaatcgctttggcacccttggcgaggccttcatcggtaggtcgaatcatggtcaatgttcgggcaatggcggtacgataatcgcgatattttttcaaattaggacctccgttattatttagtaaattggtcagcgcagacatggttctgtgctggctaaaaagatatttggtacagggtcaggtcataaccaacgatatgtatgtgttaataccacgagccaaaatgattgtgttatgctggtttaaagaaccaagtaggtcatcaattgccagtacttatcaactattgtgccatagattgtggctggacgggtataaaaaaacaataaaaacgagttagtgaagtcttttcaagattagctgagctttagcgcaagtattggctgattgggacaatggcaattgttgtgaaaggtcggcttactaacacagcaatggtcaattgaattggccttacgggtgattacttataaaatgatatagcggctatcagacgacaacgagtgcgttgacttgtttgtggattgcaatagtcgagcatcacattcaggataagtgggaatgaagttggaggcgcagcagatggcaagagttagatttgagaataaacgggtcaatatgagcaaactcagtcagtttggatttgaacccaatcagaatggtcagtatcagttccgaactttaattatgcaaggccaatttgaaatgataatcgagttgaacactgatggcagtctgaacacgacattaacggatacgacgactagtgaagtatatgttttacacctgacatcccaagcccatggtcagtttgtaggtcaagtagcgcaggcttatcaagatgttttatacaacatcgaacagcattgttacgataatgacgtcttccaatcgaccccggagcgtaagctgattgcgcaagtcaaagctgtttatggtgacgatcttgagttcttgtggcctaaatttccacaaaacgcggtttggcgacgctcagacacgcacaaatggtatggcgcattattgacggtaacttccgataaactggcgttgccgggcgcaacacatgttgtgacggtattagatttgcgagcgcgcccagaagacttatctatgctgattgatggacaacattatttaccgggctatcatatgaataagaaacattggtattcaattttgcttgatgatgtggtaccacttgccacgattatggacgacgtaaaagttagttatatgttggccaagtaaggcttgaatgtaagtggacggtctcaccctaaaccgaagcattgagcattaactaaaaaaatcgttcccaagaagacatctgggaacgatttttttgattaatgattggtaaaaccatcgttagtgactattagattgaataattagcgcgaggcatggtgccgactgcggtaccaatcgaaggcgagcgttaatagcatgtaagcaaaatcaacgagaattgcttcttttagtggtacgttgagtaaaacgactgaaacgaacgttaaaacaacgacaaaagtcagtgccgattgtgcccatcgtaagagccattctggcatggttagctcacatcctttgttatgggagttgtggttgttgatgagactgatgattgtggccgatcccgtaatgcacgtagcgcccaaagaattgagaccgtatcaacaacttcttgaagcatagcgccaaagagtgccggaatgataccagtgctggcaatcaacatcaagatcgtacagatagcaatcccaatccaaacggcttgtttagccacttgcatggtatctttagcaatgcgcaccgccgtgaccacgcgactgagatcgtcttttaagatgacgacgtcggccgattcactagcagcagttgagccatgggcgcccatggcaatgccgacgtcagcaacagccaaggaaggcgcgtcattaacaccatcaccaaccatgataacggggcgttcggccgctggtacagcctttaagtgggcaatcttatctgcgggtaggaggtcggcagcaacggtatcgataccgacatcggcggcaatatgatcagcaattgcctgttggtcaccagtaagcatcatgacgttttgaacgccctcagcgtggagtgcttgaagcgtggcggctgcttcggggcggacattgtcgataaacgtgatgtaacccgcgtactggtcatcgatgccgacgtagatagcagtagtagcaagtggcttggcggttgtagtcggtgcgacgaatttaagtttgcccactttgacctgttgctgctcaatcgttgccgtgaccccattacccgttacttctgctaattgtgttgccgggctgaggctagtggcactcgcatacttgacgagtgagcgggccaggatatgacttgagttttgttcagcgctcgctgcgaggtgcaagatttgttcggcagtaaaaccaggctgaggaacaatttggttgactgttaattgaccactggtaatggtccccgtcttatcaaacgcggcggacttagccgtagataacttctccaacatgtccccagtcttgaccacgattccgttccgactagttcggctcatccctgagacgagtgcaacgggtgcggcgagaatcagcgggcaaggtgaagccactacgaggacttctgcaaatcggtggggatcaccgctgaatgcccaagctactccggcaatgacgtatgctaccaaggtgaatgggactgcatagcgatcggccagccgtacgaatttggctggtcgtgattcggattctttaaccaatttgactaactgttggtattgactatcaatggctaatttatcaacaaccattgtaacggcactatcgccgttgaccgcaccagacataatgtcatcgccaacgtgcttgtcgactggtttagattcacccgtcaatgaagattcatcaaagagtgccgttccttgaataaggtgaccgtctactggaactagctcaccaggtttgacgactagctgatcaccaatttggacatcttcaacggcaatatctgttaattggccggcgactgagcggtgggcaatacgtggtgaattatcgagcaaggctttcaattcggtattcgctcgtttggccgcataatcttctaacgagtcacccccagtgagcataattagaacgacaaggctagcccaatattcgccgacagctagtgttgccacaatcgccgtaattgctaataaatcaaccccgtacttacctgaacgtaaggttttgatcatctcaactaacattgataaggccataagtgaccccattaatgtaatgatgatttgtgctgccaattggtagtgcaaaccaaactgtaaaataaccgcaatgataccgacgctgaccgttaaaattaatttatagtagtgccgcatgcagttcccctccttttagatgataacgtttttttacttgttacaagaataacatgaaatcggtttaattgaaacagataagaatgattctaaactaaaaactaattattacgaaaacttttaaaaagtttcagaaaaaatatgggtgtaaaactcgtctaatccttgacgggttaggcctcgacggctcaaaatggttgattttacttctgatttaatactagtatacttataaacgaacatcagatatcagaaaatactgaaatcagcatttgtataagccaacgtgcgctgtgcaggtggtaacttgttacccggtactaagcgcttttttggtgcaccaagcaattaatctaacagttgtgcggtgggcttatctggtgattcaagggggttatctattagcaagagcagtgtaaccattaatcgttacgtggtgtgacgacggtcgtgtgctaaaggcacgatggtaatagaaacactagctaaacaagatgaacaccaacgtcgattaagcaattaaaaatcatttgtcagtatggcgttgtccggattcaaccaacggaaagaaggaaattctgctactgattttgagttagcacaaacagaatgcggatgacaatgccggtcaaacctgatacagtcagggtgctgagtgctccgaggattaactcggaggggtgtaccgattgctagtcggaaatttacgcgtggggactaccattgctggtaggaagaaccacgaatttgatctaaatatagagagtatatgctcagtagcaggtttattattttaaaaagtaagaatattgattggtgggtctatttaccaacaattgggctctttgcggcggcttccgttgttttattaatggggggccattcgctggagacgagtttaagtggcatcttgaactggctcacaaataacatgagctggctttatatgtcggtatatgtgatcacttttatctttttcatttacttagggtttagtaagttagggaaaaccaaacttggtgatcctgatgacaaaccagaattttcaacgtatcactggggcagtatggtttacgcgaccgggatcgatgccagcattttaatgttgagcatggttgacccgttacggtacctccaaagcccttcattcggcgtcaagccgttttcaacttctgcatataattatgcgcacatgctgggacaatttaattggggaccaatggcgtggatgatgtttgcgccagccacgattgcaattgcctatgcaatgtatgttaaacacatcaaggttcagcggctcagtgccgcaatttcagtactacaaggtcctggtaagggtaagcaaattgcccggaacacgattgattttctcgttattattgggattatgggtggtgttggtacttcagtcgggatggaaatccccgtcatttcaaaagttttgagtgccgttaccgggattgccgatacgatgactttaaagttagggttatttgccttattattcgtaattttcgccatggctgtttttaatggcttgaagaagggaatcggtcggctaagtgctgcccatgtttggttagcgattggcttcctaatcgttgttttaattgttggcccaactttgtatattttaaactcggaaactaatagtattggcttgtttgtcaataagtttattacgttgagcacgaatactgcaccaaatggtcacgcaacggccatgcaacggcagacgatcttctactggggctggtggttatcctttatgccagtcatgggcttattcattgcccggatttctcggggccggacgattcgtcaggtactcggtggtatgttgctatggggctcattaggttgtgtcagtttctacgccatcttgggtggttatgccttatacttgcaacggatgggcatcgttaacttagttcatatcttaaatacgcaaggacaagccgctgtgattgcagcagtattgtcgaccttaccattgaagatgattatgctggctttgtactgcctatcttgctttattttcttagcaacgacggtatcttcatttgccttcattacctcgtcatttactagtaaaaagttggccgcgggggaacaaccaagtcgtttcaatcggatgagctgggtcgttatcttcctagtcttctcattggggcttgtcacggtcggtggctttgaatcgattcagtccatctgtgcgatgtctggcttcccattaacgattgtcgcgctcgtcttactgtactcgatccatcacgacttaacgactgatccagtcaaggaagctgcgaaagccaatgccaaagcagctgaattagcacgccggaaacggctagcacgtgacgttgaaatcacaactaaaactgactacgcacgcgaacggcgtactgcacggaaacgtgaaacggaagccgattagcgctactcagttgaactaaatatatcaattaaactaggctcgtattatggatttccataatacgagccttttaagcttggcccacctgtttgaaataatggtagaaagatgccttttagggttggttttctgttcgtcagccagtgagcgtcctattccgacctccggggctgggtgacaattgctggaacgcagccgacatcgatttgagctaacgaataacccgcgtcatctcaaatacgagtcttattctaagccggaaggaaatcacttccgactaagaataatttggctactgagcattgtcacccagcccctccagtctcaagccacgggttgaagccgagcattgtctagccaacggattaatgcggtttgggcatttgtccgttggcatagcaagcacagactttagtggcaccgaacacgtttcaggaagccgctcgaatggctgatgaacggccacttaactcggcacaattggtcgttggttattttgatacaggaactttaaacgagacgttagggttaccctaaccactttgttgaggtgttctattattactatagtaattccgaaatagcgagctatcccaatatcttttcgacctaacagttgattaacaaaattactgtttatggagaacaatgacaaattcatcaaaagttgggtacatcttcgtccgccattcgaatactgtcccgactggaaggcgtttcggccaatgctcagcggtgaaattccacttagcaagcgtccttggcttggttagtggaagaccagtatttaagacgtggtcttcggcttaaatctgtgtccaccgcgttccagcaattggcagaaatgcctggagggcggcgtaggacgaacgaactaagcaggtttacgctaaccggaactgtttccagcgggcctaagctggtggctgttgactttaaataaaggcatctttataccataattcaggtgggatggattagaatgatagcgatgatagtaaagggaggattggctatggcgattagtaatgggcatgttagttttaagcggccggcgtggttgggagattcgattacggcgaataatgggttggcgacggtgcattatcatgatattttggcggctgattgggatgtcgagcggagcgataatttgggaatctctggttcaacgattgggagtcgctacgatgcgatggcggcgcgctatcaagctattcctgaagatgctgattttattgctgtctttgggggcgtcaatgactatggtcggaatcagccgttagggcaatacggtgattgcgatatgacgacattttatggcgcgttaatggtgttactgacgggattacagacgaattggccgaccgtgccgaagttatttatttcagcaattcatattggctctgattttggcggcagttttagtgcggtgactaatggtctcgggtatcgtcagtcagattatgaagcagcgattgcccagatgactgcggactatggcgtcccacatttgagcttgtaccgtgatgcgggaatgacgtttgcgattcccgctcaagcggctatttattcggtggatactttgcatccgaacaatgccggtcatcgcgtgattgcacgcaagctgcagtcgtttttggatagccacttttaggttggcctagtcagtaatgaatggcacagttgatcgtaaataaaagcagcagcacgctaatgggcgtactgctgcttatctgaatctaggtgtcaaaacgggctacttggcttttttcttagtcttgggcccttgtttatgcttctgctcgcgcagcaagtctttgaaggtttcgatttccgtagtgtgcttagccatccattccttgtagttagaatgggagtcggtatcgctgattttaaggccggtttctaaccagaataaagcttcggttagggaaccgaaattatgaaaccagagtgtgtggccgttgtcagagtccatggcaacgtaagacttgtagtggggcgttaaaaaggtatgtttaacaattttgaatgcggcccggcgacgagttaatttgtaatccggcaagatatagcggccaggatgggccagatgtgggacagagttcttacgttgttctttatattcagtcaacatcgctttagcgcgttcgggactgatgagggtgatatcaaattttggcatagcagggctccccttggtgaatagcagtatggtcaattatagtagtcaaataataatacttatactataatgatagcgcaattttatgaaaattcgaaatataaaaacctgaaaattagggattttccctttcttacagtaaatttaagtaaaactaatcggaggtttgattatgagtacagcacccctcagttcatttgaaaaaaatattccggcggtaaccgaattgttagcggttgatgctgaattgcaaacgttctttgtggctttgacacctggttatcagcgcgaatgggcccgctttatttttggaactaaggcacaagcaactaaggaacggcacattgaagttatgaagacggtttttcgagctggctataaatctaagcgagcgtatgatagtcggtcggataaataggtggattttggcaatttgaaatacggtgacggattgcgattaagaattggggtgtagccaccaagatctaagcgggtctgggtcctgatttggtctaattgctgtcaattctgtggctagcaggccttgtgagtgcctctaaagcctgcaattctgcttcccgagcattaagcgtggcctcaattgctacgctgagcgtgcgctttaaccggcttaaacggggaatgtctagactgacatcatcaccataaattgtttccagcggtgtccaccagacgggaccggggttgggcgtatcaccgttatggcgaggaaataagtgccaatgaacatgcgcgtcaccattcccgagtagttcaatgttcattttgtctgcatgaaaggcctgcgcacaagcttcctggacgatactcatctcctcaaggtatcgtaacttctcgtgtgccggtaaatgatgtaattcggtaacgtgatgtttggctaaaaagagcgtgtagccttcaaagtactggctatcagcaaggaccacgtagcccgttgtgagttcgtaaacgaaataaggattctgatgtgcctgaattagtttgattcgttcacagatcgtgcaagtggatgtcattcgctcgcctcctgagtcttgataagattaagtatacgcgtagatgtggtgagtacatcaaaaatgttagtgaaacgtctaaaaaacgacgacctgaaaatcaatcctgatttggggtcgtcgttttgattgtaaaaactaatcgtcaattctgttaggtcgatcgtgattaaggtaaatcgttgccagctgcaaagtaaatgtcgtaccattcttgccgagaaagcgtaacgtctgctccagcagcattttgagctagatgttccggattcatcgtaccaaggatgacttggaagtgggctgggtgccggagaatccatgcggtcgcaatagctgatttagtgacctgtttctcatcggcgagtgcttgcatggcattattaagttctggaaacttcggattgtctaagaagatacccgcgaagttaccgtattgataaggcgaccaagcttgaatcgtcatcttatggagccgtgagtattcgatcatctcgccgtcgtggttaagactacgttcgtcctgcatgttcgtgtgcaagccaaagtcgatcgcaccggtatgcatgataccaaattggagttggttgatgatgagccgttggtttagtgccgcttgaagcatgtcaacttgcatgggattgaagttagagacgccaaagtggcgcaccttgccgctagtttgcaacttgtcaaaagcggcagcaacttcttcgggttccatcagggcgtccggtcgatggaggaggaaggtgtcgagataatcaacacctaagcgttgaagttcgccatccacggctgccagtatgtgctgtttggaaaagtcgtaacgcttgccaggaacgatgccgccttttgactgaatatagagctgatcacgcgatacgtgagcctgcttgagtgcttgaccgaagatggtcgatgattgaccaccaccgtagatatcagctgaatcaacgtaattgatgcctaaatcaacagcggtatcgataaccttggtggcttgagcgacatccaaggcgtccatgcgcatgatgccaagcgccacgctggaagcttgaatattgctgtgacctaaattaatcgttttcaaaactaaagtcctcctcaatgtgcaacttgatttaaattcagtatacggttttcgtaagaggatgtaaacggttacgactggtgccgactgttggtaaatctgattttagagcaaaaaaaatagaacccaaggcttctctacttgagttctacttatgaggaataatcctgattagcaatgaaaaattgttcagtgttaatatgatacaccttcatgctattcaattttacgcgtgtccaacttctaacggactaacccgtatttattgtaactatctgctatagtcgatctaaagtaaggttgttacttgattgcgactcgttagacgggttttaacgaaagtcaaactcgcgtttaaaacttgggaatgtcttcgtaacagacatgcacctccgtttaaactttgtaatacctgagtctacaaatggaactggtaatgtggaactaacaactggtcatcggagacacctgtttccaactaaaacttagttaaaatctgttcgtcattctaatgccaattaattctttgcggttatcgtttatctaagggtcaacgttcagtcatccaacgtaaatctcacgacactcgctagaccgataacgcttcacggcgcttaaaacggtttcgataacgacccaaactgtgatactagctgtctaacattacagcgacagccaaactcttttgagaagctttgctaatcgaggattaattcctttcctcacttagtataatagcataaaccgcaaacgcttacaacaaaaacaaccgcgaattcgcaataaaaatcaatagtgactcaaaacgctgctatatcggggattataataaattttttcgagaaatagtcgcataatttgctgattgaccgatcgtttgaaaagtcggctaattagcgctaataattgattgaatatgggctgacatacggtacaatagaagtagacaagaaagcgctttatataacgatgacgtgtatcaagtgtggtggcacttataccgcgaaacgttggcgtgattaatcagtgaattcaagctggtatggaaggacgagatacgatgacaacaacgtttaaagaccgggccttcgaggcgctaggacatgtcattgaccctgaattaggaattgatctagttaacttggggttgatctatgatgcacaattgacggcggaggggaccgctgaaattaccatgacgttgaccattgcgggctgtcctttgaccgaatggttggctaaggacattcacgatgaactgatcaaattaccagaagttaacaatatcgagattgagattgtgtgggaacctgcttggaacgaaagtatgatgtcccgcgaagctcgaatggaactaggcattcatagttagtggccggcctgttcgcagctagttcaagggctgacggtcattggatagggcatgattaaggaaagacgttgctggtttaggcttgcggcgccttttttgcgtgccactgtactaattccagccagcaatacgtgcatgcgtcgagccagcaaaaaaacaccagtgacacaaccatccgtagacgattgtatcgctggtgttttagtcatgctagaaatgccgatttaaagttttggcaatggcatccatgtcttgtacccgttgtaatcagcggtgtgcagtagtttttcggcatttgccacccgatcttgggttggagactcgattccttcaagccggtacttgatcttcatttcatgatattttttaacgcccaaagtatggtacggcaatacttcgactttttgaacgacgtcgtttggaatcttagcaatgtaatcgccgagtttcttcaagtcttcatcgtaatcagtccgttggggaaccaggacgtgacgaatccacatatcatcgtggtgttgggccatgtactgaatcatatccaagatattttcgttcccatactgggtcaactgcttgtgtttggcagaatcgatgtgcttaatgtcgaccaacgaaatgtccgtgaccttcattagacgttcgaacttgtcaaagaaaggttgttctcgggtaaaaggctgtccagaggtatccagacaagtactgatattcatcgccttggctttttcgaataagtctaagatgaagtcgatttgtaccagtgattcaccaccactgactgtgatgccacccgtcttgccccagaaagcccggtatttagccgcgtcttcgagaatctcgtcggccgtcatttgatcgccaacgttgagtttccaagtatcagggttgtgacagtattggcaacgcatgtggcatccttgaaggaatgccacgtaacggatacctggtccgtcaacggagccaaacgtttcgatggagtgaacgtagcctatcaaaggctcctttgccgccgcttgcgttgttgaaacttgtttgttttccatgagcctttcgccttcttaactattaaagattaaatgttacattgattcgaagaatgtccgtgaaataacgtcatcttgttgttccttggttaaatctgcgaagtagacacagtagccagaaacccgaaccgttaatgttgggtattcttcagggtgtttctgagcatcaatcaaagtgtctttattgaagacgttgatgttcaagtgcatcccatcgttcttcatgtaaccgtctaacatgtttactaacgtgtctttccgtgattcgaggtcatggcctaacgtgttaggagtaacgccgaacgtgttggaaatcccgtcagttgcgtaacggtatggtaatttggcagttgaaagaagtgaagctaatgcaccactcttttcagcaccgtatgcagggttagcacctggtgagaatggttcgcctttttgacggccatttggtgtggtaccagtgttcttaccataaacaacgttggaggtaatcgtcaaaacagaagttgaaagtttggcattccgatagaggtgatgcgtgttcatcttgctgtataattctttgactaaccatttagcaatgtcatcagcgcgatcgtcattgttcccataacgtgggtagtcattgtcggctttgaagtcaacggcgataccacgttcgtcacgaattactttaacgtgaccatacttgatagctgagattgaatccgcggcatgtgataagccagaaatcccagttgcaaaggtccgatcaagatcagtattcttcaaagctaattgggcagcttcatagtagtacttatcatgcatataatgaattgcattcagtgagttaacgtaagtgtcagctaaccaatccatttgcttgtctaatttcttcatgaattcgtcgtaatcgatgtattctgaagtaattggttcgtaagcagggccaacttgatctccagcaatttcgtcgcggccaccattgatggcataaagaatcgctttggctaagtttgcccgggcaccgaagtactggattccatcagcaattggttgtgcggaaacacagcaagcaatgccataataatcggtaccccattgtacccgcatcaagtcatcattttcatactgaatggttgaactgtcgattgaaacttcagttgcgtaacgtttgaagtcttctggtaagcggtctgaccataaaatcgtgatgtttggttctggtgcggcgcccatgttgtccaaagtctttaaaatccgaaaagcggtcttagtcacatggtgttgaccgtcgacgcctaaaccacacattgataaggttgcccagattgggtcaccagagaagagagaattgtattcttcagtacggatgaaccgaaccatccgtagtttcatgacgaattgatcaattaattcttgagcttggctttcgtccagaacaccattgtccaagtcacgttggatgaagatgtccatcgttgtatcaatccggccaacggacattgcagcgccgttttgggtcttgatagcagctaagtaagcgaagtacatccattgaatagcttcttgagcattagttgcaggcttgctaatatcgtagccataactggcagccatcttcttcatatctgctaaagcacggtattgatcttgaacttcttcacggaggcgaataacatcatcagtcaattcaccatcaccaatgtgggcaaagtcattagctttgtcttccattaaacgatcgatcccataaacagcgacccgtggaagatcaggaatgagacggccacgtgcgtatgcatctggtagtccggtgatgatcttgtagtgacgtgctttccgcatgtcaggagtataaacatcgaagacgccttggttatgagtcttgcgatattcagtgaaaatcttgtcgttttcttcatcaggggtataaccgtatgatttcaaagcgtcatcagccattcgaataccaccaaatggcatgaaggcccgcttcaaaggcttgtcagtctggagaccaacaatcttttcgagatctttttgaatataaccagggccgtgtgaagtaatcgttgcaacgactttagtatcagcatccaacacaccaccagcggcacgttcttgtttctttaattctaagactttgtcattcaaggtcttagtagcggctgttggtccggccaggaagctttcgtcgccattgtactgtgtgaagttattttgaataaaatcacgaatgttgatttcttcctgccagtgcccgcctttgaaacctttccaagctgctggttttgttgtcttttctgatgtaatcattttctcgcctccataatttgaatccaatcaaatgattgataaaattctatatttgaatcataacattttttgctggatttgtaaccgctttcaggtgatttatttcacgtttgggttatttttttgcaatctattattgaaaagttgactattaacgttgatataacagtacttacatagctagataggcattggtaattcacttaattatatttagaaaacggctaaaaacaagacttgttttgatatataagtggaatattgtccataatgtaacaagtgtttaactagttaattaataaaaagtgcaacgaggtgtggagggtgttaaaagcgtttgccgttgattttatgaggaagttcgttatcataaagaagataagcagaaactagtgaatgtagtgaaaggtgggcgtaatgcggatgctcgaacaaattgaacaatatattgacagttgtattgaagctggcgacatttatggggcgtcgtttagcttgatcacccctaaaggtatcaatcaatactatcatggtaagcagggccgcgatgagtttgccgtgggcttagatcctgcgatgatttatgacctagcatcggtaactaaggttgtagggaccacgacgaggatttttcagttgttatcggaccacacgattcatttaacggactcggttgcccggtctttacctgggttcactcatcctgaaataacgattaaaaacttgttacttcataatagtgggctaccggcagatattgataacctggataagatgcaacgtgaagatctgatcaaagcggtttatgatgcgccactcgtcacggcaccagggacaacgtatgtctattcagacctgggatttattttattgggatggattattcgtgcggttgacggctcattggctcggagtattcaagaccacgtttgctatccactagcgatgaccaatacgggttataacttaaatcgtccgaagattcggtttgtgccgacggagtttgatccgcggcggggtcagattcaaggacaggtgcatgattataaagcctttttgttgaatggtgagagtggtcacgcaggcttgttctcaacgctgacggatttatccgtatttattgaaatgatgttaaactttggtgaatatcaaggcaaacgggtgctggatgaaaatgtctttgactggttaggcgagtatgacgaaaatggccggacgttaggttgggaacgacgtgcgggacgacatcaatatttccatactggttttactggcccggcagttgcttttgatttggatcgtcaaattgggctggttgtgttaacaaatcgagtttatccaactagtgacaatcaggtctggaaccaagatcgtaagcgagtattcgatctgttttttgaatcctgatgatggcagcttcattaatagttagtagttaaattaaataagcgtcgcagccacttaaggctgcgacgcttatttaattacgatttcatgacagctagaccgctgaagtgtttggcacttgtgggtgctaagcaaacgctattttgctttttgcttctatatatacgttatttttgcaaccagcgaagtccgggaacatgacgtgcaattttataaccagcggcaccgataatgacaccagcccaatttgtgatgacatcatcgatatcaacccaacgtttgaggttaaccaaccagtcaaggatgaattgtcccagctcgagtgttagccccgtaagaaatcccaaccaaataaaacgacgccagggcaagtcgggaaaattccatgccagtaaaccgcccaatggaacagtgaggagaacgttgagccaaaattcaatgtcaagttgttggaaaggaatcacgttcagcttaacgggtccccattgaatatattgaataacgagttgggtaccaaaattgtaactggtaggtgtgtagcaaaaagcagttaagacccagagaaaggcaattaaactgagttgcttaaaacgctggatatttgtgcgcgctgatcgcgcacaagcgtatagtagaacaataaacattaatgaaatcaaaaagaatggtagccaagctagcataatttagtcgctcctttaattaaatagtatagagaaagaaagctggtttgactattaataaaaagaaattcagaaaaagtgttgacactttttacttcaattggtatattagtaagcgttgctgctacggcagatacatctcaccaccaaataattattgaaattagttgttgacaacttcttcagtaattggtaagatagtttctgttgtcgcaatggcaaccacgacaaattaatcaagttacttcttaaaaaaagttgttgacaagatattgattaagatgttatgatgattaagttgtgttaagcgattaacacacggaat

SEQ ID NO: 2 - DNA, 326187 bp, synthetic construct
  source 1..326187: mol_type = other DNA; note = Lactobacillus plantarum PDG8 - Contig 2
aagatcagctcctaaaagatgggtttgtggtaaacaccattttaaaggaagctgatcttttttgtccgaacagcgttcggattaattttacaatctaccgtttgtatgatttctttcaggggacgatgcctgaagcagtgactaaaatccatcatgattggatgcactattggcaagctgtttgtcactttaaggtgattcaggttccaaatacgacggattttcgcgtcctgggtaccgatggtcaatatttgatgtacgttcattttgtggacgccgggcgacaacaattggattatgtcaattattttgataatcagggtgttaaagtccgacgcgaattttatgataaccggggcttcctgagccggacaagctttttagtgaaacatcaggaagtgcacacagaagtgtattatgatttacaagggcaagtcaaaattatcaaacagtatgacattaccgggccagagccaaaactacgactgattacgttgaagaactatcaacaaagagactttttcttcaataccgaacaggcttttcagacattcttcttcaatgagttggccacttctgatgacgtctatttctgtgatcgtaaccgacaaacggcggcggccttaggtcatacgcgccccgcaattcgcgtgtgttcagtcttacatagcacggcatctacggattggtgaggacgtggtaagtgggcatttgaaatcggtctatcggtatgtcctagcccatccagaccaatttcaccgaattattgtgtcgaccgagcatcaaaagcgtgatttattggcacgctatgataattcaccaccagttgtcgtgattccagtcggctatacaacggttcatccggttaaaattgatggtcgtgacccgcaccggattattagtgtggcgcgctattcgccagaaaagcaattaccacatcaactggaagtggttcgtcggttagttggtgaatttcccgacctgactttgcagttgtttgggcatgggcaaaagattgaaatgcaaatgcgtcaatttattcaggccaatcatctagaaaaaaatatcgttattcggggtttcttgcccaatctggcagaagagtaccagcgggcaagcctcgccttaatgacgagtgtggaagagggcttttcgctagccacaatggaagctgaaagctatggcgtgccggttattggctatcgaattgcgtacgggccggaagatattatcgaagatggcgttaacgggtacttagtgacacccaatgatgttgatgagttgacaatgaaagttcgtcagtatttacagcaccctgaacgacaagcacaactgattacgaatgcctacaattcagcaactcgttacagcaagcagacgattattgaaaagtggcgccagttaatagcagcactttaagaaccggtgataggggcaaacaaggcgtctaccgagtttaagagactaggtagacgccttgttgttatctagatattaataaagtaataaaatcagtgccaactgaacggctacgttgatcatgagatgtaaccgagtacggccaaaggactgttgactgaaccagacagcaatcgtgatgagaattgcaacgatcgtttgccaggtcagcggctgcaggaagatggtgataacaagtagcaggccagtgatggccgaaatcagttgattgatttggcgctgacggctgaagctcggaacgtataggaagacataactagccagcatgggggccagtttccagagaaaagtagttgataaatagttattttgtaaatcgaagacggccactgggatcgtgaacgtcatgatgacgccgaaaacgactagaccaaagtagttttgcataccgaagcgtggaacagccatcacgagcaaccacgcactgcacgttaatagcaggtacagtagttcggattccttggcaataatgttggtaaatgcaaaggccacggtaattccaattgcaatgaggctccactggggagcaatccgccgatctaagataatgaagaccgcggcggccacggctaaggtgtagccaatcagtggtaactgcgcggctgaaaatgaggccgtttgaaatgagcgcccgtaatcgagggcggcccaccaactaatgatgctttgaacgatggtaaagatcgccaaggcgatgtaatcgcgtttaatatgtaattttccgattcgaatcatattgtcaacactctctaattaggataatgagttaatcgtaccggtcggggcagttcccgtcaataatttgacagaaatctttaaaaaaaatggtgattgtgataaccttatatagttatgagccgttcccgaaaggataagtttagcttgttcaatgaagaataagtgatgcttagatgccttgtaaccgaaattatcaagggggaatttattgtgagtgaaagacacttatttacatctgaatctgtctctgaaggtcatcctgataagattgctgaccaaatcagtgacgctatcttggacgcaatgttagcccaggatccacaagcacgggtcgctgttgaaacttcagtgacgactggattagtgctggtcttcggtgaagtttcgaccaaggcctacgttgatattcaaaaggtcgtgcgtgacacgatcaagtcgattggctatgttgatggtcaatacggctttgacggtgacaattgtgccgtccttgtctcattggatgaacaatcaccagatatcgcgcaaggggtcgatgattccttggagacgcgttctggcgatgctgacccattagatcaaatcggtgctggtgatcaagggatgatgtttggttatgccatcaacgaaacccctgaattaatgccactgccaatcgcattgagccatcggttgatgcgtaaaattgcagcgctacgtaaggatggtaccattaagtggttacgtccagatgctaaggcccaagtcacggtcgaatatgacgaagacaaccaacctaagcgaatcgacacggtggtcttgtctactcagcatgatcctgatgttgatttggacacgatccggcaaacggtcattgatcaagtcatcaaggctgtgttaccagctgatttattagatgaccaaactaagtatcttgtgaacccaactggtcgttttgttattggtggtcctcaaggggatgccggtttgactggtcggaaagtcatcgtggatacgtacggtggttttgcccatcatggtggtggtgccttttctggtaaggacgcgaccaaggttgatcgttctgcaagttacgctgctcgttacattgccaaaaacgttgtggctgccggtttagctgatcaggtcgaagtgcaattggcatatgccatcggggttgccgaaccagtttcgattgcagtggatactgccgggaccgggaaggttagtgatgaagcgttgattaacgccattcgcgaaaactttgatttacgtccagctgggattatcaaaatgctcgatttgcaacggccaatttatcggcaaactgcggcatacggccactttggtcggaccgatattgatttgccatgggaacatactgataaagtggatgctttaaaagcagcatttaaataatgcggtaacgttgattcgttacggtctgtaggtactcgacgctaaaagcgaccttttttcaaggtcgcttttttttgcgggctattttagatgcacggggttttaaaatgattgatagagaaggagaattactaagatgcaacagcgtaaaactaacgtaatggcggttacggttgccatttacgtcgcgacgtttatgagtgcgattgaagggacaatcgtgtcgaccgccttgccaacgattgttggtgatttacacggggtttcattgatgaattgggttttctcaatttatttattgactaatgcgatgatgacgccaatttatggaaagctgactgacttggtcggccgaaaaccagtgatgcaagccggactaattatttttattatcgggtctatgatgagcggtttgtctaattcgatgccggtgctaattttttggcgggccattcagggaatcggcgccggggcgctaatgccagtctcaatgacaattatcgcagatatttattcattcgaacgccgggccaaagtgctaggcttcaatagttcagcgtggggcattgcgtcagtgctggcaccgctgattggtggactaattgttgataggctcagctggcattggattttcttcattaatgtgccagttgggttgatcacccttttcctatttcaattttatttacgagaacccaaacgtcacaataacgtgaaaatcgactacttgggtagcttttggctgatgctcttcttgctgtgcttgatgctaagcttccaactattgggaaacgccactatcagttgggtggccgttgggactgcttggatcattagtgcgctcagtttgtggctatttattcgtcgtgaaagtcgcacggatgaaccagtgatttcgatggatttattcaaaaaccacacgtttattattcagaatgccgtggcggccttagtcagtggtttcctaatggccgttgaagtttatattccaacttggactcaggggatactgggtgtaccggcttctttggcgggattcgcagtgacaccgagctcgttaatgtggatcgtcgggtcattcgtgacgggtcggttattggcaaagtgggcgccgcgacggattttgtatctgagtttggctttcatcctcgtgacaagcatttgcttagcgtggttgccagttaatactgctttcccatggttcttcctgatcacagcgattggtggcgtgggcttcggaattacaattacagcaacgaccgtcacgtcgcaacaccttgtgccagctgagaacgtgggcgtcgcaacgtccttcaatacgttgagtcgaacgattggtcaaacgttgatgatttcaatctttggaattgcgttgaacgttgggatgaaccaaggtattcagcaccatgcaggaacgaacatggcgatgatgaacaagttgatcaatccacagacagcaacgcaattaccgtctcatttgttgccgacacttcatcgtatcttatatacgggcttacattgggtctacctgattggccttggtttggttattctagcctttattgtgaatagtttggatcgcggaccacaaaaaacggcagcacaacacgcggctgatttaaaccaaaatcaggattagtcggcttagtatcaacaaattaattgtcaaagcgactcataatttgtcgtttatttgatattgacgtaaaaaaaatctgaaaaattttcaataaaatttccataagtgttataaataaattttaagttgttagatgagtgtaatgggctttatgaggcctattacactcgttttcattaatattatttatttggtaactattttaggaaaattaatggaaaacgtgtaacaagattgacggtatcaactattgccaacaaaacataatcatagtattatgagtgcatagcctaacgattgatggtgtataccaatgatgctatatatgtgttttttgtatcatatataaacgggtttgattaggttagagaaggaaggcaaaaccatgaaatttctgagacataaatcttttaggggagatccgcaagttcactacaagatgtttaaagtcggccgtacttgggtatttacggcgatggcatcatttgtattgactgctgcacctcagttagtatctcatgcagatacggtttcggcggatactagtagcgatacggcaagtagtgccactagtagtgccagctcgggggcggatacgtcttctgcagcagcgagtgcggcggcactagctgctgcaacggcaagtagtacgtcaactagtactaccagtgactcgtctacggcatcttcttcgagtgaaactgcctcgaacagtaattccgaatcctcatcggatagttcaagcagcgatgacagtgcttcagacgcaagttctgcgagcgaaacaagtacgactaatgcgacaagtacatcaagtactagtagtagcagtgtttcaacggctagttcgagcgcatccagcgcaagttcaagtagtagttcgagctcgtcaagcgctacttcatcgagtttaactgatagcagcagttcttccgcagctagctcaagtacgacgagtttgtcaagcagtgctagcgtagcggcaagtactgtctcgacagcaagcagtgttgccagcacgactaagtctgcaagtacggcggcttcaacggcagccattgcagcttactcgtcggtatcggctgccagctcacataccgatagtaccgtagctaaggcggcttcatcatcagcttcattagctggttcatacgccacacttgccagcagctatgctagtttggtcaataacctaacgacgcaagcagcagtgagtgcggcccaaagtgcctatcaagaagcgcttaacgcggctgatttgtcacggcactacaatagtattgcaaacatgtacttagacgcattgacaaatggtgtggggtccaatgttgataatgcaatcgcatactctggtgcaaactctttagcatatagtgcagcgagtgcggccagttcatacgcagccctggcttcaacggccacctcaacggccagcagtgctgctacccaaggcttaattaatttagcaagtagcaattattccgccgcatctagtgcggcatctgcagccacggtagcagccagctcggcagctgaagcagccaacagtgcatacttagccatgcaatacgacaaaaataatacggccgttacctcagcttaaaccgttgcttctagcacggcagctgcggcttcaacggccgcggttaacgcaacgaccgttgcgatggcagcatcttcagcatatgccgctgtaagtagtaatgcggcaaataatgactatgaagccactagtactgcctatgcagttacttcctccgccgcaacggaggcgcttagtcaatacgccgccgggagcacagctactagcaccgctagttcggcagccatttttgccaatagtactgcaattagtgatttggcgagtgcggcttcttcaagtgcaaacgtggcgaatacgtcaaagagtacggcttcaagtgcggccagtgtggcggcaacgcaaactggcactcaagcgtcagcttatgcttcaagtgctgcaacggccgctagctctgcttcgtcagcctacgccgtcgccagtacggctgcaaaatctgctgtcagtgctagtgatcctgccaccgcggactcatacgctcgggtggcccaatcggcatcttcattggctgctagttacgctgcaactgctgagtctaacgcgactttagctgctaagttttcgacgaatgtcgccaatgaacaaaccgttagttccaatgcgactttaacgacgagtacggcaacgcaaagtgtctcgactggagatactgtgacaattaccaacaaggtgggtttggattcaggatattcagtaagtggtacaccaacttatgtttggtatgtctcaacggatggagcaacttggacgaccattagtggtgcaacatcggcaacgtatacaacaactgcaactacttcagggacgtattattatcaagcagtcgttagtggtaagcgggttacagcattaatcttgacttcaaattttgaagcagctggtaatgtgattaccattgttgttaccaatccagaagggacctacactgaaattgccagcagttatgccagccaagccaacagcgcagcctcagtggcaacctctcaagctgccgctgcaagtagtgcgatcagtttggccagttcttcagctaacttgacgggctcattagctagctactacacatcacaggctaattcttcatacaacgcagctagctcatatgcgagtgtggcttcggaggcagcaagtattgcaactatggccagtaattcggccgcttcttatgaagccgaaggggcgtataccagtgctaatatctgggcaggaatggcatcgagttatgcgagtgttgcaactgaatatgctagttctgcaagtagtgcggcatctgaggcagcagctagtctcgatactgctttgaaaaatgcggttaatgaagatggcggtgataccgctgctgattatttagcatcaagttatgctagtatggctgcgtcatcggcaaatgtggccggtgaccaggcctcgctagctgcatcctatgcggccaacgctgctaatgcatataacgttgctgggtcttcatttaataccactgcaactagcagttataatgcagcggcaagttctgcagctgtagcggctagttcatacgctgcggcagctagtgaagcggcaagtctcgccgcttcatatgcagcggacgggaattataattcggctgccttgcaacaaagttacgcggctttgcgtttgacctacgcaacggatcaattgaatgctgcttcgagtgcggcgagtgcgattacccaaacggttgtgcaagcacaatccagttattataattcgattgcaacagccgcttctagcgcagcgtcagcagctgaatcggcagccgggaatgcaatcagtgtcgcgagttcattaagtgcaaagtatgcgtcaaacactacgttgggtagctcatacgttgcacaaactaataattatgccgtgacaactctgggtgcagcggcggccgcaacttcagctgcggaaatggcagctcagtatacaagccaggcttcatcggcagtagctgcgggcgattatgctatggccagctcatatgtgactaatgcctcagcggcagccagtgaagcaacctcatatgcggcattgtctacatccaatgcggctttaggtagtacggcggctagtaacgcgacgaattattcaaacaatacgaattcatataaaagcactaatacgggtaatgcaacgacaattctagggattgttatttctggtgggatgacttctcaacccgcagcagtgacgtcgaccgtttctggtgggacctttaccttgtcagcttcgtcagcattaggactaggtggggttgcactatcatcaaaaacaacttggtatgttcaagttaacggcacctggatgaccttagataaggctggcgcttatattgaatcatataatccggttgacagtgctggtttactgtcaactagtagttcattaacagttactatcaaagcgggctatactggatcattgctgttccaagccgtacaagggttttcttgggacttgttaaactgggttacagtttatacatttgcaagtaatttagctgaagtcgatgtttatagtagcaatattccagcaacaaacatttccatagctggtgatgattacgtcattaatccaacgaacagttcaagtggctcaaacgataaggttactagccagtttacatcaacgactaaccctgagaatgctactggaacgattacctggacgacaagtgattcaagcattgcgacaattgatgattctggccttttgaccgttgtgtctaatggaacggtgacaatcacagcaacaattacaaatgctgacggaactagctattcatcttcaaagacaattacaattggtagtggccttgaggatacaactgctgatgcaggaagtgatttgacgtgggttccagatggctcgactacgggtactgggactaatattacttatcaatggtattattcttcaacagcggacggtactggaacagcgctgagtggtcagactggtacgacacttaatctgtcggatctgacagtagggcaatccggttattactacctagttattactggatccaatacgactaacgggactactaccacgacaactgtaactttaggccgggcttacttgactgttaatgctgtttcaactgaagcggcagattctgcagctagcgaagcagctaactacgcaaatcaagcgacggaatatggttcagttgctagttcttatgcgaacattgcgggcgaatatgcaagtaaaaactcagaagcaagctcctacgcagaacaagcaacggaagcagcttctgatgcacagtcagctgcaacagctgcttcaactgcagcttctaatgcggcagccgcccaatcaaatgcagattctgcggaagctgccggcgaaaactcggctgcttccagttatgcagaggaagctaaaaagaaagcgtccgaagcatctgaagctaaaaagaaagcttcaagtgccgctgatgatgcaggctactatgctgatttagctgctaatgttagtgaagatgactcggatagtgattctgacggcgacagtgattcggatagcgacagcgattccgactcagacagtgattcggattccgatagcgactcggactcggacagcgactcggactcggacagtgactccgactccgacagtgattccgactccgatagcgactccgattctgacagtgactcggactcggacagcgattcagatagcgacagtgattccgactcagacagcgattccgactccgatagtgactccgattctgacagtgattccgactcggacagcgactcggattcggatagtgattccgactcagacagtgactcggattcggatagtgattcggattcagacagtgactccgactcggatagtgattccgactcagacagcgattctgactcagacagcgattcggactcggacagcgactcggattcggatagtgactccgactcagacagtgattcagatagcgacagtgactccgactcagacagtgattcagatagcgacagtgactccgattctgacagtgattccgactcggatagtgattcggattcggacagcgattctgactcggacagcgattccgattccgatagtgattcggattcggatagcgactccgattctgacagtgattccgactctgatagcgactcagattccgacagtgattccgactccgatagtgattccgattcggacagcgattcggattcggatagtgattcagactcggacagcgactcggatagtgattcagactcggacaacgattccgacagtgattcggactccgatagtgattccgattctgacagtgactcggactccgacagtgattcggatagcgacagtgactcagattccgacagtgattccgactcagacagtgattcggatagcgacagtgactcagattccgacagcgactcagactcggacagtgactcagactccgatagcgattcagactcggacagcgactcggattctgacagtgattccgactcagacagtgactcggattcggatagtgattcggattcagacagtgattccgattcggacagcgactcagattcagacagtgattccgactcagacagtgattctgattctgatagtgacagtgactcagactcggacagcgactcagattccgatagtgattcggactcggatagtgattcagattccgatagtgattcagactcggacagtgattccgattctgacagtgactcggattcagacagtgattctgactcagacagtgattcggatagcgacagcgactcagattccgatagtgattcggactcggatagtgattcagattccgacagtgattcggattccgacagtgactccgacagtgattcggactccgacagtgactcggattctgacagtgattccgactccgacagcgattctgactccgacagtgattctgattccgatagcgacagtgactcagatactgacagtgattctgactccgacagtgattccgattcggacagtgattcggatagcgacagtgactcagactctgatagtgattccgattctgacagtgattctgactccgacagcgattcagactcagatagtgactcagattccgacagcgattcagactcggacagtgattcggatagcgacagcgactcagactcggacagtgactcagatagcgacagcgattccgattctgacagcgactcagactctgatagtgattctgactcagacagtgattcggatagcgacagcgattcggattccgatagtgattccgactcagacagtgattccgattccgacagcgattccgactctgatagtgattccgattctgacagtgattcggatagcgacagcgactcagactccgacagcgattcagatagcgacagtgattcggactcggatagtgattctgattccgacagcgactcagattctgacagtgattcggattcggatagcgattccgattccgacagtgactcggactcggatagtgattccgattcggacagtgattcggactcggacagcgattcggactcggacagcgattcggactcggacagtgattccgacagcgactcagattctgacagtgattcggattcggatagcgattcggattccgacagcgactcggattccgacagtgattcggactcggatagtgattcggattccgacagtgattccgattcggatagtgattccgattcggacagtgattcagactcggatagcgattcagactccgatagtgactcggattccgacagtgattcagattccgactcggacagcgactcagactcagacagtgattcggatagcgacagtgactccgattcggactcggacagcgattcggactcggacagtgattcggatagcgacagtgactcggattctgatagtgattcggactcagacagcgattccgattctgacagcgattcggactcggacagcgattcggactcggacagcgattcggactcggacagtgattcggactcggatagtgattcggattccgacagcgactccgattctgacagtgattcggattcggatagcgattcggattccgacagcgactcggattccgacagtgattccgactcggatagtgattcggattccgacagtgactcggactcagatagtgattcagattccgacagtgactcggactcagatagtgattccgactcggatagtgattcggattccgacagtgattccgattcggacagtgacgctgactcagacagcgactcaggttccgacaacgactcagactctgacagtgattcgaatagcgacagtgactccgatacaatcacagattcagattcaaatgatggaaccaattctggcaatggtagtaattctggctcagatggaagttccagttcaaatactggatcaggttcgggcaatacgacgggctctactggaaataactcaggtactggcactggtacgacaacttcatcgactgcttctagcaacggtgctgcttcgacaagtacgactagcttgagtgctgcagcaacaagtggcgtctcggccacagccgcaacgttggcggttacgacaccatccagtgacggtgctgcaacaacgtcagcaactgctgctacatcagtggtttatgccgctgctagcgctcaagacgttgatgcaacttctgatcagactgattcagattcgaagagtagtaatgattctgataaggataagaagtcagctgatactgatagtgctgatgataaggttggctcaagtaatactgacgagaatggtaagactgcatctgatacaagtaataatgccggaacgattttcggtggcttgttgaccgcggctgcagctgctggactcggctggtggttcttcttgttcggtcgtcgtcgtaaagatgatgatgaagatgacgagaatcaaaaatagttaaaatttaaagctgatttgttagtactgctaacgatatacgttgtaaaataagactattaaccaaaacgggcgtgaagcccgttttggcgtacataaaagaaaattgaaagaggtaagactaagatgcaaaaatctactgtcaccaagcttaagcaagcactgattgcaactggaaatttgaaagattacggtacaagtaccgtaaccttggcactttcggtatcggatcatcgacatcgggcccaagtgcgattctatcgttgcgattctttcaagcaagcttggatagcagttgcacaacaattagccaaaacccctcaagcgagttgggttcgattagaagcagttcaatcaacacagaagttaccaagagaaacttttgaaaagcgattggcagctacttttcggatgaactattggcgatacggtattagttttgatgcagatttcaagacagccttattggagatggaaagtaatggacaagcatttttccgtcctagcaaagcgcatcgaattggtaagaatcgttcgggttcttgggtcgactatgatcgagtagagccgtatcttaacaagcgtgaaggagcgctaccagtcgatattcgaaagacagaaaatgtttgggtctttacaaccgctggtgtatttactgacgggcagaaaatctggaatctatctgagcaagaggattgtggtaagggcgttcgggtggtgactgacgagcagagcgagctgcaatcagctattgaacatggtgaaactttcctaattaatcagttaaaaggcaatggaaaatttgtctacggttattttccggctcgtcaaagagttcttagcaattacaatgttgtgcggcatttttcgtccttatatgccttgctggaagccattccattcacaaagcgtactgaagattttgcaaaagttaagttagcgattcagtggggcttaaaaaacgccacgattgaaaaagagggcgcaatcttcgtcgatgataatggcgagctaaagttgggtggacaggccttgttaatacttgcattgagtaaatatcaagacgttaccaaggatgatactttcgtgccagttttaatgaaagcttttaaaggcgtccatttcttccaagaaccgtctggtaagttaattcatgtcctaaatccagatttaacggtcaaagcagcttatcgaattatctattatgaaggagaagtcgcatttgcgctttcccgactatatgagttaacacatgataagaatgtgatggatctggtgaagcaaatcttggattacatggtggctaatgactacggtaaataccatgatcactggatttcttatgcaatcaatgaagcattactggtattcccagacaatcgtgattatatgaaactgggtttgaaaaatgtattcagtcatctaaaattcattgaagagcgtgataccacgtatccaacattacttgagttagttgatgcggccgtcaaaatgaccgatatgattaaacgttcaggtaatgaagacttgatagcaccttatgacttggttcgtttacggcaggtattgcggtatcgtgcgttgtatgagattactactgggtgttttctacctgagattgcaatgtatctctataatccacagaagttcattggtgggttctatgcacgtcatgacaatttccggacacggattgacgattgtgaacacttcttatctgggttgatcaactattataactacacatatcgacaagcataatactaggtaacagaaagggtgactgtatgttttacttcattaatgaatatattttaggcaagaattcgagtgttgagcacgcggcaatcaaccgggtgaaattatttaaccactataaagcgccagcccagattgtgactaagatgtatgaccgtttgctacatcagaccatgggaacttttcagttagcaaaccagcaagtgctgaatatgtttgattactttcaacaaaccacggatgtgccaactaaagttctgcatactgatgacatgcatctgccagttgaatatgcggtagaagtgggtgccaactttagcaaaatttttaatggtgatgaacacgttagcaacgtcggctttattcctggaacgattgggcgcgtcttttaccaagaattcttcgacaatcaaggtaacttatcttcaactgacctgtgggattggcgaggcttcaagtccagtacataatattttggtcagaacggtaaactggttttggaacggttttataatctacaaggcgagaccgttattgagcagtactatgtacctgacactaacggtaatccgctagcgtcacgtttgattttaaagaattatcgtgatcaagcagagcgcttcttccaggacgcgaaccatttatttcgtttcttcttggccgaactcagtcatttggacaagcaaacgacgacctttattagtgatcgcccaggtaccagtgtgaagccgttgttggaacttcaggatgattctcacaagtatgtgacggttccaatttatcaggcgaaggatattaatgacccaattcattccccgttggacgggttcttaacaccggccttcgataatctgcaacactttgatggtttcattacagctactgaaagtcaggctcagcatctgcggacgcggttccctaaagctaaggtgacagtgttaccaactgtaactacgagtccgttggcgcagagtaaactacagccaatcacggcccgccccaagcaattgctatacgttgggcggctggcgccggatcggcaactggatcagttaattcggaccattgcgttagttaagcaacaggtcaaagaaattcagtgtgacttttacggctacggcgatccagagtatcttaagacgctgaataagctggttgaagaattaaaattgacgaataatgtgcatttattagattatcatcctgatttagaaacacgttatgatgattatcagctgttgctcaataccgatattgttgatggtggtccaatgagtatgccggaagccatgagtcacggaattccagtgattagttatcgctttaattatgggcctaaagattggattgatgacggtcatgacggtttcatcgttgatcctggcaatcaattggcgctgcgtgaccgggtcatcgaattaatgacggatacgaagaagttgacggcattcagcgaagccgcctttaagaagcttcatacgtcacaaactgacttaaaagtttggcaccgttggcaacaattactgggtattaagtaggagggcgcatatgtattatttcttaaacgataacatgcaattttcaaaatcaggaatcgaacaggcggaaatcaaccgactgactttattcaagaagcaccatgtggccgctaaaatcgtgacccgcgtattcgcaatgaatttgcacgatgtgcttgaaggggccaacattgccgatgctgattttgttaatctttttgacttcttttgtggtagtcagtcggtcaagcgtcaaaggtttgatttggccgactttgaagtgccagccgatgctatcaaaacccggaaggataatcagattcaagtcatggaacgtggtaagttaatcatgattatttaccttcgggccggtacggaagctgttagcaatgtgcaatactttgacgttaatggtcgtacgctcaagatgagttggtgggatacgcggggctttaagtgttttgaacaattatttgactgggacggtaagattgcccaagaagcgtactttggcccggatggattgattcacgtggagaagttacacttgttaaatcacgctggtcaggagcgaatcacgtggcgcgtcttgaactacaacgagcagagccatacttttaatgggatgaatgaactgacccgttacttctatgatgaacttaaccagttgaatgatgaacaaaatgtcttcatttgtgatcggaccgttgaatgtgcctggggcttattcaatatgaccacaccagctaagaaagtcttgcatctacataataaccatgtgagtgatgctaaggatattatgcattctaccttgaacaataattatgctaatgcgctgaataattgggcggcttgggacgcggtcatttctgcgacaccggaacaaactaaggacgtggaagcccgctttggtaaggatattccagcgttcactattccggttggctatgttgataatgctacgttaaaagccgcgccggtgaagtttgaccaacgacaaaaagacctcgtcgtgcaagttgcgcggctggcacctgaaaagcaacagaatcattcaatcgaagcctttgttgaagttcacaagcagtttcctgatgccaagttggaattatggggttatgcgaacggggatattgaaaagcaactacatgcacaagttgctgcagcgcacttggaagatgtggtattgttcaaggggtataccacggatgtcaatgccgtttacaaccgggcccaattaggacttttgccaagtcgagctgaaggattctcattgatgttgttagaagctcaagcccatgggttaccaatggttgccaatgacgtgaagtacggcccgagtgatattattcaggatcataagagtggaatcctaacgacagacggcgatgtgcaacaattgaccaaaacgattttagaattgttgaagaatcaagggcagctggcacaatacagtgctcaggcctatgaaaatgccaagcgttattcagaagaagccgttttcaagcagtggcaagcattgttagattactttaagcctgctaaggtcacggcttaagtagatttgacggcaagggagggcgcaaaatgttaatgattatgaccatttatgggaccgttaagatgtttacccgaatgatcgtgtactgtggcatcggtggtcttgtcctaattgttcgtcaccataatcgtaagaagcggcgtaacgagatggacgagggaactaagcggatcatgcgtaatacccctaaggatgagaacggtaagtatccgtgggagaagtaaggtaccattggtttttaagttaagtatctaattgaaaagacctgtcagacgaagctaatcgtctgacaggtcttttcggctaatttatcgttaaattaacgtttctgaatggccaacaaatatggcggcacatggacttgattaataaactgatattgtaggacttggaattgatgctggtctaaattcgttacgtaatccaaaacggcttgtgcttctgtcgcaccaccgggatgaccagcatagactagcaggataatgagtccgttggtgacgaggcgttcctgaatggcttttatggccgttaacgttgtcgttggtttcgtaatgatttgtttatcgccacctggtaaatagcccaggttaaagacggcacacttgataggttgatcagcggcaatcttatctgcgatgtgttcatggcccgtttgccacagagtgacttgatgggtgagcgctgctttatctaaggcagttgtcgtcgcttcaatggccgctgattgaatgtcgaacccgtcgacgtgaccagtagtcccgaccagcttggcgaggtagacggtatcatggccgttgccaaccgtcgcgtcaatcacgtggtcaccgggattgacgacttggttcattagcgcgtggctataagctaatgccgaactgagttgaatgagtgttacccccttgttgaattcatgaattagggccgcaatcgaagcggtccgtgccgataacgcatactaaaacgcgcacttatatatagtaaaacacttccaagtaaaaggccaccgattgtatcgctgggatagtggacgcccacgatgacccggctgatcatcattaacaagatggccgttatgccgagggcagtgagccagccagtcaaggcattgcggtgccagtagtcaaatgccaacacgagcagactaccgataaggacggtcgttgttgtcgagtgcccgctggggtaactataccccccaatttggacaagtcgccaagcggttggccgtggccgcatgatgacctgtttgatgagataattaccgtagccggcaatcagccaggtggtgacccaaaagaagactgcgccgcgtgggttatggcccagccagagtgccaggccgataattaacgtgattatggtgatggtgtggggattgccaagctgcgtatacgtgaccatcgcgtgttgaaaccactggggactatgatgccaaaaattagcaaccgtggtgtcaaagtgtgttaaccaaggcgcccgttgccataccgcggccgtccagcctaaccatcctataaatataagtagaatcaaactgtccgaacgttgccaggatcgttgcttcaatactgattcctccgataaataaattattgccattattatagcattttttatcaggggtccgattaatgccgatgataaaatttatcgccagcggggcttgggcccttgaaaaaaacgtgctggtttgctactatgaaaacaataactttacgactctgagaaggaatagtagtggctggtgttttgcagaaactccgtggtagttgcaaacggggattcaccaatcatgaactcaccttcgagtcttccggctgaacaagattgtaggtacggacgtggtttcgcgttaagattctcaagaggccacggtaacgtggaatcataggtggtaccgcggaacccgttttcgtcctataagcttaattggcttataggatttttttgttttttaaccgcttttactgagttgaagcatgaaaatgccatcttgaatagtcagttggaaagtcgcaatgctagcttttacatacaaggcagcaagaaaggggcactactatggcatacaaccataaagtcattgaacgcaaatggcaacattattggaaggaaaacaaaaccttcaaaacattagatacgacggataagaagaagtattacgccttagacatgttcccatacccatctggccaaggattacacgttggacatcctgaagggtatacggccacggatattatgtcacggttcaagcggatgcaagggtacaatgtcttacatccaatgggttgggacgcattcggtttacccgctgaacaatatgcgctcaagacggggcataacccgaaggactttacggccaagaacatcaaaaacttcaaacgtcagattcggtcattaggtttttcatatgactgggaccgtgaagtgaatacgactgatccaagttactacaagtggacgcagtggatctttgaacagctctataagaagggcttggcttacgaatctgaaacgttggtcaactgggctcctgatatgatgggtggaacggttgtttctaacgaagaagtggttgatggtaagacggaacgcggtggctatgatgtttaccgggtgccaatgaagcaatggagcctcaaaatcacggcctatgcggaccggttgattgatgacctggacgatattgattggccagaaaacatcaaagagcaacaacgtaactggattggccgctcagttggcgcatccattcgtttcaaggttgctggtcaacctgacgataccgagattgaagtgttctcaacgcggccagacacgctgtttggcgcaagttacatggtcttggcacctgaacacgacttagttgaacaattgacgacacccgaacaagcggacgctatcaaagcatacaaagctaaaatcgccagcaagtcagaccttgaacggactgatttgaataaggacaagaccggggtcttcactggtagctacggcatcaacccggttaatggtgaaaaactgccaatctggattgccgattacgttctggcttcatatggaactggggccatcatggcagtgcctgctcatgatgatcgggactttgaatttgcacaaaaatttgatttgccaatcaaacctgtcattgcgggtgataatgattatgaccaacaagcttacactggcgacggggaacacatcaactcaggttttgttgacggtttagctaagcaaccagctattgataagatgattgactggttaggtgaacaccatgccggtgaaaagaaggtcaactatcggttacgtgattggatcttctcacggcaacggtactggggcgaaccgattccagttattcactgggaagacggcgaaacgacgttggttcctgaagatgaactaccattgcggttaccagcaactaagaacctggaaccatcaggaactggtgaaagcccgttagcgaatatcgacgactgggtaaatgtcgtcgatgaaaacggtcgtaaggggaagcgtgaaaccaacacgatgccacaatgggccgggagttcatggtacttcttgcgttacgttgatccgcacaaccgtgaagctttggccgattatgacaagttgaagtactggtcacccgttgacttatacgtgggcggtgcagaacacgcggtcttacatctgctttacgcacgtttctggcacaagttcttatatgacttaggcgttgtgccaaccaaggaaccattccagaagttagttaaccaagggatgattttgggtgataatcacgaaaagatgtctaagtcgcgggggaacgtggttaaccccgatgatattgttgaccaatatggtgccgatacgttgcggttatacgaaatgttcatgggaccattggaagcttcgattccgtggagtaccgatgggttacatggtgccaataagtggatcgaacgggtttggcgcttaatgatcgatgaaaacaatcgtgttcgcgaccgaatcacgactatcaatgatggtaagttgacgaaaatctacaacgaaaccgttaagaaagtcacggaagactatgaagctatgcgctttaacattgcgatttcacaaatgatggtcttcgtaaacgaagcatacaaggtcgacgatttaccaatcatttatatcgaaggctttgtgaagttactgtcaccgattgcaccacatttgtcggaagaactatggtcattattaggccatgatgacacgatcacctacgccacttggccaacgtatgacgaatctaagttagtagaagacacggtccaaatcgtgcttcaagttaatggtaaggttcgctcgcacgccgaagtcgctaaggatatgggcaaggatgaacttgaaaaactagccctggcggatgaaaaaatccaggaatttacggccggcaagacagttcgtaaagtgattgccattcctggtaaactggttaacgtggttgccaactaagtaccacgaccagtatcaagttaaatgaatatcgcttaaattaatcgtgatggtgactgacaattgttggttgctatcacgattttttaactactcacagaactaattagtgcggttacgattgatttggttaagtgaataaagattctgaggacgttctggttcggtttgggagacaaatcacacgtgtttttggtgggcagagtgtgtgcaaccgcctatgcttaacttaaaactagcagtaacgtggtttaatcagcggaaatggttatcatggcggcactctgctgtaatcgaatttgagaccgcatcgtggccgctggtaaagcgtacggattggtcttttttctgtatcagccatagggtatcggacggcggtacggttcgccaatagctggtgcagttgtcaagaccttatcattaaagttcggttaaactcacgcataaggccggaattgaattgcaacttgtttgtttttcatctaaaatgattaggattgaattaagaaagtgggttacgaacatgtctgaggaatcaaaagctaatcagccccagaatgcacacgtgaattctgaagccgaagcgcaccagaagatggtgcgcgggtcggcttggatgacggctgggagtctcttttcacgggtgctcggggcgatttatattatcccgtgggttatctggatgggcgctgattatacgcaaggtaacgcgctttatgccaagggatataatatttatagttttttcctgctaattgcgatcgggggaattccgtccgcaatttctaaacaactttccgaatataatgcgatgaatgaatatgccgttggacagcgcttattcaagcggggcttgttgttgacgtcagcctttgggattattggtgccattattttatggtttggtgctggcttgatttcaacagcttttgggggctatgatgccaatctgattcccgtcttgcatgcgttggctattgccttggtgattctgccatcgatgtctttgacccggggattcttccaagggtatcaacagatggcgccgtccgcaatctcacagttcgtggaacaagtctttcgggtcatctatatgttgggtgcgacgtatttcatcatgcgcgtcgctcacggcgattgggtgaatgccgtgacccaatcgacattcgcagcattcgtcggggcggctgccagcttcttattactcggttggtattatttccgcaaacggcccgagctaaatgccttagctgctcagagtgagaacaaactagttattccagtctggcaattgttccgcgatattattattcaggcgattccatttattgtgatcgataccgcaacgacagtcttcaacctgttggatcaagcaacgttccaaccgatgatgcggctggtttaccatttgggtactaagcagatcgatacgttgtatgcttactttgcatttaatgcgaacaaattggtgatgatcattgtgtcattggcgtctgcgattgccgtgacggtcgtgccgattttatctgaatcattggccagtcataatatgcgtaatattcgtaaacaattggaagattcgattattttattcctatttatcatgattcccggagcgctggggatggccgcagtggcacaaccacttaacacgctcttttatagttatgatcaaattgggaccttgattctgcagatctcagcatttaccgcgattgctttaggcttttttacggtgatttcggcgctgatgcaaggcctatcacgcaaccgcgatattattcgctattacttgatcggcttactggtcaaaatcgtgattcagttaccatgtatctatttcctatcaacggcggggcccctggttgcgaccgcgattgggatgatggttgcgagtctgatggcgatgtatgatttggaagtcaactttggaattcggtacgtgaagttattaccaaaaatcaatcgaattttagtttattcgattttaacgtatgtcacggcacgattagttgtttatgggctgaactttgtgttgaatgagcacagtaagacgcaatcgttcttgatcgtggccctagcagttatcgctggtggtgcggtttacgtttacttagcactccgttcacggatggctgatttgatgattggaacgaaagctgctgggttacgacggaaattacggattaaataggtgaattatgcgagtagataaatttttacatgcgatgcgaattggcacgcggactcaagtacgtcgtctgattaaagatggtcatatcactgccaatggtgagccagtaatctctggcaaacaacagatcaaccctggcagtgacaccgtctttttagatgacgtgcaggtccgttaccaacaatacttctattatgtgatgaataagccagtcggggtcatcacggcaacgacggattccgctgcgaaaacggtgatggacctgttcaatacgacggattttcgtgacgatctatttcccgtgggtcgtctcgataaagatactgagggaatcttggtcattacgaacgatggggccctatcgcacgacctattgtcgccgaaccaccatgttacgaaggtctatgaggctgaagtaacgggggaaatcactgcagctcaattggctaattttaatgatgggatcacgttaaaggacgggactgaattgcaaccggctcaggctgagattgttcaattccatgaaatcgagaattttaccacgattcgaatcatgatccatgaaggcaagtatcaccaagttaagcggatggtcggaacgttaggtgaacgggtcgtcgggttacggcgaatcaagtttggttcgttaacgctacccgttggcttattagcggggaactatcgtgcgctgactgatgacgaactaacagcgttgaaggcggatgcgaaccaacccgtaggcgaatagtgcgtgttacgaattcggccactctggtttaaattaaatcattaagccccaactaactatgaattcaagcatggttagttgaggcttttttagcataatgtcgttggcttgttcgtgttcattatggtccagctagctaagggcgttcaatctgactaaagcggtgcatgtaagtcggaatgcgggtactgatttgatgcggcaagacgacgtaccgcgttgcagcgaggtcatcggcaatggcactgtgcaagtagaccgcgctgagaacggcatcggtgaaattatgaaattgacttacgaagccaccaatcataccagccaacgtgtcacccatgccgccggtcgccatggccggagtgccgccggggttgaaccagactcgttcgtcagtgtagacggtcgtgcgatgagctttgaccacggccgtaacacctaaccgttgttgcgcgtcatgattggcagttggggtttgatctttgatcgcgatgccgctaagtcgttgccattccatttggtgtggcgtgaccacgatgtccgtggcgggtaaggtgcgggcctgctgtgcaagcaaggtcagcgccgaaccatcgatgaccaatcgttgtgggacgtgcgtcgcggcgagaacggcggtcagtaactgatcagcgacggtatctgttccaaggcctggaccgatgacgataacgtccattcctgctagcaggtttaataaggtgtccgtttgatgatagtcaatgaccatggcttctggtagccgagcatgtagactcgtgaaattagacgggtcggtagcgaccgtcaccagaccggcaccactatatgttgcggccgttgcggccatgatgatagcaccaccaaaattttgattacccccaatcagcatgattcggccgtaattgcctttgtgagaatcagccggtcgtttgataatcgttcggctaacaatttcagttgtaataggttgcataaaatgaccagctttctaagttaatttactttgagtataccattttccaaaagcggttacttacgattattaagttgacgatagctatgataaaattaaggtaacaatatgtgggaggaatttaacatgtcagttgattggaaaaatgaagcaactaagcatcaagatgattatttagcagatttaaccaccatgctccgcgtaccgagctttcgtgacgatagccaggcgacggatgatgcacccttaggccctggtcctaagcaagcgttaaccacgtttttagcgattgcggaacgcgacggctttaagaccaagaacattgataacttggtcggttatgctgaaattggtgagggggatgaaaccttggcaattttagcccatgtggatgaaatgcctgctggtaacggctgggatacggaccccttcgaaccaaccatcaaggatggcaagatgtatgcccgcggcgtttccgacgataaaggcccgggaatggcggcctactatggcttaaagattgtcaaagaacttggcttgaagctcaataagaagattcgctttatcgttgggacagatgaggaaagtaattggactggaatgaaacgctactttgaagttgaaccagcgccaaccttgggcttctctccagatgccatgttcccgttgatcaatggtgaaaagggaaatgtgagtctgcaattacacttcggtcatgaagataatggcgactttaaccttgtttcttttgattctggcttgcgtgaaaatatggtgccgcgtgatgccgaagccgtggtcgcaacggatgacaacgagcagttggtggccgacttcacagcgttcctggaccagcaaccagtaactggtgaattaacggtcgttcctgaaggcgttaagctggaagttgttggaaaggccgcccatgggatggaaccacgtaacgggatcaatgccggaacctaccttgcaacgttcttgactaactatgcctttgctgatgatgccgctgctttcttagacttcgtggctaataagctacacgatgattcgcgggcgaaccagttaggcttagcttacaaggatgacgttatgggtgatttgacgatgaatgtcgggttactcagcttcgaccatcaaaagggtggtgcgttaacgttgaacttccgttatccgaagggaatcgaacctgctgatttaacggcgaaagtccaagcgcagttaccagctggtgccacggtcacgcagggtgacttcatggtgccacattacgttgaccctgaagacccgatcgtcaaggatttgatggacgtttaccggcgtcaaactggtgacacggcctcacaaccacaaattgttggtggtgggacttatggccggatgatggctcgtggggttgcctttggggcactcttcccagataccgaagatacgatgcaccaagccaatgaattccaaccaattgacgaattaatggctgcaatggcgatttacgctgaatcaattgccgtgttagcaaccgacaaatagtgatcctttaatggagggtgatggttatgacgatggttaaacgcattttagtcggcatcgatacgagtcctcagtcccaattagctttaacgaaagcaattaagatcgcggtcgagcaaaatgccgctttggatattgtgacggtcattaatactgagaaatttattggtgtgactcaagggccgatgggttttggcgcaacgacaccgcaggcattgaacgaattgacggccggtcttaaagcgaatctcgctaaggctcgccaacaagcgatggccgcgggtgtcagcgatgtgcgggttcacttacattcaggtaattcgaagttattgttagcgacgactttaccggatcgctatggcactgacttgatcgttgttggggccacaggtcttaacaacgtggcacgggtgttaattggctctaatgctgcttatgtgattcgcaatgctacctgtgacacgttggtggtgcgcacagatgctgatcaacagccagtcaaactgccaaagcataccactcgtcggctttaattgaaatttttaggacatccgatagtgtgtccggataaacatttgagcggctttttcaagctcgatatcggacacagagaaaaccgactcacggtggaccgttatcatccatgacagattaactggtaggacacagactaaatagttgtttcgagaatgtacaaattcttgaaacaactattttttattcactccgaatttgttggtggggcgctgtttatgaaaaaaatacataacccatacgttatttttacattatgccaacattcccgatacgttggtctggcatgattaaagagtaatctaataaattacaaataaaaggtcgaggggatatgaatatgggaattaccttgcagaacatcacaaagacgtatgataaggcgaaacagccagttttaaacgatgtaaatgctgagattcaagacggggagttattcgtgattgttgggccatccggttgtggtaaaagtacgctgctgcggatgattgccggtattattccaattactagtggaaagctggccatcaatggtcagatcatgaatgcagtcccaccaaaagatcgaaagctgtcaatggtttttcaaagttatgccttgtacccttttttggacgtggctgccaacgttgcgtttggtttacaagcacgaaaaatgccggccgcggaagtcgagcgtcgggtcaatgccgcgttgaagatggtcaatttgacggcttatcgtgaccgcaagccgcgcgaactatctggtggtcaacggcaacgagtggctttggctcgggcgattgccagtgatgctaaggtttgcctgatggacgaaccgttatcaaaccttgatgcgcaactacgcgtgcgaatgcggaccgaaattcgcgaactgcaacgtaagctcggattgacattgatttatgtcacccatgaccaaactgaagcgatgaccatggccgatcacgtaatggtgttaaatgagcgtcacgtgcagcagattgatacaccgttagatatttataatcatcctgctaatcatttcgtcgctgaattcttcggtacgccacagattaatttactgccagtggtgacgaaaaccgctcgtaatttacacgtcgcggagggctttcagattgcgcttaaccaaccattaaacgcggggagctatacgattggtatccgacctaatcagctaaacgtagtaccagttactgatgagcgcggtaatggcaaggtcacgaatgtcgagacactgggcgagatgacgattatcgaagtgcaggctgataacgggacggcattgcgagttgcacaatctggtcaggtccaattaccacttgaacaacgggtgaatgtaaccgttaatggtaagatcttcatttttgatgagcacgaacaactgattgctgaagaggagggtgttactagtgatcaactcgtttccgtcgattaagcgacgccttaagccgaaacaatcgccagatgcgcatgaccaagcaactgtgcagaccggcagttttgaattaaagcgtaatgataaatattatgcttggctatttcttgggccctcaatactcgccctcagtgtttttgttttctatccaatgttacgcaccttgtatctaagctttttcttgactaatagtcttggtgaaccaaccgtctttgttggtttgcaaaattaccttaatttgctgacgactaagagttatcttgctagcctgcaagccactggaatctatgtcgtgggtgtgacagtgttcacgttaattggggggttactgttagcggccgctgccaatcaaagggttcggggtatcgagctatttcgaactatgtttacctcgactatgggagtgtctgtctcggtctccgcaattttctggttattcatgtttaatccatccgtgggcttgttgaataaggtggccatctggatgcacttaccggcaattaattggttaacggagccacactgggccatggtggcaattattatgacgagtgtttggatgcacctcggatttacttttctgatcttttttggggcattgcaagtcgtgcctaaaaccttatatgatgcggccgatgtggcggggaccagtcggcgttatcagttcatccatatcacgttgccgatgatttcccccacactcttctttgcggcggtgattacgttgatctcagcgttcaagagtttcggattgattgacttgatgactgcgggtgggcctacgaacgccaccaacttattagtttaccgtatttatcgggatgccttcgttgatggtaactatgcgcttgctagcacggaatcgatcatactagcaatcattattgcagcgattacggtaatccaattcaaacttttagcaaagcgggtgcattactaatggaaaatacgatggctactcaagccctgattcgacatcgaatcggtatcggattccggtacttgttattaattacattaacgttagtcattattttaccgtttgttttagggttgtggaccagctttttaccaacgacgactattgcgaaaggatcactgagcggaaccctttcttggcagaactatcaggatgcgtttaccaaaacccccattcttcgctacttatttaacagtttaatgatttcaatcattcagatgattgctcatctgttttttgcatcaattgccgcctacgcctttgtgtttttagaatttaagtatcgggatgcgttgttctacttggtcttggcaactatgatgctaccatttgaagctgaagtgattccgaactttcacacggtccgtgcgatgcacttgttgaatcactatgcggtgatggttatcccgttcttaacttcggcctttggtatcttcatgttacgtcaagcctttctgcaaattccgcgagacttaaaggaagccgctgatgttgatggtctctcacactggcaattttactgtcgcgttgccttaccatactcacggattagtttattgacgctagctgcttacagctttttaggaagctggaaccaatatttatggccaatgctgaccacgttttcaaatcggctacgtccggtccaagatggattgcggcaattgcattcggaagaaaccgctacgaattggggactcgttcaggcgagtgccgccatcgtggtgattccaacattgattgtccttttctgggggcaacactactttaaatctggattgaatgaaggttcggtgaaatgatgaagataacgcgaaagtggcagtggctagccggtatgatggttgtcctcttggtagtgggtgggttcgcttatagtcggacccgtgtccatgcggatagtagtcgcattaaagtggtgttttggcatgagatgaaaggtcctggtcaacaagcgattgacgcctacgttaaagcgtttaatcaccaacagtccaagtatgaagttgtagccgagtttgagggtggctataatggcgtcattcaaaaaatcttgaatacgcatgggacggccgcgtcaccagcgctatttcaatcgatggatatttccaccagtcagatgtatcacagtggtttcacgacaccgatgcagaaatttattgaccgtgaccattacgatgctgatcaaatcattccgggcgccaaggcgatcgtgatgcgcgacaatcaattgctagcaatgccgtttaatgcatcgcaaacggcgctttattataataagagggtcttgcgtcagtacgggattacgccgccaccagtggatccgacttacgatgatatcacgcgagtcgctaaggccatccacgacaaatcccacggcaaagtcaagggaatgacaatggaggcctattcgtggctattcgagcagctggtcgctaacgcaggtgttcccgttgccaatcatgataatggtcatactggcaatgcgactaaggtcgactttacgagtcccgcggctatcaatgcgatgaagtgggttaaagaaaatattgactatggtgactttatgaactttggttcgggtggtaatgctgctgcaaatgaagcagcttctttcttggcaggccatttgggtatcttcatgcaatcgtccgcgaacacgggtcagttgtatcaagtgctcaaaaatgatctaggtgtcacatatttcccacggccgaatggtcagagagccaacggaatcgcagttggtggggcggcactttggattgcgaacgataaaccaagcgcggtccaagatggcgcgtgggaattcactaagtttctcgctagcgcacagacgcaagccgattggcaagccaagactggttatttagccgttaataagggggctaaggacgagccaatgctgaaaaaactattcaagaagtcgccggtcctagaagtttctggtaatcagatgctacgaacgaagcctaataatacgaactcaggtgtctttgtcgatggttgggttcccgcacggacggcgattcaaacggcgatgcagcagatttttgcaggccaagatattcgacaattgttgcaaacggctgaaaatacgtacaataaagtgttagaatcaaataaccgtgcaaacggtcgtcattaattggaaagagttgaagaattgtgccaaatatgtcgttgatttatggtcatcggggcgttcccgttaagtttcctgagaattcgctagctgggtttgcgtatgccatcagtcatcatatcgatggcttagagtttgacgtccatcttacccaggatcaaataccagtgattatgcatgacgaacgaatcgatcgaactactaatgggcaaggggccattgcggatctgaccttcgaacagttgcgtagatttgaattagcaaatggagagcccgtcccatccttacaagaatttttaaacttagtgagtggggagcccgttcacttgaaccttgagttgaagactgatcgacactattatcttgatatcgagcggattgtgctacggatggtccggcagactgacttaatttatccggtcgttttttcgtcgtttaatctgaagagtttacagcgggcctacgccattgatgccagccagaaatatgcttttttgacttcagcgcgtctgggtaatccggatgagtttgcgactcacgaacacttagaaggggtgcatcttgaacactatcaacctgtacaccatgttgctgaacgggtttggacagtggatgagccaatcgtaatgcaacaattgttcgcagcctcggtcaatgcggtgattaccaataactttgagttagcccaacaagtccgggcagccatgtaatcgagcgcaattgtgctagtgcggcattcaaagattgtcgtttggtaatgcgacactacccgcgctacctagttagctggtcgcgagtcattaagaagtttctgtattgtttgctcgctagattgtgcgcaataaaagcgctagtccccattatcgggactggcgcttttagcatgattaattaaactgtggttggattgcgaatcttgcctaattcagaatcgatttgagccagcactgcttgttggttagcaggtttttccaagtcgtactgttgtaaatcaatcttcattttagggctagcatcgtattcatcgtaccatttccgataagcggtccacatcttatagtaataagattccagttcagggttgtggtcgaactgttcgtagtcgcgaccacgcttcttgatccggtaaagaatcgtatcgaagtcagtttcagagtagaccatcaagtctggtgccttcttaggcagttcagtcaattcggtcatcatattgtctagtagttgcaagtaaacattcaattcagtgtcagagatgtttccttcagcgttgttttctttggtgaagagggcatcttcatagatggagcggtcgaggacgttgttatcgtcggccaatgccttcttgatcattgcaaaacgtttgttgaggaaatagatttgtaataggaacccgtaattcttaggatccgaataataaagtggcaatacggggttgtcgccaaccggttcgtaaaatgccttagttccaaggtggtcagcaattaaccccgttaacgtggttttgccgaccccaatcattcctgctgttattatcaccatgatagcccctctttataaaaaattgcacaatatattgtatctcaaaaaaagttttaataccatatagacttttaatgaaaaatttgcttgggagctattttcacttattttttagcctgttcctttaataaatcacgaatttcttctagatattgcgcggaaacatcgacttcttcttcctcgggttcttctggttcatttttaaccactttattaataattttcaccagaatgaaaacgacgatggcgacgatgaagaaattaatgatggcatttagaaaggacccgtacttaaaagtagcatcaccgatactgaactttagattggataaatcaactttgcctaagaaaatcccaatcagtggattaattaagttgtctgtcaacgatttaacaatggccgtaaaagcggacccgataataaccccaacggccaaatcaatcacgttaccgcgggcaataaattccttgaattctttgatcatgcgactcgcactcctttattaattgactgttaacagtatagccaaaatcaaacgctgactcaatcaatataccaatctaatttaaccgtaagcttgtccctaactaaagcatacccatactaatttgaggtggtatcatgattagttttgtttggatagtgacttaatgttgttctgaatgattgttgtggtgcatttgagactagttaatggttttagttagttgggctgttgactgacaagctagatgacttagcgtgtgtgacatccggtcaaaatgagtctgtgaaaagcagtctcaagtaatggggaagtcgtttcaatattagtagggattttcacgaatactaataatatggtagtaggttaaggtgttgaccagcgaatcagaattaacagcaccatttgggtaaagtcgtcaacttagttagctgctaaaaacgactctctctgatattgagaaagtcgttttggcagtgtttcgagatcataaatccaaataactaattcgttttattgtcagatgctttagcttgagcctttcgccgaaccaacgtggctaacttactctgagtggctttgacggcgacggggtcttcaaagtcaatttgagccagccgagggtaacgacggataaagaacaaccaggtcagagcaataaacagcattagaatcagtgctaagacgcccatctcaggaagagcagaattaccagtcattaaggtctgccgcaagccgttgacgctgtaactcattggtaaccacgggtggattgtttggaaaaagtgacctgacagctgaattggatacgttccggctgaaccaccgagctgtaagactagtagtaccatactgaagaaggcgccagctttgccgaagacaaggttaagccaagcgacgatcgtcatgaagagtagcgccgttagcgtgagtaacaaccaagtggcaaacggatgaatcgggctgagtccgttgattaacatcatcaagccgagcataatcgtactttccatgattgaaaagacgagcatgatgctggccttgctactccaccaatccagtgccgattgcgggtgtttgcgtggggtatacatatcaaacatcatattgagggcgagcgcgccgacaaataacgagacacttaacatatacggcgccataccagtaccgttgtttggtacatcatcacggtcctggtgagttgtagtgacgggtttggcaacttgttgatacgtcagttttgatggattgagattccccttgcttgcggccgttcctaatttggtcgctaatgcttggttaccagtttgaatcttattaccagcggttgtaacttggttagcacccacggctagttgctgagctccggtggctaattgcccattgccactagtgagttgctgactgccattagcgagtgcaatacccgttgtgccgagtcgatgtaagccagtggtgacttgttgactgcccgtaactaactgtgagatgccagttgttaagctgggtaggttggtctgtgcaagattgaagacccgtagccacgcggctggcaccttgtgttagctggttgccctgggtgctgagttgacgcgtgcccgcggtcagctgttgagaacccgcggcaacttgccccgcacccgtagccagttggtgacttctctgattgagcaagttggtgttagcatccagtgttttaaagccttgggtgagctgctggctattagttgtgagcgttgttgttccgctagccaagtttgtcgcaccagtagtgaacggccccaatgccattagtgagattaggtaggaccgtgttcagctgggttagactagtactcagtttgttagccgcgttaccagcagattgaataccggttgtcagtgattgcgcaccggtagtgagttgggtgaccgtggtgacaaggtcagcctgctgttgagtcgtggcgctgagggccctagtcaaagcagtcgtatctagagccggttgcgtcgactgggcgatggccgtggttaaactcgcaagggcggcgttgatggcgtcacggttagcggattgatcaaccgttgccaaaatggctgatttttgtgccgcagtcaaattttgactgttagcggttgcggcgacattgtcgtgaagcgccgcactagttttaatagccgatgtcagcgcacttagcgcggttttaacggacgataagtcggtaccagcagcctgctttttcagcgctgccacggttgcgctaatcgtggcttgattgttggttggttgcttaagttgcgtctgcaatttttgcaagtcgatggtgagggactgactgttctgacctagtgtctggatgccagtagttagctgacttgagccgctcgttagggccgtcgttttagccgttaactgagcggtctgtgcttgtagttgattagcaccttgactaagcttgttggcaccagtgttgaccttgccgacaccggccgcataagcgtttaaaccggaactaagttgttgcgtaccagtcgccagttgagcggtaccactactgaattgttgcgtgccactggccacctgatgggcaccagtattgactttgacagtcccagtattcactcgctgggcgccagcaacgtattgatcaacaccttgatttaaagtttgaaccccggtgttgagttgagccatgccagcaactaactgattacttttgacgagcagttgtgttagaccggcaaccactttttggttacccacctgtagttgtgaaatgccattaagatattggtttaaaccgaccgtcagtgtttgactcccttgttttagtttcagcgaactagttgcgagggtgtccaggttggtggcgattttttggttggcagtttggagctgctgaccaccggtggctagcttttgattattagtagcagctgttttgaggccactgtcaagttgtttgatagcggcaaacatcgttttggcatagctcgttgtaatcgtttgggcgacggatgaccgaatcgaagtgaccgccgaatcggccatcttgctagcgacgaagttatgaccagcacttgtatcataatgtagcaccatggcttgtggttggtgattgagtaaggtggtcgcgtggcgcgaaaaattggttggaatcgtgagcaccatataatagcgaccatttttcaagccagcttgtgcctgacttgcgttgacttgttgaaacttcaaagcgctagatttttttaaattcgttgttaaattgcgcccaacactgagatgcttcccttggtacgtgactggctgatcatgattgacgacggctacaggtaaattatttaaccgaccgtatggatcccacattgatcgtaaaaatgtcacggcataaattgatggaatgaacataatgattgccatgacgataatcattagtttgtgtttgcgcatatacgcccattctgctttaatcatctttacttgcgctcccttaattgtctattttgtatgaaaccccgtgtgtgcattaaagaggataacaggtttcagaaatagcaccacatcatcaagacagcatgtggggtttaaaccccattttgagtgcaagtggggtttaaaattaagggtaagttatgattttaaaaatattatgggtatacatagcatgaattgagctgtcatcaattatgataaaaatgtgttagttaggttactggtcatcagtaaatgtgcgtcctacatacaccttctaggttgagcggcaattgctataacatagccaacgtcgattcggctgcgggattgtccgaacgtggaaaagaagccccttaccatgatatttcaaagtaaggggcttggtatgagataagcagttaagatttccagacaattagttcatctggtttgaagtagagttgttggctaacaccaaaccgaactaagtattgatctttagctgcgtagtaggcaatgatcgttcccacaattcccaaatatggttttggtaacttgacggtcgttccgatttttaaagttgacatgattgaaaacctcctaaattttagtcattatcaaggccgtgacgacggtaggcatagaagaagatgccacaggtaatcacgagccatccgagttgcgtcagtacctcacgaagcgtccatgaaaagccaccagtggtatacgaggcggtaatatagtgattaagcgtgctgctatacagataactgctaaaggatttaagggtggtattgaactgttcgaaattcggtatcaggcttaaaatcagcatcattggaatactgtagacgcctgcttgagtttgactattagcaatcagaccaataatgtatccgagcacgagactcgttaaactagtgataatagtaatcaataaaaagtttcctaagtgaatttgcgaccaactggcgccgcttagggggaccagtatcaaattggttacagtcataatagctagtggtggcaataaactaccgataaaaaattcgggcccggtaatggaagaggtcattaggacacgtaacgtatggtgttctttttcttcggctaagggataactcgtcatcatgatgccacccataacgatattaaagcatagtcccattcccagtaatagggaaatcagggcgacgtgtgatggtgctttactttgcataatactcttcatgaaaacgacgtacaaaatggccatgattggggcagtcattagactcatatttgaaatgatcagtcttaatttaagaccgaataaggcttttattttggttactgataaactcattttaggctccttccagttacggttaaaaagacatcttcaagggtcggctcgcacgagtgaatcgtctcaagttgcccagaaagcatccactgattaatctgataggtcgtctcaggagatgcggggagtaacaaatcttgcgctgccgatgcaatgtggacgcgatactgctggtcgcgattatattttaattgcaatgcttgtggggctgcacattctgcgatgcggccagcgttgagtaaggcgacacgattgcagagacgagtggcttccagcatatcatgagtcgttagcagaatcgctgtaccctggtcgcgtaattccctaatcagtgcgtgaattgcttgggtcgtgcggggatctaaaccactggttggctcatcgaggaacaagacttgcggttggtgaagaattgctcgggccagaactagccgttgacgcataccttgagataacttaccagcgagttttttcttatgttgactgagaccaactcgttcaagtaacttatcaacacgtgcaaccgggacaccaaacattttcgcgaagaatagtaggttttggtataccgataatttgtcgtaaagcccactttgatgcgtgacgatgccgattttttcatagcggtgttcgtcgtatgcttggacagactgacccaggacgtaggcttcaccgttcgttggtaataattgtccggttagaattttaatggtggttgtttttcccgatcccgagggacctaaaaagccaaaaatttcacctggttggacggtaaaactaacttggtccagcgcggtcgtattttgaaatgatttggcaatgttaatcacttcgattgcattttttattgtcatcgttgatcgctgactcctttaaatttgatttggaagcgtagtggcttctacaaaatctagtttactggaacaatcgtcgaatgtgattaaatcaaggtgtaatggggcatattggggccgaatggtgcattatttaggctgaatggtgtcctaaaaattgatcaaagcttttaaatcagtgagtttaccgcgagagaggggcagtttacttttgtttttcaagattaacgtgtaactatttcgggagtaactgattagttccgcgatttgttgtaaattaaccaagtaagaacgatgacagcggaagaagccgagcgtcgtcaattgttgttctaattcgctcattgtttgcgatgacgtgaattgttcgccactgacgttcagttgactgaccccgttgacactttcaataaaatcgatctcgttggggctgaaaaagactgttttatcttcaaccttacttgcaattttaaaaattggtctaggtgtatcttctgaagtgtgtgcggaatcggaactgctttcggtcgccaaatcagtcaactcgaggccctggtttggtcgatagcggaagatagtcgtactggttaggacaagttcttctaatgagtaggaggtcagcagtacggtgacgccgtgttcgcgagtataggctaaggctgctaagtacagctcaatgccagcgttggtcaagttggtcaggggactttcaattagtaacaagtccggttgtaggatgaacgcccgcagtaaggccagacgttgttgttgatcaaaggataagtgcttgatcttagtatgggcgacgtctttgagtgcgaaatactgcaaaatgtcatccaggtccgtctcaaaggtgctgatgtgttgaaaggtcttcaaataagtcgagactgttaattgcggataaaagccgtcatcatgaaagatggcttggatacgtgcgggagtgaggccagtcatcacgccactagtttggggtgtcgtttggcgtaataggttaaagagggtcgttgcctcaacgtggctcatctgaatgccgatgttactttgcgctggaatggtgagtgtgaaatcttttaaaatcgtttggtgtgcttgttgtttaaagatgttgcttaactgaattgtttgcatggtgagaacctcgttgtttttagtgtctgagtgaggtggttagaaaaaggccatatcactcaaacaaattggcaaatctgatgtagacagtaacaatataccatatcgaagtaggcagttgtggtttgtcctgattaagaccgttatgtcaaaatgacagctgacatgatgcaaaataccgcaataaaaacaggacaatggacggccggcattcgtatggcgggtcaatatcctgttttttaaaattaatgtttgatgattgaatgactaacgagattgatcaagtggtcataaaacacttggtcaattgataataatagcaatatcagaaatggccaaccaaacggtctctgtgggtgattataagcaattactggcatcactgttaagcccatgtggatgaaacttcctaataaaatcagccacaagctgattagggcccattgcgatttttgccgcatgtttatgcgcctccataacaattaagtatggcacagcgattagtgcttgaccaattgattccagaagcaggcaaagtcataagttgtgactgaaccgccaagctagaatttgtttttgaatttcaaccaatttagatagtgatcatgggcttttttcagttgtcggtagcgccggggttgtttgcggtaaaaatcctgatgataattttctgctggccaaaattgctgtaagggctcaatggccacgacaattggtttttgataacgttgcgagtccacaagcgcttgtttggatgcttgtgcaatggtcaattgatgttgattagcataaaaaatgactggccggtattggctaccgcgatcattgatttgtccaaagcggtcggtcggatcaattagttgccaataaatatcgacaagattttgatacgagattttacgggaatcgtatctgatttccacggcttcaacgtgccccgtatattgaccactaacttgttcataggtcggttgggcccacgaaccaccggtataaccagaaatcacattattaataccgggacgctgatcaaagggctcaaccatgcaccaaaagcacccaccagcaaagactgcccgttcttcataaggcgaactaaggggtgggtaagccgatacattgtttttagtcggcatgggtgcgttgccagtgatggcaagataaaagtccataacatccggggtcaagttattccgcatagctaatggtcgcaaatcagcttcgagctgttttagttgcccagtcggcgatagctgttgccgattattcttggcctggactagtaaatggcgttcccagtcacgcgtcgccgggttgatgattaaattgtataagtcgcgcattaaggcttcaggttttgttttcatggtgtctccttaactggcttatttgccgagtattagcacgtacttgcattttgactgatttgattttagcacggtgctttggtagcacataatgttatgatttgttttctatcaccctgtcgtaagctactctaacaagaaatgcaaccagatgatattgatgtgatcgttagttgcatcttagttataagcaccgtttggccgacgtcaaaaatggcggctattattgtgggtattattcacccaagtccaatttgattggaaaagtttgctatgaagtatggttgatagtttataatgaatcgcatgcgaaaaaaggaggaactaaaattggatgatgaagtcgccaaatatacaacccaagagatttcagtattagttgggatgagtgtctctcaggtccattactatgatcgcctgggcctaattcctaatctaagacgatctgagaatgggtatcgtgtttttacggaaaagaatctgatttggatgaaaaatttgaagatttttattgattccgaaatgccgttgaaggatattcgtcaactaactgatttagttgttcaaggcaagcaagcaacagcggaaaagcgtcaagcgattgttgaacatcatctgaaagaattagagaaaaaacaggctgaacttaagaaacaggtcgcattcatgaacgggtttattaaaacatatcagcaaatggaaaaggagtccgatgaacgatgaatacagttttagttattggtgcaacttcgccaactgcccaggccttcattaaattaatggaacgtgattatccagaaatgactttaaaattatttgttcgtaatcgcaaaaaggtcccggcctatcagaaacgagaacatgttatttttctgggagatgcagcgaaatatactgattatgtagcggcactcgaggatgtcgattatatttatgattccgttggtgggctgagcactggtccgtacgttaagttattgttacgtgcaattaaggaaacacaggcaacaattaaacgaatagtcgatatttcggcaggcggtatttacggtgaatatttgtctggtaatttaccctatttatcggctgttcgcacgcaacatcctcagtatacccatgatcagttagacaaaccgttgttatttgcaaatagtggtattccctttacaatctttagaccaggactaattcagaatggacccgaaacaaaaattattacgcacggtcctgaatttagagcgataccggagtctgaatttgcaattaatcgagatacgtttgctagggcagcagccaatgccttatttaatgatgactaccacaatcaaagtgttgctatttctaatggtgaactattatagaggagaaacttttgtatgaagcgtttagttggaactctgtgcggtattattagtgccgctttatttgggctaggtggaatactagcacagcctttgttaagtgagcaagttctgactccgcaacagattgtattgttacggctgttaatcggtggggcaatgttgttgctatatcgtaacttgtttttcaagcaggctagaaaaagcacgaaaaagatttggacacattggcgaattttaacacgaattatgatatacggcatcgccggcttgtgcacggcacaaattgcctttttttctgcgattaattacagtaatgcagcagttgcaactgtctttcagtccactagtccgtttattctgcttgtatttaccgcgctgaaagcgaaaagacttcccagtttattagcaggaatgagcttaataagcgcattgatgggaatctggcttattgttgaatccggatttaagaccggattaataaaaccggaagcaattatttttggcctgattgcggctatcggggttatcttatacaccaaactacctgttccattgttaaaccaaattgccgcagtggatattttgggatgggcactagttattggcggtgtgatagcgttgattcacacaccgttaccaaatttagttagattttcaaaaacgcagcttttagcggttcttatcattgttattctagccaccgttgttgcgtatgatctttatttagaaagtttaaagctaatagacggatttctggcaactatgactggactatttgaaccaataagttccgtactttttggcatgttattcttgcaccaaatcttggttcctcaggccttggttggtattatattggttgtgggtgcaattatgatactgaatttacctcaccatatcacggcacctgttcccagcaaaccctgtcaatgtacgatgcctaatcagtagggaatgataagcaatcaataatatcaaaagtactggctttaacaacatattgaagaaatactgccaattaaaacatcggtactgcgattaccttttcgtaatcatataaagctattgttttttgaaagttgggtcattgagcacagtaattgattgtttcagttttagaaattgattcttagcaggtcgcatttttgaaatgtcttaacaaacgactaagttaaatttcacaaatggctgtagcacctataattgcacgctgtgctaaaaactgcgcgtatgtatggataaacattgagatttcaacgcaaaaataaagcggttgcatttccgcacgtctttcgctagagtggaatagtaaacctaaaatgaccaagtttcagatggtcaagcggatgagagggaactttaatatgtataaaatgattgtttgtgacttggatgagaccctgatgaatgacaatggtacgttgtcagaaaagaatgcggcggcaattcaagctgcggcggctaagggtgtttattttgtgccgaattctggtcgtagttatacctcgtttcagaacgatttggagacgatggggttgcgggaccaaccacatcaatattcgatttcttataatggtggtttgattttagagaataaggataatcggccattggcggtgaatgccatgccatatgaggttgctaaaggggtgtttgaagcgggaattgcgaatcagcaggcggcgacgcatgtgtacacgcaggatacgttatatatttacaatccggttccaagtgattcagattatctacaaaaccggggcgtgacgttcacaactatgacgacgccggactttgaacaattcaaaacgatgaacgtcatgaagattattatggccttgccaacgatgactgaccgcaagcaaatgcgcgcagacgttgaagctattgttgatccaagcaaattagccgtcacttattcgtccgaccgttacgttgagtttaatccggctggcgttgacaaggggaccgcagcggttcaattaggaaagctactgggaattacggcggatgaaattattgcagctggcgataacagcaatgatctccccatgctgaaggcggtcggattgcctgtgagtgtcgccaatggtatcgatgcagtcaaggccgcagctaagtacgtgacggtcgctgataacaaccatgacgcgttagcagaggttattaacaagtttattttatagtacaaattttatttagaaaatgaaagttgccatttggcgttcaacttttacaagtggtatcatgataattgaaaatgtggtagtatgaaataaattatttgttacaaattactgaatgggggaacacgcatgagtgcgattcgcgacgatttagctaaagcgattaagaataccaacctcgttgaaatctattccaagggaaccaatgagcaatttagtgttggctatgtgattcagcaggatgagaagtttgtgctggtccaagccgttaatgtcgatggtgaactagatgggttagtggtctttcgtaaggcatcgttagcccgcgtaattagtgacactgattatttgaagagcatggcgacgatcattgcgctggctaagcaacggggctattatgatgtttggaacactgaacgattgatgaataagctgctgaagaagcagaataagactaaacattcgctcttaaaaacattgttgaagcaagcttttcaccacgatcaagtgattcagctatctggtcgaatcaaaaaacatggtgacagctatgctggctttattcatagtgaacataagaaatatattgaatttaattacgttgatatgttcgatcttgcaaagcgcccacaaattgctattcgctacgctgaaattgatgaagccagtttccatagttttgaaacctttaatacaaccgcggttatcgagagttttatgccgggtgattttcactaataatgatctgtgagcggcaccgttaatgaacgggggtcgctttttttataccgtcgatcatgtgtgtcttttaagacaataaaggcgtgtatagcaagctttggagacggttacgggtattaattggtcagtcagcgatttggtaaagattgttaagtttttatcgcacaaatatacaaactggccgtatttcgctacaatggtagtattgagcatcatgcggggaggggagcagttatcgtttacgtctattggtatattgcagcttttgaccattggtactcggtcatgttggtttttttactgcagatattaatcaatcgtgagcttcgacagaagcgagtctatgcgactgttgcggttatgaccgtacttctaactgtgatctacatgttgtatgacgactattcggatatcatcacgttcattgtgaacatggggttactggcgtttgtacggcgcaaaaagtactttattgtgacgagtctaacggccacactcgcctacattctttttagtttctttggcaattatgcgacggagtcgatttttcacttatttaacttgggtttgaatgactggagtggctggctatttgaagccatcggtgaaacaattgtcacagcttgtatgttggcagtcgccgctagtttcaaggtcttaaagaagcgttatccgcggcaatttgtagacgggctaacgttgaacgtgattgtcagtgctttggctgtagttgcggtcgcgttttttaccatcacgactgcggcggataattataatattggctcaggatttttggggattctaatgttgattctagtggctatcttgctgatcaacgccggaacgtttctttacctgttctatagttatacattgcgggttcaaaataaccggcaagctttggaacggcaacaatatgatatttatgtcaaaaatttggaaaatagttatcaaaatttacgtaagtttcgccatgattatcaaaacatcttactgtccttgggtgagtatattcagacagctgatgatcctgaattacaacaatattttcgtcaagttgtgaccaagtctaagcaaagtctaaatcgtgattttggacactttgacaatttagaacaaatcaaggacaaaccattgaaagccattattcagagtaagttttccgttgcgcgccaagctggaattcaagtacgcttggaagccaacgacccgattgcggcaattgcaattgattcagtgacgttatcacgggtgagtggcatcttgttagacaatgccatcgaagcggtgaagggtcagagtggtggtcagattgcggtcgcacttgttaagtatccccgcatggtggagttgatttttgccaattcattgaatcatccgattgagcgcctggatgagctgatggttgctgggcatacttcgaaaggtgctggtcatgggcaagggttagcaaccgttcgtgagttgttagatccattagctaacgtgacttatgaagtgagctcccatcaacgattcgaatttattattagtattgaaagtgagtgagcagcgtgttaaagacctttgttgtggaagacgatcctgaacaattagcaaccttaaagcaaatcattaagaatcatattatgattaatgattttgatatggaactgaccttagcaaccggacaagcacaaacgttgttggactatgtcgagaccaattccgatcttgagggactctactttttagatattgaatatcctgggcaagacttaaatggcctagcactggcgactcgaattcgcgaggcggatgttaatgcgcggattgtcttcgtgtcgacccattctgaaatggcctttttgacctttgaacgacgaatcgaaccactggactttattgtgaaagatttgggtcaagaaacggtcaaagccaaagtggagacagatattcgggttgcttatgaacgttataccaagcaagcagtcaccagcaaggccatgttttcttactctaagggtggtcagctcttcaatgttccattagatcaggtgttatttatcgagactggagcagttcgtaataagctggttctccatttaacagatcgaattgttcaatacaatggtaagattagtgatgaaaccgtggcccacccagagttattccgggttcataagagtttcttggtgaacccgcaaatgctagtacgaattgataagcaacatcagcttggctactttgaaaatggcgagtcggtcgatattgcgattcgtaaaatgcatgatttaatcgcattaatcaagcgttccgaactggcagtcacgtttagctagcttcgcttaagactctaatgtaacaaaatcgttaatcaaaagtgaattttaatgacgttggtgcaggctattatgagctttgcaccttttttggctttttagattaatttgcatgtatgcttagactattaaatgccagctgtgggagctggtctggaggtggcgtcatgaagcagttctggtcactaatcttaatgattttggccggttgtttgttaatatttggttcggaatacagcttgcaaggtgattatcatcgacgaattcatcggctcactgtgtcaaaggtggtttaccatcaaaatgctacctctgcaacaatcagtggccgtaccaagcacggtgtcattgtcaccttaaagagtgggaaacatgtccgtcaggttatttcgaataagcagagtggtcaattctatgttaaaatgccagttcataagcggattacaattaaagtcgtggggctaaaagccaaagtactaacagtaccaaccgggacaaagagttagatgggtgagcgggcaagttgccggctcttttttgatggttaatgactaggacagcgtgccatataaaagctacggtgaactactcgaatttatttagttgttagtcgcgttacggggttgctaaaaaatcattaagcttctagttttgcgctaggcgcattgttgattttagcgtacagtaacaatgacaagaaaaggagtcgtggctgtatgttagtggttggcattattttggtgattggaatcatcgggacactggttttacgatttcaatttcactttcgcctcgcgatgggcaccattaccgagacggcgtttgcctgctcattgttgaatatcggggtatttttgttgtttattttattgggtcagttaacgggaccaatcctgctatcagaatgggcctacttgccgatttatcggttgttacaaggaggtttgattcccgttattggcattggcttggcaattctgggaatggtgcgtgagaaaggcctgatgaattggtggctattacattttaatgtgctatttttgatttttgacgtgttattagtctggcaggggagttataaaagttagggtggccagtgccgtgacgaagttgtgcgtgaaggtcgtcaatgcagtaacatgatggtaattgctaggctattgatcacaaagtggagcgcaatggccgcgcgaattttacgggtcagccgataaacaatagctagcacgagtcccatggtgacgtatatgaggaagctcggtaaggttgaactactatggaggctaccgaaaacaatcccgctgagcccgaccttgagccattcttgttgaaagaaaaggttagtcagaacgccacgaaaaactaactcttcaacaattggagtcaaaaaaacggcgctcaacgccataagccaaagcgacagaggactgccggccattaaatttttaatggcggcgttattttgtgtttgattctggtgatacagaagctggtttataaattgaaagccgccctcaaaaattaagatggtgagataggccattccaataatttgccagtcatggtattgtaagttttctgattgatagttgccggtatagtgccgcattagggcggttgccgccagtgctaggatcacaaaaattaacagatagacacctgccagggtgatctgccaggctgtgagctgatgctggcgatataattggttaattaatttaagtaacattggtgggatcacgaccccaacaattaggccagcagtgagcaacacgcgtccgagccaccccaagccgcggtcaataatttccatcggacttcacctcccatggttgattttaccgcagtgttcaggtttcgacacggatttgcaaatctgagaaaggcatcgatgccaggcacaagcggatgatattaatctggttgaatgctaaaaatataataattgtagaaataatggttgatgctctataaagataaagaataaaaaagcataattcggacaaatcttcacactttcttcacaattatgtaatagtatatacttgtacctaatagttatacacttgttcattttactcccccaaagtggatggacgagcaagtacaatcccccatattgtacttaaacctaactctttggccctactgctactaagcggtagagtcatttttttgttgcacgtccccaaagtcaccgaatacagtacctgcaaaaaatcgtcccttaatacatacttaaattatttttagcggtctaaactatcaaattcaactgggttttatcatttgatttattttttgcggaattaatgtggctgcaaacacccataattatttgatcggtgctagctaacgatcgttcatattagccttgaacgggctagtctcaaaacaaagtgacgctagtgtcaaaaatcaattggtttaatcgcaacaaaaaaggccgaggttagaaaaacctcgacctagttaagcagtcagttagaatgcttcgccagaatagtcgacctttttaggatcggcatttttgatgtgttcggaagcaaagttaaccgtttcgcgaatctggttataggttgcttcatctaaaccaagtaaatccatgcaagaattaacgtgggcaaaaatctctggtttagcatcgatggctttttgcgacaacgagatgttgacttggcgttcatcgtccgtatcgcgcttgcgttcgacccagccttgggtttgcatccgtttcaataacggggtcagagtcccgctatcaaggttaacgtgtgaaccaagttcccggaccgtcatcggactcttttcccagagtgccaataaagtgatgtactgcggataagtcagcttgaaaggtgctaaagcttcggaataaaaatgattatatcgtttgctggcggtgtagagcgcaaaacagagctgttcgtcgagcaaaatgttttttgttggggttgccatcaaaccgcctcctttactatctattttagtacattgtacgcaattaattcgccaaatgcaattaatattgcgcaaatacattgttttcgaacgatttatttataaaagcgggttaattaattgacctgttggcgttgttgggacttaatgcatgtcaggaataactgggccatggcctgctgattgatggcaagttgatggttgtccgtgaacgcataaagtggaacttgtgctggcaatgttttggccgcgtgatcaccaactggaatcaggcaggcgatttttgttttgtcatgtacaaattcatgagcgtcacgtggggcggccttaatcgtcagtgatgccaatacgtgataaccggtcggcatcatgtgttgtgcatgtttgacatgcaccccgtgtagtcgggaacgtaactggaacccagacgtggtggtcaactgtaacgcttgctttaattccaataaataagtttgttgattatcaatatttttcaaccggatcttgaagtgtccgaatggaatggcgcgatcctgatgttggacggctaaggcgtgttgttcgacccgcattttatccttaacgggctcaaaggtatattgttgtaaaagttgtgttgctgttttcaaactatcactccctacgattaatttagtcctttaaaaacttgtggtcaaataattggttacgtttgcgagtgacgtcgttttcaagtaaaattaaagtgatagggggttggaaaaatgtttatgacaactggtgatttacagcgctcccatatgattaagggcgtcgtctccgtcacaaaacacctgatgtttgaatctgatggtgttgatcagtttgaacggtttgacgatttaatcgaacaagtcaagccactactgctacaaaaggcagaggatcaaggtggcgacgggttaatttatgtgaacttcaatactgaagtcgctcagatgagtgttgcaccacggtttttgatcgtaaccggctatgggacggtcgtcaagctcgttgatgaatcagtctgatacttaggatctgaattttcaggtccttttttgatagcaaacaagtgatagaaaggaaggtttgatgaccagttattcatttccacatggcgccattgacgtatacgacgctacccaaaacaatttaaagcacgttagtcttcgcgttcctaaatatgcaaccacggtgttcgtgggcttgtcaggttccggtaagtcgtcactcgtttttgatacgattgcagcggcgtcacggcgcgaactgaatgaaacgtttcccagttttacgcaacaatatttaccgaagtatggtcaaccacacgtcgggcatatcgagcacttgcccgttgcgattgtgattgctcaacaacgcctcggcaagaatgcgcgttcaaccttggcaacctatactggaatttattcgttactgcggctcttgttttcacgggttggggaaccgtttatcgggtattcggacagtttttcgtttaacttaccccaaggcatgtgcccaacctgccaaggtttaggttatgttgacgatattgatgagcagcaattgattgatcctgagaaatcattaaatgagggggccatcacgtttgtgagttttgcaccggatacgtggcgttggcgccgttatgcgacgagtggtttgtttgacaatgataaacccatcaaggattatagtgctgcggaatacgatttactgatgcacgcaccgcaacagaaattagcccatcctggagaaggttttcctagaacggccctgtatgaaggtgttgttccgcggatcaagcgctcgattattggtaagaaggaagccgaacaccatcgcgatgcgattgcggcgatcgtcacgcgcaaaccgtgcccaacgtgtgatggcacacgactcaaaccggtcgtgttgaccaatcatattaacggggtcaacattgctcaggtgacggctatggatttaaagcatgttctggcatttttacaagcgattgatgcgccgttagcccaagatattgtgcgggagctgacgaccaagatccaatcgttggtcgatattggcctgggctatctgacattggatcgtgggaccagttctttatctggtggtgaagcgcaacggattaagattgccaaatacttgaccagcgccttagtagatatggtctacattttggacgagccaagcgttgggctgcacccacatgatattcagttaatcaagcaagcgttaacgaagctgaaggataagggtaacacaattctgattgttgaacacaatccagccatgtttacgttagccgactatgttgtcgagatggggcctgcagctggtcgcactggtggaaacgtgacctttaccgggacttatgacgagttactggcttctgatacgttgacgggccggtggttgcgacaaccgcataaatggggtcaagaacgaccagtccaggcccacttggcattacaccatattaatgaaaataacttgcacgatgtcagtgtcgacatgcccctcggtgtgatgacggtcgtctcgggggtggccggttcagggaagagttcgctggttaccgcgctaaaacggcaattaaagacggcttatattgatttagcccagacaccagtgggcctgaatattcgctcaacaccggcgacttacttaggagtgctcgaccaaatccgacaactattcgcgaaagccaatggcgtggcaactagttggttcagctataatggtaagggtgcttgtccgcggtgtaagggtaaaggcgtgaccatcacgaatatggcctttatggatcccgttgtgcagacatgtgaattgtgtcatgggctgcggtataatgaaacggcgctcagctatgcttaccagggtaagacgattgccgacgtgctccagatgtcagtcacagcggcgttagctttttttgccacgatggacaaagtggctcagccattgaagaatttagaccgggtcggtttgggttacctaacattggcgcaaccgctcaccactttgtcgggtggtgaactgcaacggttgaagctggcggttgagctaggcaagcagggaacggtgtacttgttagatgaaccgactgccggtctgcatttgcaagacacacaacgcttattaaaattattcgatgccttagtggccgctggtaactcgttgattattatcgaacataatctggcggtaattagccaggccgattggttgatcgatgtggggccggatgctggtcagtatggcggccgaattcagtatagcggaaccccacgagcagcagttgacgtgcccacttcacgcactggagccgctttgaaggcttggctgaaggcgtgattagaaaatttgattaaataaaaagcacgtgcaattgcacgtgcttttttagaagggcggtaggtgggaatcgaacccacgcgtgccggagccacaatccggtgcgttaaccacttcgccactaccgccatcacgttaacttttcgtcaacatatctagtatacactaaaatcgtgggttgcataggactttttgtggattttcagaaattaatcgcctcagtttctgaagcgttggtgaaggttctactgtgaccaacaattatttaaccgttagtaaaaggccatagttcccctaacaatgggagctacggcccgtttgccgtggttagtgtgtctaacggataggtgaggtggaccagcacttataggttgagcaaaattattatgaattcatccttattgaagaaatgcgtaaaaatctttgcaaaggcactactttgttaaaattcacaaaataaaagagcccagtaaataagtgtttaccgtggctcttttattgctcatagactaattatgccccaggcaggattcgaacctgtacattgtttccaatacagcgacctgaacgctgcgcgtctgccagttccgccactggggcagttgctttaacaacaatatccattatagcgaaaagtaacaaaaaaataaacctttttctatatttatgcagttgatattaattgtaattgcaaattggttgcttagttactggggctggccttaattagcatggaataactgtacgccgaaatactgaaattactaccggcaaaaaatgcatccaaaaagtcacccatcccagcaggttcaacgacactgcttgaatgggtgacaacttgtcggtttattaatttgcttgtttggtcgtgatactaccatctaaataaacaaagtaactattcagataatgcccccggccgccattagccgttttctgataagcatcgacctgataatagtggtggccgtgtgcatcttgattggcagttggtacgacaccaaaggtttgttgcttgggatcgttgagcacttgcccgacggcggccactgcactagttgcgctagtgatatggtcgtcagcagcttgataatggtcaccagattgcttcttagcactagcatcagccgctgcattggcacgactagtttgctccgcgcggttagcggctgcaactgagttcgcttgcttagtggaaatacttggctcagcttgggaagtgcagcctgctaaaaggaatagggcgcagaaactgattaaaattgcccgggtcacgttcggacctccttatttcgtttgttcttgggacaagctcggataaggggcttgtcggatgatgttcgaatcaacgatggtcatcacaccgattgacagaagtaacaggatcactaagattaattttttcattaaaataacctcacttgataacggtgattgacctatttccagttagggacccaaatgacgcggtcaatttgttcaggaatgaccgtaatcttggacccagtctgtggcccagcttggacgtcgatcacatatgagatcggaccagcatcgacttcaacaatcgagccacgttgaccgtcgactgtgtcgactaaactatacaatggaatctcatcattgctgatttccatttcatataaggtgaattggaggaagtaggactttttaccggtcttgatttttaagggggtgtcaatggcaccgtaatcgggaagggcccgattttgagcgttgggatcattcaggtactgcatttcatcgacagcatcgatcgccatcttccattcaccaccagttaaattagttttggaggagagggtcatgaccgagttagcgtaaatgtcgatcacgttgaaggcttcgtcgacctgctttttcggcagatagccgatggtatagccatgctccgcaacttttagttcaacccgtacggatcgctcagcaccatcaacttcttcaactaactgaatttcaccgatgttagcgttagcgtcgacacggtacttcttggcatagagataatctgctttcagaccagaatcattatagccaccataaggtttaaagtaacctcgggcactcgcatcggccagcgcggcttcaaattctttttggtagtaatctaaaccaatgacgtatgagcggaaaattgcacgcgaattagcgttgatccggcgcgtctgaggaaccgccaccggatggggaacggcttgattcaagcgattccgaaaaccgttattttgagtctgcaacttggtaatttgacggtcttgttcctgattggtcaaagtttgatgaacgaggcgctgccgaattgatttaagcaacgcggcctgtttatccgccgcctgattgacatggtggagatggactaacaccgcaattaagataatgattaaaattagacaggctaagatcagcccggcaataaataaataagttctcataaataattcactccaaaaagaattgcagattagtttaagtataagcgaccagcccactaagcgccaatttaacggctgagcttgtcagggggccgataacaaggtatgatattgctattgtataatatttttgagctagaagaaacggtggcgaacggcgtgcagtggttgattaaaatctaccatcaatatcaatatttttggaaatacgcactgtttggctttatggccgcgctggtgaacgtcttggtattctgggtgctacactcagtcttggcggaacactatttattttccaacacaatcgcatgggtgctagcaactttgtttagtttttttaccaacaaagcggtggtctttcagtccaaatcgcaagacttttggcactggtgtcgcgagttcattagtttcatgttgacacgaggcttatcatattttttcgatactttcctcatgttcgtcggcatttcgttgttgttctgggcacccctacttgttaaaatcatcgaccaggttctcgtgggactctttaactatgggacgtcgcggctgatttttatggaaagcaaccagaaaatgcgaatgcgccagcaaatcatgaaacgtttgagtgatcgtaacaattaattggcatcaggcaagcaagtcgtcccctaacggacgacttgttttttttgatagcatcactttggatcgttaggcagtaatttcaacgacattgatggtttaaatcaagtttcccgtcaattgccagtgcaagccgatgccacaaataatcgttagtaaggtgccgcagacgagtagggtgacaagtccagagttcaaatgactttcctgcttgcgggcaaaggccacttcaatgaggccaatcgtgccaagaccgagtatcacttttagcaaggtcaaccaccagttgcctgataaggttctgattgccaaggccaccccagtgatgataattagcaggtacccgatgcgactaagaatcaaaaagcgattggctgatttgactgagtgacgactgagaccaatcgcaaccgtcagcatgagccatagccaaccaataatgtgccctaataagtacatgacaaaaccgcctccacatttacaattcatgtctaattttagcatgaaagtaggtgttggcggcggtttcttttattgtactttaattaagtttttctgttggatgtaatcgactaattcaatgaccgttttaaagcggttaaacggtgtgacgatgtgaacgccgttgaagcgcgcacagataccatcaatcaattcctttgcaatagcaatgcccactgcccgttcgtttccggtctgttcggcttctgccatgcgtgtcaagataggctctggaatccgaatgccatggacttcatggtgtagaaattcagcattacgccgtgagacgagtggcataacaccaacgaacactggcacattcacgtgattagccgctagagcatccgccaaagcgtcaacgtttgcaagatcatacacgggttgggtgataatgtagtcacaaccataacttaacttccgactgattgacttggtcgatatggaagtgcgataagcgttaggattaaaggcgcctgcgacccgaaagtcactggcttctttaagcgacttacccgttggtccgatgccgctattgaattgcttgatcaacttcatcagttcaacggagcgcacatcgctgaccgaagtggctcccggaaaatcaccgagtttggccggatcgccagtgatagctaagatgtcctcaatacccaggctgtgtagacccatgatctctgattgtaagccgattagattgtggtcgcgggtcgtcaagtgaacgatcggcgtgatgccgtagttcaacttgagctgcgccgcaatcgtcgtattagcaatccggaccgttgctaacgaattgtcagacagtgtaatgccatcgacaccagcggcttttaatcgttcagcaccccggaaaaatttagtcgtatcaaaatcgcggggtggatcgagttcgactaacgccgtttttggggtcgcaactttttgcagaaaccggtgctgactctttgtcgtgacgagcgttggtggctgtggttttgtagccggctggtcatgagcaacgatgctgcgattacttagaccgcggacggttgcgctggtatgcaaaggtgtggtcccacaacaaccaccaataatgttcagaccgagctgacgaaagcgttcggcatattcttcgaaatagcttggttcaccatcgtagaccaccgcaccgtcctgatcagtgccaggcaagccagcgtttgggtaaacggctagtttaacgttagctggaatcgccaagttttcaaatgactgagctaaatagtaaggtcccaggcgacagttcgtgccgattacgtcggcgccggcagcgttgagttggacgatggcatcagtgaagctcgtaccgtttcgtaagacgccgggggctaacattgaaacattcgtgatgacgggcaagtcagtatgggccttcacgatttttaacgcggcgagcagttctggcaaatcataatatgtttcgagcaagatgccatctaactggttggtggctagaagggcggtaagttgttcagtcacgctggcagcaatcgttgctggtgtcgcccgttgaacagttgcatcggtatcgccggctagtccaccgatcgttcccagaatgtaaacggggtgatccgcgtgttcccgtgcggtcgctgcaattttcacagcggcctgattgatggtggtgacttggtcttgtaaatcataccgggtcaactttaggcggttcgcagcgtaggtgttggtttgaataatatcggcaccagcccgaatgtacgatcggtgaacgcgtaagatcgtgtcgggatgcgtcaaattcaggttttcaaaagccgaattgatgccatagttaccatataaaagggtgcccattgcgccatcggcaacgaggacccgttgctggagtgcttgtttaaacttcattcaagccacctccttagtggatgctagtggtcaattgggcctggatcgcgttgcgcgcagcaatcatgttctttaaggctgctagggtttctgattcttgccgggttttgagaccacagtcaggattgatccagaattgccgggcgtcgataacgcgtaatgcgcgttggatgttggcttcaatttccgcaacactcggtacgcgtggactgtgaatgtcatagacccccagaccgatttcttgatcgtacccggtttgttcaaaagcactgataatctccccatggctacgggacgtttcaatcgaaatgacatctgcgtcaagggctttgatggtatcgatgatatcggcaaagttagagtagcacatatgggtatgaatctgagtgtcgttttgcacgccggtcgtggtgatcttaaatgagtacactgcttcatccaaataggcttgccaatggcgctgcttgagtggcaaaccttccctaagtgctggttcatcaacttgaataatcttaataccagctttttccaagttttgaacttcttgccggagggccaaagcaatctgattttgaacctgcgccctagggatatcgtcgcgaacaaaactccagttgataatggtcagtggtgctgtcaacatgcctttaaccggctggtcggttagactttgcgcgtaaacggactcagcaacggtgattggttccgtgtaagcgacatccccaaagataacgggtggccggacgcctcgtgaaccgtatgattggacccaaccattttgggtcgcatagaagccagtcagtttttgaccaaagtattcgaccatgtcagtgcgttcaaattcaccgtgaaccaggacgtcgaggccgaggtcttcttgtagcttgatccatcgtttggtttcagcatgcaggaatgcctggtaatcggcatcggttaaattacccttgcgccatgctgctcgttttgctcggacttgcgcactttgcggaaagctcccaatcgttgttgttggcaggaggggtaggtgtaaccggtcgtgttgtaacttaatccgggtcgcaaatggtgcctggcgttcgaatttttgattactcagttgcgcttcagcggcgcgaaccgactggttgttgcggtgactggactggttgagggcagtcaagttggcctgattatggtcgaacactgcttgaacagcggcaaccccctgattggctgccacggttaaggtatgcagttctgccaatttctggtccgcaaaggccaggccgcccagtaagacggggtcagccttggtttcatttttggtggtaatgggaacgtgtaataatgagttggcgggttggagccataactgatcatcggtcacgatttgccgtaactgctgaactaatgcaagttttgcttgtagatcactagcccagacgttatgtccatcaataatgccagctgcgagaattttgtcggttgggaagccgtggtcgaccaagtgcgccaggttttcaccatggtcgtgtactaggtccagtccaagtgcttggattggccaggtcacgatttggtcgtactgatcaaggctgtcaaaataagtttggagttcgatttttaaggatgggacagccgcatgcaaatgttcaagtgcagtttgataaggtgcgagttccgcaaccgtcgttgttttgactagggtcggttcatccaattgaatccattttgcgccagctgtcgctaattcttcaaacacttgttggtaaagcggtaataactgcggtaatagttcgttgacggcggcgtcatccaagtactgtccgtgacgtttacccagtttaaggaaagagatgggacccagaatgactggtttaccatcaatgcctagttcttgcttagcttcttggtagtagcgtagccagcgattatctaataacttaaaggacacgtcatcgaattcaggaacaatgtagtgatagttgatattgaaccactttgtcatttcggccgccacggcggtatcagttccacgggcaattgcatagtagtcgggcaagtccaactggtgatcgaagtgaccaaagcgacttggaatcgcgttgaatgcgactagtgtatctaaaacgtgatcgtaatccgaattgtcagcgaccggaatatagtccactcccaggtcgcgttgctttttcaagttagctaggcgtaattttttagcagtggcgtgaaaggtcacgttgtctaattgtcctttccaaaagtgttccaataagtgcttccattcacgatgttcacctaaacgtggataccccaagttactattaataattgtcattaaaacccactccttatatttagcaaattatcttaaacgaaaaaacggcaacctcatcctgattaaaggacgaagttgccgttcgcggtaccaccttaatttgtcaacacctcacgatattgacctcaatccgtacgtttcatacggaagcttattaacagtagctaactgtcatcacctggcaaaagctcagtggtgccgtttggaggccatttttcatcaatcgtcttccggtttggtttgcactattccaaactcactgcacgggtagcgatgattactttcctcttcaggacgtttacatgttttatgattgattagaaaataccaccaatttctaatttagtcaaattattttttaatcttttgaacatattcaaggcgtaatgtgacgcacacgctatttggagccaggcaagtaggaaacgtggtgtgaacagccactagtatttgccagcaaccgttgtcggattccgaccgcttgaactggtgaatagggttgaaacgcagctcccacatggttgggttgacattttaggtcttcataacaggggcgttgcgccaagcattcaattgaggattaagttggttaagggtgctgacgatattgagtgaaatcaggtgctttggtaatcaatgcactggtataaagggattttaatagtcctaaaatttgaatatttcatcaaaactgtggggaaatgtcctaatctacacccagcagattaccgggtgcgtacttgctaaaagcactaaatttcatgaaatcatcatatttttttcgagttaagagtacttattttcacaattaacttgctagtatatttggtgagcccactagcgaagtaccaaagatcaaataaataataatgattaggatgatgaagaatgagtcaaagcttatggcaacgattgtttaatcaccgtcaacaaacgaagcaggccgtattaattcttgggagtggccgttccggaacatcggtaatgactaagtgtgttaatttgatgggcatttctctcgggactgataacctgttggcacctagtaagcggatcaatccgaaaggctattttgaaaataaagatgtcatcaatattcacaagtcacttggaagtcgcatccggtaccggccagccttcaagggttactatgatagcccgaagattaaaaaggaccgggcggcgttaaccacgtatctacgaaatttttttgagaatgaacagtatctggcgataaaagacccacggatgaatgattatatcgaattgtggcaacgtgttttggctgacgttgaggttcagccggctgagatcgtcttgctacgtaatccgatggacgtggtcaattcgaatgagcgcgcctggcaccgtgataccacgctcgcaatgcgtcagtggcaagtccggacgttgctttcattacgtgataccgaccgtgagcaccgcattttagtcacgtacgaagatttgtttggtcagacgttgacgacgttgaaacgaatcgcgacccaatttaacttaccgtggacgagcgacgaggcggcactccaagcgcaaatcgatgacttcatcgatccagcactccaaaagagtgatagcggtgaaaatttagctgattttgaagctcgaacggacgtgaaaaccgatgttaaggcactttacttactaggccgtcaagctgcggctgacccggattactttgcctcggctgaatttcaacagcgcatcgacgagatgactgacgagtatttagccaagtatggcgctttatatcgggactttaacgtcaagatcaatagtaaaacgttctttgtattcggcgaagatcaggcccaagttgatcaggtcaacacgactttacgaaatgatcaagtcaagatggtcggcacagaagctgacagtcatgaggttgctgaagatttgagcgaacggttgaataataatacgattgccattcagacgtaccccttggactatttagtggtcgagcaaaaggaagccctgaacaattatctccgtaaaaacgcgaaacgcgagacgttatgggggattggggatgctaaaaacaatgaaatcgttgaaatgttaacgacggtcagtgccgagttaggtgcggatacgcataacgtggtgattgcagatgacttaacggccatcactgatgaacgtgagcgccgattagcgattcaacatttaatacggacgttgcacgcggttgaacagccaccatacttggtcctgatggctgacgaactgggaacccctgcgtcgcaaagtgcggtgacggcttttattgctgctgagccgaccaaggcagcgccattacgagatgaacagccggacgaaacgttcaagctgcggaccccgctagacatggatgaggtggcggcaactttaacagcgttgtgtcgacgtgcgagtcaggatgaacaacagcaagccgcattgaaccattttgtaagtcttaattatgatgaaattttaaacgtgaaaggtgatcaatatgcaaacagtgtacggaattaaagctcatggtggtaagttagttaatttagaagattttagtgaagcaacgcgtcaggctgctgagcagctgccaagtttaaccatcaataattggaatatctcagacttggaattaattgggattggtggttttagccccctgactggcttcatggtcagtgatgattaccattcagtggtcaacacgatgcacttgaagagtagcgttatctggagtgtaccaattacgctgggtgtgtcccaagcggatgctgataagattgaattgaatactaagattgctttgaagggcgctgacggcgtcatttatggcacgatgcaagttgaagataagtttgttccggacaagcaattggaagcccaaaacgtctacaagaccaccgacgaagcccatccaggtgttaaacgcttgtatgccaatggtgacgtctacttgggtggcgcaattaaattgttgcataagccagatcatggtgcttttagtgattattatatggaaccattagaaactcggaagatgttccatgacctcggctggaagcggatcgttgggttccagacacggaatccaattcatcgggcgcatgaatatattcaaaaattagctttggaaaacgtcgatgggttattcttaaatccattggttggtgagaccaaggcggatgatattccagcagacgttcggatggaaagctataagacgattctgaagtattactatccagaagaccgtgttcggttggtcatttatccagccgcgatgcggtatgctggtcctaaggaagccatcttacacgcaatcgttcgtaaaaactatggttgtactgactttatcgtcggtcgtgaccatgctggtgtgggtgactattacgggacctatgaagcccaagaattaatcacttcggtcgaagatgagatgggcatgcacttcttcaaattcgataattccttctactgcaaaaagtgtggttcaatggcaacgcagaagacttgtccacacggtgccgaagatcacatctcattaagcgggacgaaggtgcgtaagatgctggctgatggtgttgtaccaccaaaggaagtttcacgtcccgaagttgcccgggttctcattgatgggttgaagcgtaaacgtgaacagcaacaggaggtctaagcatggtaaaatcagataatattacttggcatcaatcgcaagttagcaaggccgaacggcaagcgctgaaccatcataagagtgtggttttatggtttactggcctgtccggttccggtaagtcgacgattgcgaatgccgttgaaaaagcattatttgaccaacaagttggtagttacgttttagacggcgataatatgcgctttggcttgaataagaatttaggcttctcagctgaagaccgtgaagaaaatattcgccgaatcggcgaagttgccaaactatttgtcgatgctggcgtgattacgttgacagctttcatttcaccatatcggaccgaccgtgataaagtgcgggcgaaccttgaggtcgatgagtttattgaagtgttcgtcgacacgccgcttgaagtttgcgaacaacgagatgtgaaacaattgtacgcgaaggcgcgtcgtggtgaaatcacgggctttacaggcatcgatgcaccatacgaagcacctatcgatcctgagattacgattgacacgtccaaacaaccactgaccgcttccgtccaacaagtattgaattacttggcggaacatcattacgtcagtttggctactgcaaatgaaaactagtgcaatcattactgccatcacaaaatcgattgtgaaaatggaccgaatcttggtctatcgtcatacgaatccggatcccgatgcaatcggggcacaatttggactagtcgccttgctcaaagcggcttacccggagaaactcgttgtggcgatggccccagttccgggccatttggcgtggatcgatacaaccgatgagcagttagtgaccccccaagcaacggacttagtcattgccgtagattgtgctaaccatgagcgcctagctggggagttgccaacaggtgcctttgtgattaaaatcgaccatcacccgaatcacgatccctatgggcaactgaactgggtcgatgaaacttatagcagttgctcggagatgatttatgagttggcgcaagcggggtgctttacagtgacggcggccgttgcaaccaagctatatgccggaattatcggtgatacggtgcgcttttcaactcctgagacgtccactcgaactctgaagattgctagtgcactcgcggcaacggacattgatattgccactattagtcaccacgaaatggacttaacgccagcactcagcaagttgtatgggtacgtcctgagtgaacaaactattgagccaagtggtctggcacacgttgtcttaccgcaacggctatttagtgacttgagtctggaatgtggcgatgaggatgcgcttgtcccgttgcccggtaacctgacgacggtcaaagtttggttgttcttcattgaaaccccacaggggcaataccgcgtacattttcggtcgaaagcaatcaatgtcaatgcggtcgcaaaagcgttcaatggcggcggtcatccgttagcaagtggggcatttgttcctgacctagcgacagttggacaagtcattgagcaaatgcaggcgcaaatattagctgcgacggccgtagattgagtataataaatttaatataaactgcactgattcggtttgacatggcaattgttagtcattctgtgtcggtcacgtgggttgccacgggaaggttagaccgccagtatcagcgtatgagcctaatattctggctgacaaaacgggtatgtcgttggagtagcggtcgtgaggaattaattggcgtcagacaaaatagtgagatagggtcggtgaaaggtaaatgaaaaagcgaaattggttgattgcactaattgtcgttgtgattgtcgcgattggcggtggttttgggtattacaaatatcatcagtcaactgcgacgacaacgaccactagtaaggtacgttcggcgagtgcaacgaagaaggacatcaacacgcggctagtcaagactgagattaaggcccagtcgagtgagacggcgacgctgaagaaggcggtcgccaataagaattataccgttaataacatgtacacgaaggttaacccatacggggtgtccccgttatccgctaaggtgattttccagacgagcaaggcggccaaggtcagttatacggtggtcggcaagagtagtaagacttcaatttctaatacggtcaataagtacacaacgagtcatgatttgaccgtgctggggttatacgccaacacgaataaccaggtcaagattaaggtgacttataaggatggcacgtcgacgaccaagacgatccgactgaaaacggcgaagttaccatcggcgttgaccgattttaagatcaacgttaagaaggctaacaaacaaaaaatggtcttagggactggtaattcgaagctgacatttatggttcggacgacgatctctgggagcaagcagtctaaaaacttatcgttcgggatggatgcggatggtaatattcggtggtatacaacgcggccaacttcccacattttcaaacaacttaacaatgggcatttattgatttggaccaaatcgaatgctaagaattcatattttgatgagttagttgaaatggattatacgggtaaagtttataagacttataaatttaatcataaggcctggggtaaggctaagggttctaagaagcagaaccataatcaggtccaccatgacgtaacggaattaccaaacggtgatctgattgcgaccgtttccgatggcggccggacctatgtcgaagacacgatgatcgttatatcgcataagacgggtaagatcaccaaggtcatcaacatgaagaatatcctacctgcgaagttctatacgaagtacaacgcgacgaagtccagtaaatatatgggtaagaaggactggtttcatcagaactccgtctattatgataagacggataagagcttgattatttcaagtcgcaaccagaacttagtgatgaagatcgattacaagactgaaaagatcaagtggatcttgtctggtaagaagacttcagcttggccgaaatcgtaccgcaagtacttgctgaaggctagtggtaagattgcttggccgggtgggcaacatgccgccatcgttgatccaagcaccttgggcaagaagaactcgctcaacgtgatgatcttcaacaataacgtggcagttggtacgaccaagaaatcgttggcggactcttctggtaaatattcagaaggtgtcgaatatcatattaatgaaaagacgaagacgatttctcaagttggcagttacggcaagtcattaggtaagaagaactttgccaatattattggttctaatcgttacttgagtgcttcgaatcggctaattgattttggttggttgaataatggtaaatcagctaatattattgaatacgatttgaagagcaagcaacaggtgtttaacgttgaattaacgggccttccaagcggtggttatgtctaccgggccgaacgcttctcgttgtatccgacgaagcacacgtatggtattaatgaataagaattgaatgtaaaacgggcgctcatgactagatggctcatctggtcgggggcgcctgtttgcgtgttgcgctaatcagtcacggccgttaacagattatagagagacagtcaggcattgtttttccccttgacaatccagttttggagcgtccgtctgacttcaatctgacctcaaccgtgcctgttcacaaaccaattgctagtccgaaaaggtcgttttcaaagttgtgactgaacgttaatgaaaaagtcacaatttggtcgcaaaatcatccgcaaagctagaataatttcataccatgtcgcatttatgttcacattccaagtctacaatggttcttatgttgaacggcgcgacggatataggttgattatgagcagtggcgcaagactcagcaagatgaaaattagttgaagcggagcgatgacgatgaccttaaatattgcaattgttttaatcacgttattagtatcatttatattaatggccatggaagttacgaccccgaacgccgtaatcttgtgtgccttagcgttcttgatgtttgtcggcatcttgtcgccaacggacgcactgtcaggttttgctaacgacgggttagcgacaattgccctgatgtatattattgcctatgccatcgccaaaagtaatattattacccacttatttgaccggattctcggcgatggtcacagcgaaaagcgttccttattacggttgttagcgagcgtgagtgtgatttcaccgtttatgaataataccccgattgtgtccactttgacaccgatggtccagcgttggacgaagcagaaagggatggcaatctcaaagttcttgatcccactatcctacgccacgattctgagtgggttgttgaccgttctagggacttcgaccaatctagtggcacaaggattattgtctaagtacaaattagcacaatttggtacctttgacttggccgtcatcgggattcccatcacgattattgggttgatttacttactgacgatcgggtaccgcatgttaccgacctattatgggagtagtgttgacgatgttgttgctgaaccgaatgattacttgattgaaatgacgatcggcgatgagtttgaacacctcaatcaaacggtggtcgccgccaaacttcgtaatttgccgcgctctttcttagtggcgattaatcggagtggtcagtcgatcgtgccggtgacggatgagacgattctacagttaggtgaccgtctttacttcactggaaattttgattgtattaatgatcttatgaatattaaaggtctaataccaagcactcagaaaatcaatatgactgatatcaccaatgaacgggttcggctcgtcgaagtctccattccggacacgtccagtttggtgaaccaaacggtcaaatcagcgcgttttcgcaatgtctttgggagtgtcgtcgtcgcaattcgacgcaacgatgtcaacctcgaagggcatctcggaagtattcgcttaaaaggcggggacaacttggtcatgattaccactggtgaaccagacgagctggcaagtctcaaagatttacacgtctttaattcacaaccagtgaagtcccggaaacatacttataaggatgttttaccgattgttttattggttgcaacgatcatcgtgtcgactatgggcgtgattgatttgttcgttggtctggcggcctcgtgcgtggtacttttcttgacgaaatgcgtttcaatcagcgatattgtgaaggctgtcgatatgaacgtgttgtttttagtggctagtagttatggacttgggcttgcgatgtcgaatgtgggtgctgataagtttatcgcaaagtcattagtagcaattaccgggaacgcatcaccaatcatctatatgttcctgatttatttcgtgactaacttcttaacggccattttgtccaatgcggcggcgttatcactgatgtttccagtggtcgtttccgcagcgaagttggaaaatctacccgtgatgatgcttgtgatgttgattacgattgctgcgacggcagacttttcaacgccaatcgggtaccaaacaaacttaattgtttacggccctggacattataagttcacggactactttaaagtcggaattccgttaaatttgatttgtatggtcgtttgtgtgtttgtgtcctattactattatatggtgctgtgatgtgacttaatcgaatctaaaagacttgtgagcgcctgctgacaagtttttttgtgttggttagtaaatcggtgacagcttagcacagtgaaataaccttaaaaagtaaatcaagacggccaattcactaattaaaataaaatatttaatatttgcgaacaaaggactagtattataaatctaaagttgatatactagcaaagtttgcttgtctggcaaagcgccaagaaaacgattacaagtacgtcatcttaattaatgaaaggagtgcgaaaatgaacgatttaacaaagggaaaaccgctaaaattaattttttggtttacgattccgttactaatcggtaacatttttcagcaattttatagtttatcggacacgttgatcgttggtcagacgttaggggttaaagccctagcggcggttggatcaactgggagtgttcagtttttgatcattggctttgcgcaggggttaaccgctggcttatccatattaacagcccaacattttggggcacgtgattttaaagcagtgcggcgcagttttgcgattagtatcgtagttagtctaattgttgggatcattttgacgattctgtcgttgatcttcgttgaccatatcttgttgttaatgcaaacgccaacggatatcattgcggatgcgcggacattcttacaaattatgcttggcgggatgctggcaccaattgcgttcaacctgttgtcaaacatcattcgcgcactcggtgatagtcgcacgcctttatggtttttgattatcagcgcgttaattaatattggcttggaattgctattcattttggttttcaaatggggcattgccggggcgagctgggcaaccattttagcacaaaccattgcaacgctcatgtgtgtggtttacatcatcgtcaaagtacccatcttgcacattggacggcgccacttcaagttagtttggtcggaagtgaaggctcacctgaatgttgggttacccatggcttttcagatgtcgatcattgcgattggaacgattgtgttacaagcggcactgaatagtcttggcactaattcagtggcggcgacgactgccgctcagaaaatcgaccaagtcgcgactcagccattaatgtcttttggggtcaccatggcgactttcgcggctcagaattatggtgctcatcagtatgaacggattatcacgggagtcaaacagaccatgtggctgtcggggagctttagtgtggctgccggtttgattgaaattatttggggtaaacagcttgtgggattcttcgtcggtcatcaggacatggcggtattgaacttatcccagacgtattttaacgtcatcgggagcacgtatatcctattatcaatgttatttattatgcgtaataccttgcaagggcttggacgcagcgcaattccaactttggcaggcgcggcggaactctttatgcgggtgtttgcagcgctgatcttagttcggatcttcgattacgccggtgcttgtagttcggaaccgttagcttggttagggtcgtgtgccgtgcttttgcctgcttatattaaatcagtccacgatttacgacaacaggcccgcatgacaaacacggtcgcagaaggggccgaaccaatattaaacgattctgaaaaattgtaattaaggcttgcaaccaagtggattatttgataatatttgttatcaattttattttaaagtcactcatataatctcccggacacctgtggacggggcatgaattgaaaaacgttaaggagtttacaaatggccgtagaattaaaaattggcgattacgtcgctggtaagaagtttgcttcgttggaacatgatttcaagggtgaaattgaaaaagtgtatgaaaattcagtcttgatcttaattaaggaatttcaaaaagctgacgaaccaattgttaacgagtataaccaccgcgcagttgttcgtaaggatgatgctaagctcattaaagcggctccaaagccgaaagtcgtcccagaaaaagaagactaaaaatttataaataaccatgacaacagaaaaaatgtatgctatactaatttctgttgtcaaatgcgggtgtagtttagtggtaaaattcaagcttcccaagcttgcgtcgcgggtccgattcccgtcacccgctttgctattaatcatttcggttagtagtcattgtattctcaagctccttgagcgcatggtccgttggtctagttggtttaggacgcctgcctgtcacgcaggagatcacgagttcgagtctcgtacggaccgtcaatagatgatgataatcaagaacgttagtcagcaatgacccgttcttttttattgagtaaaaatcaagatgactaaatagttgaccggatgggtgatcaacagtaatcgttaaggagcgcaaatgcaatttataacaacatctttcgatgagttaactgttcggcagttacaacagatttacaagttacgagtggcggtttttgtcgtcgaacaggcctgtccgtatcaagaagtcgacgatacggacttgatggcttggcatttacgagggctgaattcaacggaacagctgctagtatatgcgcgattaatgcgtgaagccaaccagcaggcccgtatcggccgggtgatcaccaatccggcggtgcgggggcacggctacggtcagcagttgctccaacaggcgattgtgcagattcaagcgttgtggccttccacgacgcaaatcaatattcaggcccagcattacttagatcgcttctaccgtggatttggttttcaaccagtctctggcgtttatttagaagatgggattccgcatcagaatatgattttaacgttgaactagtcaaaacggctgaattctgttatactaacgcatggtaaaaatatatacgtctaatgagaaagaatagtacgatgaacgtttagaccagcgagttcgggatgatgggagccgaatctaaacattattggaagcgcgcttttgaagacgacaattcgataataagtggatgtcatatcaattagagtggtaccgcgggcacgtctcgtctcttacatgtttttaaatatgtgagggactttttttgtcccgtaagacaatcaaggaggacaatatggattataaacaactcgtcgcagcggccttagcgccagcactaccagatttaacgcaggaagtgattctagataagatcgaacaaccaaagacgtctaagcagggggacttggcctttccgaccttcaccttagccaaaacgttacacaaggcacctcaaatgattgccatcgacatcgtcgaaaaagtcgatggcagtgactttgaaaaagttgttgcaatgggcccgtacgttaacttcttcttcaagaaagatgcgtttgcagccgatattttaaatcaagtgttgtcgaatggtggccattttggtgatgctaagctcggtgaagcgggtcaagttcccatcgatatgtcatcgccaaacattgccaaaccaatctcaatggggcatttgcggtcaacagtgattgggaattctttggcaaatattttaagtaagttggattaccaacccgttaagatcaaccacttaggtgactggggcacgcagttcggtaagttgatcacggcctacaaaatgtggggaagcgaagctgaggtcaaggctgatccaatcaataacttattaaaatactatgtacgtttccataaagaagacgtcgatcatcctgaaatggatgacgaggcgcgtgaatggttcaaaaaattggaaaatggtgatgaagaagccacccatctgtggtcatggttccgctcagaatcattgaaagcgttcaagaagatttaccaacgcttggatatcgactttgattccttcaagggtgaggccttctacaatgataagatgcaagaagttgtcgacatcttggaagacaagcacctcttgcaagaaagtcaaggcgccgaagtggtggacttaagcaaatatgacttgaatccggcattgattaaaaaatcagatggcgcgaccttgtacatcacgcgggacttggccgctgcgatctaccggaaacggacttatgatttcgtgcagtccctctacgtcgttgggaatgaacagaccaaccactttaagcaattaaaggctgtgttgaccgagatgggctttgactgggctgaccagatccaccacattccatttggtttgattacttctggtggtaagaagttgtcaactcggagtggccgggtcatcctgcttgataaggtcttggacgatgcggttgcgttagctcatgaacaaatcgaagccaagaatccggacttgcctaacaaggatgaagttgcggatgcggttgggattggcgctgtggtcttccatgatttgaagaacgaacggatgaacagctttgactttaacttggaagaagttgttcgtttcgagggtgagactgggccatacgtgcagtacgcccatgcacgcgctgaaagtatcttacgtaaagctggtagcccagaaattgcggcaaccgagcaaacgttaagcgacccagccgcttgggataccttgaagttattgagtgaattcccagcgactgtagtacgtgccagcacggaatacgaaccatccgttattgctaagtatgcgatccacttagccaaggcatacaacaagtattatgctaacaccaaaatcttagttgaagatgatgaattaaacgctcgtctggctttggtcaagagtgtcagcatcgtcctgaaggaagcccttcgcttacttggcgttaaggctcccgatgaaatgtaattagaattaattaacaactgttcaaatttgaacgccacgcatactaaaccggccgttaaagccgggcgagaatgcgtggcgtttttttgttgcggccgtagaggcacggaactcgatatacaaccgatggcgaacgcaagttgtgaaccaatcgcagaaatcgcaagtaggtagcggaggcccactattgtaactggaaccagacttatcgtgtgaagtggattatcagtcgacggatcaaggctttaccgccccggccgagtaaaataagcccgattaacggccaagatagtaacaataggcacccatgaatgacaaaggaaacgctgatcgacatcatatcgtcacgatattcattctgagagagcaacatatcacggctactgacgggattgacggcgttatgataaatttgagtgattgtttgatgttgaccggtcgcatcattcaaggcacgtgaagcgactgaaatcatttgaaaagggttatgggtaagtcgtggcaataggcacattaggagtggatggccgaagaagtatgcagaagtcagatagaggttggttaacgtccaatgtaggtgaaaacggccgctgggatctgcggtgacggcataaaaagcaatcacgaaaaaaatcgcgcaacgaatatagtcggaaccgattaagctgaaagcctttttcatggttatccctccgtttgaggcttggctgtgttttcttcagataaatgctcaaactgggttgcgggcgtcatgatgcttacaaatgaccgcccatccgagttagtgaaaccaagcatgatttatgtctgattataagtcggtgtgatgatcgaaacaaacattaaaatcttaataaggcaacttccaatactaaaattttaatgacctgtttagtcgtccggggtggtattctgaaaactaattcaaaatgccatattgggggcttggtgatgagctacttagaactaacgaatatttgtaagaactatcaggttggcaaacaaacattcaacgtcttgaaggacattaacttgcagtttgaactcggtgagtttgtggcgattgtcggtgaatcaggtggtggtaagacaaccttgatgaatattattgggggactagaccatgatttcacgggaaccgtcagtatcgctggacaaccacttgattatcattatgagcgccagctggatcggtaccggcgcgaagtcattggctatatctcacagacctacaatctaatcggtcatttgaccgtgcttgagaatgtcatgctagccttagatatgactaaattaagccatggtgaccgattgcgacgggcacacgagctcctagcaaacgttggcttgacggcacaaataaaaaaatacccgcaacaattatcaggtggtcaaaaacaacgggtggcaatcgctcgagcattagccggtgatcctaaaattttgattgcggatgagccgactggtgcgctggatgcagacaataccgccgatgtcatggccatgcttcaaaaaatcgcacgggaagggcgcttggtgatttgtgtgacccattcacagcgcgtggcgggtgcggcgacccggattgccgagttggtgaatggacgaattaagtcacaaccagtgaccacccaaaatgtcggcaccacgcaaacagttgcgtcactacctgcgcggccactttcgtattgggtatcagtcatgatggccttcaagcatatgcggcatacgtggatctggaatacgctaattgtcgttggcacagcgattggattattcgccgtcatgcttttcaatggtctggggaccggcataaaagggtatattaaccacgaaatgaatgcgttggtggacccacaatcaattatggtcatgcaccaagcggataacgcgaaggatcgtgatgaacaggctgcggccgtctatgatccagctgtagccggcggtatcgcagcccggatgccggtgttcaccgactcacaactcacagcgttgcgtgaccttaagcacgtgaccaacgtggaacccgggatttcagctacaaacgcaacgattgcgattggacaacaaaagtatgccgcacctgaactgacgacctggacgagtagtgatccgacccggcagttgaaagcaggccacgtggcgggtgacaatcaaatcgtattagataagtcttcaatcgcgcagaaatggtcggcaacgcgttggcgtcagttagtgggtcgggctgtgactgtgagttatcaaaccttcaatcaaaaagggcaacccgtgaccgtggcgcgcgtgttgacggttgccggaatagtagatagtacctctgaggtcggtttgaatgcagttaactacaccacgatgcagtcgatgcgttcagcggcacgtgtctcaacacaaccaacgtttgtgagcgttagaattaagagtcgggtgcaaaatcaggtcgtggtaaatgaaattaaccacttatcaattaatggcaagcacccatttgccgcgactagtattgcggccactttggattcgttcaatacttacgttaatattgccactaaagtgttggcggcgattgcggggatttcattaatcgtttccgcattaatgattattgtaacgatgttcatgtcggtcagtgctcggatgcgagaaattggtattctgcggtcgctgggggagcgccggcgtgatattcgccggctatttactagtgaagcgctgatgttaggcattatcagtgccacgttagcgactgggctgtcctatttagctgaacgagggctcaatcatggtctggctaagctaactggcgggtatgcgctagttcagattcagctcggcaacgtaattgcaatttttgtaatcgcaattattatcgcctggcttgcggctattttaccagcaaggcgggctgcgcgggctaatccgatcaaagccttggccgctgaataacaagtgattggataattgtcgtgatggaaaagttatgttaaccagtcaacttgtttgaaggagtggttaaaaactgtgcgagatgtcgcaaaatagtcgttttattcaggggtgggggtcattaattcattagggctggtattaacgacagcagccagttctaatattggctcgcccagggtacgcagaaacttctgattgagaaaagtaaattagctcggctaggttctgcgttactagtcgagctaattttgattaatatcttctggtcttaggtaactggggatggttatttggcagttagcgtgtacttgagacgtcgatgatggttctttacaaaccggtgctagttagttaattgacataactaaacattattagtaaaaactaatttttgagaagataagtagcaatggcaaaattcaattgtatccgtttaaattgattaccatacatgttggcgcttactttttgtggccaaaaccgtgtcttgtcaaccctatgcagaattaatccatcgcccacttgacttattcaacgagtgaattaattcgccaacaaacttatcagtgacttctcataaaaagcccaaagtcccccctgttatacatgcaaaacactagtaattcagcgactgtccgggtatgctgttggtgtaaattaagctaaggagggttttgttttgaggaaacaaccacagacactagtcattggtggaacgcaggttgctagtggcaagagcttgttgacactggcgttagcgaacgtattgactaattggaaaatgacggtcaccatcgttagttgcaattatcaaaccgttacgtggcggaccattcaaaagcatcactgccatgagtggcagtcagatattcgaacggctaacgagctcaacaacttttggatagcgttgcagggtgtccagacggattatttattgatagatcttgattctacgggtccgaaacacgataactatacttggttactcaacgagtgctggttgccattagcgcaacaaattattttaacctattcgactgaaacggatgtcaacacgttgttgtatcaagatttaggggccttacagtttagcatggaatacacactgaccaatcctaaaatctacaccgttttgaatcgttatccagcaccagtagctgttaggtcagcgatgacggccagtgacttactcccattccatcgtcaatttcaaactcggcacgcagaatttgctgcaatgaatttagagccattgggtatgttgaccgacgcccgccagcacccagaaaaagttttggcggatgccacgcaaattttaaccaaacttgtggcgtaattatggctaattattgatcaaaacgacacgcgctgtgatgagcaacgggtgcttttttgcggatgccaatcacagcgaaatatgtacaaatctggtataaatgtagtgatgcgaattttgtgggggaaatctaatggaaacgacacgagagcttatttatgatacggtacgcaaattggttttaacggatacgcggtatcacgatggtgtgacagcaatggtcattgctacacaattgaaaatgcaacgcacaaatgttagcgcggctttgaatgccttagtgcgcaaacaaaaattggtcaagactaagacgcggccagttcaatttttattagctgcgtcccacctccaagagccatttacgggactaattggtcgtttaaatagcttgcaacatgcgatcaaactagcaaaagcggctgttttgtatccgagtggtcctttgaatattcacattgtggcaaacggtggggcgggcagtaccacgtttgtacacgaaattcagaattttgttgagcaacggggtatattaacggcagctagcagccccatcattgttaagtgtcgtgattatgcagacgatattcaccaacttgatagtcaattatttggtgagcatggccagctagcgcacagtctttgggcacactccgagggcggtattgttgtgattgaccattacgactatttagatggcccgcaacgcgcacaattgacgagtgtcatggaagccgtggcgtcccataagcaaccaccgttaatcattttagtgagcgggattgatcaggaaattcttaggacgcagcaattgataatgaaaattgaattacctgattttaagcaacgaccgtggtcagaaagatgggcgttgattcgtcgttttttgacgattgaagctcaacaatccaagcggacgattcgattggaactagccgttgcccaggcgctcatgctggcaaattatgatcagaatttgaaaacgatgaaagcgaccatcacgatggcctgtgcgcaggcttatgtccgatttatggctgatgctgaccgtgaagttcgcgtgtaccttgcggatctatcgcccgccgttcaacaagcgttagcgcacgaacgggactatcaacaagaattggcggccgtgttggcagcagctgatttatcgtttgcggccaagtcgtcttcgggtttgagctcagattcattgcaagcgagtcggcaacaagttgagccgggaacaagtcctcgcagtgtccaagtgccaaggtcagttgaacaatcaccgtcagtgataaaaccgagtatcgtccaacagcgtgcgtccaatacgcaaaatttagcacaaatcgttgcgccactaattattaagattgtcaaagactggcaaccagattgtgaacggttattggcacggccgttgaccgagagtgtgtttaatggattatgtttacacattaatgggatgtatcgccaaatgccaacgaccaaacctgcatcagcgacaatgatcacgcaattacagtcacaacatgtggccgaatatgaggctgctgttaaattagcacaggtcttagcgacaaaactagatttgaccatttcaccggctgaagttgctttattagcaacgtttttagttgcacaatcaccagtgacgcgtcatcacccggttgtgctttacgtcatgcaaggaatggggactgcccaggccctgatgcgaacaacgaacacgctcagcgctgtcagcaatacttatgcttatgatgttgacttatcagccgatagcacgatggtgatgaaggcactgaagcataaaatcagcgagattgattgcggtgcaggtgtgctagtcatttatgatatgggggcaatcaaatggatgttgacgaccattcaaggcgaactcgcgaccaaaattcggatgattcaagtcccagtgactttagtcggagtcgatgctgctcgaaagagtgcgcgcgtaatggacgtggacgatgtttatcatctagtgcaagtcgatctaaaccaactgaacgccgaaaagacaacaaaagatgaattgattattacgctgtgtcatacgggtgaggggggtgctgcgcaattaaaagattatattgaccaatattcacggttacagatgcgcgtcaaagcgttggcaattgggcatcgtgatgagttggtggcaaccgtacttagactacaacaggtttatcagattcatgcatttgtcggcacctttgatcctcaattattcggcattccgtttatttcgatggcagcaatttttgaacattcacatcagcagttagatcaagtgctgatgtttcggccggaagctggtcgctgggatacttataatcagatctatcagtattttaagacgcagttcgaatacgcagaagttgctaagttgcagcgtgtgttaccaccactcatggatgatttgacaaccttataccaactaactgaggatcaacaaattggcctgtttgttcacttgggtagcatgattgaccgtattttggctggcaagattgtgacgacaacggcgcaaacgcggaaattagtgacccagtattcgcaagattatcagcaattacgacggtgtctacggccggtcgagcagacatttaaactgattgtgaatgatgagatgattgggacgctactggtcatcttaaagcaattacactaatcttaagtgccacggataatcgtttgagattgatatcaggaaggtgtcagctttgattttgatggggagatgatggttggttctagcattgacggagcagtttttaaatgagacttaaataagtcgcttcaagcagtggcgattgcttgaagcgactatttagatggtcagcgattcgtatgaatttaaaggcctaaccgttgacaaagtatctatggttggctcggtttgcaagttgttgttcggtgagcaatgatttgttgttcgagttgcaataacttgtcagacatccgtccgagtagcagtgcttgactaaaatttctgagtagccaatggtgttgttgtggccgataactgtcaacatcttctagaaaggtcacggttgttttggtgccttcagcaatggtcgaataggtcacggttacggtatccagtggtgaaatagctgtcatttggtacttaatcccacgctgataatcgtcaatcgtaattttaatctgagcggccgttttggcggtcgtttttgtatatgtcagtcctttcttgattgacgttgctgtgagtatttcaccagtagcggcttgaatctctatgagtagttgtttttctaaccagtcataaaattccgtgtttgtgacggcaagtgtgcgaatgattttcatgattcgattatagcgagacattttcgacagttcaaggctgaaaaaaacgcgttaaaatgagtaagctatacaacccgatgaatcagctatacacaatacataaattggtcattaaacctatacactaatagtgatgaagttggatatttagtctaattcagctattatgacgccacgtgtgtgttgatactgctaattcatggaccttaaatctatacacaagcatatgtaagcgcttttgtggttaatgacaaaacttgttacgatatgtttgtcgacaaatacagaaagtaggtaaccggataatgacattagccaataatactgaaactcaagatattgcaatgacacttatcgcgtattctggtgaaggtcgtacgctggcttttaatgcgttagatgcgatgcatcgcgatgctttctccgaatctaagatgttattgaagcaatctagtgaagcactggggaaagcacatgatgttcaaacccaactactggtggctgaggcgaatggtcaacaggtttccattgatattttactaattcatgctcaagatcattttatgacgagtctgttagctaacgagttaatcgctgagatgttaaagatgtctcaaaaatttgaaaggatggtcgatttatgaaggcaatcaacgtgttattagtttgtgcgggcggtatgtcaaccagcattttaatgaaaaagttacagcaatatcgtgacgaacaaggtgttgcagggcaaatccaggcagtaggcttgtccgcgtatgaagatgtctatcaggactatgacgttattttaatggggccgcaagtggcttatcggcagggtgaagttgaggcggcaactgggttgcccgtcgctgctattccaccattggactatgcggtgggtgacagtgcccatattttcaaactggccgagaacttggtgtgatgacgagggattagtattcgggggtgaaggacgatggaacgcttttttaatagtaaactgatggtcggcttacaacgcgccggccagggacttggcaataataagtttattaccgcattacaggcagctatgatgtctttgatgggtattctaatggttggcgcgatctttcaaatcacgatgtcagtacttggaccgacgatgtttggcgtgttatcagcaaagagtattctgttagcctacttgaagattccattccaattctcaatgaattctttatcaatttgggttgttttattcttgggattccattacgccaagaatttaaaaatgacggccccaatcatgaatgcgattgacgcattatttggtttttggattgtggccggtgggttgattgtcagtaagactggaacagttagcattgatacaacctatttaggtgctcagggaatgtttattggcttcgtcgtagtttggatttccgtccgcgttgagaaattatgtacagacaagaatattcgaatcaacatgccagatgcagtcccccaatttctccaagacggttttgcatccattgtgccattattgtttaacgccgtgattttcttgggcgcatcgttattagtcacggttggaacagccggtaagtataatatttgttcgggttttatggaattactggcaattccactgagtgcactgacttcaaccataggtatttttgtcctgtgtatcttgggtgctttattatggacctttggcattcatggtacgatgattttagtcccaattgtgatgccgttagtgattcaagcggtttctgaaaatgccgcattgcaggcagctgggaagccggtggtgtttgcacctgtgatgttgttctcatttatgaccgtagcaggtggaactgggaataccctgccgttagcgctaatggcgatgcgttctaaatctaaacagctgagtgccgttggtaagctgtcaattatccccggctggttcaaaattaatgaacccatgacttttggtattccaattatgtataatccgattatgagtatcccgtttgtcctgaatattccggtagttatgttgtgtgcactcgtactatacaagattggatttttaacaccggggtggattgtaattaccgcgattttacccatgggttttggaagttatctcagtacgctcagttggcgcaacgcattgactgactatttgatgctgattccgtcagcgcttatctggtatcccttctttaaagtttatgaaaagcaactgattgccaaagaggcggcagttgaagctgaagaaaagcgggcggcagtttcgaatcaaggtaatgcgcccatgcaacctgtgaagcctgagaaagaggtgtgaatatgcaatttccggctgatttttactggggtggggctactgccgctaatcaatgcgaaggtgcttatgatgttgatggtcggggcctgactatgaaggatattacgacaatgggaggccttaatcagcgacggcaagtcacttatttgcaagcggatggtactcctggaaaaggggattcaattcctgctggagcacacggagcggtactgccagatgactattatcctaatcagactagtattgacttctatcatcgatatcaagaagatattgcgctgtttgcagagatgggtttcaaaatgtatcgaatgtcgatttcctggtcacggattttcccacgcggcgatgaaaatgaacctaatcaagcagggttggatttttatcgccaggtgttcgaaactttgaaaaaatatgaaattgaaccattggtgacgatttcacacttcgatatgccactgtatctggaggaaacgtatggtggctggaatgaccgtcggatgattggtttttaccagcattatgcggaaacgctatttacggcgtatcgtgggctggtaaagcactggattaccttcaatgaaattaataatacgatcatgtttctggcattgcgtgccaaagccggtgatgcagattaccaacgcgcttatcaacaattacattatcaatttgtcgctagtgctttagccgtacagcaagcacatgcgattgatggcgaaaataaagttggttgcatgatttgcggtatcacgtcttatccgttaacctgtgatccggcggatgtcttgcagaatcggtacgtctgggaacaaaacatctattactgtggtgatgtgcagtgccagggacagtatccaacctatgcacgacgtttatggaatgagcatcaagttgatttagacattacggacagtgatttagaagccttgaaagccggtacggttgactggtataccttctcgtattacatgtcaacggcagttacaacacatgaggtcagtgcaactgttggcggtaatttttcgatgggcgcgcgtaacccatatctacaatactctgaatgggagtgggcggatgacccggctggtctacaatattatttggagctgatgaatgatcgatatcatttaccactaatggttgttgaaaatggattgggtgccaaggattatttgacagtagatggtcaaatccatgatgtataccggattagctatctacgtaaacatattcaagcaatggcaacggcaattcaccatggcgtcaaactgattggttataccagttggggctgtattgatttagtttctgcaggtacagggcaaatgtctaaacgatacggattgatttatgtggatcgtcaagacgatggtagtggaactctggcccgaatcccgaaggactctttctactggtatcagcgagtgattgcatccaatggtcaagatctaggtccctcggcctcaaattaaatgactgttgctcagcagttttcgtcgatatcggatgaagactgcttttggttgttcaataagataattagccgcgtcaaacaaaacaagaggataccaccaccaagcaaggggagggtccaagaaccgagcattaagatcaaacggggtgctagcaaactaccaataacggtagtggtgtcgatgacggttaagacccccgtcattagagtattacgattgtttgtggggatttgttggatagtggtgaaaaaactaatgttggtctgtccgcgtaatgcaccaattaagaacatggtaatcataagactggcaaaggtcggccacataagtagtaagcacccaccggtgaaggccgtcaaagttagcagggattgctttgaccatcgttttagcaatagtggtgccaataagatacctgtggcgttagctgttaagaaccagctaagtggccagtgactatgcaacttgctgacgacgagccaaggaacggctactgcaatcgtcgcgtcgaccagataaccgagaacggcgtacagtaacgaccatgtcggccatgatcgatggcggtctagcttgacggtgacaaccgaatccgaggagagattggaacgtgttcggaattgccaatcgaagccggctgaaaccaagaacgctatccccattgttaagattagggtagccggtgttacccatagtaatgccatcgtgacgagcattgtcgcgctaacgatggccaactggcgaatctgagtttgatagccgttgacgatttgaatatttacgggcgcaagaagatctggcaaaatcgttttgttactgagcttataaaagaccccaattgatttattaagaacggcgacgatgactaagcaagtgatttgccaactaaccgtatttagtgcgtaataggcaccaatgaagagtattcccgtcaaaatatccgtaatgaacatcatttgtttggctgagtagtatttaagtacccgaccagctactaggttcagaccgattgccggcagcattgtcatcgccatgacgttgccgagtaactggggatcaccggtcttttcaatcgttaaccaggtgactaggtaagtaaagccatagaagccaaaaaaggtaattaacatgctgctgagatagcagagtagattatggcggtcgttaggatgtggcctaaattcttttttcattaactgacaaccaccggtgtatgggttgaaatgttttcatagagccatttggcatcagcaatcgtcagacgaatacaaccatgtgaattggcgactttaccaagttgctgggcttctttaacgatgtattgatcgttagcatcgactgggactgagtgaaataggtaaatcccatgatccttgaatgagacccagtaattggcgccttcacccgattgcgtgttaaaaaagtgttgtcctcgttcggcttggatttcaaagtgtcctttgggggtatcagagccatgtttgcccgtagaagcaagcatggtataaagggtctgatcgtggttttttaagtagactcgctgttttttgattgaaacctgaatgttgatgtcatcgtatttagccagtttgggatacggccgtgacagggagggcttgtgccagtcaacggtctccgggactggcgtggttaccttagttgctgaatgactaactttagtgattggccgattactggcaatagcctggtggtgccgggcaaataggtgtccgaatccggtaaaaatagttaagctaattgcgccaatcgtgacccagatgagctgatgaacactgattttcaaaataccatcccttacaaaaatgattttagtgattttagtttactcagttagcgaacgtttgtttatcaaaattgtgtaaactttgcatatcattttcgtaaaattttccaaaatgagttgtgatagccattattgctggtgccacgggtaatgtcggaaatcggcaaattaaagttatttgcagtaaatcagctgttaattagacaatttttccagctaattaaaaaatcgccattaagcagcgtgcttaacggcgatttgaatttttatttattgtaaactagcgaccttagctacgattttagcaggcgtttcccattcagaacgttcaaattcggaaacgggcacttcaataccaagctgattttgaagttctagtaacagttgtacggaacccatggaatctaagataccttcatcaaataaattggcatccatattgtttgaaacatcttccccagttaaatcttgcaagatcgatagtaccgttgctttaacatcatccatgatcaaaatacgccccttatcattattgtgaattattcagtcttcattctagcatagttttatcatcgatgatggttaatcaggtgtattaacgaaatctttacttgattaaacgttaaaattggcgtgaattaaatcagttaaaattttaatcccctgttcaaagcgatcgctggattcataagaaaagctcagacgaatgtactgattcggctggaaatcgtagatactaccagggttgaagagaacgttgtgcgcagtggcaaggtcgaataatttgggaatattaatgttgtcggctaagcggacccacagataaaagccacccgtgggcgtctgccaagtcgcaaaatcgtcccagtaatgatgcagaatttgttctgccgccgcggccttcttgacaagtacggaccggaaatcagcttgatacgtttcatattcaggatcagctaagatttctgccagtacaagttgtgacagtgagctagcgccgtaatcggtttgcatgcgcacgtcagtcaagcgatcgatgaccggtttggcggccaccgtccagccgatgcgtaatcccggtgcaagggactttgagatgctaccaaaataaataacgttgccagtcttatcgagtgccttcagtggctgtggcggctgctgatcgaaccagacatcttgataagcggcgtcttctaagattggtaagcggtgttcttgtgcggtttgtaagacctgttgacgtcgctcggcactcatgacgattccagtcgggttattgaatgtcggaatcgtgtaaagaatggcatggtgtccctgaatgggggcgttcatctgccagtacgccaagccctgactgtccatcgggatgccagcgagatgggtgtgggccgattgaaagacgtgtaaagatttgacataagtaggtgcttccgtgtagatggtggcatctttgggaaatagtgacattgagaccagttggagcgcttgtaatgatccggaagtaatcagaatgttttccggatgggtatgaatcccaactttttccaagtgacgtgcaatttgttgtcgcaaagccaaaatgcccgcaggctcggtatagttcaaactcgttaactgttcgcctagatgtgcaaaggcccgttgaaaaagtggacggggaaattgttctggtgcgggttcacccgtacttaaacgaataaccgcatcggtttcaaattggttgattttttggagcgcgtgggaattgggcttgaattggcctgctttaacatattgcgaccagttgacgtgttccgccaataagctggaccaatggttacctgaaataaccatcccagagcctggattgctcgtaattaagccgactgccattagttcatcaagtgccgtaattagggtgctacgattcacgccgaattgttcggccagtttacgctgcgcaggaagcttagccccaacggcccaattgcctttcgcgatttgttcttgaaaatagttagtaatttgttggtaaattggtgtgctgacctgtttatttggttgccagttgatcgttaaaattgccatggcaaacgcctcctgagtgcccatgcgggcgaattaagctgtcattctactagccagaaatttgatgattgattcaggtggttgggtgaaaattgttaaattggttggctacaaatgaaattatctctattataatcatctctgaattaaaagctagtcggatatgaccaattgattgaacgataattggttggtaaaagaatcgaattggctggtcttaaggaggtcaaaacatgcaagtgtttttacaaggattattatttggaattgtttacattgcaccaatcgggatgcaaaacttatttgtggtttcgacagctattgaacaaccattgcaacgggcattgcgggtggctttaattgtaattgcgttcgatacgtcgctctccctggcttgcttttatggggtgggccgattgttgcagaccactccctggctcgaattaggggtgttgttgattgggagtttattggtcttttacattggctggaatctgttgcggcaaaaggccacggcaatggggaccctcgacgcggacttttcatataaagcagcgattctgaccgctttttcggtagcatggctgaatccgcaagcactgattgatggttccgtgttgttggcggcgtttcgggtgtcaatcccggcggcactgacccatttctttatgttgggggtcatcctagcatccattatttggttcatcggtctgaccagcttgatcagtaagtttaaacatctcatgcaaccacgagtcctactctggatcaatcgaatctgtggtggcatcattattctatacggcgtgaagttgctagcaaccttcatcacgaaaatatagttgcggttacctctgacaatcggtatgctagtcgtattggactttttatgagagggacgatacgcatgaagattgctggtttcggagtggaggcctggttaaacgcacatgagcgtgaagcaaccactgatattagtcaaagctcaatcgcagccttaacgatggcagaaattgcggctttagacgaccaacaagcaccacaggatttttacgaagaactaggggcggcccggatggattatggctggatcgagggctcaccacgatttaaagaactcgttagtcagttatacgagcaagtgccagcagccaatgttctccaaacaaatggggcgaccggggctaatcatttagcaatctatagtttggtggaacccggcgatcacgtgattgcactgtacccgagttatcagcagctgtatgatattcccaagtcattgggcgctacggttgattattggcatattcatgagtcagcgggctggttgccggatattatggaactgcaacgcttgatccggccggaaacaaagatgattttactcaataatgccatcaatccgactgggagtttactagatcgaacactgttagaacaggtcgtcacattagctcgctcagttggagcgtacgttttggccgatgaggtctacgagccactggatgaaaccccgttcgtctcaattgccgatttatacgagcgtggaattgcggtcaacagtttatccaagacctattcagcgcctggtatccggatcgggtggacggcgacacctagtcaagccattgctgatatttttcggaagtatcgtgattatacgatgatctgcgggggcgttttgaatgaccaactggccgttagaattttagcgcaccgccaacgcgttctggcgcgaaatcgggagctagtcagtcgcaacctcaaaattctgacagagtgggtcgcacaggaaccgcgggtcgaattgattacgccacatggcatttcagtgtcgtgtattaaactaatagtaccgatcgatgatgagacgttctgtcaacaattactgcgggataccggtgttttattagtgcctggttcacgtttcgatattccggggcacgcccgcttaggttactgtacggatacgccgacgttacaacggggtctggatttattagggcaatatttacgccgctttgattagttactagtggactggtaaccgtggttgactcattacttttaaataattatacaaatttgtttaagcacattttcctaatagtggcggaaaatgtgctttttgaagttctgtgcgtagtttgccaagtgaatatttgctataatgtattcattacaagatttggggaggtttcgcgacatgaaaaagtcagagcgccaagcagttatcgaacaattaattagtgaatatccgatcgctacccaggaagaattgatggctaagcttaaagcagagggcattgctgcgacgcaagcgacgatttcgcgcgatatccgagagatgcagatcgttaagacgccggatgagcacggtcagacgcggtacgcgatttttaaaacaactaacaaaaatgaacaggaccggctatttgaaacgctacacgatgtggtgacgagcattgaccgtgttgaattcatgaatattattcatacgttaccgagtaatgggaatctattggcggcgatcattgatgatttgaacttgccagaagtgagtgggaccttggctggtcacgacacgatctttgtcgtgagtccgaatacgacggtggcaaagcagctatacgaatcctttgctagtcacattagtaatgaagactgactgtggtgagcagtctaattggttgcactaggccgtcgttcacggtatgattattgtcattaaaagaggtgtgagatatgaaatatacgaagaaacgggcgcctcgaaagaatcaaaaacaacgcgatgcgaccttcgataaatttaaacaacaacaaaatgagctcaacgctaaccgccggggtgtccggcgcaagtaatggctgagctagctttcaagtatgtcatatggacggctcggaagctttttttgtttatggccgttttatcgtagtgacctttaatctggttacaacacgtggtctaaatcagtgatttcggcaacaactggcaaacatcgggttatctacaaaatgagttgcgtttgattgttgaagattttttcaaggttgtggtcaattactgagcatcggaaaatttatgatacaattgtaaaagctaacaagtaacgcggacgttgtgacaggtgcgtcggctgaacaaggggaagattatgcaaaaaaatggtttttgggccacgatcaaagacggcttacgagtcattggcaattggttagcaccctattggcagcgattcgctgccgtcgtcggctaccaatggcaccggcgacaaatcacacggtggctaattgtactcgtcttgaccgtcatcttaattgggagtgcctatttaacttatgaagccaagacggctaaagttggtaatttacaggcggagttagaaaagacaactgaaatctatgataaggacaataaaaaggccggttcactctattcacaaaagggaacctatgtccatttgagtagtatttcaaaaaacttacagaacgcggtaatttcgactgaagaccgtaatttctataaagaacatggtttctcagtcaaaggaatcgggcgggcatttgtcctgctcgttatcaataagatacttggccgtgactacattagtggtggtgggagtacgttgacgcaacaattggtcaaaaacgcctacctaacacaacaacagaccttctcacgtaagtttcgggaaatctttttggcgattgaaactgaaaatgtctattctaagggccaaattttagcgatgtatttgaataacgcttatttcggccacggtgtctggggagctgaggatgcgtctgaacgatattttggcgtacacgcgtcagagttgtctgttgaccaggcggcgaccttggccggaatgctgagctcgcccagtggttatgatccaatcaatcatccgaaagcgtctacggctcgtcgaaacgtcgtcttgaataacatggtcgctaataataagctttccaaaagtgagtataagctttattcgcaaaaggcgatgacgctgacgaataactaccattatgaaagtggttataattatccatattatttcgatgcggtgattgatgaagcaattaataagtacgggctaacggaatctgacattatgaatcggggctataagatttatacgtcgcttgatcaagatgatcagacacagatgcaagattcttttaaggatagtacgttgttcccggccaacgcggacgatggtacgaaggtccaaggggcctcaattgcggttgatccgtcgacgggtggtgtgttagccgtagtcggtggtcggggcaaacacgtcttccggggctttaaccgtgcgactcagattaagcggcagccgggttcgacgatcaaaccgttggcagtgtatacaccagcactacaaaatggttatacgtatgattcgaacctttctaataagaagcaaacttttggggccaataaatatgcgcccaaaaactatgataatgtttatagtaaatcggtcccaatgtataccgcgttatcgcaaagtatgaatattccggcggtttggttattgaataagattggtgtgaataaagggtatcaatcggtgaaaaagtttggcttacccgttaccaagtcggatgataacctggcacttgccttaggtggtttgacgacgggggtatcacccgctcaaatgaccagtgcctatacagcgtttgcgaatggtggtaagaaaacgacggcccactttattacgaaaattgtcgatgctagtggcaatgtcgttgtcgataatacgaagactaagacgaagaaaattatgtccgccagcgttgctaaagaaatgaccagtatgatgcttggcacgtacaatagtgggaccggggctgcggccaagccgtatggatactcggttgctggtaagactgggagtacgcaggctgattacagtacgggttcgggaacgaaggatcagtggatgattgcttataccccggacattgtggtcacgacctggatcggatttgatacgacgaacagtactcattatttgaagagtttatctgaaaatcaactttcctcgttattcaagaatgaattacaaaatattttgccgaatacgaataatactagttttggtacgaaggatgctgcgacgctggcaaccgaatctaatagtagtgattcggatagttctgatagtggatcatccgtatgggaaaacgttgagaagggcgctaatgcagttaagaacaaggctaaagactggttctccaaagccaaaagtttccttggcaactagtaaagctagcttctgaacgtactaatgctattcaagttccgttaaaaatgctaaaataatgacgacacatacttcgaggaggaactcacgatggccgtaaatatttacgatactgcgaaccaattggaacaagaattacgtcagactaaagaattcaaggaattaaaggtcgcttatgacacgatgaagaccaatgacagtgccttttcactgtttaaggactttcaagaagttcagatgcaattgtcacaaaagcagatgaatggggaagaattgacggatgacgaagttcaaaaggcccatgatttagctgataaggttggcaacgttgacgaaattaagtccttaatgggtaaagaacgtaacttgaaccaattgatgaatgatttaaatcaaattatcactaaaccagttcaagaattataccagaactaagtaaattaaggatcgaggggcaatgacggaatctgttccgtgattgccccttttttagtgggggttatcatgaaatttctacacgcggcagatttacatttagatacaccgtttcaaggactgagtggcttaacaccagctttgcaggaacggttagtgacggcaccactgagggcactcagccgactagtcgatttggcggtggctgagcaagtcgatttcgtcctgctcgttggtgacttgtttgaccaacagggccaaagtgttcaggcccaggcggcactgatgacggcgctagcgcggttgaatacggcttcgattccggtgctgctatcgttcggtaaccatgattttcaagcggatttaagtcgctggcactttccggccaatgtgcacgtgtttggcccgcaggtaacaacggctaccttaacgactgtggcacaagaacgggtcgcgattagtgggtttagctatgcgcagcggtgggtgacgacggacccagttgatgattatcctgttaaagccacgggcgttgattatcagattggtaccttgcacggtcagattggtgtggcgggtgaccactacgccccgttcaacgttagtgaattattaacgaaacattatgattattgggcacttggtcatattcatcagcggcaaacgctcaattcgcaaccaccaatcgtatatgccggcaacacgcaggggcgccatcgcggtgaaactggggcgaaggggtgcctcattgtgaatagccaggccgatcagaccttgcaaccagtatttaacgccttgactgatattgaatgggcggattggacgccaacgctcactagtccagaacccatgtcccgttcacatatcgtccatcagttagctgatcaattatcattgaagatggttaccggcttaaaattagtaacgattacgttaccagctagtcttcaactgagtgcgatggcggaattagccttaaatcagggggccattctagcccagttgcaggaacaggcaaatgaacattggtggccggttgcgattgagcaagcaacgacggatacgatgacccccttgtttggtattaacgcgacgacctggcaacaagttggtgagcaggtcgtaaccgatcaagcagtcgctgaacttgcaggcaaactcttggatgaagactttctgaacaccgcgttgctggaagatatgtcacccactgcttggcaacaacaagtggtgcgactcttaaatgatcagtaccatttaacgacgggggtgaatgatgatgcagattaagcgtcttgaaattgcgggctttggcaaatttcaacagcagcagttcgagtttggtgatgggcttcaagtgatttacggcctcaatgaaagtggtaaatcaacaatgcgggcctttattctcggcatgttatttggttttccctcccgccgtcacccacttgaacgccatgaaccacaaggtacgaatcagtacggtggttcgatagagctagtggttgacgagacgacataccggttgacccggttaggtgatcaacccgctaccttggtgaacgtgcagacgcaggccgctcaaccgctggccttacttgacaagtggttagcgccttatgatcgtgaccagtatttgcgattgtttacgtttaaccaggctgaattgacggcgctcaaaactatgcacgccagcgatttgaacgtgcaattacaacaagtcggattggtgggcagtgcaccatggcgagaaacggcgactacgttacggacagatgcggaggcgttatataagccccgcggccgcaaacccaggttgaatcaagcattgcagcactatcgcatgttgacagaacaggtcaaggcggccaagcaacggtacccagaatacgaaacattacaaaatcgattgctggatttgcaggcacaacggacaagtacccaacgtgatttaaccaagttggatcatgaacaacaacagctcgccaatttacgaaatcagtggccggtctatcaacaattgcagcaactgcaagccactaatatgacgacgacactaactacggcgactaggacacgctatcaacaattaagccaacagcgaacggaattgcaacacgccttggcgagtgcacgtcagcaattaagtcagcaaccagttgatacacaatctcaaggactagttggcttctacgtccaacatcaagaccagtttgaccaattagaagctcagttaccaaccctgcaacaaaccttaggccaataccaaacgttgacccagcagggaagtgctgccaaggctgattttcaagcgcaaagtaatgcacatcctgagctgttaggttgcctctctccgcacaaacaggccgcaatcgagaccttgaaggcgacgttggcagcgacggcgaacacgcgtcgccaacatccggccccgaatagtccatcgcttgattggcgcttgattggtggtgcaatcgggattgtcgcgggattattgctaccattaggcggctttaaatggatcttgatgttagcaggtgtggccctacttggttggtttgggatgacccgtagtcagggtaaaccggtgcaagcaaccgaccacttatcagaccaattagtggctgctggtctggcaccgaatctgactgccagtgaagccttacagcaattggaactagtcgcggcactgcaacgcgcacaagctgcggtcacgactgctgatcaagcattagcaacacaggctgccaaactctggcaattgattcagccttatcaatttgcggcaggatggattcctgttgatcaggatcatttaacgacaagtgttactcgaattgcccaattctatgatcaagtccatcaagtgatgcaacagcagaccatgtccggccccgactttgcctttgtccagcggcaggtccagcagttgacgcagcaggtccgtgatctgaccgagcagctacaggcgttagcaacgactaacggtttagcggatgtagacgcgttgacgcgagcggttagtgatgccgaaaagcaaacggccaacgccacgagtcgtcaccaattacagcaacaactcagttctgctgagctatcggcgttaaagcagtatacgtcgcttgaagcgttgcaagcggtactggctgaaagacagcaacaacgtacccaaacggcgcagcaactgacacagttagctacggacattgccacggcgcaagcacaactcaaagagttgacggcggatggccagtacgctacgctacgtcagcaacaggcggatctacaaacggaaatcacagtcatggcacgtcaatggctaacgcggcagttgggtgcgaactggatcgatatggcgctacaggcattgacacaacagcaattaccaactgttttggccacagcaaccacgattttcgcgcaattaacggcacagcggtataataagattgacttagacggtgatgaaatggttgtgaagacggcaacaacgcagttcatggtcgcggaactttcaacggcgactaaggaacagttgtacttggctttacggctagcgttgatcaatcatttgggccaagcagctcagctaccactaatgattgatgatggcttggtgaattttgatgagcaacgtaagcaagctgcttggcaagtcttagcagcagttgctcagcatcatcaagtgctctactttacgaatgagacagcggcactgacccaactgaagacagcgactgtacagcagttaacctaggggggataacatggcaaagaagttatttgattatcaattagatgaaaccgtggatggctattttttgttgaaagattcggaagttcgcatcgccaagaacggcaagaagtttttagccattaattttcaggatacttccggcgagatttccgggaagttttgggatgcaagcgatacagatgtcgaaaactttcaggcaggtcggatcgttcatctgaaaggtaaacgcgaaaactatcagggtaatccgcaaatcaaaattcaacaaatgcggctcactcatagtggcgaaccgcaagaagtgcaacaatttgtggaacacgcaccactaaagaccgacacgatggcggatgaaatcaatcagtttgtctttgaaattactgaacctaattggaatcgaattgttcgccacatgttaacgacatttcatgaccggttctttagctatcccgcggcgaagaaaaatcatcacgcgttcgccggtggcttagcctatcacacgttatcaattttgcgcttagctaaggcagttgccgatcagtatccccacgttaaccgggccttactatacgccggtgcgattttgcacgacatgggtaagacgattgaaatgtcggggccggtctcgacgacttatacgttggcagggaacttggtcggtcacattgtcctgatcgatgaacaaatcgtggagacttgtcaacagttgaaaattgacgagcagtcggaatctgttttagtcttgcggcatacgattcttgcgcaccatggtttgttagaatatgggtcacccgttcggcctcatattatggaagctgaaatcttacatgacttggacgagttggacgcgtcgattcaaatgatgcagacttcacttggacacgcagagccgggcacgtatacggagcggatctttgctatggatggtcgtaacttttaccggccaactggtgatcaaacgaagggcgaattaccagacgaacaaaactaactaaatcgatacggtgtttgaaagaactgttgaaatcaatgattttaacagtttttttgtgacctttatttttgatgacgaattccattggggtgggtgagacggtgcaccattaattagcgtgggccgtcattaaagataaaataaaaattttaattgcaattaatatcctgacatgataagttactacgagtgattagttgttatcgttgaccattgcatacgtgttgaattagggcacgttgagcagtattggcgtgcacgatgcgcgtaatctagcggccagactgattgattaaacgataatccggcaactgtggcacgtgacgggaccgtcacagagacaaatgatttaaaattgcacgcattaggggagattatcgggatgaacgaacaagaagcatatgtaacgacattttattggctcgcggattgttggttggaaactagctatctgggacttgaggatgaatttgacgacgatgaaatcgatgacgccgtcaagtcactactaaatcggatgcaagccggggcaatttatgaggtaacggcggatgatccaatgtggcaagcatggaagcgggcagttagggccgtgcttacgcccaatgatcatgctgaacatgaagttgatgagaccgacggagaggatgaattagtgctgccagctggggtacgaccagaacgtcaattagaagaagttcaagcctatgcagcgatgaacgcgtttttgcaggcacaagatcaggaatatctgcaagaaattggtaaacgggcggccactcaggtcagtggtgccgggtggcaagtgtggcgtgcacatcgccagagcatgcatccggagtttgccgccccgctgacgttgactgctgaacaattaccagccgtgatgtgggcctttttcgataagtaccaggatactgaggactcttttgagatttttgaattggttaaccagcttgaacaatggcaaaaaagtgctgatcgagatttggacgcgcaatggtcacagcttgtggcgaaaagtcagattgatccggccgcaattacgcgcatgcagggcttgtcgttagcgattgagttatttgatcagcttgagtgggacggtgatttgactgccaaggcaactttgcagaataaattgatgcaacgcacgctcgatgacacgctcaatgatgagacgacagccaactgggcggatgcctggcaacactgggatttagcagatccgttgacaactgaacagtgggcccgacggtttgatccggcggacgactatgaagacgagagtgaagaagatggcgcggctcggccagcttggcaacttggtgcgagttatagtaccgttttgattgcaatgcgcttagtcgcttacggtgtactgcggcctgagagtgtgcctggtatggcaactgtgaagatggcgaaccgtgcactggcagctaccgtcagtattggtatcgtgttagttgcttggctggtcacagctattctgattacaattgtaatttggggatggcggtggctgcgtaagctgattttttagtgcagctgaacggccaactgaatcacaatagtgccgattgactaggctgaagtttgtgaatctagtagttgaagctgaaaggacggggtgtcagtggtagtgcttcatgatggttcgtaactcggacagaaagtcggcatctaaatggggcgattgtcctaattgtaatggtgccaatggctgatataacgttggtatgtctggctttaacggctggttattgaagtattgctgaccatggattttgacggtcgctttgagcgtgccaatcgtcatgacggccacggcggtatttaaaaagacgccaccattgagactagtatatccagcggaagaacgcccaactaaagtaacgtgcgggttacgttttagcgccatgatggtcacctccgcggcactcgctgtctggttaccaataatggcataaatatgacgaaagtgggccgctgttggttgcgaaaagttaaagtcatcttgaccaagtccaccagtgatgcggccatggtacatcacacgcggccggttgcgatgatggttcgtgatgccagtgtagaggaggccgtcgggaatgatggcggccaggccagcaatcatcggtgccgaactaccaccagtattggctgcgaagtttaagattaaatcggttgtcggcttagtttgtttaatcaggtgctggagttgtgtccaatactgtttttgtaattggtgctgactgctgtaaaatgctggcacattgatgatggtgaggccggcactcattgtcttggtcggacgggtggcatgttcgacttggcggagattggcgacggcgaatgaatgtaaatttgcagcgcgcagaatttgattgagttgggtcagtgacgtgattttgcgaccatgatcagtcgcatgtagcatggcttgccattgcgtgcgatggttgataatgccatattttgacatgtaggtgatagccggcatagcgttgaaggacgcacggagccgattagaagcggaaagaccaaacgttaggactatcgaaattagacctaccagtccgtaacggcatttattcgttatcatgataagccatccttacttttcgtgactagattagcatgtattggttagctaaagtgtaggcgtggcgtcaaaatttcgcaacgaaaagcatatcttaactggtgcgtctttgaaataatggttactgttaaaatacccatctacattggccgtcttaacggctaagcagatgggtatttgttgtatcatgaaattgttgacgattgtgccagatcggcttctaactgggttaagaagatcgtcaccaagtctttttccacctggttcagtgaatgctcggctggaaaggcaatgaaataattcagggacattaacgcttggggcaaaggtaagatgttatagcgttctggatcaggctgggtatgcacactgtctggtaaaaaggtaatacccagtccagcagtggctagtttggtgatggtggcggtattcgtgctctcaattacgatattcggtgtcacgttgtgcttttgtaataagtagtcaacttggcgtcgaatcgatgacccgtggggagacaagactagaggcgcttgtagcaggtcgttaaggggtagcgctcccggattaatgaaggcctgatggggttggtaccagttgacggtgttcgggataatcgcgtagtacccgtcccgaccgcggtcataactttcaagccccggcgcgatggtttccggattttgaccaattaagaagtccagctcaccgtggagcacgcgctgttcgttgcgactagcgatatcttcggttaattcgatcttagtggccgggtgggctttcaaaaaagcaggtaagaataggggcaataagtaatagccgaggctagataagacgcccagccgaattacttgctggttggcatgtgtgtattgcctaatttgcttattaaagtaatccttctcgttttcgagcgccgtcaaatattgataataagtccgcccagccgtggtcagtcgcagtggcgtgacttcacgattgatgatggtgacgcccaattctttttcaacattgcggatgctttgggtgaggtaaggttgtgaaatgtagagatctttagccgcccgggtaaaattgccgtgcttgagcaacacatctaaaaaccgtcgcatttcgctagaatctgattttggcataaagcgccttcctctcgcattgtaattaggtgagtattcgtttgattgctgatttggtcatgttgagttagttgcatcgccataaggacgttcaaaacatgttcaataagttctgtcaacatcctggcgatagtggctaaatagcattatgaccaaccattttaacatgattaattttaacgcgaatcgtcgacatagtaaatttgttatcggggtatagataaataaatatttcacaagcggagcgctttcacgtacactaatcagtattaagagtggccaatcattcaatagctactcgtcgaaaacgactgtttaaatcatcctgaaaggatctgaaattatgaaatttgttgggattgttgggacgaatgcaaccaaatcgaccaaccggcagttactgcaatatatgcaacggcattttcagcaacaagccacgattgaaatttgtgaaataaaagatttaccggcttttaatgaaccggaagaccgaacagcaccagtagcaattcaacagctcagtgataagatcactgcagcagatggcgtgatctttgccacgccggagtatgatcattcaattccggccgtactaaaaagtgcaatcgaatggctgtcatataccacgcggccgttaattaataaaccagttatgattgttggggcctcgaacggctcactgggaacctcacgcgctcaagcgcacttacgccagattttagaggcgccggaattaaaagcactggtgatgccaaatattgaatacttactaggccgttcactacaagcttttgatgatcagggcgacctgacttatccggataaagttcaggaattagacaatgcgtttggcgaattcattgattttgtagatttaacgaataaaatcatgccgtcgagtcagtttttcgaaaagagtaagcagttctcgtggcggcaagtgactggggaggaataaacatgaaatttgttggaattgttggaacgaatgctcagcattcgtacaatcggatgttgctggaatttatgcaacgacattttgcgacacaagccgaaatcgaaattttagaattgactgatgtcccgatgtttgatgaatcgaatgatcaaactgacagtaccatcattcaaaactttgccactaaaattgcggcggctgacggggttatcattgcctcaccggaacacaatcattccgtgccttccgcgttgaaaagcattattgaatggttatcattcaaaattcacccattagatggtcaagcagtaatgattgttggggcttcatacagtgtccaaggatcgtcacgcgcgcaactacacctgcgccagattttagacgctcccggtgttaacgccagtgtcatgcccggttcagaattcttattaggtcgtgcccaaacggcttttgacgatcaaggtaatttaaaggtgcaagggacggttgattttctggacagttgttttgcaaagtttcagaagtttgcgaccatcgtcgccgagatgcgggcaccagaagcgcttagctttgccccgggtacttatcaggtgacggccactggacataatggcgaattgccaatgcgagtgaccctctccgctgaccggattgaaaatattgaaattgataccagtagtgaaacgcaggggattgccgatgtggcttttgaacgcattcccaaggagattattgcgggtcaaacgctcgctgttgatgcgatttccggggcttcaattaccagtcatggtgttatcgatggggtcgctcgtgcggtcaaagaagctggtgccaatcctgatgatttgaagaaacggcgtgcgactaagcaggtcgctcaacctgctgtcaaagaagtgacgactgatgtcgtagtggttggtgctggtggggctggtatgacggcagcggccaaagtgttacaggctggtcatcaagccgttgtcctagaaaaatacccagctgtcggtggtaataccgttcgcgctggggggcccatgaatgcggctgatccggattggcaacgacagtttgtagctttgccaggtgaaaagcaaacgttgaaggatctgagtgagcgtgatgaaagtacaattgcacctgaatatcgggctgatttccgtaaattgaaacagcagattgacgcatacctgactgccaataccaatcaaaagggcaccttatttgattcaaccttgttacatcggattcaaacttatttaggtggtcaacggactgatttgaacggtcaagagattcacggtcagtatgatttggtaaaagaattgacggataacgccctggattcagtcaagtggttacaatcgattggtgtgaaatttgatgaaagccaagtgacaatgccagttggagccatctggcggcgcgggcataagccaatgggcgatctagggtttgcttacatcaagactttacgggcctttgttgaacaacagggtggtacgattatgacggaaacgccggtaaaagaattactggtgacagatgggcaagttcgtggcgtcattgcgactaatgcggctcatgaaaaagttattgtccatgctgatgcggtgattttagcttctggtggtttcgcagcgaatactaaaatgttacaaaagtacaatacgtactggacggccatcgacgatgatgtcaagacgactaattcccccgcaatgactggtgatggaattcggctagggactagtgttggtgcagcattagttgggatgggcttctcacaaatgatgccggtatctgatccggagaccggcgaattattcagtgggctccaagtgccaccggcaaactttgtgatggtaaaccagcaaggaaaacggttcgtcaatgagtacggcagtcgtgatgagttaactcaggcggccattgataatgggagtctcttctatctaattgccgatgatgaaattaaaaagacggcttacaacacgacacaagctaaaattgaccagcaggtggcgaatgggaccttgttccgtgctgatactttgacagatttagcgcaacaaattggcatggacccggcagccctgaccaagacgattgcggattacaatcgttacgttgatgccggcgaggatcctgaatttcataagacggcctttgatttgaaagttgccgtggcaccattttacgcaacgccgcgtaaaccagcaacccaccacacgatggggggcttgaagattgatccggatgctcacgttttaaatacggacggtcagattatcgacgggctatacgcggcgggagaagtagccggtggaattcacgcgggtaaccggctaggtggtaactcgcttagtgatatctttacgttcggtcgaatcgcggcggctcatgctgttgctgagcacgttgatccggtgacggcctaaggcaattattaagtcgctacgttggttgagtcgtgttagtgtataatcgaccgtagagagaagcagatcgacaagggagattatcacatgcaaaaaccaatgccagtcgcggtgacgaacattgcggacaatattacgcaccaaccagcttatatgacgattgttttaaatgatcacaagtattcgaccgcgcgcaaaaagacgccgtttatcttgaaagcgttgaatgagggcgcggctgctcatgggcgtttgacgatcacgcctagtcggctgagtttggccgatgagcgcggcacagtctttcaaaccttggcgccaatacccacagtcatcacggacgtcgagctgggattgtatcgctcaatcgtgcggcaacttggtaatggcgtacgaatgaaggcccgttacacattggcggtgacgttgaccagcgataccgctacttatcagatgttaaataccgatttgtcagtgttgaaaccgctgttggcttggatcaccgactttcatcttcacttaaccgattcgttacaattggcaaccagtgacatagactggcccaatttgacggctgatcaatttgaagcattgacaaagggcaccccgtactttgcttggcaacagacgattggggcccactggtaagtaaaattaagaactacaaaatatgaagccagactttcgataatagtcgaaagtctggcttcgttttttattataaaatttcaccgataaagtcgcctttaggtaattgttggaagtcgtaagtttcaaaatcactcacttgtttggtataccagtgtaagctttcggtaatcatcaggttgacggcctcatctttttcctgcaaggcgatgatgggcaagtcgcgcatggtagccacacctagctcgtaggcggtaccagaatctaagtttttggcttcaaagtctaagacagtcacgatgacttgcgcggccgcaatttgggccatgtcacggtggaaaatttcggtcgcccaagttttggtgaactgttcggcttgagcgtcctggtgtagacgtggtgaataaaaatccgtgaccgttggattttttgctaaagcttcctcaagttgtgtgacccgcgtcacttgttcgggactgaaaaacggactagcaatataaatttgtgccatgaagatactccttaaagttaatttagtaaaaagactaatggcttaattttagagattttgggggtcaacgtcaatttgtttttaactactagcttgtggccacagatcaatccggtcaagtttcgaaggcagtaacgttaccacaaacgagcgagaatcaccagagcttgctcattgcaatacttggacttgccttattgttgttgatgcttgtatggttaccagctaaataagttattgtttgactgaaattagaatgcaatggatttagagttatacagtggggtttcagaaattatgaaggcccatttttgtgagcttaaatgaattgttgtggttaataataagtccgtcacttaatcttaaataaaccggttttgaagattcggttggaattctgaatggttcgtaacacaaggttatttccgcattttctttgtaccggttcgtaataatgggtggtactagcacgggggttaagttcggataatttgttaatggttggtaccgaaatcgttgctttgtttgaattgcgaggaagatattggtactatcaatttgaactattgagctgtgtgaccactgacagttgcctaggtcaatggttggatgattgagataaataattacagtaatagtcgtaagcttgcctttgaggattgtgggtgtcaggcattaatgattataaaattagtcgtggatagttgtgggggcagatattctgcgttattaatgataccggaatgtttttcgttaagtgtctaatttgggccacaatcgaatggcgctaatgataccgaaagttgcaattataattgttatttcgtaaaactatttgagtcatattgggggaattagcatgcaaaatccacggttaaccattattgtgccttgctacaatgaagaagcggtgttacctaagtctgcacacatcttggatggtatcttgacggatctgatccaacacaaacaggtcaatgcggcaagtaagttattatttgttgacgatggtagtcaagataagacttggaaactgattaagtcgttggaaaaacagtactcaaccgtgacgggtcttaagtttagtcgtaattttggtcatcaaaacgcgttgatggctgggatgcaggtcgccagtccgactgctgaaatagtcattacgattgatgctgatttgcaagatgacccacaggtgatcccagaaatggtggcacgctatcgtgctggtagtgatattgtattaggtgtccgcaatgatcgaagtagtgattcacttttcaaacgatggaccgcggacggcttttatcggctaatgaagcgtattggtgtgcaattagtacctaatcatgccgatttccgtttgctaagtcaacgggcagttcaggcactgttaacctatgaggaaaccaatttattcttgcgtggaatcgtaccacgactaggttttccaacaactaaactttattatcatcgccaaccacgttttgcgggtgtttcaaagtatccattacgtaagatggtggcttttgcttttgatgggatcacgtcattttcaatcgcaccgattaaagtaattttattgttcggtatggtgattagtggcggtagtttgatgatgatgctatatgcgctaatacaaggattactagggaccgcaacgagtggctggtcctcactcatgacaagtctatggtttttaggtgggatgcaattgattggtattagtattgttggcgagtatgtaggaaaaatttttgcggaagtcaagcaccggccccgctatattattgaaacggatgattatacggcaactcaacagccagctattgtgaattcgcaacgggtgcacggatgaaggccgtggttaagagcgtcaattggctggcggccgcggtattggtcgtcgcagttggcatggcgtggttgcaaccgattcacttcttcggcaacccggactgggcgtcaccggtcgttcaattagccatggttctgggattattggtcatgacgatggctggccggcaggtgctcaaacagttatcatctcgtcagtatcgttggctgttgattgggctggtcggcttaatcgccatcgtgcaaatattgattgccactagttttgttgacgtggcgcgggccgacccgtttttcgttcggcagcaggcactgttattagcgcagggcagccatcattggcaacattattttatgatttatcccaataatgtgaattttacgttattagttgcgaatctgctcaagccattattgaaactgacgcagacgccctgggtattattaaatgtcatccgatttatctggatcgataccggactaatcagtgggttatatttactaaaccgttggcgttactggcaaccgggggcggtctcatttagtttgttgtggctcgtcagtgttcccgtggccgcatttggactatttgcatatacggacgccctcgttttgccactacttccagacagcttggccttgctcacactcggactaagcttaaccggctggcgtcgttggggcgttttgattggtgatgggttattggtggccgtgggcgtggtgatgaagactaatctcattgtgctctggctcactctcgtattgatggggatcatcttgtggtggcaacgacaattcagtggtcggcaaatgttaggctggctcgttagtttagtgatgacactcggggtgatgtttgcggtgatgcgaactgcccaacagcaagcgggttatacgcgccaagctgatgccgccttaccggcaaccagctggattgcgatgagcttgaacccccaaagctcgggtgagtaccgacatggcgattttgcgcgcgttaatcagatgccaactgcggcggccaagcgccaacagacccagcaaataattcagcagcggttacatcagatgggcgttacggggaccctcgtacatttactcaaaaagatgcgggtcttctgggcgactggcgattttgatagctttaagttgaccacccagtggattcgtgcgccccgctggtatttgaatcatcaacgccagcttcaattttggctggttctaatgacgcaaacgatttacctgacgatgctggtgcaagcaatcgtgactttgatgaagcggcgcgagtgggccgtgacgttcgtcgccctggcaattctcggtttaacggcttttcatgtcggactttgggaagtagaagggcgctatgcgttgccgctattaccgggattgatgctcctcagtattgtgggtggtcgtgagttgccggtgtggcaccttaaccgagtaatgcggcgccaactgacgtggttggtcgtcgtattggcggcaatcagtgtggttagtttgtggcagacgagtcaggcgacgcggattactgatgtggtacgtggcaatcagggaaatgggcgttatgttgtgtccacggttcaaaaaattggaccgggtcacgctgttacaacgccgttagccgttagtggtaaaagtaatgttttacggttgaagccagttgcgacgcatgggcgcgtaacaattaccttgactaagggggcgcatgttgtcaaacggtggcggggctcggccaatgagctgaccactttgaattatccgttgacagcggcgggcaacctgcgattagcgattaaaaacattggtcagacgcccgtccggtatggtgtgatggcgaccaactacagcccgttaacaggccgggtgacggctaagcggcacgcgtacttacaagtcgtgataaaacagcagtttattaagccgcacgcgttaacaacgggtgccgccagtctagcagttgtcggctgtgtggcgctggcgaccattttggcgttaggtcggttacggccagaaactgaataataaaacttgaagcgaaagtcttaataactggtgttgccagtgttgggacttttatttgtggttaaacgaaatataatagccgttaatttgggtgacttatcaaggtgaggtgaattcaaatggttcaaattattgcgcatactttagtgactgccgggcacgacgttttaattttaaaacgcaatcagtttgagcgtgggcggccgaatgttgatgccagctattgggatctgcccggtgggagtgcattagctaatgaatgaccgcaagtagcggccaaacgcgagtgttgggaagagacaggcttgaaagttcaaactgagcgcgttatttgggaagatgccacctttgacaaggctaaaaatcaggtgtacacgcgtttagtgtatagcacacaggcattcgttactagaccggcaatcaacttagaacttactgaacatatggcctttctttggatgaaacctgaattaattttgactaatataagaattgtgtcctatctaaaaccgatattaacgcgactggtttagcagttacggcgaccattaaaacaacaatcggactgcctagcagaatagcttggcagtccgattgttttgattgacacgattctaatggtggcgatatcgttgacgccaaagaatgaagctaagtccacttatgattgaaatcagtagtccgcccagcaatcccgggacgtggtaagttagctgaatctgattcttaccgggctgaatcggtagggctaacatcccaccaatgaccgttttaggagtaactttgacgccgttgaccgtggcgcgccaccccttgtcggctggaatagcaacgtagagccacttttgcttggagcgattggtgacttgaccactgaccacggtatgaatgcccgagacgtggtaagtcggtgtaaagcgcgtggatagcagttgctgtttgacttggttgaaccgggcttgatccaggctggcgatgtggacatgggtgccaagcgttggttgggtacgtttgaccgttaacgtgacgacagcgcctttgtcaaaataacctagcgatcggagcactaactcaccgttggcattaaacttagtcgggactaagtgaccgttgacccgcatcgtggtgtattttgtttgacgagtcgtgtcgttataatacagcgtcccggtgcgtgtcatccttaatttaaccgtatgcaaatacggatagcgtttggcctgtgaatcttggatgacgtgatctgagagcgtcgtggcgttgccaaaataggcgcgtttcgatggccgcaaactttgtaagaggcgttcttgattgataatggcactattctgacgaagctttaactgtctaaatgctgttggcacggcaaaccctaacccgttttgactacggagccgcgttgtcgcttgacccacggcgtttaattgcacagcgtattttacatctaagagtaaatcagtgaccggatttaggccttctgaactgacacgccgggcgtttttagaaaatagcccaagtgacttcaacatgagacgtgtttggttcgcaaaagttgaactgtagtaggtaatatcgtgaaagttaaataacatcgggtcgttgtaattacgatacttgctatcataattgtaggcctgattgattagcgtattttgattttcaacgcggtataattgaccatcaggatcgttgacggcttgcatttggcggtattcggttcgataggcagttacaaatttagcctgattccctagtggtgacttcgccatcatgagggtactgttagtccctaattctaaggcgacgatacctgccaagctgagcgtttgccaccgcttcgccgttgcgaataaggcaattgcggttaagatgacagcgactaagctgagcgccagcgttgaagttgttaaggggtgcttagcagttcgttgggcaaaccagcctaatatcagcgcactgaccatgagtgtcggtaacaaccattgccagcgcaaggcgatccgccggggacctgctaaccaggcttcaaaagcgatcatgatcaagacaaagctaaagaaaaaagcattgcggtatggaaagccagcgggcgtttgaaacatgtgccaaatcgtatctaaggtacgaatgtccatactcaagaagagtgcaagtaatagtccgaagctatgccatttgtgagctttagtcaagttgggctgcacccagaaacttagggccagcaagacgaccagactactgctgaagacggttggtgcgtgtacgagccgagtcgtaaaattggcggcacctaagccaaattgactcaaaacagctaaaccgaattgtgggaccggtaagtagctcgataatttgaccgcagatttagccgtggtcagcatgcctaaaccagtggggatcaggacaaacatcgtgcttaacccactgagtagcatggtgaccacgacgtgccgaattaacgaaaattgatgacgaacagtttgccaaagactgtcctgagggcgtttgcgttcaaatagttgataaataaaatagtaaatcacaaataggcaagtcatatagcctaagtagtaattggtgacgatactgacccataaccagccgaaaaagcgcccgggatgactagttgcaattaagtggtcgagtccttgaatgaccagtggtaaccaaattaatgcatccaaccacatgatcgtaaaatagttgagggcaacgaagccagagaggctgaaagcaacaccaaaaatggcagtcgaccaccgctttgtttgaaaatgcgtttgtaaaaaagccgtcatagtgaccgcaatcaagctgatttttaacatgatgagtagactaagtccggttggcaaattggccgccggaaacaacaacatcaaaatgttaaatgggcttaatagatagtaagcaatcgtgggtagtgcgttaccgcctaatgactgtgaaaatgaatataattgaaaactatgcgttaaaatggcatgccgatacgcggtgaaaaatgataagtattggccacccatatcactaattaataagttatggttaccgaagggcgtgatcccccaaattgcgaagacaatccccatgatagcaagggacagtaatccagctgtcactgccacttgccagcgccttgtttgataattaggccacattttattcaactccgatattatgaatgatttcattgtaccgtactgaaacttgaaaactagttaagaaaagcgaacaattttctgaaaaaagttaagaattagtgttagtcattatcatttttataaagtttgctagcagtttaacacagcagttcacgaggttaaactaaaaggggtgattgacaattgattaagaaagtgtttttataaaaggtgaaaactgaatacgatttcttcggggcagggtgcaattcccgaccgacggtaacaacgtaagttgaagtccgtgacccgcgtgagcggtggacccagtgcaagtctgggaccgacagtatagtctggatgggagaagaaaattattgcttgaattttactaggcagtagtggctattggcgacctttaagtaggtttatttagctggatcctactggtgaaatctatttggcgaacacttcacactcgattatcgatgatttgataattgggtgtttttttatcttgttggaggtgaaccaatgttaactgattttatgcaaatggctatcgatcaagccaaattggcgggggtggcgacgtaccaaaatccccaggtcggtgcggtattagtcaaagacggccacgtgttagctcaaggttatcatcattattttggcggtgaccatgctgaggtggatgtgctgcggcaggtcacaccagaacaggcgcgtggggccacgttatttgtcacactggaaccttgttcacactatgggaagacgccgccgtgtagtgcgcgaatcgtcgcggctggaattcggcaagtcgtgattggtcaattagatccccatccaatcgtgggtggtaagggacgtcagtatcttttgaaccacggagttgatgtggtgacgggctgtttaacggacaaagttcgcgcgttgaacccccactacaatcatttttatgtgcagcagcgaccatggatcaccctaaaaacggcgataacgcttgatggcaaaattaatactgaaacgccgactcggacgctggtttccaatcatgctagttatatcgatagtcagtgcttacggtcacagtttcaagcaattctgattggtgaacggacgctaacgattgatgatccacaattaaccgtccgactgacggcaatggtgcagccaccggttcgattggtggtgttgaatacgagtaccgtggcgttaaaccaccggcttgttcaggacggtcaggcaccaacctggttactttgtcgtcaggctgcggctagtgacgaccaacttcgaaacagtcccaatgtacacgtcctgattggcaactggacacccgctgcaatcagtcaactatgtgtcgaacaaggctggcagtcactcttagttgaaggtggggctcatctgcaagctgaatttgttgcggctgaattgattgacgaatgggtcagctacatcgcaccaatgatgattggtgggacgggtttgccagccgttaccggggccgctgcgatgacaccgttgacatttgaacaaccaacggtaacttgtttagggacgaatatccggctacgggccgttcgaaaggaagttaagtaaatgttttctggaattattcaaaccaagggccgcgtcagccaagtgcaccaacaagggttggaaatgacccttacgattaccgcaccgtcgctgatgacaccgagtcttaagattggtgacagtatagcggtgaacggcatttgtttaacggtaacgacccgacaagcggatgctttcagtgtagtggtgatgcctgaaacggtgcgtcgaacgaacttaaagatccttgtggtcggttcattggtgaacctagaacgtgcgttacaagtgaacgcgcacttagatgggcacattgttcaggggcacatcgattactgtggtcaagtgatgcagcgacaatctgatgcgcacgcgttgcgtctgttgatcagtttaccgtcagaatatcgcgcactagtagtcactaaaggttcggtggcagttgatggggttagtttgacggtcgtagcggtcacggagacaacgtttgaagtcgatttaattccgcattcacaagcggtgacgaccttgtctaagttacaagttggaacgctggtgaatgtagaaacggatattctgggcaagtacttggcccggcaattagcattagaggggagtcattaagatggatacaatgaaaaaggtagcagcggccttggccgcattaaaacggggcgaattgattattgttgcggatgatgagacgcgtgaagcggaaggagacatggttggcctagccgctaaagcaaccactgcgacagtgaatcggatgattacatcagcgcggggactactctgtgttccgatggcgccaagtatcgccacgcgactacatttgacaccgatgactagtgaacacgatgcgtttggaacggcatttacagtctcaacggatcaccatacgacgtccacgggaatctcggcagctgatcgggcgaccacgattcaagcgttagccaatcccaatagtcaggccgctgatttctatcatcccgggcacgtttttccattgattgcgcggactggtggattgttagcgcggcgtggtcatactgaagcggccgtcacgttagcacaattagcaggtgtgacccccgcggcctatatttgtgaagttatcaagaaaaatggcttaatggcgcggcgccgtgatctcaaagctttggcagagggcttacaattaccgctaatcaccattgaagatattaccacctacgtgattcaaacgggtgccgcccagctaacaacgaccccgagtgtcaacttaccgaccaaggatggtcagttcacgatgactggtttcgaagcccccggtcatacggcgttgccagtggcactgcaagctggtgatatcagtggcgatgaaccagtgttagtgcggttacactctgaatgctttacgggcgatgttttaggatcgcggcggtgtgactgtggtgatcaattacacgccgcactccaaaagatcagtcaagctcagcgcggtgttttcgtctatttacggcaagagggtcgcggcattggcttggctaacaaactagcagcttacgcactccaagaacacggggttgatacgtatgatgcgaacgtgcagttgggctttcaaccggatgagcgccggtatgatattgcggcattaatgctacgccaaatggggattacacgggttcgtttgctgactaataatcttgacaaggttgagcagttacgtgcagcggggattgatgttgttgaacgggtccccttagaaataccagccaaccagtacgatcaagcttacttaaaaacaaaacgtgatcgatttcatcatcaactcacactaacggagggacacgaatgacaacttttaacggcaaaattaatggcaacgggcttaagattgggattgtcgtggcgcgtttcaatgcgtttgtaacgcagcagcttttaactggggcacaagaaagtttggtacagcatggggtcaatgaaaccgatattgacgtggcctgggtaccgggagcttttgagattccactgacggttcaaaaaatgattacaaccaagcgctatgatggcgtgattgcacttggggcagtcattcggggtgcaaccgcgcactttgactatgtttgtcgtggcgtgacgacggggattgcgaccgtcagtttggcaaccgatacgcccataatgttcggcgttttaaccacggataccattgaacaagctatggatcgcgctggctttaagagtggcaataagggtgctgactgtgcggtcagtttgttagaaacgttggacgtgcagcgggcaatattaaaagctgacttggcctaaatgacgtaaattaagggtatgcataatatttcaaataccatcaatttgtaacttgggccattgttgatgccactgcttctgtgccattcgctgctgatagattgccatgtgcttggcatcctggcgatagtaggggattggggaacagcgaaagtttatcaaatcgtctacaccgtatggggcgattagcttgatttgattttcgtctaaaaaggcgccaatacaagttggaacttcgacaaagtgaccaattgcatcggtaacggaagtgaattcgggatccttatcaaaattataatgtgccatatagacctcattttttatttgccattggtattgtggggctttatcagtaagttgctgatagatttttaaatcatcgctggctggtcgctcagggtcaaaaaagacgacgtcaatatcactgttgaacatcactggctgcccgctgagtacttgccaaacagtattacggatgctaccagccgccaatgcgccttgttttaaatgacagtcttgaattaattgaagaatcgtcattaaagcaggagttgttttaataatatgaataactcgttgttcgttggtcattgaaaacacctcaatttaatgttggttaaaaatagtctaacatagtaatgatatcgtgcaattcaaataaaggatttgcttttgctgatttcataaaaaattaaggccgcttaccactactaactgatagtggtaagcggtcttagtttttggttgtgagtttaagtaataattgcctagtcttccgtaacctcaatcttaccaactgcaattggtagggttacgtgagcatcatacatgcccacttcaccagcgactgatgcaggtagggctaagtcttgtgggacgccgtgaatataaatgacccgcttgtctagttctaagtcatcggtaccgaagacttctttgaacttagcctgtaggtcgcctaagggcacatcgatttcataagcgaagtggccctgcgcgtcggcaactgggtaattatcatttggtacgtccatatgatggggcgcattatcaaatgggaccatcgtcgtcccagaaacaggttcagtttcaggcaagtctacaaagccgtcgtgattgacatcttgggccatagtagtaatctgtgccgctttgccatttggaaagccgtggaaatgttcccagtgttgcgtgttggccggggtatcgaacatttcaatggtgacgtgtaattggttaccagtttcagtgaaagtcgctgtgccgtgtggggcagtaccgattccttcggcgttcagcgggacgatgttagcaacgtattttttagtcatgaataattcctccagttcttcattatatggtcagtatatgctagtctaatcatataaaaattgacatagatcaagaaaaggagaaattatgcattcaaaaatggattgtgtgagtcgttcaccattattttcaccgctagcgccagcggtgaaagccaaattaatcacggtgacccatcaccggaaattttatcaaaaagggcagttgattcgtcagccactcgaccatcaggaaggcatgctcattttagatgagggaacggctaaaatttatgccttagctgctaatggtaaggagaaaattattgagttgttgcgtagtggtgatgtcggcggacaacactggctatttgcaccgcatgagaatcagggatttattcaagccacgagtgatgcgtgggtctgttccattcaatatgatgattttcagcgattattaggtgaatcagccagtttatcattagcaatgatcaataattttgggaaccaattgattgaagctgagaagaatcaattgcgacgagatttgctggatgctaaagcgcgtttgatggcgtatttgcgcgattgtgccgttgaatccggacaaatcgaatttgaattgccgttgaagaagaaggaattggcgaatattttggggattactcccgaaaccctgagtcgtcagtttaaacaattggcggctgaagggcagattatcgtcaataagcgccagattacaatttgttagacggataaaggggggcgtcgcctggttttggctagttaagggtgacgctggttcaatattaaaaataaagtctgatttccaacgcagtatgggctaggaaatcagactttatttgacttgtgaggaagaggttctttaatgatgaaaatgccggttagcaacgccacttgctcgcaatgccggcaaaacgacttgatcaatgagattggtgagttgctgatcagtgttcatcggttggttgatgatgtcgcagtaccgtaattgttgaaacaatactaattgtgcggcttggttaggccaaatctgaagttcaccgtggttttgtgcattcgtcagaagtggctcgatcaaggtcaagttggcatgatcaatttgagtcactaactgcgtgagatcgcgctggttctgcgcgttcaaggctgtggcaaacaatagccgaaaatagcggaagggccccgtactagtttgttggataaagcgttgcgctaacagaatgagatcggtacgaagactgccagtatctaatggcgtggtcgtaagtgcaatgggagtcttttgtatttgatgaataatagtatgaaagatgaggtcaaaggtcgaatcccagtagcgataaagaacactgcggctggtagcggccgcagtggctactcgtgaaaaagtgacctggtcgaggccgtattgactaagcagggtataggtggtgtcataaatcgcgttttccagtcggttgccacgtcgacgttgattgagttgggtcacaaaaagatctcctaattggttttagaaacagtttactgctttttgtgccttaataatagtgatttccgtagccaaacgattgttgtagttaaagacaacgtgtatcttaaatagcgttgttaacaataatttaagtaatcagaggcggaaaatatggcaaaaattattattgtcggggctgcacatggcggctgcgaaacggtcaatggcttattagcagctaatacggataatgagattcattggtacgagcacgggcaattcgcgacggctttggattgggctccggcggatgctgaaaaagagcggttggccttgtcccagcaggtgactctattcgaccaaacgacggtcacaagaattaccccagcgacccacacgattactgctcgtaatcaacgggggcaattacagactgatcattacgatcgattggtattgagcgttggatcgttaccaatccagttaccgattcccggagccgaattatctggtgttcgatcgattcaaaaccgtgccagcatcaatgagttaaaattggccgctaagtcagcagccattaaaaacgtggtcgtgattggaggcggctatattgggatgaattttgcagccttatttaaacaaaccggcaagcaagtaactgttattgatgtgaacgctcggccattcagtcacaatcttgattcagaatttacgcaaattttagctgcagcgagtgttgagaatgggctgcaattaaagatggaagagcgggtgacggccgtattaggttcaacacacgtgacagcggtacaaacgaatcgtggtcagtatgctgccgacttagtccttgtcgcagtcggcaatcgaccgaatactgcatggctacggggaactttggcgctagattctgagggattaattgagacggatgattattttcaaacaagtgttccagatatttacgcgattggcgatgcgactaaagttcggtttacgcccacgggtactaaagagcggatcactttaggcagcgcggccagtcatgccggtcggttattagcgcataacttgttaacggatcagcgaattgtgtttcccggcgttcaggcaacgtccgcgcttaatgcggcgggatattactttgctgctacgggcctaaacacgcaactagctgtccgtatgcaacaaccggtgttagcaacttacatcgcggttccccgattggtggcatccgcaccagctcgattgaatgcgaccgttcattttaagttgttttatgataaaactcatcggatactaggtgcacaaataatgtctacagcagaattaacggcggtcatcaataccgtttcgctcgcaatccagatgggagcaacgctcgagcaattagcctatggtgactttttctttcaaccgggattaagccagccggtggatgtactcagtacggctagtttacaggcgttacaaactttagccactaactaggttgattattgccaagcccattatacggacttggcaattttaagttgatgtgttgcttaagctcagtatatgacatggaaaactagtggttactgatgattagctcattaggaactcacaggaaaaaaccgtcgcgtcatcaataatgatgggcaatccagcgacggtcaaatttaagtgatgaaatcgacaattattgtggtggtctaatggtgctttgaagtcgcgcttccaattgctagagttggggccagtacttaaggtgtacggccgaggagcctcagtttggcacatttaattgttagttcgtcacgttagccgttagcgtccaagttacggttgtgttataggtttggcccgcttgggcggtgttgccaggaacggtcaattgaacttgggtgggttgccagacgttggttgaaaggtctttccccacgttggccgttgctggggctgcaaagacgggttgttcggcggttgtgagatcgaccgcgtagcttttgagctggcccgtagcgcgttcattataggtctgcccggcaggaatgtgtaacttcgcgccggtgagttgggcgccactagtactagtaaaaggactgttctggcgggcggtgacggtccaaccgtgagttgctaaccgattatccgaaacttggagccactgtttcgcgacaccgttgattgtctgggcggcgtaagttttaggctgcatacttgttgtgacactgccaaagttaaattggctgggcgcgtagtctaaacgaagttcgcccgtattaccggtcccagtgttttcgctcccactggtattggtcgtaccagggtgctcgggctcagttggtgctgtcgggccgattgccggtgcgacggtgtattgggtagcggcggcaaacgtggcatcatgataagttgtactggtgaccggattttcgttccccgcactatctttcacaaaaatctgaatgacgtcgttagcttttaatttagtggctggcatcgcaagggaccaactcccatcactggcagcggttgctgtgatggcattgccgttgctatcagctgcggaggtcccgttaaccgtgtaacgaagtgtgttaccagccgtcgtcgtggaaccgctggcaatcgttttttggtcggcaacgatttttccatctttaacggttaccggcgtcggtggcgtcttatcttggacggttatggtgacaggatctgaagtataggtggtcgttgcttgagctgtcatagtcgtgccggccgttggaaaatgatctaaggtgaaattaacgtaaccgctgctgtcagtcgtaccactttgcgttgcgccttgatcatctgttaacttgacggttgccgtgcccgttccagcgtaaatcggcgtttgtgtgccattcgattctgtataaccggtgataacgcgaacgcggaccttcttgtcggcattggtgacgagctgggcgttcaagtcactcgtatacggtgagctgaattgcacagtcggtaatgagagggtgttcgcaattcggcgcgcagccgagaaggtgagtagtcccggtaagacgctaccgctgttggtaatcaggaccccgttctgttcgatggcggtgatcccttgataggtcacactggcgctcaacaggttcaataaggacaatgaccacatactcaggttactgttcgtgattttgaaacttttaatggtcgtctcgacgattgaccccgtttgaacgagaagcgcaaagtccgtatttttaatgtcgtaggccttaggggaatctagcaagacgctcaaaccggacatgtagccaccaaaaataggggctgagccactactagtgatatacaactcgccacccgtcacggtaaacgtactgttgttgccaagcggaatcaacggggtaacgtagtagagcgcattactactagttgtggctaagttctcaaacgtgaccttactgccagcgttggcggtaaacgtgtttgctgtttctgcccgatagacgttaccgtacatcttggcggttaggatagcgttggtacccaccgtgacggcatcatactggtcatagaaaataccccgagtcgcgtctgatgcgctacctagcaagttaacattagcagcgctaccaatagtgactttacggtctccagtcccaactgtactagttgccgtgaagttgaagaaagctttgttggcggcactgttattcgccttgcgaccgatgtaggtactgctggcggcaaaggtcattccaccagtaatcatgttttcagcgacggttgttgcggtgactgcgccactgacattgacttgattaccaggagcgttgacgaggcggtaaacgtcgctggtagtgattaaatcggtcactgtaattgtccaacgagctccaccagcattagccccaccatcggtcccactttgaatgattccggcggcgccaccactacttgttccactcgcaattgcgccacgaatactactgaagttttttactgtcattgtctgggccgtggttgtggaacccaatgtgaagttaccgatgccgagatcaaggctgtgattttgcccgtcgatggtcaggctggtggtacgagtgcctaattctgtagcacttgttgacgtgtgggtaatgttggcccccaatttaatcgtcgtgacggcggtattggtatacgctgattttaaatcatcataagttgagacggtcgtgctaccatctggattgaccacgattgctgcggtcgtgatatcattagcggctttggtggcagtcgctttagtcgctttcggtgtccgttctacttccgaatcagcctgcgctgtgcgactagtagcagtgtcgttgtcagcagtcgggtccgatgtcgcggtggtactagacgactgttcggacgatttgcttgtggcattgtagtcatcacgtttcgtggtagccgcttgtgttgctgttgctgacgaatcgtcagtggtcgggtcttgactggccgaagaggtgctttcggcatcattgctgacctcacgtgctgattcagtgccggcttcttcaggaggtgagtcgactgcggagcccgcggccacggtgaaagttattggttcagcggtcatggtgtgggtcgtcggtttttcactactggcgacagctgaagcggtagtggtcgctaatgctggcccagtaatcagtgcttccgcggtcactttgtaggttttcgcttcactggcactcaataccaaatcgaacgtggtactggctgtcggatcagatggcgtcaaagttagtttccggttgtcagcatcaaaatccagctcagcgaggctcgctctgttggcttgccgggttttagtttggtcaacggtgagggcctcaggaatagcgaccatgacttggtgttcctgggaaccttgtacggccaactgaagtgtaaaaggttgcccaatcactaattccgtgggtggttcctcgaatttgattggtgtggtcgtggtggtcgctgtcgcataaatggcaccgccgttgacaacgagtagactcattaagagaacgagtaacccgagccaagccgttattaatcttcgtggtcgttgcaaattgctcactcccttcggcgttgcatgagccacacgagccaaccggctaagacagctgtcaacagacctaaccagactaacagttggcgggcttcattcgtttgtggtagcactgattgatctggacgtattgccgcggatgatggtgtctgagtcgaagcctgttgattagcagtggcgatgatgttgggcaccgctagatattgatagggacgggggtgctggaagtttgtcaggtccgtcccggcttgccagtcggtcaatgtcacactagtgtcagttggggtagccgctagggcatcgggactccgacagccaccagcgagggctagtccaaggcttaatgatagtaaaactagccgcctgaatttagccataacgataacctccttgtttgagtaccaagttagaagataatctaaaattaactgcttatttaggttctgcgattgtgtcgtttcataattagataaacgattccggcggataagccagcaattacaatgacgattaggacgtaccaccagatactgatgggggcggccgggtcattcttggctttttgattattttgacgtgcttgttcagtcgtaatcttaaagtcccgggaccaatgccaagtttttttggcccatttggagtcgttagtcgttgcggtgacggataaggtataatcacccgcccgcatgacttgatcgtctaaaaaagtggggtaagtgaagttcgaattgggggccatgatcaagttgtcgctactgttctgatagagtaccttggaactgccttttctcgtgaccttagtggtcagttttaattgcgagaccactgctggttctgggttccgaatggtcgcgagcacgactttgcgatagttgcgtaatccgggagtgaccgtccccaaagtcaacttaggctgtgcaatttctttggccgtcagtttaaccgctaacgcataactatatttttggttaatattgacgcccttggatgcttttttcgcgccttgccccattttttcgaagtaccatgagcctaagattaccccggtatcgaatcctttgggaatgttgattgtggcgctgacgacccggttacttttggcggggaccgtgactttatcggaaccggctgccaaagtcgcaatttgatcaaaacgatattttaagctggcatcgtatcgtttggctgtttgggtgtaagcgatttggcctgaatcattcgtaaatgtcgtgagtagctgggtcttgaccgtaattgattggtcagtcgggttatagacccgcgcctgaattttacgagtggtgcccgccttggccttaaggtcgaaaaacggactgctagcatcgacttcttggccgggactgattctgttaacactatattgaacttcggcattggtagcggtggcctggacgcttggtgaggtccaactcatgaaaaccaagccaccaattacgccgaataagcacatcaattttttcatgattacctcctagttagtggtagcggcgactaacgtccaaactaagttgttcgtgtagttaccgacttgggctgtcagcttggggattgaaagggtcacggcacccgcgttccaagtgtttgtggaagtggctttaccaacacccgcccggttgggagcactgaaaacgacttggtcagcggtggtgacgcttacactgggggcaacaactaaattggaatcggctactgaggcgggctcgtttagcgaattacgcgcagttccttggggtaggtgaatcaccgcaccagtcagcacgtgattattactagcgttagttaacgtccggtcttgcttaacgttgacttgccagccgttggcagtggtgcgtttgtccgagacttgtagatattgattgtagttgccaattgcagtgtaagttttgggctgcgttggacgtagtgacggtaccaaagtcgatagtttttggggctacatcgagggtcaatgttccggtattgttagttgccggattattcggatcggtggttgtcaacgggacgttgggactagtgggatcaactggggccgtggcactagtatcatcttgaaaagtcacggtaccattagtcgttgccccgagagccgtcaaactggttgccattaaccctaaaatcgctaaccccgtactaagacaaaagcggttaaacatggcaatccctccttatggttagctaggggtagcagcggtcaaggtccatgtcaaagtgttgctgtaggctcctggtttggccgtgtttttgggaatcgtcaaagtgacatcacttggatcccaaactttaaccgaagtgcctttaccagcgccggtagtggccgttgtattaaaaacggtcacggcaccactcgtattggtaacatcggcagctgtagtcgttaggttggtatcgaccgccgtagggtcagttgccagactattacgtgcaatcgcagctggtacgtggatggtggtaccggtcaaaacatgcggtgaacttccactagtttcggttaaatcttgatcttgctcgacggttacggtccaaccctgttcatcggtcccacggttatcggtgacctgtaaatattgttgcccattagtggtcgtcgtggccttataagtgtgttcggcggcataagtttgaacggagccgaagtcgaaagttcgaggagccacgtctaatgttagagcaccagtattaccagtagctggattgtctggatcttctggaacttgtggattggccgggttagtgggatctactgggatagttggtccagtattttctgtcaattccaaattagtagttgtgttcgcagttgaatcggcggttgccatgacggcgggcattcctagtaagcttaacaacatggtcgcggtaagcactgtttttttcatgatggatcgctcctttttggttgtccgtgcctgcggtgatcaacaaatgtttggtaacgataatcaactcctggccagaagattgtcttgcgtttatcgttgctatagggctagcataatctattaggttgcggctatttttacgcatatattttgatgaatattgattagtattagcttatcaatcaggccacgatgatgtaggacagtgttgatgtgcagcactaggtgtaatggcgtataattaagtcatatgaataaataaagaatcggttaactaacgggaggagtgatgggcgtgcgccgagcggaaattatcaatggcttacgatggtcagtagtagcggacgcattagggttgcccgcggaaaatcgtcaacggggaacttatccgttaattacggaaatggtcgcaagtgacttttggaaacagccagcagggagctggtctgatgacacatcgatgagtttaggattgattgagaatttggttagcggtggtgattatgatgatctcatgtcccgatttgagaactatatgcgctttggaacgaacacgccgcgtggtgaactgtttgacattggtcggacttgtgctcatgcaattcggaattatgccatcaatcagtttccggcccgccaatgcggtgatccttcggtgcatgcgaatggcaacggcgcgctgatgtacttagcgccgttagcggtggctctgcagaatgacacaagcgtcgcacatcgactgacgataactagaaattacacgatgttgacacatggtcatgctcgttcagttgtggcgagtctaatttatttggaagtgttgcatgcgcttcatcagggacaagcgttgcctgctgcactggtatcggtgcatgaattgctaatcagtacaatcaaggatatgacacttttaggtgaactgagcacatatggcgcgttattttcaccagacttcgcccaaacaaaagccggagtcattcggactagcggttacgttgtggataccctgttggccgcatgctggttagctttaaactaccagacgccacgggaagcggtgttagcggctgttaactttggcggcgatacggatacgattgccacgattaccgcggccttaactgctgcttggcatcctgatattacagtggatacgaagtggtggcaacaaaccttaaatcataaactgctcaatgcccattttgaggtatttactgctaaatttgcgagcagctagctgacggttagtctttcggcgtgaattgtttggatgtgattaagtagcttgggaggcgttcccgggatatatttatcggtggcctggtgcaaagcgctcacgaataacgttagtcgttttcaaaaaacaagcgtttaaaatcatgattccacacaaaaagccaccctgacatgttaaacgtcagggtggcttaattaatttaattagttagagcttgatgaagatgaggttgaaaggtatgacgataagatatccttcaaatcgttatccttgattgaaacgttcccacccttaagcactttagaaacaacgttttgtaagacagtggagtcgctcatatcattgtcccaaatttgtttcttcaaatcagcggtgtgatcagacatcttacccttaccagggttcttgatcatccggatgatttcataaccgttgctggtcttaacagcggaagtcgtgtattcaccgttcttcagcttgaaagcagccgttaagaatttagatgagtagctcgtgttagtgttatcaaaggctgataacttaccaccatcattcttagtcgttgtatcagttgaatacttcttggctaacttcgtaaagttggcttggctagaatccttcttcaaagcgtctaagactttgtcagcagttgctgatttggcaactaggatatgttgaaccgtgactttaggttcgtaagacttccattgcttcttcaaagctttatcagtaatcttgaccttgtctttaacggcttccttcaataataagttagaacgtaattgttccttgaaggtcttggtcgtcaaaccattttgcgataagacggttgagaaagaactaccatattgtgacttgtaagtattatattgcttcgtcacttgcttagtcgaaacttttgagccataatccttttcgagcaccttattcaggatcatttgttgcaagacttgcttacctgaagaggttcccttcatactactgtaatattggctttcggtaatcttaccaccggaagttgatgcaacggtcttgctaccacaaccagctaaggtgaaggttagtaagacaccagcaagggcaatgagccatttcttcattcctaaaacacatcctattcttgaaatcgttctgcgttagcagacttcaacgactactataccatatctattaaagcttctgcatgcatatggaaatctttacaaaattttcagagatttcacagcctcttcataaattctacctaatgcgtcagtgaatttaaacgaaatcagcttgttaagatagcaaacaaaaaaatcgtgggcctaatgcgacctcacgattacttgctcagtcggttgtcttggttaaatggtctaaggtgtcttgtaagtgatccgcacgttttttcatgatggctacgtggggttcaatcttaaattgaaatttatccaattcagtctgaatgtcatcaaaaacttccgcagcgtgggccatttgaacactgagattgctctgggcatcgctaaactcttcacgtgcgtcttgtaagttatcagcagcatctaaaacgtcttgcacgtaacttttgatgtctgtgtagagtgctttaggtgttttctgattgatcaacatgtaggtcgcagcactgagacccagaccgatcaggctgttacgaataaactttgccatgggagacctcctaattagctaattcagttttaatggcgttctgtaagcgagtgtagtcggtttcgtcatattttttggcgttgtccttaaagatcatccgaaaatcatctttatcgctgtagcgggggatgaggtgaaaatgggagtggaagacggactgataagcgaccgcaccattattgttaacgatattcatgccaatgatattctcgtcagttgctttgatagcgcgggcgatttcaggaatccgcgcaaacacgatgctggcaagatcacgatcgtaaccgaaaatatcggcaacgtgcgtcttcggtacgactaaggtgtgaccaggagtaccttgcgagatgtcaagaaaggctttgaccatgtcgtcttcataaacggtatagctcggaatatcgcccttaattattttacaaaagatacaatcgtcatcgagttttggttcaaaagctgtcatgtgataaccttctttatttattagttgggttcattatacactatcgatgttgcggcaatcaaaactaggtagcttgattgacgacaaattactgaagtttcggtaaagtcggggatcaatgagccaaccaaatagagggtgtcgtgatggctatgctataatgggagcacttataccaacacagaaagaggttaacgttatgacattagcggtacaacacttagttggtgggtattcgcaaattcccgtcttaaaagatattagttttcaagttgagcccggtgaattagtgggcttgatcggacttaacggggccggtaagtcaacgaccattaatcatattatcggtttgttgacgcccatgaaaggatcaattgcgctcaatggcgtgacattagcacaagatcctcaaagctataaaagccaaattgcgtacattccagaaacacctatcttatatgaagagttaacattaaaagaacatctagaaatgacgatgctggcgtatggtttagaccaagaacaggcttggcaacgggctcatgacttattgaaaactttccgattggctaacaagttggattggttccccgcgaacttctcaaagggaatgaaacagaaagtcatgattgtttgtgcgttcatcactaacgctaagttgttcattattgatgagcctttcttaggactggatcctttggcggtgcacgacttgttggcattgattgcgacagtcaaagcacagggagccgctgtccttatgtcgacgcacgttttggacacggctgaaaaagcttgtgataagtttgtattattgcatgctggtgaagtacagacacaggggacttttgctgaaatcaaagcgaattatccggatgcgggtgagtcgttaaacgatatttatctttcattgaccggggtgacccgtgatgaatgagttatttcaaacgcggttgcagcggcatctgcgtcggatgctgcgctacctaagattggtgttcaatgatcactttgtcattgcattgatgttttttgtcggcggactcgggctggcttattccaattggctcaagacgcttggccctcagcagacgtggatcgtctgggtgctcggtctcttattatgggcgggcctaagtgtcagtcatatcgcaacgttattagaaccggccgataccgttttcctgttaccacgtgaacgagatgtgcatgcgtacttcgtgaaagcgtggcgctacagttggtggttggcgcaagcagtccaagtgatttttgttggcttgaccgtgccgttgctcatgatcgttgatcagatgacgggctggtcgttgctggcgttactcatcacccagttggcgttaaaggatgcccagttaacgctgagcgtgacgcatctctatcaagtgaagccaagcatgaagcggtggttgcgccccctgaactgggccggcgcgttcgtcacgttggcagtgggactactagtgacgccgtggttgagtgccgtaatggctatcgcgattgcggtgggacaacgttatttgcaccaacgaatttggtcgaccacggtgattgcttggcgtgacgacatcaaagccgaagccaaccgtatgttagggatttatcgattctttaatttatttacggatgtaccaatggtgcaaggcagtgtcaaacgtcgtcggtacctggattggttactacggtggttacctaaggaccagcagcatgcgtttggctacctatatacacgtggcatgttgcgcggcacggaatttagcgggttagtggttcgtttgacagttattggtgcggtgctactgtactttagtgggcacggttggttagcgatggcgttggacgccttatttatttacttgattgggtttcaattgttgccgttttacaagcaatacgataatatagtttttacgcacatttatccgctggcaactaaacagcgggtgaaaaactttcagcggttattgcgaaacgtgttaagtttgacgggattaatctttttagttgcgttctggttaagcaacgcaccgttagctcaagttgggattttgctcatcattaacgtgattgaaatctatctcttagttacttggtatttaaaattaagattagcttaaaaccttgatgtatcaagggttaaaaaggacttgacggattcaactttcgtctataaaatgtgattgttaagtcaaataataatgagtcattaaataaattttgagaggagtggggctgatggatttcgaacttgatgatggctgggacgtttacccgatctatgggaatacgaataaagctttcatgggcaaaaaaaatcaccaacgattgttcttaaagcgaaacgcctcgccgttcctagcggcgctgtcgatggaagaaattaccccgcgattaatctggacgaagcgtatctcgagcggggatacgctgacagcccaagagtggttgaatggtcaaactttaacgaagcaacaaatgcggctgcctgaagtggcgcatttattggcacgtgtgcacaattccgagttgcttcaccggatgttaagaaaagtcggtggtcagagtgtccgcccacaagactttattcagcaatacttacaagatttaccagatgatttacggcaccatccgttaatggcccgggttctggatgaattaagaggaaccgcacccactttaccggccactgattatcgcgtttgtcacggtgatcttaaccacaagaactggttactatctgatcgccaacaactgtacttggttgactgggattccgcaagatttgcggatccggcgtcagatattagtatgctactatgcgaatatgtcccgttaagtgattggcaacagtggcttagtgaatacggtgagactatgacgaccgccttacggacgcgagtggtctggtatgctaagattaatttactattgaatatcaaagataattattatcggaatcagtaccatcagatgaaccatgaaattatctttttagaagaattatcgcagtacgaagtgtaacgacgagcaacaaaatcgccgcgagtcccagatggaattcgcggcgattttgttgagtaagcaaatgaagaaggagtcaatcaagatgcgtgtcagaaataaaccgtgggcgccaaagttaattgccgcccatcccgaacttattaccgaagatccaactcagttaaaaggccgctggcaaagccgttttgccaaaccccagccactccagattgaagtggggagtgggaagggccagttcatcattgaaatggctaagcgtcatcctgagataaattacgttgccattgaaattcagacctcggtgattgcgattattttgaaaaagctagtcgaggccccgctgcctaacctgcaattggcacatgcggacggtcaagcggtgactgcctttttcgaaccccatgaagttgatcgcttatatctgaacttctctgatccgtggccgaagtcgcgtcatgaaaagcggcgtttgacctacaagtcgtttttgagcagttaccgggaagtcttaaaacccaacggtcagattgaatttaagactgataaccgggggctattcgaattttcattaacgagcatgaataactttgggatgcaatttgaacaagtttggttagacttgcatgcggttgccacacctgaggataacgtcgagactgaatatgaacagaagttcagtgcggcgggcccaatttataagattattgcaactttcccagcaaaatagactgaatgagaacagcgaaacgcgtcggcgatcgctgttttttaattgagtgtaattgtcggaaacatcaaaaatgagcttccagaattttaattccagaagctcatttttgatttttgatgcggatagtcaattgtgagttattaaagccggtaaatgtctaaaatactaccagtatttgcatcggccaaaaactcgtactgtaccagctgaccatcttcatagcgggtaatgccgccatagtagacatccgtgcgcaatgcgaacttttgtaatggggattttttcatttcaatccacgagccttcaatcggtgcttccttcaaaaacgcgcgcttgacttggctaagaatttggttaggggtggggcggcgcaaccgcttgaacaggccgccaacggaaaagcccccggcgataccagccatcccaaccgctaacaagccgccatattgtaattgtttattcatgatgttgcgtctcctttcagctaacttgactaggaaatgttttatttaaatttagtataccaatgattgacgagaatacaaagaaaagtcataattaatcagtatgatttaagtaaaatacgctataataatatattgaacgctaaaatgagagtaaaggggtttcacatgttaattacaagttataatccatccgaattaggtgacacgttaatcaccattttacgaccagatgcggccacccaaacgattgaaacacatgccaatgtgacgcgtattagcgatgctgacagtggggaaaccttgggctataatttctttgacgtttccaagacgttaggcgacttagatgccaatggtcaagttcacttaacggccgaacaagttgagcaattaaataatttattaaaaaccaatgattttgaacctgaattagttttagacactgaccctaagtttgtggtcggctatgtggaatcagccgaagcacatccaaagtctgatcatttacagattaccaagacgaatgttggtttggaacaaccacttcaaatcgtgagtggttcacctaatatgcaggcgaatattttagttgttgttgccaaggtcggtgcaatgatgcccagtggcttaattatttggccgggcgaattacggggcgttgagagtgatggcatgattgtttcaggccgggaattacgattaccgaacgcgccacaacggccaggagctttgattttgcccgccgattatcagccagtgggtgcggcattcgattttaaacgcgctcagacgttatttaccgcttaatttgcagatattaaaaactaggatgattgaaaatgaaccattatgatggcccggcatttttccggaaatatcgatttaacaaaccacaagtgaataattcagcggccagtcaatcaactcctgtagcggcatcggctagtccacaatcgactgctggtgcacctagtgcgacgccaaagcgggcagccagtcaaactagcgccaagcaggtgacgagtcaggcaactacttcgagtagcagtgctgcaactagtgcgaccctctttaacggtggcacccatgggacttttcacccatcccgggtaccagcccagcttagtgcggcgctgacaaatggcggtatcattcaggatcacgatgaccgtaattatttagaaattgaagcgagcttgcataagcggcccgagaccttcttattgtttgcggatgcagcagctaatgatttaccggctgttgatttgcaacaaccgctttctgatagtgggacggacacgagtcaagttgaacacccgagtgattcggcagttcttagtcaagcggaacggaagatggcttcaagtgttgacccgacaacggtaactagtcaggcagcatcgagcggggctgctcaaacggtcgtggctaacacgtcacagaccggcagtgattccacggtgtccgcagcttcggcgacggttgtgcgaccaacggaagtgtttgaacctactactcctgaattagctgtgtcggctgcggcaattaatacgcctaaaaccgatgattcagtggtagtgacggctcccacggaagtatttgagcccactgacccaagtttagcagcgtcggcagccgccataaatgcgcctagcgcggtaagttcggcagtatcggcaggccccacggaagtatttgagcccactgacccaagcttagcagcgtcggcggccgccgtaaatgcgcctagcgcggtaagttcggcagtatcggcagggcccacggaagtatttgagcccactgacccaagtttagcagcgtcggcggccgccgtaaatgcgcctagcgcggcaagttcggcagtatcggcagggccgacagaagtgtttgaaccaactgatcccgcgcttgctgaatctgctgcaactgttaatgcggctgctgatcatgataaaatagaatctgctgcgactagtgcgacacccaagtcagcacatgggctaggactatccttaggggatattatgaccgctgagcacgatgcccaggcggacttagcgttatttaaggatcagccaacaacggcggcttctgcagcaccacagtcaagtactgcgcagactcgttcacacgttaacgaagaaccttatcaaccggttggcatgcggccaactagcacaagtcctgctgtgacgtcggcaacggccacgccagtcagcgttgtggcatccacggtacctttacaggaaagtgggggagcggctagtgtgactatggcaccgtcacaggcggctacttctgcagttacaactagtcccgctttgtcagagacatctgcagtggcttcacaacctgagttagttcatagtggcggttcagcggcccccgtccttgaggataaagaattagcggcttatcatttgccaccgctgaatctgttgaaagcaccgatcgtggctaatgaatctgagatggatgattggatcgagcagaaggccagtgcgttagatgaatctctggacgcatttggtgtcaatgccaacgttgtcgattggacgattgggccaaccgtgactcagttccaagtaaaacctgctcgtggcgtcaaggtcagcaagattaccaacttaaatgatgatttgaaattggccttggctgcaaaagatattcgaattgaagcgccgatccctggccgtaatacgattgggattgaaattccaaatgcgaaatcgcggccggtgatgctgtctgaagttttagattctgacaaattccgcgacagtaagtcaccattgacggtcgcactcggtgtcgatttattcgggcaaccacaagtcactgacctgcggaagatgccgcacggtttgattgcgggggctacgggttctggaaaatcagtcttcatcaatagtatcctggtttcgattctgtacaaagcgaacccacaacaagttaaattgttgttaattgatccgaaggccgtagaactagcaccatacaacgagattccacatttattagcacccgtgatttcagaacccaaagccgcttcggcagcgctgaaatgggtcgttgatgaaatggacaaccggtatgataaacttgccgctggtggtgcccggaacattgagcaattcaacaaactggccgacgaacatgacgagccggctctaaaaatgccgtatatcgtgattgtaatcgacgaattagctgatttgatgatggttgcttctagtgaggttcaggattacattgccagaatcacccagaaagcccgtgcggcagggattcatttactagttgcgacccagcggccaagtgttgatgtggtcactggtttgatcaagaataatatcccaacgcgggtggccttcatggttgccagccagatcgattcgcggacgattctggacgcgagtggggcggaacgcctgttgggacgcggtgatatgttgtatcttggcaacggtcaacccgcaccgattcggttgcaggggacgttcgtggacagtgagattgacagtatcactcagtttgtccgtgatcaggcagcaccgcactatgaatttcagccagacagcctaatgaagcacgaggaagcagcacgcaatgaagatgacttgatgcctgaagcattggcttacattgccgatgaagataccatgtcaacatcgaagttgcaacgaaacttctcgattggctataatcgggcggccaatattattgatgatttggaaagtcgcggctacgtttcagcagctaagggttccaaaccacgagatgtttatttcacggcagcagatttaactaaattacaagccaattcataattaaaaataaagcgattcacctcatgattgatgaattgtgaatatgggagattattagcataatggataaagcaacggtttattattttgttgggatcaagggctctgggatgagctcactagccttgattttacatgacaagggttaccaagttgaaggctcagatattgaacaatatacgtttacgcaaaaaggtctagctgcagctggcattaagatgctaccgttttccgaagataacattcgcgaaggcctcacagtgattgcggggaactcatttactgatgaccatcctgaaatcaaaaaggcgcgtgaaatggggttgcccgtttatcgttatcatgaatttcttggaaaattaatggaaggcttcacgagtattggtgtggccgggactcacgggaagacgtcgacaactggtttgttgtcccacgttttgagtcatattgctcccaccagttacttgattggtgatgggaccggtaaaggcacccctgacgcgcgtttcttcgtttttgaagcggatgaatatcggcggcacttcgttgcttaccatcccgattatgccatcatgacgaacgttgactttgaccatcctgattactacaaggatttagctgacgttcaatccgctttccaacaatttggcaatcaagtgaagaagggcatctttgcttggggtgacgatgaaagtttacgacacctcgatgttgataccccaatttactattacgggacgaatgaccgtgacgactttcaagcggttaatatcaaacgaacgactaaggggtcttcatttgaagtgaagtatcacgatgaatcgttaggggaatttgaaatcccattgtttggtgaacacaatgtcttaaacagcacggctgtcattgcggtttcttactttgaaaaggtgaacttggacgaaattcggcgggaactcctcgactttagtggggttaaacgacgtttctcagaacatcaagttggcgatatggtcatgatcgacgactacgcacatcatccatcagaaattaaagcaacattggatgctgcacgccaaaagtatccggataaggaaatcttggccgtattccaaccacatacgttctcacggacgaaagcattgatggatggctttgcagccagcttaagcaaggcagatcacgtctttttgaccaatatcttcagttctgcccgtgaaaaatctggtgatgtttcctccaaagacttagctgctaagttacccaatggtggtgaaattatcacgaccgatgacatgtctgctttaacggcttaccacaatgccgtcgctgtctttatgggtgctggtgacattcaaaagtacgaaaaaatttatgaagaccaaatgaaataatttttaaaaaagcggccccagcagggccgcttttttagtctgtctttaaattgatttagcgtaaaccggcgttagcatccaagatgaaaccctatgagagatgttagattattgctagacaacagttgtgcgacctattttgaccttacaagttttaatggaacttatgcagtcgataaataaagcaccaatgaggataattcactagaatctccgtcattggtgttttattagtgtgtatgatttctaaggattaaccacgtggttagtgaggcaggtgcagtagtcttagttttgttgcttctgggctttgtttaacattttcttagcttcacaatcatagtcgcaggccgcacatttgccctttttagcacgtttgaccacgcgataaatctgatagccagcagccccaataattagtgcgataattaagaaattaacgaataatgccatgtgaatcaaactcctttcagataaataattgaccaacttggtaaatgacgaaggccaaggtgtaagcaatgaccaaactcgagcagacggcgtaaacagcccacttggtcgatccagtctcggacttgatggtcccaatcgtggcgaagcacgggacatatagcaagatgaagacgagcatcgcgtatgcggataacggtgtgaaaaagcgccccatcatggcaatcaagccggcctgatttgcgctgtggaacattaccatcatactagagctgatgacttctttggctagaatcccagtaaagagggctgagataacttgccaagcagtcacaccgagtggcgcgaacagcggtaatagtgttttgccaagtgtcgcggcaaagctgttgtcgatgtcgctgactaagccgctagtaccgaatgaggaaagtaaccaaatcaagaccgtaccggcaaaaatgatagtacctgcctttttgatgaaccctttacccttatcccaggtgccacgccaaataatgtcagcccggggaatatgatactgtggtaactcaacgatgaagacggaactatcatcgacgttgaaaatcagttgataaaatttagccataccgagggcgaccgcaatgccaagaaagtaaatcgacaagacaattagggcctgatttttcgggaaaaaagcggccacaaataggctgtagattggcagacgggcggagcaactcataaatggggaaatcagcgttgtaattaagcgttctttaggttgttcaattgtccgggcggccataataccagtgacgttgcatccaaatccaataattagggggataaatgccttcccgttgagtccaatcatctgcatcaagcggtccgtaactagtgctgctcgtgccatgtaacctgaatcttccaagattgaaatacaggcaaacaagacaaaaatttggggaataaagacgagcacgccaccgacccctgcaattaggccgttaacaatcagtgagcgcaagaccgggatggctccagccatggtcaaccagtgactcacggtggtggatagtggtccggagacgaagctatctaacaaatctgacaggggcgtgccgacccaatcaaaggataatttgaacatcaagtagaagattcccacgaagacgggtagccctaaggacggattggtgacccacttgtcgattttagcagtcatctcgacgtggctggtgcttgccaagttttgactagcgctggctaaggtttgctcaataaagtctagtcgggtttggaagatctgctcgtcgaatttttgagcgtcgtaataagcggcttgactagtgagtggtgtcaatcccatgtgtttcgcgtaggctcgaattggcttattttgattaataaattgaatcgtcagccaccgtgcgaagtctgctgtcaaatcaaattttttgatgagctgttggctagcctgacgaatggcttgctcaatcatgaaaggatagttgagtttgagcggtgtcgcggccggatggggacctgccaataagtcttcgcgtagctgatgcagcccttctttattgcgggcgttagtcgctttgatctgacagccaagttgttcagctagcgtgtcaaaatcataataatggcccgtccgtttgaggtcatcaatcatgttgagtgcgataatcaccggtgcgccaaattccaacacttcgatcgacagtagtaagttacgcttgagctgactcgcgttggtcacgttcagaattagatcagggtggttatgtagcagatagttggtgacgactgcttcatctttggtgattggattaagtgaatagactccgggtaaatcgaccatttcaacttcagagtgccgaatccggcccatcttcttctcaacggtcacgccggtccagttaccgacgtacgcgtatttatccgtcagttcattgaatagcgtggtcttaccagtattgggatttccgagcaatgcaaccgtcgtcatcttaatggcctccaatcaacgtttgaaatacggtgtaccgaatcccaatccgttgttgatcaatctgaacaattactggtccgtgaaacggatagtagcggacaacggccagcggactgccgacatgtagccctaagctgtgcaatcgttgaacggtctgattatccaaacctgtgaattgttgaatatgtagttgtgatgtattagtaacggattgacttagcataaggctcagtcctttctgaatattccaatagtgaataattcatcaaaaatattatacctacatcatagcatgaaagggcttttattaatatggggaaaagccttattttcttttgaaatgaaaacggttatactctaagtatagaatacaaaaaggccgatgttacgctatttttgttgaagccgttgactaatcattatatacggaaggaataacggcttgggtaataaattcaattgttggaggatgatttaaatggcaaccttggaagttaaagatttacacgttgaagtgacggatgatgagcaaaaaaagtctcgtgagattttaaaaggcgtcaatttatctatgaaaactggtgaaattcatgccattatgggaccaaatgggactggtaagtccactttatcacaaactattatgggccaaccggcttatcacgttactcagggtgatatcttgttgaacggcgaaagtatcgtaaacatgccagttgatgaacgtgcacgtaagggactcttcctcggcatgcagtatccagctgaaattcaaggggtcaccaacgctgaatttttacgggcagcaatgaacgcacgtcgaccagctgatgatcaaatctcagtgatggcctttcttaaagaactcgacaagaacttggcactacttaatatgagcgaatccatgacggaacgttacctaaacgaaggtttctccggtggtgaaaagaagcgtaacgaaattttgcaattattgatgatcaagccatcattcgccttattggacgaaattgattccgggcttgatatcgatgcgttacaagtggtttctaagggtgttaattcgatgcggggcgataatttcggctcattgattatcacgcattatcaacggctgttaaactacattgtgcccgatgtcgttcacgtgatgatgggtggtcgaatcgtgaagactggtaacgccgacttagcaaagacccttgaaaaagaaggttatgctggtttacgtgacgatttgaacattgatgtcaaacttgttgacgacgaagattagggggtggcagtaatggaagcaactgctgattatgaaactatcaaaacaacgctagctgcggctgctaacgaacatggtgaaccgcactggctcgttgaacgccgtttagcggctttagatgcgatgcaaggcctagcggttcccaaagctgatcgctttagtattcgcgactggccactgacgcccaccgaccaaccactaaagttcagtcgttcggatcgaactttagcaactgatgtaacggctgaagctggtcatatccaaatcgtacaagttgggcagacaacggtgaccgtcaatttgcctgatgaactagatgatcagggtgtcattttgaccgatatgttcacggcttttcgcgaacatccacagctaactgaaaaacattttatgggcaaagtcgtcaaaactgacgaggaccggttgaccagctaccataccgcgtttttgaacgccggggtcttcctatatgttcctaaaggggttactgtcaaagaaccaattgagatcaccacgattcaggatagtacccgagtgcaaccgttaattagtcacgtcttgattgtggctgaacaagacagtcatttcgcagtaactcagcacctgacaacgaagggtgacgtcgataatatcgccaactgtgttgtagaaattttggcacgggctgacagtgaagtgcatttttcagcgttcgatgaactcggggccaacacgactgcttatttgaatcggcgggccgcgatcagtcggggagccaaagtcgattgggctatcgggatgatgaataacggtaacactttcggggactttgactcggaactgatcggtgagggcgccaaatccgatgccaaggtcatcacagtgacgaccaaggcccaggatgtctgtgttaatacgcgggtcactaaccgtggtaagaagactgacggcaatatcgtacaacgtggggtcattatggaaaagtctaacctgatttttaacggaatcggtcacattattcacggggcctccggtgcacatgctgaacaggaaaatcgggttttgatgatgtctgatgatgcccatggtgacgcgaacccgattctattgatcgatgaaaatgacgtgttagctggacatgcagcaagtgttggtcaaattgatcaaaatcaaatgtactatttgatgagtcgcgggattgataaaccacaggcccaacggttggttattcggggcttcttaagtaccgtgattggtgcgatcccatcgaagactgtccggactcgcttaacgaacacgattgaaaggaagcttgaagatggcatccaattttgagacgttacggtcagattttcccattctaaaccaacaagtgaatgatgaacgacttgtctacctggataatgcggcgactgcgcagcgccccaaccaagtcgtggatgcgctcgttcacttttatcaacacgataatgccaatgttcatcgcggtgtgcacaccttagcagagcgggccactagtcaatacgaagctgcgcgcgccaaggtgcaacggttcatcaatgctgcaaaaacggatgaaatcgtcttcaccaaagggacgacggatagtctcaatctgattgccagtacttatggcgaagccaatattcaagcgggtgatgagatcgtcatttccattatggagcatcatagtaatttaattccgtggcaacagttagcattgcgtaagcacgccaccttgaaatatattgagttaacggcgactggtgaattggacatggccgatgctgccaacaagattacggatcgaacaaaaattgtttcagtgacccatgctagtaatgtattgggaacggtcaatccaatcaaggcgttagcacgattggcgcatcaacacggtgccgtgatgattgcggatggggcgcaagcagcccctcatatgccggtcgatgtccaggcactcgatgttgatttttacgcattttcagggcataaaatgctaggaccaaccggtattggcgttctatatggtcgtgagaatttattagctacgatgccaccgtatcaatttggtggtgagatgattggctttgttcaccgtgatgacagtacctgggcggaactaccgtggaagtttgaagcgggcactcagaacattgccggtgcgctcggcttgggcgcggcggttgattatttgacgcaactcggtatggatcaagttcagcaacacgaacagcaattagtcaattacttattgcctaagttgattgcaatgcctggtgtcacggtctacggtccccaagatccccaacatcatacgggcgtcatcgcctttaatatcgacggtttgcacccgcacgacgcggctaccgcgttggatatggaaggtgtcgccgttcgcgcgggtcatcactgtgcacaacccctgatggcagcgctcggcttagtagcaactgcacgggctagtttttacatttacaatacacaagcggacgctgatcaattattaacgtcactccaagcaacaaaggagtttttcgaacatgggactgtctaaattaagtggcttatatcgcgaagtgattttagatcatggtgatcatccgcatcataaaaatgcgttgccaaacgcaacacatgccattacgttgaaaaatccaacttgtggcgacgtcatcaatttggctattcaattggatgcgcatgatcaaatcgaagatattggatttacgggtgagggctgtaccatcagtcaagcatcggccagtatgatgacggatgcggtgatgggtaagtcgaaagaacaggcattggcaatggctaagacattttcggatatggcgattggcaagcaacacccgcaggccgatatggatgccttagaagacgccgcaattttatcgaatattatgcaatttccggcacgaatcaaatgtgccacgctagcttggtgggctttgcaacgggcattgcttgctgaaaatggcaatgaggaggaatcagaagtatgagtgaagtacctgacgtggtcaaaaatgaccgtgattatgaatatggatttcatgacgatgtcaaaccagcatattcaactgggcgaggattaacggaagccacggtgcgcgaaatttccgcggcaaaacatgagccacaatggatgttggattatcggttaaatgcctatcatgagtatttaaagatgccgatgcctaagtttggcccggatctcacgaaactcgacttgaaggacatgctgtattatcagaagatgaccgataaaaagttccgtgactggaaagaagtcccagctgacttgaagcggacgttcgaccggttaggtgtgcctgaagctgaacggaaatacttagccggttcatcggcgcagtatgaatctgaagtcgtttatcacaatatgcgtaaagattttgaaaagttaggtattatttttaccgataccgatacggcgcttcacgattatccagaactgttcaagaagtggtttgggaaactcgtcaaaccaaccgataacaagtttgcggctttaaacgcggcggtctggtcaggtgggtccttcatttacgtgcctaagggtgtccagacgaagacgccaattcagtcatatttccggttaaatgctgaaaactcgggtcagtttgagcggactttgattatcgtggaagatggtgccagtgtcgactatgtcgaagggtgtacggcccctaattattcttcagatagtttgcacgcggccgttgttgaagtcaatgttgagcccaacgcttactgccgttatacaacgattcaaaactggtctgacaatgtttatagcctggaaactaagcgagctgcagcggccgaaaatgccacgatggaatgggtcgatgggaatttaggttcgaaggttacgatgaagtacccaagcgtttatttgaatggggaaggtgcccgcgggaccatgttatcgatcgcggttgccagcaatggcatccaccaagattctggtgctcggatgattcataatgctaagaatacctccagttcgattgtttcgaagtccatcgctaagactggtggtgcgactgattaccgtggaaccgtgcgttttgccaagcattcagacggttccaaagcgcatgttgagtgtgatacgatcatcatggatgaccagtcgtcttccaacacgattccgtataatgaaatcgacagtgctaacgtcgcgatggaacacgaagctaaggtgtccaaaatctcagaagaacagctctactacttgatgagccgaggaatttcagaagctaaggcaaccgaaatgattatcatgggattcgtagaaccatttacgaagcaattaccgatggaatatgctgttgaattaaaccggctaatcagctttgagatggaaggttcaatcgggtagtaagggggattggttaagctgatgttaaaataaaacttgagtggcatgcgagattgcgattcgagttttttggttaaatgattgttgatgaatgttagccattataatcgtgccagctaggatggttgataattgtagtaatttaaaattgtatctcggttagtgtttttatcatgctgattcgccttttcgttaatattggcgacgtactttattataaattaggattattaacgtatattctaacaatggtataattaaaaacagttttaaacagacaggagtgtggcagaatggcagacgaacttggcgaggataaggccctctcacccgttgaagacgcggtcatgaagtcgttagagcaggtgattgatccagaactgggcgttgacatggttaaccttggtttgatctatggtgttgacgtagacgataatggtagctgcacggtaacgatgacgctgacgacgatggggtgcccattaggaaatttattggcaagtcaaattaatcaagcaattatgagtgtggatggtgttaagaattgtgaacttgacttggtctgggaacctgcttggggaattgataaaatgagtcgttttgctaaggttgcccttggcattcatggctaacgggtgagacaaggtggtgtgcgatggatattgaaaagtttattgcccggcgaaaagctttaaaaatttcacaagtcaaattatcaaacggaatttgtacgcaggcgactttaagtaagtttgaacggcgtgggcgagtaccagcattagcaattttaaatcagctctgcgctcgtctgggattgacagttgatgatctaagtgaaaaccaggctaattcagtgacccaaattcgacagcaacttgatgagattgagcgacgactgatgatggaagattatcaatcagtcctgcaatcattggtagacctgaaagttgagcaaattgatgcggtaccttcacggatgcaatattactatttatgtggcatgctaagttcgttgattaatggaacagccagtgatatttgtttttccttctcgcaaatcgttgatgatttggatagggctcaccaaacaattttcacaccgctagcttatgtcggtctgggtgtcatgtatggccggttagctgagcctgagaaagctcaattttatttcaggagagtacgatactatgtcgagcacgctggctcatcaggatatgcaaatgattacttacggctgttaaccctaatcttttatacggcagagtattacgcaattagtggtgatttcgtcacaagtaatcgtctaatagatgatggggtagcgctttgctcagatgaacatgtcacgtattacttaccaagattgaaatacttagcgaccgagaatgctgttaagcaacaactttcggataaattgattaagcggttaatgagtgaaacagaagcttttgcacggattaatcataatcaagttgttgaggttaaggtagctgcattgcgacaacgatatttgcagggtattgctgcttcagaaaacaattaacaagacaatggctagatttagtgttttattgtagtttccaacatgctaaaactaatcaatgctttgtacattaaataataagaagttatgtatgacgccgcccgcccctaaaaaatcttccccggatgtcccgcaaaaagtcctaccgattgaagttctattataaacgcttatggtgtcccattccggaaaatcctaatgtagcggtaatccattaaagacaatgattgaatggaattcacttagacataagaaattcttattaaattcacaggcacaaactattttaccttctttgactaatttgatagacttaagttaagaaagttgaggtgactgattgagatggctagtcataggcaaatgattgacaaactagtgtggtgttgttactagcgcagtctgcgttagtaacgatgcacaaactcaatttttaatcttaactcggaaaaagtaacgagtagtcaatttttaggtgaaagagggattttatgaacaattttcaaaatgacccacaaccacggaccatcaacacacaagttggcctccgtagtttcctaactaaaatgtatgggtttatgacaatcgccgtgttagtttcggcctttaccgtttacttagcgatgaccacgttccaagcacaaattaatgccgccttttcacaacacccattcatcttcttgatgatcttcattgtcagcatgtttgtgatgattggtgggattcaagtcaacgcgacacgcaatccagcgatgagcttcaccttactgatgctctttgccatcatctttggggttgaaatgtcagtgaccttgtccttatacacgggtgccgttatcaccggtgcgttcgttgcagctggagctgtatttgcgaccatggcggtgattgggacgacgactaagcgtgatatttcacgtattgggacgcacttgattgcagctttaatcgggttgtttgtcgcttcactggtcaatatgttcttacaaagtgccatgattagttacatcttttcatacattggtgtattgatcttcgccggcttatccatgtgggacgctaaccggatgcgcaacatgtatttacaatatggtgaccaggtttcatcgactggtttggccgttactggggccttacaattatacttggacttcgttaacttgttcctctacttcgtccaaatcttcggtggctcaagccgcgactaatcattaagataattattaaggattatgaccaagatgtcataatccttttaatttaccgaaaatgagttatttcacgggttttcggtggaccgaactcccgttttacttaattgtttggtacaattataagggtaaataattagtcgttcagcctgtactgacaggcgctgcgaatcagaccgccaatcgagtggtattaatggtctgagtgacggattttcataaaaatgatgatttaaattaagagatggggagcaaactaatggcaaaaaaattattactgattgatggtaacagtgtggcatttcgggcgttctttgcgttgcatagtcaactggaacggttcgtgaatccagacggcctgcataccaacgccatttatggcttcaatacaatgcttgaccacatgatcaaggcagtcgaacccacggatatgttagtggcttttgatgcgggtaagaccacgtttcgaacagccatgtacgataattacaagggtggccgggctaagacgcctagtgagttttctgaacaaatgccgtatatcaaacagctattagacgcgtatggtatcaaacattatgaattaaaagactacgaagccgatgacattattggcacactggccggtcaagcggatcaaaccggctacaccacgacggtcgtcactggtgaccgtgatttgacgcagttgacgaccgagcataccacggtggccgtgaccgttaaaggtgtttctgaagtggaacactatacgccggcgcacgttgaagaaaagctgggcatcacaccggcacaaattattgacatgaaggggttgacaggtgatacctcggataactatccgggtgtcaccaaggttggtgagaagaccgcccttaaattactcaaacagtatggtacgatggaaggcatttatgaaaacatcgatgccatgaagcagagcaagatgaaggaacatctgattgaggatcgcgaacaagcggcgcaggctaaggtgctagcaacaatcaagcgggatgcgccgattgatgttcaattggctgatttatcctatgatggcccggatcttgaccagctggccgcgttttatcagaagatggactttcaatcatttttgaagaaattacacctacagtcggacgaaccagcaacgcccattgattataccgtcttgacgaaagctaacctgacggaattgcaacaatttaccgatcacgtggacttttatttggagatgccaacgccgaactaccacacgtcggcctttgctggctttgccatcggagcggatgatcactggtacatcagtcgggatgtggaattattaatgcaaccgactgtggctgatctcttgagtagcacaacgattaccaaggacgtttttgatatgaaacgcacgacggtcgggcttaatcgtttgggtattcagctaggtaaagtcgattttgatctcttactcgtttcatacttattagatacaaatgataacagtaacgacttgggaagtttagctgagcaacacgggtacactgacttgccgagtgacgagaccgtttatggtaagggcgttaagcgtgccattcctgaagatgatgatgtctactttagtcatctcgcccggaaattggccgcgatcgctagtttgaagccacagttattaaaggaattggcagctaatgagcaggatcaactttacgatgatattgaaaaaccgatggccaatgtcttagctcagatggaaatcgccggcattacggtcgacagcagtcgacttaaagccatgggcagtcagtttacagaacggttgagtgaaattgaacagacgatttatcaagaagccggtgaagagttcaatattaattcacctaagcaactaggtcacatcttgtttgaagaaatgaaattacccgtaatcaagaagaccaagacagggtattctaccgccgtagacgttctagaaaagttagcaccggaagcaccaatcgtcgctaatattttacaatatcgtcagatttcgaagattcaatcgacctacgttgtcggtttgttagatgccattcattctgctgatcaaaaagtgcatacgcgctacttgcaaacgttgacccaaaccggccggttgtcgtccgttgatccaaacttacaaaacattccggtgcgcttggaagaaggacgtaagattcgacaagcctttgttcctagtcatgaaggttggcagattttctcgtctgattattcgcaaatcgaattacgggttctcgcgcatattactgatgatgaaaatatgcaggccgcttttaaagcgggtgatgatattcatgccgcaacggccatgcgaatctttcatttgaactcagctgaagaggtgacgccaaatattcgacggcaagccaaggcggttaactttggaatcgtctatggaattagtgattacggcttgtcacaaaatatcggcattacgcgtaaacaggctcgcagctttattgacgcttacttcaaagaatatccgggtgtcaaaaagtatatggatgaaattgtccaaacggcgaaaaaacaaggttatgtggaaaccatttcacatcgacgccggtacttgccagatattaattccaagagcttcaaccaacgctcattcgctgaacggacagccatgaatacccccatccaagggagtgcggctgatattatcaagattgcgatgattaagatgcaagataagttacaggctgcgggtttgaaagcaaccatgctgttacaagttcatgatgaattgatttttgaagcgccaaaagaagaaattccagttttagaaaaattagtgccaagcgtgatggattccgccgtacagttagccgtaccgttaaaggttgagagccactacggtgatacttggtacgatgcaaaatagggggaaccaccatgcctgaattacctgaagttgaaactgttcgtcgcggcttaaatcgtctggttagcggggcaacgattgctagtatcgaggttttttggccgaaaattattaataatgatgtcgatagtttcaaacagcgtttagccaaccaaacgatccagaccattgatcggcgggggaagtatttattgtttcgctttagcaatggtctgacgatggtgtcgcatttgcggatggaaggcaagtataatgttgtaccgcgtggtgaagatcaaggtaaacacacgcacgtgatcttccatctgaccgatgatcgtgatttgttgtacaacgatacgcgtaagttcgggcgaatgacgctcgtgccgaccggtgaagaaaacacggtggcgggattgcggacaattggcccggaacccgttgctgaacagttaacactggcttatatgacggccacttttggcaagtcgaaaaagatgatcaaaccactattgttggatcaaagtaagattgcgggcattgggaacatttatgcggacgaaacgctatggatgagtaagattcatccaatgcggcctgctaattcactaactactgatgagattgcaacattgcgccaaaacattattgatgaaatggcgatggcaattaaaggtcacggcaccactgttcattcattttcaacggcatttggtgaggccggtcagtttcaaaatcacttacacgtctatggtcgtgaaggggaaccttgcgaacggtgtggcacgattattgagaaaatcaaagtggcacagcgagggacccatttttgtccgttagaacaacggttgtaggtgatcaagatgacaaagctgattggattgactggtggcattgccactggtaagtcgactgtttctaagctgctggcaactaagttaccaatcgttgatgcggataaaatcgcgtggcaggttgaagggccaggccaaccgacgacccaaaagattgtggcgcactttggtcagcaagcagtgctggcagacgggcggctgaatcggccatggcttggccagttggtttttaacgatgctcaagctttacaagccttaaccgcaattacacggttaccgattcagtacgcgatgttcgaagcgattgtcgcggcaaaccagcaacagcccgacgcaattattttagatgtgccgttgttatttgaaagtggctggcaacatgtttgtgatcaagtgttggttgtgacggcaccaccagccgtagtattgcagcggttaatggcacgtaaccacttatcgcaacaggcggctcaggcacgaattgacagccaaatgccacttgcacagaaggtcgcaagggctgacgttgtcattgataacggggttaacattgataaaactaaagcagccgtgttaaaatggctgaaaactattactaaataaagaaaaactgattgttagttgttacaaggggtgagaagtctatgcaatgtccacattgtcatcataatggctcccgcgtggttgacagtcgaccaactgatgatggtcgcgtgattcgacggcgccgggaatgcgaaaactgtgggttccggttcacaacatttgaacgggtcgaagccacgccattattagtcattaagaaaaatggtgcccgcgaagaattcaatcgtgaaaaagtcttgcgcggaattattcgctcggccgagaaacgacccgttagcatggaaaccatgacgggcgtcgttgatgatgttgaaaataaggtccggtcactgggcgaaaatgaaatttcaagccaagttatcggcgagtatgtcatggagcaattggcagatattgacgaaatttcgtacattcgttttgccagtgtttaccggcaattcaaggatatgcacgtcttcttgaatgaactccaagatatgatggagcgtgataaggtcaaactggcaaaaccgtcagcgaagacgacccacgcacctaaacgaaaaaaagattagtgaaaaagaatggtgaacaacatgccaaatgatgaacccttaacacccaaaactgggttagtggtcccgcaagcaccagcgctcagtgcggcgcaacaagctgtattggcggaattatacttgccactgatggggccattggcatatagcttgtacgcggcgttacgtagcttacagagtagcgagaatgagctgagcaatcgacgcagtcacgcggaactgcttggcatcctaaatgtggacttgccgacggtgttagcggctcggcgtaaacttgaagcaactggcttgttgcgcagctattatcaacaagatgaattgggtgccatgtacatttatcaattacaagcaccattactggcgttacaattctttgcggatgatctattgagtgtcctattgttagatacggtcggtgagttacgttatcaacaacttgctggcgattttgcagcacagccgattgacttgacggctgccaaagacgtgacggcaaatatcttagatgtgtttcacgttgatagtcaaaaagttacgacgccacctctttcagtgcaaaaggtgcgcgcccaattggcggccaatgaaccggccgaggatcactcgcccgtgctcagtgacgatgactttgactggcaactgttggggcaaattttgaagcagaactatgttgatctcaaacaggttgcgagttcacggcaactgatcattacggaaagtcgggtctacggcatcagtgagattgagatggctaagttaatcagtgaagtggctagtttaacaacgggtcagtttgatgaaaatcaattgaaattattgattgcgcggcgctatgaacggcccgcagtttcgagtcagcaggtcgctacggaagcaacggttgcaacgacgaccactaaggataacaaggcttcagcacagctctcaacggctgagcagcaactcgtgacgtatgctaagcagacagtgccgtatgactttttatcagctttgaagcaggagaaacatggttttgtgacgagcggtgagaaccggctagttcatgatttaattggtcggggggtattacccaatgccgtcatcaacatggtgatctactacttattgcaaaatcgggagttagctgcccttaatcgtaatttgctagaaacagtcgccaatgattggcaacaacacggcattacgacgccggaagcggctttgatatatttgaagcaacgtaaacagccgaaatcaacaccaacacggcgcaagaacaatcgaccgacgcgtaaggagattatgccaaagtgggcccaacaacagcaacagactgagagtggtaagcaaccagctcagaccggtaaacaaattactgctgcccaacgcaaacagcttgctgatcgactagcaaagcttgagacaaattcggaaaaggaggactaaaacatggagaatatctcagaaacactccggacgttaatgaatcggaaaaacttgaatcatcggtatgaggcgttaatgacaactgtgtaccaagatccagatgttcgccagtttttagctgctcatcaaaacgaattatcttcggatgcgctagaacgttcagcggctaaattatatgaattttgtgaagagaaacgtaaaattgcgcggcacgagccaactcaagcacctgggtatcagccgacattagtgatgagtaatcacttgattgacattgcttatcagccaacaccacaaatgcaagaacagcaagctgctcacgcattgcaacagcgggttcgatcaatcagcatgccgaaaaatattcagacggcggacttaaagacgtatgatcaagatggtgaccgggcgacagcattaatggcagcacttgattttattgatgcctatacacaagcgcccaagcgttttcaccggggcttatatctctacggctcatttggtgtcggtaaaacttatttactcggtgggatggcgaacgcgttggctgctaagggtttcaatacgaccttgattcattttccgagttttgcggtcgagatgaagcgctcaattagtaacaatacgtcggcggataaggtcgatgcgattaaacgggcaccgattctcatgattgatgatatcggtgcggatgcttcgtcgacttggattcgggacgatgtgctcggtgttattctggagtatcgaatgcaggaggaactgccaacttgtttttcgtctaatttttcgatgcaagaattgcaagatggttatttgacgctctcacaaaagggtgatgaagaaccagtcaaagcgcagcgaatcatgcaacgggtacgttaccttgcgagtgagattgagatggtcggtcgtaatcgacgactcaatcccgatgcttaaaatcaagagttgacttttagtttaaaagtggtttaatgaaaacagatgcaaaagacacgctttgtttaccatggattgcagagaccaagaccttgttctggaagtcttggaccgggtttacgaagataccacttttgtgaacatgctcaattgagccggaacgcttccgttattagcgctaatgagtcagtgtctttgatgacactgaaaaatcgggtggaaccacgtcaatgacgtccctaatgctagttcagtctggcattagggacttttttgtcgtcccggcgcggtgttttggtgagtgggtaaattttaaggagagtgtcaagtatatggcaagtattaatgttaagttcccagatggtgctgaaaagcaatttgatgccggcgtaacgacggaagcaattgcaaagtcaattagtccttcattggctaaacggtcggttgctggtaagttcaacgatcagatcgtagactatcgccaaccactgacaaccgatggtagtatcgaaattatcgctgctgatagtgaagacggcctcaatgttttacggcaaacggctgcccaagtattagctaacgcggttaaacaattattccctaacattcattttgggagtggtgaagggaatgccaacggtttcttctttgataccgacaatcctgacgaagacggtaaacaagtcagtgaagatgatttggaagccatcagtgataagatggctgcaattatcaaacaagatttaccaatcgaacgcgaagtcttatcaaaggctgacgctttagctttagttggtgacaacccttaccaacaagacttagttaacgaacgtgccgctgccaacaatgatcaagtcgttgtttacaagcaaggggacttcgttgatttatctgacggtgcccaattagcttcaacggggaaagtcaaggtcttcaagttattatccgttgccggtgcatactggcaaggtaagtccagcaatccaatgttacaacgaatctacgggacggccttcttaaagcaaaaagacttagatgctgacctcaagcggcgtcaagaagcccgcgaacgtgatcaccgggtcattggtaacgaattagacttattcttcgttgatcctaaggtcgggaatggcttgccttactggatgccaaatggtgcaacgattcgtcgccaaatcgaacgttacattatcgacaaggaagttgcaaatggctaccaacatgtatacacgccagttttagctaacttggacgtttacaagcaatctggtcactgggaccactaccgtgaggacatgttcccaccaatggacatgggtgacggcgaacaattggaattacggccgatgaactgcccatcacatatccagatttacaaccatcacattcgctcataccgtgaattaccattgcggatcgctgaactcggcatgatgcaccgttacgaaaagtctggcgccttaactggattatcacgggttcgtgaaatgactttgaacgatggtcataccttcgttgcgttggatcaaattgaagaagaattcaaaaaaatcttgagtttgatggttgaagtatacgaagactttgacatttctgattaccggttccgtttgagctaccgtgatcctgaaaacaaggaaaagtacttcgatgatgacgctatgtgggaacgcagtcaaaagatgttgaagtccgctatggatgatatgggcttggattacttcgaagctgaaggtgaagctgctttctatggtcctaagttggatgttcaaactaagacggcccttggtggtgaagaaaccttatcaactatccaattggacttcttgttaccagaacgctttgacttgaagtacgttggtactgatggtgaagaacatcgtccagttatgattcaccgtggtcttgtttcaacgatggaacggttcgtcgcttacttaactgaaatttacaagggtgctttcccaacctggttagcacctaagcaagtaacaatcatcccagttaacaatggtgcgcacggtgcctacgctgaaaccgttcgtcgtcgtttggcagctgaaggtgttcgggtaagtatcgatgaccgtaacgaaaagatgggttacaagattcgcgaatcacaaacgaagaaggttccatacttgttagttgtcggtgaccaagaagttgctaacgggagtgtttcagttcggaagtacggtgaagaacggactgaatccgaagccgttgacatgttcattggtgccatcacgcaagaaatcaagcattacagtcgtggtgcaagcaaataattaacagccaatggcatcaatattgattgatgggttgacaagggccgtggttcttgttaatatattggagttgagaaaaaagcagaagcacccgcttctcgccttggtgaccagagtcatcgggcagatgaacgatgaattgattcccattaacggggttgagcgggcgtactatgcgcccgctctttttgtgaatttctctaaaatatttcggaggtgaattaccatagctaaagattcaatggttaatgacggcatccgtgctcgcgaagtacgtttgatcgccagcgatggtgaacaattaggtgtcaagtcacgacaagaagcaatgcagattgctgaagacgctagtttagatctagtattggttgcgccgaaagcgaaaccacccgtggccagaattatggattatgggaagtaccgtttcgagcaacaaaagaaggatcgggaagcccgtaagaagcaaaaagtggtcagcatcaaagaggtccgcttgagcccagctatcgacaccaatgactttaacacgaagctgaaacatgctgaaaagttcttgtcaaaaggtgacaaggttcgcgtctccatccggtttaagggccgcgctattacccataaggatattggtcgccaagtcttaaatcgaatgattgaagctactaaggaattttctacggtcgaagcctatcctaagatggatggtcggagtatgttcctagtactagcaccaaaaacagataagtaatttctaggaggattattgattatgccaaaacaaaagacaaaccgcgctgctgcaaagcgtttcaaggtaactgctaagggtaagattaagagcgccaacgcttttactagtcatcgtttccatggtaagactaagaaacaacgtcgccaattacgtggtacggctattatcgaaaagccaatggtcaagacataccacaagttattacaaaaataattcacaacgttttagttaaatctaggaggaaataacatggctcgagtaaaaggtggaactgtaacacgtaaacgtcgcaaacggattttaaaattagctaaaggttaccgtggtgctaagcacatccaatttaaggttgctaaggaccaagtaatgaagtcatacctatacgccttccgcgatcgtcgccggcgtaagagtgacttccgtcgtctttggattgcccggatcaacgcggcagcccggatcaacgacatcagctacagtcaattaatgcacggtttaaagttagctaacgttgacgttaaccgtaagatgttagctgatttagctgttaacgatgctgatgctttcaaggcattggttgacactgctaaaaaggcacttgcttaatttaaaacttaattagggcttgctctaatgtttgaacgaccgtcatcctgtatgggtggcggtcgttttgttttgacgcttgattaaggggcacgattcctggacaagatggttcggtgtgttgacgtccttactgaatcttgagattgatttgacacattattgtgatatagtaatgatgtaagcgcttacttatgtgttgattaattatttagctgggagctttggagaaggggtgtcaccatggcaacagttttacctaaagcagttaaggtctggatgggcgccaacatcttgcagattgagtttgataatggggagtttcgatacatgcgtacacatttcattgatgactatgtttctgcgtggtcacccaaaaagggtaagggaaagcggcgcaatttgtggttaatgccatcttgggaatggttgggtgccaatgctcggattgaatcggatggcactgtcgtgttgttcgaaaaggatgtttatacggcccaagaactttggcataatagtgtgacgcgaattgacttggtctctggcgtgcactgattcataaaagatgatgccaaataaaaatggacttggtcatttgactgagtccattttttgatgccgcttggagtatacgtggataacggcctaagtgagccatttagtgcgcgactctgatttatgaaaatcgagtgtgatttctgattggttaagccagtctgccattgtctattcgtgataatcttcgttataaataaagcgatgcagttttaggtattgtgcaccgagtttgcgttcattttcattatctttagggtaataataacgacgaccagccaatcctttaggcatgtagttttgttgggcaatctgatgtggcatttggaatggattatcgatcagaccaccacctgtaatttcctcggagtgtttgtagtgcatatcgcgcaatccacggggcatggggtgctgacttggattttgtgtgtcctggtctagtttttcccaagattggtcaaacgaaccagacttgggtgaaatgcacatcagcatggtggcaaacattagtggatattttgctttgggcatgccaatcttttcggcttgattggcagcgaccacaatttgtgtgacctgttccgggttagctaagccgatataagtgtatggaatttcacgtagccggcggaccactgagggtaagtcatcattttttaacaaaatggttaagtagtagagcgccgcgtcagtatctgagccagccatcgaatccgaataagccgacagatagtcataatgcttagttgccttccggtcgtagctaaaatgctgttgctgggcaaagtgttgtaccgcagcaacagtgatttgcttctggtcaatagcgtggagcgtttccaagatatttaacgcaattcgcagatccccttcggccgaaatagcgatcaggttgagggctttagcatctacctgatcgtcggttaggttgtaaatgtcggttaccgcacggcgtaaagcaatctcgatatctgtatcgctcagtggttgaaactcaaaaatttgacagcgcgaacgaatggccggaacgattgacataatcggattttcggtcgttgagccaattagcatcacgtgcccattctctaagtagggcaacaaaaaatcctgcaatgttttagtcattcggtgaatttcgtcaattaatagaacaaacgattgctctgggtattgtgcgatggctttcgtcagctgtgccttattttcggtcgaagcattaaaagccacgaatggataatcgtcttgactcgcaataatctgcgccaaactagttttgccagttcccggcggcccccacagaatgaggggaatattaacatgttgatcaataatctggcgtaatggctggcctgccttcaacagatcctgttgcccgaccatctgttccagtgattgcgggcgcatttgatcagccagtggtgttttaaatgccaatttcaaagtcctttctgattaagtgttttagtcaaattgatgctatcatcatagcactaatattttggaaactgaaaaagaaagtttggcaggttagcggggaacgatgctgaaatgagtgagtctgataccataggtttgacgttggctcgagtgatgggttgaaggtgtattgatttaagttttcatgcttgttgatgaatgagaaaggcgatattgtttcgtagatggtattgagtcagcttggggagattaatagcttggaattaccccccgtgtatacggaaaacagattaaacgaatcccggggagtgcaacatcagttgtaagcactaaaagacagaaaaggacagcgtatttggcgagttaaagttgatcattatcgcgcgagccgtaatacccgtcaactcatttccatccttcaataactaccttgccaatcatatgatgttgctcgataagttgatgggcctgccgcaagttaagcgcgttgattggccgtagtgtctgcgatagcgtgctttgaagcaagccacggtcaagtaaatcggcaatggtttctaagatatcgtgctgactaatcatgtcggccgtgtggtagtaggattttgagtacatccattcccaagcaaatgtcccgcgtttcttggttagttttttaaggtcgattggacgccgattttcggtaattgatgcgatgtggccaccgggtttaatgagcgtacatatctcattccagtgactgtcaagatcgcttaatccgaggatgtaatcgacatctttaatacctaaagcatgtacttcactaaccaaatcatgatgatgatcgacgactaaatcggcgccgtgttgctgcgtccaagcgatactttcaggtcgtgaagcactactaataactgtgagccccgctaattttgctaactgagtagcaattgaaccgacaccaccagcgccattgatgatgagaatggtttgattgcatttttcggaattaggtttagctgggtcaaaaggaatgtgaagttgttcaaataatgcctcgtatgcggtcagcgaagtaagtggcatggccgcacgggcagcggttgttaatgtcgcgggggcgtgaccgacaaggcgttcatcaaccaggtgataagcactgtcgcagccgggacgtctaaatgagccagcataaaagacgtagtcgccgggttgaaacagggtgacagcttctccaacagcggtcacaataccagtggcgtcccaaccgaggatcttgggtcgcatgaggtgctcatgccccgttttacgaacgctaacgtcaacaggattgacagcgacggcttgaacttgaacaagtaagtcatgaccttgagcgctaggttttgcaatcgtcacgtctcgtagactagcaggatcttcaataggtaagtggtcggtaaaaccaattgcatgcattattaatcaaacccctttcatgacattactataggttaccagtgaggaataaacaagacgtgaattatttgccacatagggacatatttgtcacgcctattagttgtgctacaatcaagacacttaattaaggtaggggaagttagatgcagcgacaagtatacgattgtacgccgggttgtccggttgaaagtaccttgcaagttattgccggcaagtggaagagcgtgattttgtatcatttatttacggcaggaacatgccggttcagcattttgcaaaaacgactgccgggttgttcgcggcggatgctagctcgccagttacaagaattggttcaagacggggtgattgcaaaacgagtttatccggtcgtgccaccgaaaacggaatattggatcacgccatttggtcagaccttgaaaccggtgattatggctatggagacgtggggccgacagtataattcagtgaatggaaaacctcgtcaataggaatgtgagaacgggcatagtgtgagtttcaaggaattgttgtcggttttgttaggggcgattgtgcttggtgccttgctcgcattaatagtgactgtttaactaggctagtaaagaattgatgtgattctttactagcctagttgttttctaatctaataaaacgggagtctgacgtaaaaagtacaccgatagatcactgtttggcagcatttcttgaataatcatgggtttgcagtaagcaatgataccgtattaagtctgagataggttgtggattagttgcttgttaggaggtgcatgttagataattattaacaacttaatgaagtgcagcatggccgtgaatctcgttcgctaaatgggggtgccattatgaaaaattgctttggaatcattggtgggatgggaacaatggcgacggaggactttgtgcataccgtgaaccggctgaccgttacccatcgtgaccaggattatttaaactacgtcattttaaatgatgctgagataccagatcgcaccgcatatattttggatcataactgtgccaacccgttaccatcattggaagcggatgtgcagctacttaatcaattaggggtcatgtttattgtgatgacgtgtaacacagcacattacttcattcccgcattgacggcgctttctaacgtgccaattttgaatatgccggccttagcggtaacagcagcctgtcgatcacagcaaccgcgaccgttacgaatcggtattttagcgacaacggggacactagagtcgcaactttatcaacaacttattcggtctaatggacatattcctgtgatacccaataagcagcagcaagctcaagtgatgaccttaatttatgacgacatcaagcaacgtgattttgtagatcgggtcaaatttcatggcttaattgatcaattattgaatgctgctgattgtgacgccgtcattctcggctgcaccgaattgtcggtggctcaggatgctgcgccatatgattctgaacgaattattgacgcacagtatgaactagctcgagcaaccgtccaacgcgcacaggcaactaagccagcgttgatacttcgtcggcggccatcgattaggcggtaggagggtgcaggtaactggataaaaatgatttttgatctatttagtacgtgtgattgtagctgttataacaccactttcgtatacatgaagaatagtaaaattgtaagcgctcaaatcgttgctaactagcctattctcgcacatgcaaggttgggtccgtctccacacagtcccgcacaacaaaaaagcgagccttcaattgaaggctcactttgtgttctcgattattcagtgtggtgcttccgaactgggctgacccaggtgccgctgccgtaacccaggatggttttaacggctggaatcagcgtagtgaccagagcgagggcgttaacctgccagtaaatcagcatgtagagtggcatgaaaatcagatatttaaacttgcggccacggtcgtcaacgatcaatgcggacaatagctgcaagacgccggcgaacatttcgaaggtcacgaagatgaaggccatgcagaacatatgatagacgcgctcgtaattgccagtaaagaagaaggtgacgagcgagatcaggaagatcagtgttgagacaaagaagaatagggaccagatgatgctcagcgtttgatcagtaataaaagcccattgcttcaaatacttaccgggatgactgacaacccgtttaaagttggtcaacagcacttcggtaccacctttggcccaacgtttgcgttgatgataaagggcgtctagattctcggggacgttcatatagaatagaatgtctggcgagaaaacggtcgtccaaccattcaactggtgatcccaagcaatactgatatcttcggtcgcgcgatcttgccggaataagccgacgtcaatcagagcgtcacgacggtacattgtattggcaccactataggcatacatgttacctaaagcactgacttggctccgcttgataacaccaacgatacttgaaaattctacggtttgcgacttagcgatgatcgtgcttcggttctgaacgtccatgttggccgtgaccgctgccgtattggcgtgttcttcgcccatgaagtaactcatatatttccacagtgcatcgggttctggaatggaatcagcgtcattacttaaaatgaattcaccacgggcaaagccgacaccgacgttgaacgcgtgggccttaccctgatttttcttgattgttaccacgcgtaggttgtcgtacacgctctggagacgttctaaaatagctggggtctcatcagtcgaaccatcgtctgtgaccagcacttcatatttttcataatttaaattgttcattaaatagttgattgtgtgttcaatcatgacttcttcgttatgcgctggaatcatgatcgtgataaagggttgttcttcaggcgttagcggttgaaattcaatatcgtctttgtggcgatggcggtaaatcagctggtagcagagtacaccgataaaccaggcaaatgcaccgagaattgggtaggagactaatagtaatagaacaaagttccagatactttcaaagggcttaagtgtttgcattatttccattggctagtcctcatacaatctgtggatttcgttaacatcgagattttgttcggggtcaaccgtgtagtgcttgacgtgttgccggaaagtggcctgcccgaatcgttgggtataaaagttatttagttgccgcttccgaatatctaactggtcttcgttgtattgccgttctttactgatatgctgcttgacccggtgattattgtgaatcgtggagacaatgaccacaatggcgattaagttaaacgcaataataaagaaccggtcaaaaaagtagaacagcgtcttaccttcttcgtatttccaggcgtgaatgaactggggattattcgcaagtaacgttgacgagatagtccagtagacaggtacggcaacgcagatccaagtaataattgcgactagggtttgccaaagtttcgtccaccagtgccccttggaaaaatatttatcggtaacgtattgtttcataacatcttttttctccataaacgaacctccgagatgacatattgtttagtgatcgtgcggatcatatagtttatatcattactgatattgtcagtttatcgacatagaacaacaccagggcgcctaacattaactgcgatgaacagttttagaacaatctgaacatttaaccatgtcaataagcttacatgaggattgcattgatgtgcaatcaatatacatatcagtatcatgatataagtaaaagccacgtatctttaattaatatacacttaatgggatactttgttaatctaatttgacaaaacggtcagtgcgacaattgaatgtcaacttgtggtttagccattgcaaataaactggcgagaaaagggcaaccggcaaaacatcgctgaatttactggcgacttttagtgctattttcaatgtcttactcgggccccaacctatcaaataaatgcgggtgcgatcaacttagtcaaatttgatccaggtggtgtcatcaagttacgacaacttggaaggattttcgttgcttattttcaaaaaacaaattattatataatgatgactaaaatttagcacaattgcctagtgaaatccggctccagacctgatttagtccggtatttcaccaatagtatgataaaatgggctagtggggttatgccaataaccaaaaaatccagcgagaagcgaaggggataacgatgattaagcaatttaaaccaacttggatgataccagcaatctacaatgtgacaccggcgcagttacgagcgcagggcattaaggcggtatttaccgaccttgataacacgttgatcgcatgggacaatccggatggcaccccggaactgaaaaagtggctgcacgcgttacaagacgcgtgcattccgttagtggtggtgtcgaacaattccgaagcgcgaattgctaaggcgctgcaaagcctggaactgccatttgtttcgcggtcactgaaaccactaccgctggggatcagtaaggcgcgtcatgacctgggcttacacaaaaatgaagtggtcatggttggcgatcagtatatcaccgacatgtgggcggcccatcttgcgggcgtgcccagtatcttagtccagccaatcgtgaagacggacgcgtggaatacccggataaaccgtttctttgaacgatttatcaaattacgattagcacatgtttatccagaaatgcattttcaggaggaccttaataagtgagtgaaacatcagaagaaactttatactgtattgggtgtggtgcggcgattcaaacgaccgatcctaaggcggccggctacacaccgaacagtgcgttacaaaaatcattagctagtgacgcacaggatttatactgtcaacgttgttttcggcttcggcactataacgaaatcgtgccggttggcttaacggatgatgattttcgtcatttgttagccacgattcgagatgcgaacgcactggttgtgtacgttgtcgacatttttgatttgaatggaagcatcattcctggtctccagcgctttgttggggataatcccgttttgttagtcggtaataaggaagacgtgttgccacgtcagttacgccggacgaaattgcgggaatggatgaatcaacaagttcgtgcacagggaatcaaaccggtcgacgttgcgttaacgagtgccaagaaggggcattccattgatgagctcttggcgatgattgaaaaatatcgtcgtggccgcgatgtttatgtcgtaggggtcacgaacgttggtaagtcaacgttgatcaatcggattattgccaacaatactggtttgaaggacttgatcacgacatcccggttcccagggaccacgttagacaagattgaaattccgttggatgatggtcatatgatggttgatacacccggaattattcatcctgaacagatggcccacgtgttatcaggcgatgacctgaagttagtctcaccacaacgcgagattcgcccaaagggtttccaattaggcaacggtcaaactttgttcttaggtggggtggcacggttagatattgttgatacgttaaaagcaactgggacggtctacgttgataataacttgaccttgcaccgaacccggaccgagaatgcggacaacttttataccaagcatgtgggtgaactgattacccccccaactggcgatgctgtcgctgactttccaccactagttcgccacgaattcaaagtgacggaaatcagtgatattgtctttgaaggcctcggatgggtcacggtggctgcggatacgcgtgtagcggcctgggcaccaaagggtgttgcagtcttgacgcgcccagctatgatcaacaagcgttgatgagttgtggtcggagtagaatctgattcgcgattatcaaacagaaaattataggagtaaatcaaacttaatggaaaacttacgtggaaaacaaaaacactatttacgtggtgaagcccaccacatgcggccactatttgctgtcgggaaaaacggcttgactgacgaatggttgacccaactaacgggtgcgctggataagcgagaattaattaaagtcaacattttacaaaatgctgatgtgacaacggctgaagttaaagctgcaattgaacagaaaaccgcgattacggtcgttcaaacaattggccgggtgttagtcttatacttgccagctagtcatgaagaagaccagcactattcattggaagttgctaagttataggaggaatgacgggtgcagacggttaatcaaacagcgacaaaagttctgacggaaacggtgacggcaattccgcatcgccgtgttggtattttaggtggcacgtttaacccaccgcatttgggacatttgatcatggcccagcaagttggtgatcaactgggtttggatgaagttcgctttatgccggacgctcaaccaccgcatgtcgacgaaaagaagacgattgcggtggaagatcgtgcgaatatggtccaagaagccattgttgataatccactatttcggttggagacggcggaaatcgagcggggtggcaaaagctatacttacgaaacgatgaagtttttgaaagctaagcatccggacacgcagtactatttcatcattggcggcgacatggtcgattatttgcatacttggtatcacattgacgagctagttaaattagtcacctttgttggtatcaaacgaaccgggtacccaacgacgagtcaatatccggttatttgggtcgacgcaccgttgatcgatattagttccactcagattcgtcaaaaaatcagccatgggcattcggtccgttatctggttccagaagccgtggccgcttatattaaggagcatcatttgtatgagcaaaacgattgagtatactgaagcgattgttccatatcgtcacgaggagctaatggcaaaagttgccgcccagttgactgacaaacgctatcaacactgcttacgggtcgaggagactgcgcggcagttagctgctgacaacggtgttgatgtcgagttagctggaattgcggggttattacacgactacgccaagcaacgcgatgatcaaacatttattcagctcattaagacgcatggcatggaccccaacctggtttcgtatgggaacggggtctggcatggctatgttggcgctgaactgatcaaagatgagttgcacatctacaatgagccaattttgaatgcggtgcggttacacacggtcggtgcgccttatatgactaaactggaccaaatcatctttatggccgattttattgaaccagcccgggacttccccggtgttgaagcggctcgtgaagcgacggccaagtcgttggctgacggtgttcgtttccagattcaacatacactagattatctgattcagaagggtgcgccagtctacccacaaacgttagcaacctataacgcgtgggtcggcggtgtggcccctcaatttgccaattaaatttaagggagagttttatggatagcaaggaacttttacaattaactgttgaggccgctgacgataagcgtgccgacgatatcgtggccttagacgtcgcggaagtcagtttgatggcggactattttgtcatcttatccgcggattccaagcgccaagttcaagcgattgctgataatatcgtggactttgtgcgcaaggccggttcggacgttaagagcgtcgaaggtcggactgcgggcgaatgggtcttgatcgatgccggtgacgtcatcgtgcacgtcttccaaaaggatgcgcgggcacactataatttggaaaaattatggtctgatgcgcccatcgtcgacgttgcacaatgggtaaatgcatgatttatcagacgtttgccgaactttatgacgaactttttgatccagccatgtaccagcaatggctggattttgtccgtcgtgagtatcctaaccaagatggtcagttgctcgaattagcttgtgggacgggacgcttaggggtgttgttagcccaagccggctatcaggtcaccggtttagatttgtcggagaacatgttagcactggcacagcgccatgcggacgaggcagccgtgaccttaccgctattacaaggggatatgctcgatttatctgaaattgggacctttgatgcggttacctgttttgctgattcgttctgctatttgcccgatattacgacagtccaacgtgcatttgaacaagtggctcaacatttgacagcggccggcgaatttttattcgacgtcattacaccttatcagacggatgaggtctatcctggttatatgtacaattatcgcgatgaggatcgggcttttatgtggacaagctatgccggtgaacagccgcacagtgctgagcacgatttaacgttctttatttataatgatgataagcaggccttcgacgaggtcagtgaattacatcaagaacaaacttatgtgttggctgattatcaacaagctctgcaggcagccggttttaatcatgtcacggtcagcgccgattttggccgccaacaaccggatgatcagaccacgcggtggttcttcaagtgtcgtaagtagtaggaggaacaagaatgcaagcagtcgggttaataactgaatacaatccgttgcataatgggcatcgctaccatttgcggcaagcacaacagttgaccaatgccgactgtgttattgttgtgatgagtggtgattggctgcaacgcggtgaaccggccattttagacaagtggacacgtgcgaagctggctttggaaaatggggcggatctagtaattgaactgcccgtgttttttgcaacccaacctgcccatttatttgcacggggtggtattgaactactcagtgcactggactgtacgagtgttgtttttggtgcggaacatcctgagctggactttcaacggttggccacggcaattgcggcgcggcagggcagctttacccactataatgcgacttttgccactcagtttaacgcggccttgcaagctgccacgggcgtgacgttgacggcagccaatgatatgctgagcttctgttattacgctgccaatcagaccctggcacatccgatgcagttactgccgatcaagcgtcgccaagcggatcacgcgacgacgacaattgcggccgatagtcgctacgccagtgggacagcggtgcgccaagcggcacttgcacaggattgggcggcgctgaaaccagttgtcccggccgacacgttcacggcgctgactacgcaacgactgcagcgctggagcgacttttggccgtttttacagtatcaattgctgaccgttgacgttgcccgtagtggacagtatgatcagatggcggaaggcttggaataccggatgcaggcgatggcccaacacgccacgacttttgatgactttattcatcaggtcaagtcaaaacgctatacgtatacacgattgcagcgggtggcgacagccgcactactacaacttactcaggcagaagtccagaaagcacaggcacataattatctgcgcgtcttaggcttcacacctaaggggcaggcttatttgcatcaagtgaagaaacagctcccgttgccgctgtatacgaaaatcaatcaagacttacgccagcatgctctgaatctcgattatcgggcggggcgcgtctatcaattaattaatgggcaatcgcaagatttatatcgacaaccatggcggttaccggtaacaattggttgaccgcggcgggctttcttgatatggttaggtctaatgacgggcattttggactgtcaaggaaaaaacattgacaaaggatttttacacaggtataatttatcacgttgcattaggaggtttttaaatgaaatggtcactttcacagcttaaaacataccgtgaaacgccacttcagtttgatgaagcattggatttaaaacactccttgatgagccgttatccagaaattatcgatgttaagtcagttcacgcaactgggttagcgagttatgataaggataatgtgttaatcacggcgaagattgacgcaatgttaacattgccgtctagtcgctcgctgacgccagtggatgtcccattggcttttcaaatgacggaatattatgttcctcagggaaccgatctgagtcgttttgatgaagaaactgatacggtaattattttacctgaagatgatattttagattttgatgtcgctgtggaggataatattttaattcacatccccatgcagattctttctgaagctgaacaagacggcgccccaatgccaactggtaagggctgggaagttctctccgaggacgaccaagcgttgcaagctgcagaacttaaaactgttgatccgcgtttagctaagttaaaaaacctgttccctgatcaggaagacaaggattaagttagctaggcgtatcaaaacacacattatgtgaattcacttgaaggaggtgtaggttgatggctgtaccagcaagaagaacatctaagatgcgtaaacgcaaccgtcgtggtcatattaaattggctacaccaaatttggcaccatgcccaaattgtggcgaattacgtgtatcacaccgtgtttgcccaagttgtggatactacaacggcaagcaagtcgtaaaagtaaacaactaattgttagttggtgaaaagttgcattgcggccatggcgcatgaaactttttgttaccataatacgatcaaaaagcccgcttaggtgggctttttttgttgtcttcaattaagtttgagttgggaccagcacttcttgaaataaggtttgactgaactgccagcgcggtcaagcgagtggctttgcatattgattgcgatgaggcgtctcccttccgtatactaagactatcaaatatgagtacggcttcataataagtgttactgacgcagcgacaagggggttatggagatgatgagcaaaaaatatgggatcgggttagcactactcaccgtggttctgctagctggatgtggcacccaacagtcgacgcaaaataaggcgacaagccaatcgactagcagtcaaagtagttcgaccaaaagtgtgacagccaaaacgaaagtgtcattagccgcagccatcaaaaagtttcagcaacaatatccggacgccagtgtgacgagtattgagttagaagaccaactcggtcgaccggtttacacgctggaaggcgttggcggcacccaggaacatgaattacaactcaatgggcgaaccgggaaggtcatcagtaagcagtctgagatgctggatcaagatgatcaagctgacgctgagggtgaccggctgaatcttaacaaggtaatcagtcctagtaaagcggtggcgattgccatccatgaccgtaacggtggctatgctagcgagctcaagctcgataaggacaatggcaccacttactgggaggtccaggtacatcaaggaaagcagcaagtcgatattaagattgatgcctatgaaggtcatattttggaaactgagcacgacgattagtaccacgtggttgctggtgaaaaggggcggtatgtagcctcattttgtcagcaactagtcttgaaatggtcagccggctaaacgtatcgcctattttgtaaatcactgatttgatcaatagctagtcgtaatcatcacgtccgtttccatcacaccgaattcttgccacatgatttgattgatggtttcaatcagacgtgtgatttcaatcgccgtcatccgaggtggcacaacgatcgtggctcgcagcatgatgagattaccatcataatgagccttgagaaaaatgactttgcggacactagttaaatcagcaattcgccgttgatagcgatcttcaaggtaagggtcgaaatagtcaactaggttcagactactttctcgaaaaattttggtgccagtattgaggatgtatagccctaagccgatactaatcaggttatcgaaccactgaaggtggagcttgaccgtgacaaggatcgtaagaacggtagtcagactggtcaacgcgtccgtgaaggtatcacggctcgctgcggtcagggcagcattgttaagtttgcgactccaataatgattgaaggcccataagaccagtagcaccacgaaggaaaacccggcggccaagccggcgatactgctgaggtttttgaagggggtacgggtggcgaatgtcattacgcctttgataataatgtcgattccaatggcagccatgatggtgccggctagtaaattaaaaatcgtctcaaaacgaaagcgggattgctggattcggggtcctaattgctgctgctccgcgggtgcgatgggtgcgccaaataaatcgtcatcgtgcgtgcgactggcgatgaatagaccagtcatgagtagcccggtcgaaaaaattccagataaattattaaaggcatccgcacgtagggcctgtgagtggccccagcgtgcccctagaagctcgataataaataagcccaaataaacggtcacgttgccccagagatggtgacgggccgttttaagcgaaatgacaacgggctgttcaatttgatgccaatctggcagtcgttggatcgacatgattaggggcctccttacgcatcttgaattggactgctggtcaggattagtggtgctagggtgtctctctggtaaaagtggccaccagcgggcatgtacgaataaaaaaagtgcggaacgtcagaataacaatgaggacactagcctaaacaccacgaaccgatctatgaaggttatccgtttattttactgtaagcctagcacggtgtttttaactttgtcagttggtgctgtttgaaaggtaagtaacctttttggatggtcctatgaaaattaatttctttccaagataaattatatgaaattaattttaaaatttgcggtcatttactttattaacagcgtgttttttggtacgatagttgcgtattaaaaattgggaggcaataaactaatgagtaatgaaaaaccacaaattggtgtcattgggatggccgtcatgggtaagaacctggcgttgaacatcgaaagccgcggctacaaggttgcgatttttaatcggactggtgccaaaactgaaaaggtcgttaaggaccatgctgacaagcaattagtaccaagttataagatcgaagacttcgtggcttcacttgaaacgccacggcggattatcatgatggttaaggctggtaagccaaccgatgccgttatcgatgaattattaccactattagataaaggcgacgtcttgattgatggtgggaacaccaactttaatgacacgatggcgcgtaacgcccgcttagataaatccggaatcaactttattggtatgggtgtttccggtggtgaattaggtgccttacaaggcccttcattgatgcctggtggtcaaaaggaagcttatgatttagttgccccaatcttggaaaagatttctgctaaagcgcctcaagacggtgcaccatgtgtgacttacatcggcccgaacggtgctggtcactacgttaagatggtccacaacgggattgaatacggtgatgaagagttaatcgatgaatcatacaatatcatgcgcaacgtcgcgggcttgtccgttgatgaaatgtccgatatttttacggactggaacaaaggcgaattgagcagttacttgatcgaaatcaccgctgacattttgtcacgtaaggatgatttaggtgcggataagactaagccaatcgttgacatgatcttagaccgtgggaacaacaaaggaactggtaagtggagttccgaagatgccttgaacgttcaagtgccacaatccgttattacggaagcggtctatgcgcgttacatctcaatgatgaagaacgaacgggttgccgcttctaagaaattagctggcccaaccgctgacgttgacttgccagccaaggaagaattggttgagaagattcgtcaagccctctacttcagcaagattatgagttatgcgcaaggcttcgaacaacttcgtttcgcttctgaacattatggttgggacttgaagttcggtgaacttgcccaaatctggcgtgctggttgtatcatccgggcccaattcttacaaaacatcacggatgcttttgataagaagcctgatttaaataacttattgatggacgactactttgccgacatcgccgccaagtatcaacaatcaacacgtgaagtgcttagcttagcgatccaagctggtgtaccggtaccatcatttagtgcggcattgtcatactacgactcataccgggccgaagtgctacctgctaacttgttgcaagcgcaacgggactactttggtgcgcatacgtatgaacggactgaccgtgaagggttataccattacagttggtacgaagaacaataaaatcattttgaatgaactaaactgtggctaatgacgttacgcgtgattaggcgcagtttttttgtgctgtgggtggctgtgcggtaatgatcgttggtttgagtggattagaacgtacgtttgcgttaaaattgagagtaatgaataaacgcgaaagtgggggtcgccatgcgacaagaatcattatttaacccggataaatctagtagtagtccgttggcttaccgggtccggccagtgacgctggcggatttcaagggccaagagcatctacttggcccgggtaaactattacgacaattaatcgcagaagatcagttaccatccctgattttttggggaccaccgggagtcggcaagaccacgctagccgaaattattgcgcaacagacccagtcgcactttattacgtttagcgcggtgacgagtggcattaaagaaattcggcaaatcatggatgaagcggaggctaatcgagattttggtgaaaagaccattgtttttattgatgaaattcaccggtttaataaagcccaacaagatgcctttttgccatatgttgagcgcggcagtatcacgttaattggtgcgacgacggaaaatccctcatttgaaattaacgcggccctattatcacggtgcaaagtattggtcttaaaggcattgacgcctgacgcattagaagctgtcttacagggcgctttgcagaatccgaaggggtttccggatcttgagattacgatgcagcctgatacactacggttgatcgcagaatttgctaatggtgatgctcgtatggcgctcaatacgttagaaatggctgttttgaacggtgaccgcgatggcaagcacgttacgattactacggccgggttatcgcaactgatcaatactaagtcgttgcgctacgataagcatggcgaggagcattataatattatctccgcgttacataaatcaatgcgtaatagtgatgttgacgcggcgatttactggttgatgcggatgctagccggcggtgaagatccgctgtatatcgctcggcgtttgattcggtttgcgagtgaggacattgggctagctgaccggcaggcattgccactgacggtagcagtctttcaggcgtgccagttgatcggtatgcctgagtgtgacgtgaatttgacggaagcagtgacttatttagccttagcaccgaagtccaatgcattatacgcggctaaatcggcagcgcaagcagatatcaaagcgacgggtaatttaccggtccccttacagattcgcaacgcaccgacaaaattaatgaaagatttaggttatggttctgattacaaatatgcccatgatacagcggccaaattaaccacgatgacgacgatgccacctgagttaaaacagcaccggtactatgagccgactagccagggacaggagaaagcctggcaacagcgcctagctgctattcgccagtggcaccagcaacatccgcaaaccgaaccgtcagatgatgagacataaagattgcaatttaatgagaattcactaaaattagatttgggtgaggagcagaccctggttggggtgtaggaaattcagcgttttcatgttaaaataacatgttgtactagcttaatgcaggttagtggtgataaatcactgattcgtacggtttttagataagttgaatattaggagtgactaaaagtaaatgagtcgaatattaattattgaggatgaaaaaaacctcgcacgcttcgttgaattagaattaaaacacgaaggctatgatattcaagtcgaatataacggccgtaaagggttagacgcagcgttagctgaagattttgatgccatcctattagacctgatgttaccggaactgaacggtttggaagtctgccggcgggttcgtgaagtcaagaatacgccgattattatgatgacggcccgtgactccgtgattgatcgagtttccggcctggatcatggggcagatgattacattgttaagccatttgctatcgaagaattacttgcccgcttacgagcactattgcggcgaatcgatttggaaagtgaacaacaaagcactaaacaaacgaccgtcacttataaagacttgacgattgaaaaggaaaacttagtcgttaaacgcggcgacgaagtcatcaacttgacgaagcgtgaatatgaactgttattaactttaatggaaaatattaacgttgtcctcgctcgtgatgtcttactaaacaaagtatggggttacgaatcagaagttgaaacgaatgtcgtcgacgtttatatccgttacttacggaacaagattgaccgaccaggagaaaagagttacatccaaactgttcgtgggactggatacgtgattcgttcttaatgactgacgctgatacgaatcaagtgacgcctaaaccacggcgccgttggtcattaaaatggaaatgggcgctcgggaccgcaattgggtccgcgctcatttttatttgtttttcattattggtctataagagtttcacgaacctcttattgcgccaagaacaacggaacgtggctagtgctgttacaacggtgcaacaatcgttacgaacggagtcgaagggactgaccattaaatcggtggccgctaaattgcaacccgaagcgagcgttgaaccggcaactaccatgagtgaacgtaagcatggtgtgctgcaaagtaaaatcttttcagattctgatttaacagccttatcccgtacaaacttagctgtgacggtttatgatccacacgggaacacactctatctatcccgcaaggatgcacatgagttctctaagaataagacgcgtcaggtggtggtgattggccgaggaagtgatgctgaattagttgggcgggcgcccatttatgcggctagcaatcaccgtttgattggttacacccaggtcaccgataatttggcggaataccattcaacgactcagaatttgatctggatctttattgtgatgacaatgatcactatttttggtgccacgctactgggctatttcttagctgcgtttctattacggccaatgcgtaaaatcaaacagacgattaatgcggtcaatgatgatccgcaaactgactcgcgagtgcccgatcttaaacgcaatgatgaattgtcggatttagcagtcgtattcaatgatatgcttgatcagatgcaacgctatattaatcaacagcagcaatttgttgaagacgtttcccatgaattacggaccccggtggcaattatccagggccatatggagttgctgaatcgatggggcaaggatgatccgcaagtgttgtcggaatcattggcggctagtttgtcagaaaccaagcgaatgcagagcttagttcaagaaatgttggacttatcgcgtgctgaacaattggaaatcaattttagccatgagacgtcggacgttcagaagttagtgacgcaagcatttaacgattttacgatgattcaccccgactttcattttacgtttgatgatgatgttaaaaagccggtgtatgctcagatttaccgtaatcaccttgagcaaattctgattattttattggataatgcggtcaagtactcgacacgacgtaaagaaatccatttatcattatccacggattatcgctacattgaagtcgccgtccaagactttggcgagggtatttctaaggacaatctcgatcgagttttcaaccgtttttatcgggttgataaggcgcgtagccgtgataagggtggtaacgggttaggattatccattgcgcaacggttagttgaaggttaccatggtcatattagtgttgaatctgtggtgggccagggctcgatctttcggttccagttaccgattctacgggacgcgaagctcttagctaaggccgaggctgaaacgaatgatgttgaaaagattgccaagtcggaactgccagccggaatccgaccagctactcgtgatgaagatgaagcgcccttggatgatcatgagcacgaccactaggtaatcgaatcattgatgaatttaaaacgcacattcaagttaatttaacttgaatgtgcgttttcagtatggataattgcgctgtaatgaattttaaagccgcggcctatgggatcatatcgtgattttgagggaggcctggatcaatattgagcatcgactgacagttcgatagggcgcagtaagatgctgattaaacgacgaataggttgtacaccagcaggctgggtttaatcctgattcagattgatccgactcgaaatatatttaagctgaccgatatttgttggtatgttcatcatgaaaccattttcacaagtaaccttttttggtatagtggaagagtagttaatttaatcagggggcgaagttgttgacgaacgaaccaacttatcggccaatgacgttcaaaatttttttggaattcattcggctaaatgccaaggcagctagtgtggtgccgtattttattggtattttattttcaatctattattttcatgcgtttaattggatcaattcgttaatttacttagttgcacaagtagcgattgcattgtttgtgacggggtttaataacgtgcaggattactacttggctaaggatttacattatcgggatacttataacattgttggccgtgagcacctatcaccacgacgatcattgaatttgatgctagcgatgttagcaactgcaattattttaggattagtgctagtcgtcagaacaaacctattgttactgttcatgggcgctgcagcgattggtgtggctatcttctatacctatggcccggtaccgttttcgcgcttcccgttgggtgaattactgtcgggatgtgtcgaaggatttggcgttttctttctgagtgtttatatgaacgtcgcgacccccgtactggcgggctttaagtttgcttggccgcagtttgcgattgtggggaatttagagaacatattggtcatgattttggtggggctaccagggattttcttggttgcgaatatcatgttagctgataatatttcagatttacaacaggatattcgcaatgaacgttatacggttccgtactatattggtcatcgttggtcactacgggtctacgatacgctggcgctgttaggttatttgccagtgctgatgagtgttgttttacaaatactaccgatttatcagctggcagtgttgctcgttttaccaaaaattttgaagaatattcgggcctttaacgcggtgcaggtgaaagaaaccacctttaatacggcaccacaaaatttgatgatgtttcaaggcatgcaattacttggactgatcctgggtattttcttttaatccggtctgattaattgggatggttcacaaaaacagcggccgtcatccagcataattgctgaatgacggccgccgttttttgtgtcgctgtttttcagaccttgtgagtcatgtactgcggttgttttcggcggctatttactgatcaaccgcacggtactgcggccatcccccatctttttgatgagaacttgttggccaatcgttcgtttcattgattcaatgtgactgataacaccgaccattcggttttcaccaattgtttcgagtgcctgcatcgctttttccaaagtttcatcatccagggagccgaagccttcgtcgacaaatagtgcgtcgatttggacgccattagccgaagattgaacgacctcactgagcgagagtgcaatcgacagagcagcaatgaaggtttcaccaccggacaacgtgttagatgaacgcgagttgccggtctcattatcgtaaacattgatatcgaggccgtggtcactgcggttatcactcgcttcggcagctagttcaaatgtgtagcggttattggaaagcaggttgataaagtgatcattggcgtagtttaagacgcgttgcaagtagttttggacaacgtaggtctctaacttgagcttgtgatcgttgccatctttaccagtcatgatattatacaggcttgtaatttcggcgaaccgctttgcaaatgtgccttgctggtgcatgatttgttggactttttcgagacaactttgcgcgtcggttaaggtttgttccgccacggtttgggattgcagtgctcgatccttatgagcttgcaggtcggccagctgagcttggatgcccgcaatattcggtcgttcaacgttcgttaaggcggtttgcagttgcttgatttcggttgtcagacgctccttgtcttgccgataggtggcaatttggacttgcaggtcggtcagtcgaccattggcgagttcttctaaccaattttcaagtacagtttggtcatgagtcggtgcttctgggtcagctaaggcctgtgcgattgtttgctcaagctgcgtgcgcgtggcctgtgttgtcttcaaccggtcgtttaaatcatcgagcttagtttgatgatttgataaagtaagttgactggtttgaacggtggcttgggcggcctctaggcgttgttggtaggtcgcgacgatctgattgagatgcgctttttcggccagcaggtcagcgcttgtgacttgtaagtccgtaccaatggctgcctgagctaccgtcaaatcggctattttattgtgcaataaggcccgttgttcgcctaactgtaactccgtttgttgggcctgtttttgttgtgcttccagttcagcagtatatttctcaatagcttgaaccactcgttgggctgcctcaagcttcttcgtaattgtggcgagttgctcagcgaaaaaagccctgactgcggtcaaatcgtagggtgactttagtgctagtccgttggtttcaatcaactgttggtaagttgaagttagttgcgtttgggcggtggttacttgctgcgtagcctggtcaacttctttttcagcctgttcgacacgttgttgagttgcttccacttgcttgttggctgccgccagcgcgttttgagcgtcgtcaacggcttgcatggattgtcgtaagtcagcttcatttgcaacgatggttgtgaccggcatctgtgaatgatcggttgatccacagaccacgcagggctggccgtcaacgagttcttgttgtaattgggcaatcattaagctttggcgttgaccacgttgttgttcaaattggacttgcgcattgtgctgattctgttcatcgcgggcaagctgcgcccgtaaatcagtcagttgcttggtgacgcgctgctgttcttgttgcgcacctcgccattgactatcaagtggtgtcagggtgtcgacgaactgttctcgttgtttaatcagcaaatctttagtggcgtgtaagtcatcaatagatggcaagttcgcttgttgggtggtgattttggctgttaatgtctttattacggtttggtgctgttcaaaagtcgccttcagatcagcgacactcggcttgagctttgcgagctgtgcgatgagactttcaacgcgttgcgcttgtggaatcaacgtggccaattgttccaagcgctgctggtgctgatggttagcttcactttggtcatgtaattgttgaactgcagcttgcgcttggcgatagtcgtcctgcgcttgttgcacgttatccatagctgcttgctggtcaagcgtcaattgcttttggtcacgtgtttgttgagtgagggcttgcatggtggcttgtaggggctgggcccaagttaacgcgtgcaactgttgcttggctatggtaattgccggtgtttgttcttcaactttagtttgataatcagcttgcgcctgtgtgagccggtcaaattgttgttggcgatcgcgtgcttgctggtaggtcgtttcggccgctttaacagaccgattgattttactagtcgtttgctgtgcttggtcaaaagcactttgacgcgtcgtaacaaatgctcgtagtagtggaattttttgatcgtccggaactgcttgaagttgagcctgttccgcatcattccaagttgctgaggctagtgcgacccgcaaatcggcgacaaactgatcaccagtcttgctggcggtttgatactccgctttaagttccgcagtaaagtctgaataaagttgcgttccaaaaatctttttaagaattttttccttgtcagtcgtttttgactttaagaattccgagaagtcattttgggggagtagaatgatttttttaaattgatcagcagtcaaattcaagatggtcgtgatctcgggaccaacgtcggccggcttggttgcaatgctctcaatctccacgccaccaacgtgatcaacgacagctaatttggccgtactattcttttttgtcagtccagatccttttttcttagctaagtattgttcaggggagcgcgcaatcttatagagttgattgccttgctcaaagtagaaggtgacgcttgtcggttggtcagcgggggcgaactgactgcgcatctctttggctgcccgaccatccgtcccatcattcgtcgtactgccaaagagggcaaaagtcatggcatcgaaaatagttgatttaccggccccagtatcaccactaatcagaaaaatcggggtactttctagcttgctaaaatcaataattgaatgttcgtgggggccaaaatagttcatggctaaataaacgggtttcacggctaatcctcttttcttaagttgacgaaaatctggtcaacgagttgttgttgtgtcgttgagagctggttaccagtaatcgcgtggaaaaattgcccaacaattgcatcaggactcagttcgttcatgtttttggggccactaatggcggtggcttggtggttcgattcgtagtccagttcgacaatggtgccgtagatttgttcgagttgcgcccggacgttcagatgcttactacggtcgaattcctggacggtgatcgcaaaccaagcctgctttaacggctgttgctgataaaagttgggatcaagtaacgtttcccaaggcgcacgcaacgtaaccaagtcagtttgcggctgaattggcttgaattcatgggtgatcgcagtgggtgtgattgtcacaatttcaacacctttgccatggaacttagggttggcttccttgacgttaaatttgacggggctaccggcataacgaattcgatctttgtcgggtgaggctaaccgagtgtgaatgtggcccagcatcacgtagtcgaagtctgcgaataaatcggtggtcagcgtcgccaaaccgcccactttggaagttgtttcacttgttaattccaagtcgtcatctgctttgggtgtaacggtaaaatgagtaatcaacaagtgccgtttttcaggatcaaaggtggcaacgaggtcactaaccacgcgttgcatcgcatcgtgaatggtgtgaatcgccttgacttgtttttcgggcaaaccttgttgctgatagtagacccgcgcgtcaatggggtcaaaaaacggtaacataaagatttgtgccgttggggtctcgatgggcgtgaaggcctcggctagtaacgtattgatatgaaaattattataggctagccattcacgaccgtagttgagacgtttggcgccatcatggttgccagcaatggcatagattggtaggtgatgctcgatattaatagcctgcagcatgtggtcaagtgaagtgaccgcatcggtactcggaacggcccggtcgtagatgtccccagcaatcacgataccatcaactttttcagccaatgcaatcgttagaatttgcttgaacgctgcttcctgttcatctaacaaagaataaccgttaagcgtccggccgatgtgccaatccgctgtatgtagtaacttcatgggagttcctccttgagtttgaattgttaatttccattatcgcatatttacataaaatttcaggtctcgaagtgtcgtctgcccaaagttgattaattttgacgaaatacgtttgatttagtttggaatgttggcggacaaacttgaaagtgggcaagttctaccccttattatgcaattcagctataattgcgcttaactagttgagcaattattgattgcaacatacgggtgagtaatttgctggtcatccttgctttcagcgattgcgtgttttagtcacgcataacgtaggactcggtattggaataattatggcgctgcaaccttatctggctagcagtttagaatgggggcttactcatgattccagaaaaatggcaacagacgcttggggttaaattgcttatcatggtaaatttaatcaatttggtcatcttagtagtgattaaactggccagtggtgggcccatgtggcaaattcgtaatgcaccgttggccgtggttggtgggttatttttaattgggattagtttaattttgatctgtaaacagaattccaactggcgcaagggaacgtatctcggtgctgatattaacttgaccgttttattttatttgttacttattgatttcaaccggatttccacgattggctttgcgctgatcgcgataatcatctcgattgtcgcattaccgatggcatatacttctcgtaatcgcttggttggaatccggattccgtggacctatttgtcagaagaaaactggcatcggactaatgtgctagcaggcagattatttggaatctcaggaccgctgttagtagcgatgggaaagatgtcaacagactcatttctcaatgtctttgttacgattatcgtgttggtcgtgattttgaccgtgggttattcctaccagctaagtaagaaattgatctgatcggcctggcagcgttaattggcatctcgtggtaatgtttgcgaaatcagttaaggggacggctgcgtgccggttaggtgcaacgtaaaaagcaccgccatgagaattttcatgacggtgctttagtgttgattaagcttcagtggttatttacggtgtcgttgttgtttaccggcattccgaccacgccccgcattattttgcggacgaggatgactaggcttggattcagttgcattaatcggctttggttgcgtcggtgttggtgttttgatggggtgctttttgagttctgcttcaacttcacgccgaatacgtggccggaagaagttgatgatcagtgtttgcaagcaggcaaacaaaccaccaacgaagaagtaaagtcctaaacctgcgggagcggacatggaaacaaataaaatcatgaccggactcataatgagcatgagacgcatcgtcttcttctgttcttcaggtaaaccaatcatggataggtaaccctgtgccaagtaggataaaaaggctaaaatggctagaatcagactggatttcccaagggagatccccataaaggtcgccttagataattcaggcgaatagcgaatagcgtagtacaaggcggagaaaattggcagttgaatcagtagtggtaaacagccaataccaccagtcatgctaataccgttgtcacggtaaagttgcatgagctcattactgattgcggctttttcttcctgagtcgtcgctgctttttgccgtgcctggattttttccatctgtggccgaaccgcggacattttttcttgttggtaggttgatttacgttgttgattaatcatcattggcagtaaaacgagtcgcacaatgaccgtcaagccgatgattgcccaaccgtagttgttaccgaatagttgtgacaaccattccatcacgttttgccctggctttgcaaggtactcgtaaacaaacccgtatggtttaccagctttggtcgtttgcacacaaccgcttagaaacagtgctaacgttcctaaggtgatggtgagcgtaaggcctttttttgatttcactagttaataatcccctttgttaaagtcatataatgatgatgatactaaagatgtcgggggaattcaattggttatccgaaaatcgtgatagttttgtggttcaacttcatgcacttcgaggtgcttgaccttgccaaaatcggttggcgactgccgaacaacgtcgataaagacttgcactcgttgatcttcgccttcggcttcaataaagactgagccgtccatcaggttacgaacgattccgttcacgccgcatttgtcagcggcaactttagtggcccaacggaagcccaccccctggacccggccgattgcttttaatgttactgcacgcattgtgtcacttccttacttaacttgttcagctagtctaacctgtgactagcatcttgattgtactgattgctgattgtattgtgttagcataattagtacaatctgtattacttatataatagcatggaaatgttcaacgggcgatatgctatacttgggataaaacggacactttcgaatgatacagggtgccccgaattgacaagaccggctgatgtttcaaccgattaattaaaggaagttgacgatggaaaaaattaattcattacaaaatgcgcacgtcaaggcgtggaaaaagctccaaacaaagaagggacgcaaacaacagggacaatacttgctagatggttggcatttagtcaacgaagcagttaaagcacacgtcgcgattcagaccttgctcattactgccaagcaactggcgaccgaaccggacttgactcattttccagcggtcattgaaatctctgatgaagtcgccaaacatatcagtgcgacggtgacgccgcagggggtgtttgcgctggcgaccctgcctgctgcaattgaagatctatcacaattagatttaacgcggccttggttactgctcgataatgttcaagatcccggaaatattggaaccatggtacggactgcggatgctgcgggttttgccggcgtcgctttcggtaccgggacggtggacatccatcaacccaaagttgaacgagctatgcaggggagtcagtttcatttacaactgattagtactgatctcgacaagttggttgaccaattgcaggcgcagggttcaccagtctacggttcagaattaaatccacaggcagcccggtatttagatattgacgcgccggctagttttggcttgatcatgggaaacgaaggtaatggaatgagtcgggaattattggcacggacagaccaaaacttatacattcccatcaaggggcaagcagaatcgttaaatgtagccgtggctgctggcgttttaatgttcggtttatatcgctaacttacaattagtaagaaaatgctaaaatccaggtaaaatactttcaaaatgactgactttttagtagaatagccgtagatattagcaaagggagctttagatgaaaactaataatgcgtggcaacaagattctgaatacgtggcgatcgtcgaagatttattagcacagccggccgttcagcggcttgctgagtttacacagcaccaccattcaaatcgattggatcattcgattgcagtttcatatgatagttatgttttagcgaagaaatggcatctaaatacgacggcagtggcgcgtggtggattattgcatgatttgttttattatgactggcgtgaaaccaagtttgatctcggctcgcacgcatttattcatccgcgggtagcgttacgtaacgctgaaaagttaacgaaattaacgccgatggaaaaagatatcattttgaagcatatgtttggtgcaactttagctgtgcctaaatatcgtgaaagtttgctcgtctctttagttgatgattatgaagcagaacatgaattttttggaccattacgtatgaaagtggccaaacaactagatcggttccgaggcaaggtctccgccggttaattcaataattgggggtcattgcatgtcagaaatgctagctgacacggtaacagaatccaacgtggatttcgaactgtgtccaaaatttgaaaagacgttctcaattctagggaaaaagtggaacggtttaattatcgatgttttactggaagacggtccccaacgctttaagaatctggcacgccggattcctaagtgcagtgatcgggtgctggtcgttcgtctcaaggaattggaagaaaacggcattgtgagtcgggtaacccattgtgactctgccctgattgagtatcgcttgactacgaaggggcaagatttacgacaggtcatggatacggtccataactggtctgataagtggttcagcccggtcgaatcctaatacggggttgacgtgcagggcactttgccataaactgacaatgtagataaaagccttgacgagaaatagtagttagttacggcgtcgtagggacgggtgtcaccgattgaaagcaccctggcgaccaagattgacgaattcactctctgagctgaaattgggcgtttgtgtaaacaaataattttccggtatcccgaccgttatgacgggtagtgagtgtgcatagtgactactatgcaaacaagggtggtaccgcgatgacctcgtcccttttcagggatggggtctttttttgtccgcaacgcaactaaaaattggaggcagcatatgagtttacaagatcgattaaccgaattacgcgatcaaggcttggccgatattaaatccgccgatgttttgaaaaaggttaaccaagtcaaagttgatttgcttggtaaaaagggtccgattacagaagtattgcgcggaatgcgcgacttaagcccggaagaacggccaaaggtgggcgcttatgccaacgaagttcgtgaccggattcaggctgcgattgatgaacgccgtgaagaactggaacaagcagccgttaatgagcaattggctgccgaaaaactggacgtgacgttaccgggtcgggaagttccacaaggtcagcctcacgtgattacccagattattactgaattggaagatctatttatgggaatgggctatcaaattgttgatggtgatgaagttgaagaagattactacaactttgaacggttgaacttaccgaaggaccatcccgcccgtgacatgcaagacacgttctatattaccaaagacgtgctactacgcacgcagacgtctgctgatcagccgcggtcacttgaaaatcacgatttttctaaaggaccgctgaaggtcttgtcacctggccgcgtttatcggcgtgatacggatgatgcaacccattcccatcaatttcatcaaattgaagggttagtcgtggacaagcatattacgatggctgatttgaagggcaccttaattctggttgccaagactttgtttggcgatcaattcgatgttcggctacggccaagcttctttccattcacggaaccatccgtagaagctgatgtaacttgctttaattgcaatggcaagggctgtgcaatctgtaagcaaacgggttggatcgaagtactgggtgccggcatggttcacccccacgtgttagaaatgtctggcattgatccagaagaatatggtggttttgcctttgggttaggaccagaccgctttgcaatgttgaaatacggtgttgacgatatccgcaacttctacttgaatgacgtgcggttcttgtcacagttctataagaaaggttaggcgtccacatgagaatttctacgacatggttacgcgattatttgaagctggacattccggccgatgaattagcagaaaagattgaacggacggccgttgaagttgacggtgttattcgtcccagtgaaggattgaaaaaagttgtagtggggcacgtcttaacgtgtgagccacatccagattctgatcatctccacgtttgtcaagtggacgtaggcgaatcagaacccttgcaaatcgtttgtggggcacctaacgttgcggctggcgaaaaggtgatcgtggcgttaccgaattcatggattggtggtcacactaagatcaagaagagtaagatgcggggagttccatcaaatgggatgctgtgcgccttagacgaacttggttttgatgaaaagttagttccaaaagaagttgcggatggtattttcattctgcctgacgatgccacgccaggtgatccggtcttttcatacctagggatggatgatgaaattattgacatgtccgttacccctaaccgtggtgacatgcttagtatgaatggtacggcgcatgaacttgctgccatttacgaccaacaaccaacgatgccgaaagttgatttgcatgaagatgctacgacggtggctgcggatgatctacatgtggctgtcgctgccgacgaacatgatgtcccaatgtacaaaatgcgtctaattaaaaacgttacgattaagccaagtccgttatggctccaaattcgaatttggaatgctggtatgcggccaatcaataacgtcgttgacgcaacgaactacattttgatgcaatatggacaaccgctacatgcttttgactttgatcaattgaatgacggtcaaattaacgtccggttggcgaaagctggcgagcatttaacgacgttagatggtgaagatcgcgaattactaacgagtgatctgttgatttgtagtggcgatcaaccaatttgtttggctgggacgatgggtggcctagcgaccgaagtcactgatcagactacgaccattgcgttggaaggtgcggtttttgatgcagttaagattcgtaaaactgcccataatcatgacttacacagcgaagcttcaatgcgctacgaacggggcattgaccacggcatgaccgcaacggccttagacgctgccgcagccatgattgcagaacttggtgatggtcaagttgctagtggtatggtcatcggtcgtgatgaggatgtgcaaccaacgacagtaaccattgacttagcacggatcaaccacgtcttaggaactgagttgtcattggacacggtcagtgatatttttaaacgattggactttccaacggtcgttgctaatgaaacgttcacggttacggtgccatcacggcgttgggatatccatattccggctgaccttatcgaagaaatcgcccggctatacggttatgataacttaccagcgaccctaccaacgggccaaccaacaatcggtaagcttaatgagacccaacaggtgattcgtgactcacgtaagttaatggaaagtgctggcctcacgcaagccatcagttactcattgaccacggagactaagtcgaaggcctttgcgcttcatgctagtgacgtcactaaattagactttccaatgagttcagaacggaccacgctacgcttgagtctagtttctggtttgctggatgatttagcttataacaatgctcgtaaggaacacaatgtggcattgtatgaagaaggacgggtcttttacagtcaacctgaacaagtccggccgaaggaaattgaacacattgccggagctattacgggttccatggttcccaagagctggggcgttgccgaacaacccgttgatttcttccagattaagggtatcgtggctggttatctgaagagtctggcgttgcaagatgccgttagttacgttgccacggccgaacatccagagatgcatcctggtcggacagctgatatttacgttggtgaccagttagtcggtttcgtcggtgaagttcatccaacgactgccaaagcctacaagattcgggaaacttatgtctttgaactggatttaacggcgttgattgccttaccaaaagcgcgtcaacagtatcaaccgatttccaagttcccaagtatcacccgggacgtggcgatgttgattgatgacgatgtgaccaacgcaaccgtggttgccttgatcaacaagaagggcggcgcgcatttacggcacgttcaactctttgatgtttataatgggagtcacgtgccagcgggtaaaaagtcgctagcttatacgttaacgtatcaagaccaaaacgcaacgttagtcgatgatgatgttacgacagcatttgaaaaagtactgacagccttaacggatgaattaggtgctgaaattcgttagtttgttgatagtcttgttaaacgccgaatgatttgaagtcattcggcgtttaatgtgtgtccaagatcctaaaaaaccataaaactaatggcgaactagtgcaaactgggcaacagttttgtataattgataagattaatcaataaatggaggggcgagtcttgaataacaaccaggataaccaagatcagaaggatcaaaacgattcacaagatcgtggggtaaatgaacctaatcgttcagaacaaaaacagcggaaatcattttcgaaacacgttattggtggcgttgttggtattttagtcgtacttttaattattgtgggggtattgggttatcgatattttgataatgcgacgcaaccatatgacagtagcgacaatcgcgtcgttcaagttgatatcccgtacggtgctaatggtaagaaaattgccgatattttacagcgcgaaaaggtgatcaagagtggttttgtctttgaatactggacgaaagcacacaacttatcaaactttcacgcgggctactatcagttgaagccttcgatgtcacttgctcaaattgcgaaggccttgaataaaggtggttcatcggaaccggttcagagttctagtggtaaagtcctaatcgttgaaggtagtcagattaagacgattgcgaagacggttcaaaaacaaactgatttcacgtcggcagaatttctagccttaatgaaggatcaaacattcatcaaatcattggccaagaagtatccacaattgttgaattcagcgatgagtgctaagcaagttcgctatcgtttagaaggctatttgttcccggcaacttatgttgttggtaagaaaacaactttgaaacaattagtaacgcagatggtttcgaagactaatgatgagcttgaaccatactacgcgcaaattaagaagtcgaagatgtccgtgcaagaagtaatgaccttagcgtccttagttgaacgtgaaggcagtacgacgaaagatcggcggttgattgctggcgtcttcttgaatcggttagatgctaagtggcgcttggattctgatatttcagtgttctatgcgatcaattctaacaagtcaacgttaacgaataaagatttgcagactgattcaccgtataacttacggttgaacttaggctacggccccggaccgttcaacagtcctagtttaacatcgatcaaggcagtcttagatcctgcacaacggagcaagggttacatgtatttcgtagcagatttgaagactggtgatgtctattatgcaaaggatgctgcgggtcacgcggcaaacatcaagaaggtttcgaagcacaacgaagccgctgaaaaataagaatgaggcgtaacttaaatgactgaaaataaacatcgccgaccagtagtcatcggggtaactggtggttccggtagtggtaaaactacggtcagcaatgcaatttacaaccaattatctggtcaatcattgttgatcttacaacaggattcctattacaatgatcaaagtgaaatgacaatggctgagcgccatgccgttaattacgaccacccactggctttcgatacagatttgatgattaagcaaatcaagcagttgctggcctatcaaccaattgaaaagccggtctatgattacgagcagtatacgcgtagcgacaagaccattcatcaagaaccgcgtgatgtgatcattgtcgaaggggtattgatcctagatgatcagcgtttacgcgacctgatggatattaaggtgttcgtcgataccgacgatgatattcgaatcattcggcgcattcagcgtgatatcaaagagcggggccggacactagactctgtgattggtcaatatttggcgacggtcaaaccaatgtatcatcagtttgtggaaccaacgaaacgttatgccgatctaattgtgccagaaggtggcgaaaatgaagttgccattgatttattgacaactaaagttcgttcaattttataaaaaataacgtcttaaccagcgctattttagatttaagagtttacttttaaaatctgaaatggtaggctggtttttgataactatattgcgtatttgaggagtgaaacacattggctgaagataagacatatccaatgacagaagaaggcaaggtcaagctggaaaaagagcttgaagaccttcgaattaatcaacgtccagaaattattaatcgtattaagatcgcacgtagctacggtgatttatcagaaaactctgagtatgaatcagcaaagaatgaacagagcttgctagaaaaccggattaagacggttgaacacatgcttcaatatgctgaaatcatcgatagtgacaagattgacgaaacggaagtctccgttggtaaaatcgtgacgttcaaagaattacctgatgaagaaccagaaagctacaccattgttggtgctgccgaagctgatccaatggttggcaagatttctaatgattccccgatcgccaagggcttgattgggcatcacgttgatgaagaagttgccatcaacattccagccggtaccatgacggttaaaattttgaaggttgaaaacgcgtaattttatgcttaagactgttttgaggtagcggataccttgaaacagtcttttttggtggtttagaagcgcgattactgattaccagccactatttaacgaacgttactgaacaagcacgtttgcgtgtgagttcggaattcaagcaaaacacccgcttatctgcacaaagcaggtaaacgggtgagtaaatcggacacgttacaattttgttgagcatttactatgatgaaaacatgccagttggttgggttactgttcatcagcacttgcacgtcctattccgacctccggggctgaggattagcctagctagggcgttaagcggtgaatttccgcttggcgtcatagcgtagctaaccggaagtctcagcctgacccgaacacgtttcaccaatatggcattaaagcgtggaagaccagtatttaagacgtggtttgtggcttaaatctttgtccaccacgtttcagcaattggcagagatgcctggaagtcggtgtaggacgcgctcaaccaagcaagtctatacgaactcgactttttccagtgggtccatagctggccctttttgaacttaaaaactggtatgttttaatcatgattcatgacagattgatcaggatatggccgacagtaaagtaggattagatatagataattcgtaattcaccaagcgagacgctgccggttagtatgacacccgggccagcagtggtcggtgtacctgtcgatgagatgtggcccattgagttgctgagattttcctgtagctgccaagtttgagggaggtataactcaaggctacctaatgaaacgtcgacattgatggttactcggccttctttgatgtcagcgtcatcgaagtagattttggcaccagccattgatacgttcagatccgcagaacgaaaattttcgctgtgaacgtagcggatactgttgcctagtgagagatctaaattaacatggtcatcgttgattgtgctcgttgattcatggacgtcatcgtggttatgatgattgtaatgagcatgatcatggttgtgatagcgataatgatattgataacggggatgaatcaaaagacccaaaccaatgctgagtaatacggcagcccctaaaattgtccatggtacgagcttagtgattccaagtggttgcgcatagatcatggctaagaatgcgatagcgaagacgacgcccggcatattcaagtaacgaaggctactaattaaagccgcaactagaatcaatgttaacaagagactccagatgctgacgtggagcgtgaagagactgagttgactaacgataagaacgacggcgctggcaattaagaagacgggccaaaaccaatttttatgcatttataacagtcctttctgttcaagacttattttgagttggcgatagtagcgtcttgaagcgtacagttgtttaggtgagtggtgaaacgcaatcaagttcccggtcaatgtcttggtcaaggaatagacttgtttggtattgacaatggcagatttggagacgcgaagaaagtaagcaggtaagcctgtgcccacagcggtcagcgacttgggaacacgataaacattatccagcgtatgggcggcgacctggtgaccagttgcttcgatgaataggatcgaagtaagcggtaactgtacgagttgaccacgttgtgaaacggttaacgtagcggcctcaattgaaagatttttgagagcagcagtgagggcggccgtttcggggtagtcgactggaacatgcagtgtgacggttggaattgaggtgccgggatccgtttcaatgttcacttgcatgggtttcacctccttaagtagtttaagtacaccacaaaacaatgacgctgtaaataaagactcccttagcggtcatttcaggaacgcaactggtcattggcttgctcatcgactgtcaatgttgcgttttatgggcaaaaagggcacaattactgtaaacgatttcaatgatgaggtgttagtaatgaaaataacaattacagatttggccagtaagtggtttcatgatgacatgggtgtaaccactggtaatggggtgcgcttttacggcaaaacttatggcaagacagcagttcacagtggcttctcaatcgggatcatgcgtgatgacgaaccccatcaaccgattgccatggttgaaaaggatggtgtcaattactatgtcaacgaccgtgatgaatggttctttaagggctatgatctcacagttgattatgatgaacaaagtgacggcccgaagtatgactacacgcccaataacgagtagttctggtgagtgcttgccaatagcgattaatatttggacaaaaaatcagcgttgcctgaattaacaattcaggtaacgctgatttttgctgaccacatctttgactgtgaactgggctaggcgtggtggcgtcgacgccggacgataaaccaaccagccgttgcgagtgcactaatcccagtaatcagactaccagtgattaagaatggcggtcgatacgtcaaggtgaccgtatgcttgcccttacttaatgggacagcaacaaaggtattaatcactttcttagttgcgacggattttccatcaacagtggcatgccaacccttggagtaaggaatggtcgtcatcaaaacttggtgacgatgcttgatgttgattgtaccagtaatcttacgacttgagtgggccgtgatgttccaaggggattgctggagtttctgcgccgacttcttgaattgggtattatccaacttgtagagggtgaagttttgtaaccagagagaagtcttcttcatctgaatcccgaatgtcacggtcttgctcttgctattcgatgcaacgttaacagcgatcgtgtgccggtaagttgggtactgcttgagttccttaccgttaatgtagtaactcgcattcgaagtagttaggttttgcccgagcgtgatgtagtaggaatcattggttgtcggcgtgaacttaaagtaaaccgatcccgttttcgctaaattttgtttgttcaagacggcgccagttaacgtcgtgaccttcttaacgttttggaagaccacttcgttaaagttttcggcactgatcaagccgctggttgaacgatttgccaaggtttggtaaatcaactcttgccgggcaatcggatcgccagttgttttggagactttcaagctagtaatcttgtcagacgctgcgaaaccaagacccagggcgtatggatttttgtaggtcgtgactttgttagtgctgagctttgccgatttttggtaattcgtcagatctttcttggtactggtgaccggaatgtagctacgatagttcgcgttatcagtctgggatgtcggtactgttttatccataaagtactgcatgtccagtaacgaatcggtaatcatggtcccgttggtgtaggcgaccacaccgtccccatccggctgaccaattgaaccgaaaaagttagggataatactttcgaaggtcgaactgaaatgatcagcaccgttataggccgcctgcatcggatcgtctttagttcgtgtaaacgtcttaccaattcgataaaaacgattgttgctagctttaattttgttgacggcattgtcaaggacttgcgtgtatttaccaaactcactttgtgacacgtaggaaatattatttaatgaagcgaccacgttgatcgacatatcagtcgcaactaaaattaacgcgacgatttgataaatgagacgtcgttccttaggcaacgttaagaaaatcaatgtaattgctgccaagccaattgtaattaagagattagcttgggtgacgtaggtgactttcttaatgttcaagtaaatggttgtaaacaaaccgaccagcaatgcgagcatcgttagcgcttgccacagtttgatcgttattttgtctgtcagtgcttgggcaccaatccagacgacccagaaacaaaagacaaaggagaagcggtaagggtaccaaactggaaattggcccgcatgccacaataaatcaagtggttcgtaacaaaatgataagataagcgtcgcggttacaatcaaggcgctcaacttcacggaccatttgaactggcgccgtaagaagaagagcacaaaggcgagaactgctaaccatgccacgtaaaagttcggttgaccggatggcatctgatcgaagttgaaagtaccggtgacgaacttagctaacatcttccagggcgcgtattcaagtttccaatgaaccttggtcacattatattgagccttactttgaatgagcgcccagaaagttggtaatagcaaccatgcggagaatgcgacacctagcagaccaccccaagcaaatttgagggcgtgagttgctaaggtcttcacgttttgccaatacttagttgcaccatacaaccagtataaacaactgaataaaatgaccatgtagcccatataatagttgtcaattagcatgacggccagccagccagcgaagtaacggactttaccagttgtaaacaagcgttccagtcccaaaatgaccaatggtaaaatggcgaccgtgtctaaccagatcatgttgagctgattggcgaccatccagcccatcagtgcatatgcggtactaaaagttggcaccaaccaacccttttgcgtctgcgttttagttagtagccaggcgaaggatagccctgcgaaaccatactttagtacagtgacgataaaaatgccggtagtgattgattgaccagggaatagtaagtagattaaattaaagggactcattaagtaataagcccagaccccaaccatctcgccaccaatcgttttggagaaggaatagaagaaagcactcggatcgtgcagtagggtatgccggaaataggaaaacaagtcaacgtattgttggcctaaatcgaccgttaacagactgcttgatccaaagggagccatgtgccgataaataaaataaccggtcatgatcagtaaaggtaaccaaaagctgatccataatggccatgtgcgcttgtcaaaaaaacgacggagtttcaaaaattgccacctcaatctctaataattcacagccaaacagaaaaataatcaaaaaaacattaaaatccgtaataacggctgaaatttttatgtctatcgtttagaataacataagtatggtatttatctaggattgctagtatcatctggtaaatttttgcgaaatgtttaccaaattaagaatgggagcgcctgagaattgaaattgtttaagaaaattacgataaatcgtgatcccaacaagtcgcatattccatttcggctgaacttcttgtttttcatcgtcttcttgttatttgctgcgttgattgcgcagttagcttacttacaagttgactacggacagaagttccgaagtacagtgaattcagccaataatacgacggcaacgggaaacgttcaacggggatcgatttatgattcaaccggtcgggtcttagtgggaaacaaatcccaccaagcgattcaatacacgaaggggctgtcagttgcgtcgactaagatgtacgaagtggcgaataagttaggtgagtacttaaccattccaacggatacattaacggatcggaacttggctgattattacttagcgggggcggctaatttaaagtcggttgctaagaaggttaaaacgtctagcgacgatgatgttttgtacgcacgggaagtcgcctatgcggaaaaacatatcattaataatttaacgtctacgcaaaagaatgcggcggcgatttattataagatgagttcggcgtactcgctgtcaacggtcaatatcaaatcgactggtgtgacgagtacggagcttgctgaaatcggtgagcaccaatccgaaatgccaggagttaaggtcggaacgagttggactcggagttatcctaatgggactgacttgagtagtgtgctcgggacagttacgaccgaaaagcaagggttaccgagtgatagcattaaaaccttgctggcagaaggctattctcgtgatgattcggttggtcaaagccaattggaaaagcagtacgaaaatgtccttcgtggaaccaagtcacagactgaggtcaagacgcaggatggggtcattcaaaaggagattaagaagtacggtggccagaagggtgacaacgttcagctgacgattaattcgaagttccagaaaaaggttcaaagtatcattatgtctgaagccaaaacggtggggagtagtaatgcctactcgccaggagcctatgctgttgtaatgaaccctagcactggtgccatttatgcgttagcaggtgccagccggaatctatccactggtaaagtgactgaaaatgcgttgggaaccatcaaccaatccttcgttatggggtcggtcgttaagggtgccacggtcatgggtgccttgcaagatggtgtgattacacccacgaatagtactttgaccgatacgccaatcaagttagccggaacggccaccaagtcgtcatggtttaacaagaatggtggaactagtctgagtcttaacgcttcgactgccatggaagtttcttctaactcctatatgatgcaattagccatgaaggaaggtaacttcagctatgcgtctgggaaagccttgacgatgtctaattcggtcttctctaaacttcgtggttattttaacgagtttggcttaggtgttaagaccgggatcgacttgccgggtgaagcctcaggttaccaaggttcttcggcacagaaggatattggtaaagcgttagacttgtcctacgggaactacgatgcttacacgactattcagctggcgcaatacattgcgacaatggcaaatggtgggcaacgcattgcaccacacatcgtttccgctattactgggactaaatctaacgggtcccaaggggctgttaagactaatgttaagccacgtgtcctgaataccattgacgtcccatcctcatactttgatgtcgtacaccaagggtattgggatgtggtccatgggagtatgacgcagcggacggggagtgcactagctagtttatcaccagcggttgcagctaagtctgggactgccgagacattccacggaacgacatctactgaaaccttaagtttggtgacttatgcgccttataagaaccctaaagtagtgatagcggttgcctttccaggaattactgctactagtggtgattataatatggtcgttgctaagcaaatttatgcagcgttctggaagtattataacaagtaaaaaatcagcttttttcgtaccagtatcttaattgatactggtatttttcaatcattaatggtatagtagttcaagttaagggttccggccctgtaatatgcgaatgagtttggagggtcaacaacatgcgggtacacattacacttgaatgtacagaatgccatgaacgcaactacttatcttcaaagaaccgccggaacaatccggaccgggttgaatttaagaagtattgtccacgggaacacaaagtgacattacatcgtgaaacaaaataacaacggggactcctgttgttttttctgtaacattgtcatcagacaatgggtttctcatttgttggcaactgccaaattgatttttcaatttgacatgttaatgaatgagatttttttataccaattttattttcgggggtgccgtacgtggagaaaaaagcatttcgtaagcaacagcttgggcgattaagccaaatgacgccggctgaccggcaacggcaaaaccaggcgttacagacccaattatttgcaagcccaacatggcaaactgcccaggtcattgccatgacaattagtagtgacatcgaagtagcgacgcgcccacttattgaacaagcttgggcggagggcaaaatggtggttattccaaaaacgctgccgcatcgtcaaatggctttttatccttaccaagcgactgatcgacttgagcgaacgacttttggaattccagagcccgtcacgggtgaaccagtcgccaagcaacagatcgatctgatcttagttcctggtcttgggtacagccgtgaccggcacgcccggattggatttggtggtggctactacgatcgttacctcgctgattatccgggtaagaagttgacactggcttatgacgagatggcttttgaacacgctgaatggccggttgatcaatatgacgtcttgttagacgaactcttggtagcaggggatgaacaacatgatgagaattaaacgctggtggcaaactgaaccggctatcacgcaggtgctacttggaattactgtggcagtcttcttagtcgagtggctgatgggcgacggcgccatgctgatttttaattcactaggtgctaagaacaatcaagcaattgcggccggccagtggtggcgattggtgacgccgatgtttttacatatgggacttacccatattgcactgaatggtgtcgttatttattttatgggcatgcaaattgaagcaatgtatggtcattggcggatgctggcaatttatattttgggtggcattagtggtaatattatgagtttcgcgttatccaataatcagtcagtaggggccagtacggcgtgtttcgcactctttggtgcctttttgacgattggggaatcgttctgggaaaatccagtgattcgccagctcacgaaccaatttttactactaaccgttttgaatttagtattcgatatgttctcgaatggcattgatatctggggacatgtcgggggtctagttggtggctttttgttaggctatctgctgggtgtaccacgaattggcaagattgcgccgctgaaacgaattgtggcaacggttattctagtcattggctggttagctttactaaaaatgggttttacaaatgctaatttaactgtataattaatcgaggatatgcacatgaaaacactttacgacgtccaacaattacttaaaaaatttggcgtgtacgtgtacgtaggcaagcgaatttgggacattgagttaatggccattgagatcgatcatctctatcaagctggtgtcattgacccgaagatgtatgcccgcgtcaagctcgtattgagccatgagcaccggatagaagcagaacgcgcccgtgaagacgcggcgcatgactaatggagggatttagcaacatggagcgtaagttaatcggagtcgaccttggtgggacgacaactaagtttgccattttaacagaaaatggtgatattcaacaaaagtggagtattgaaaccacgattttagatgaaggggcccacattgtgcctaacatcatcgattccatcaaccaccacattgagttatataagatggaccgttctcaatttatcggaattggaatggggactcccgggaccgttgatttggataatggtacggttatcggtgcctacaacttaaactggaagaccttacaaccagttaaggctcaaatcgaaaagggaactggcatcaaatttacgctggataacgacgctaacgttgctgcacttggcgaacgttggaagggcgctggcgaaaacggtagtgacgttgtctttgtaacgcttggaactggtgttggtggtgggatcatcgccgatggccgtttactccatggtattgccggtggtgccggtgaaattggtcacgtaacggttgaaccaaacggctacatgtgtacttgtggtaagaaaggttgtttggaacaatacgcttctgcaactggtgtcgttcacgttgctcgcgatatggcagaagaattctctggtgcttctaagttgaaacaattattagacaacggtgaagaaattagttcaaagatcactttcgatttagctaaagaaggcgatgtcttggctaaacgcgttgttgatcgggtttcttattacttaggcttggcattagctaatgtcgggaacacgatgaacccatcttcaatcattatcggtggtggggtttcagctgctggtgatttcttattagatcaagtcatcagttactttaaccaattcacattcccaacgattcgcgacacgactgctttgaagttagcggtcttaggtaacgacgctggtgttatcggagcaggttcattggcccaacggtttatttaagttaaaatcaatcgtcaagaagcttggaagtaatgtccgagcttcttttttatactaagctccaaaaactgtgctgattaggttgtggttaaaaactgagcgccaattgccgatgctgatttgggctcatgtcctcagactatgcgcgattttagtttcatgtcggtatgttgttgtaacggcgtatgaactgttacgcgatttggcacaagggatacgaatcgactagcgtgaattgaattagatgacagaattgattggagaagcaggatggtaaagttattattgtcttcacgggcgtttagcactgtggccgtaacggacgcctttttcactttagtggcgccggtggctaagaacagtgcgagaattgtgattattgtcaattcggtcagcacgggtaaaaatcacccccaaatggtggcactacaacaaacggttcagcagcttggatatgcgcacgtgcagctcctagatgtattgacggatgatttggccgcattgaatacggcaacggtcattattttgaatggtggctacgagtttttactgttgaagaatctgcgtgaaacgcacgtgctggaacgactgaggactctcgcgctggcgggcaagccaatctacggtattagcgccggggctatcttgttaggcccggatttagacctgtacgcctatttatacccggaggacaacaccgagcaactggcaagcacaacagccatcaatgcgacgacgatccgtatttatccgcattatgatgttcattgtgaagtaaagccgcaattgccgcagttgatcactgactgggaacataagacgggcgttacggtcaaacggttgactaacaatcagggattactggtgcatggtagtcagattcagatgatcgattcagattcataaatgtgataccgcgatgcttggttttgaattaacagcgtggttaaatgcgggtctcaggcccccgaccgttttaatggatttctttaaaccgtgggtgagtacggccataaagcaatcagtgggacttcaggattagtcagcagtttaatcgcggcttttcctgcttacccctagtaaaagtaagcggttttgtgtaaaatagataagtagaaattaggagggataacgtggttttaggtgcattgagcggcatggcgtatgttaacatcgtgttagttatcataatcgcggcctactttatttatgagttgtatagttacattcgacggcgtcaggtgtccacgatgttggacgaagaagcgtttcaggcgggaatgcgtaaagcacaagtgattgatttgcgtgaaaagaaagagtttgacgctggtcatattctgggggctcggaatattccgttcaacagtttgaaagttcggatgaacgaacttcgcaaggatatgccaatctacgtttacgatcaaacccatacgttaagtacacgggccgtcgtcacattagctaagaatggttattcacagctatacattttaaaacccggttacgcacgttgggaaggtaagacgaaaaaagcgaagtattaaaaaatggcggctagaacaacaacttgttcggccaccattttttatttaattaaccgttgtgagctgagcgactcttgcgcatcgcctttttccggttttcttcgaatttgttttcttggtcttcgattggatcaacaacttgcttcttaaatgataagacggagccaattacggcaccagcagttgcgacgaccccaaacaagaagccacgggtaaatgatttcattagtaaaacctcctagcaattgttagttttattatgcttgttttatgcggagatagcaatcaattcaatctgatttttaaaaaagtggggtgaaacgcaatgcttactcaaattattgctcatcgtggtagcaaggggaccaggccggaaaatacgttaccagcgtttattgcggctatcgaggatggtgcggatggcattgagactgacgtacacttgtcgcgagacgggcaactgattattatgcatgatgagctcgtcgaccgcacgactaacggaacgggtcggattgtggatcacacgttggccgagttaaagcaattggacgctggtgttaagtatgcatcagcctatgcgggaacgcgtattccgactttagatgaagtggttcaattattgattcaatacaactttactggtatttttaatctggaaatcaaaactaataagattcattatgaggggatcgaagacttggtagcggattattttaaccatcatcaagttccgtttacgctaatttattcgagcttctacggaaagtcgatcgaacggttgcatattttacagcccgaggtcgaatcggatagcctgttcaagactaaggttcaaactgcgaagcggcttcatgcgcaacacattgttctcggttatcatccggatattcgttgggtgcgagttcactggctcttattgccaaaagtgcagttgcggccatggacggtcaacacggaacgcgatatgcggttctgttatcgtcatcggtttgcgggactgattaccgactaccctggattagcacgaagaattcgtaagcaggtacaaggaggttaaacgagtgacaacagtaactaaacataaagtattactaatcgcgggaccaacagcagtcggtaagacggcattatcgctagcgctggctaaacagctgaatggtgaaatcatttcaggagactcaatgcaggtctatcgtcacttggatattggtacggctaaaataatgccggaagagcaggcgggcattccccaccatctaatcgatatcaaaaatattgatcagcgttttacagtcgctgaatttgtcagtcggacgacggcgttgatcattgatattagtgctcggggtaaactgcctattattgtgggtggaactggcttttacttgcagtccttgttggcgggctatcagtttggaccagcggataatgaacctgatatggtgtatcgtcaagcttggtttgatcgtgccgctgtcgaaggttcggatgtggcgtggatggcgttgaaacagcgtgatccgcaggcagccaccgcaattgcgcccgctaacttggtacgggtcgtacgggcgttggagtatgtgcatacaactggtcagcttttttctgagcaggcggatacgcacggtgacacactggatgcttataccttatgtctgaccgcggagcgagcgctgctgtatactcggatcaatcaacgtgtcgatcaaatggtagcggccggattggaacaagaggcgcggtggctatttgaccaaggtggcgccatgttaccggctggtaaggggatcgggtatcacgaatggttcccttactttaatggggagcagacgcgtgacgaatcaattgctaagatcaaacaggactcacgtcgttatgcgaagcgtcagttgacttggttccgtaacaagatgtcggtcgactggatcaatctattggaacaccctgaattacgggtctcgattgaccaacggctagctagttggttaagctaaattataaattggtatacctatgataaaacgtgtgatattttctaacatgaatgattgacattcgatgataacattgctaatattaagtctgtattaaagaggagggtcgttatgaaggaaaaggaactccgtcgctcgttggccgtcttgccaattggtacggttatgaagctgaccaatttgtctgcgcgacaaattcgctactatgaagagcaagaattgattacgccggaacgaaatgccggtaatcggcgaatgttttcgttgaatgatgttgatcgtttgcttgaaatcaaggattacttagcagatggcatcaatatggctggaatcaaagaaatatatgcgctccaaaaacagcgagctgagcagaagcaagctgacttggctaagccgctaactgatcgcgatgtgcgccgaatccttcatgatgaattcctgaatctcggaggcttgcagtccgacaagggccccaattatccggcacactaagatgtttgcattcgttagtcaatcaatttaaggagcgattttcatggcaaaacagtcctactcaaaagacgatatccgccgcatcgtcaaagaagaaaacgttaattttttacggttaatgtttactgatctattcggcacaattaagaacgttgaagttccagtttcacaactcgacaaactcttggataacaagttgatgtttgacggttcatccatcgatgggtttgttcggatcgaagaaagtgacatgtacctgtatcctgacttatcaacttggttgatcatgccttggaacacggaacatggtaaaattgcacggattatctgtgaagtttacacgtctgaccgtaagccgttcgaaggggatccacggaacaacttaattcgtgtcttgaacgatatgcgcgaagcaggttatacgtcatttaactgtgggactgagcctgaattcttcttattcaagatgaatgaaaagggtgaaccaacgaccgaattgaatgataagggaagttacttcgacttatcaccaatggacttgggtgaaaattgccgccgggacattgcacttgaacttgaacgacttggttttaacgttgaagccagccatcatgaagttgcacctggtcaacatgaaattgactttaagtacgcggatgctttatctgcagccgatcatatccaaacgttcaaattggtcgttaagaccatcgcacggaaatacaatttgtgggcaacctttatgcctaagccgttaaacggtgtcaatggttctgggatgcatgtgaacatgtccttgttccatgatcaaggcaatgccttttatgatgctaatgataagaatggcttagaattatcatcagacgcttatcacttcttaggtggtttgatgaagcatgcccggtcatacactgctgtcactaacccgacagtcaactcatacaaacgcttggttcctggatatgaagcgcccgtttacgtggcctggtcagcatctaaccggtcaccaatgattcggattccaagtgcacggggcttgtcaacgcgccttgaattacggagtgtggacgcttcaactaacccatatttggcctttgcagcggttcttgaagctggcttggacggaatcaagaacggtattgaaccaccaaagagtgttgatcgtaatatctatgttatggatgaagatgaacgggctgcagctggtatcgctgacttaccatcaacgttacacaatgcgctgaaagagttccagacagatccgacgatgaagaaggcgttagggccacatatttatcagagtttcttggaagctaaacggcttgaatgggcttcataccgtcaacaagttagtgaatgggaacgtgatcagtacatggaattgtactaaaccattaattgagataaaaatacgacggttagggcaccttaaatggcgaactagccgtttttgttataaaattggtaaattagtggtgttaacctttattaatgcactaattttcggtaacattaggaacaacaatgcaattcagcaagttttcaattattattgattgcaaggagattattatggaaaaacaaaatcagcctgatcttgaaaaacaagatcaacctacgcgcgcgcttacgaagcgacttcaacaaaagttagactatgtaactacggtgcgccaagcaattacggctggtgacgaccggttgatctacgaattgatcgatggtgaccactatcaccaagccttacttaacgaggaaccggatccaacccgtaacgcccaagtggatttaattacggatgtctatccggcaatcagtcactacttgagtaccaagttaattgattatttggctcatgagtacccattcttttattatgaagaaacccaactcggcgaatttcagatttactttggtaactggtgggatcggcgccggtttggtaaattgaacgttttgaaagtcgcctttgaatttagttcggaagaatacaataaattacaaaagacgtttgaactggctcccgcgcacaaacgtttcaatacagatcgtattcagcagatctcagctggtagcgatcagctacagaaactgattgacgcgcaatcagaccgtgatgcgcaaaaagaagaattgcggcagcaactaaaggaaaatgggcaacgtaactcactatttgattctggtcggatcaaagaagaacggcagcaaattattgaccagttaactaagttggccgatgaagacgaacaagctaataatgcccatgcaaccatgaaggataacgaagctaagattttaacgctttctaaggaagatacgattttagcttatgagaaacaagcgattgaaaacgcctttaagagttttgagaattttaatgagcgtaaccgtagtctttatgttgactacttgaccacgctgattgggaaggcgcaggtagcggctgatggcgaataatacggacaagcagatggacacggcaacactgagcactcacggtaagctgagtacgttcaatgagggcttaaaaaaaggactcgctaatggtgaaaaatttacggccttgatggaccaactgattgatacaactgacggggagacactgttagcagcggcacaacagctagcagactttaaactggatacggcttacgtgacgtttccccatcaatatcagaatgccgattattatttgatcttcatgagtcggttattgggcatgcatggtgatgaacaagcggtgctgaattctcaacggcatactgaagcgctgtatcacgtttacggggcgctaacggatgattacaccttcttgtatcaagtggtgaacaacggcaacggtggtgcatattatcgtgaacaaacaactggcgaaaacttgttttatattcatttagaacggcgcttgttacggtttaatagttcggcgtttacgaatttatttattaataaattattgttgaaggggactggggttgaccaaattaatacggttctcgcaacgctaattaaatttggacattgcttacaagatgattttggctttaacgtcgactttaatattttggacgttgctaacgcggctaaatatgaacttcggtcggctaatttagatcgggcaatcgttgacaaattgtttgtcagtgcggctaagaatgagcacatgttgcgtaattcacagcaaggacatggtgcccaaattgaactgcgggctggtttgacagttgatatctttgatgcagctgaagctggcggtagtcaacaatgggtcctgactgttcatgatcctgatcaagcagtttcgtggtttgacgtgttgttacactttgggttcatgcgtgattggtacttagaaaatatcgattcgctagaaataaaagcggatccattagtatttgcttaagtaacgggggtattagatgttagaactaacaacgttattacaacagtcgattcgtttagaccgcgatattacggcccgtcaacagattcattggcggccacaagaacggttgcaaaatgcgatggtctcactggacgtcgaattggcagaaatggctaatacgtcggaatggttcaaagtttggaagattcatcgtggcaaagcggatcctgataagacacaccgcgcaacgctgctgaacgaatacgtagatgcgatggacttcttcttccttgtctcagcgattcaacagtggacgcatttgattccagtaacgcctgagcaattgactacgattgcggctaagccggcgactgatttgaataaacagtacttggcgatcaagcacctcctctatgatgcttactttaaccatcgtcaggagagctaccagcacgcttggcacgttttcttgaagattgggctagttgattttggttttactcaggacgagatacagacggcgtttacggccaaaaatcatgtcaatgagcaacgacaagcaaataactattaaaaaaataacctaattgcgcgatttgatcacgtaactaggttattttttaagcctctgtcattaattgcgcgtcgttatcggcgtcttgtgcaactaagtcattaacttggtcgatcaatgtttgtcgttgatcaagatcatcgtcgcattcaaagaaggccccgagttcctcagctaaagtatctttgcccgcatccatataccgaaagtcattgctggtgatcgtatagtgctggtgatctggcatccggacgatgacacaaccagtggctgactttcccttggtggctttgtccgtaaactcgaccgcgagtacgtagggcccgtcagttgaacgatctttgatggcatgcgcgatatttccggcaattgcttcaagtttcaatatgtttcacctcaaaacatattatacgcactattaggatgggatgcgagaattgatttagtccatcagctgctcggccagccgcttctgttcagcgtagaaagcgttaaaggcgtggtgggcgttgatgactaggtggtaatggtgctgtgcgactaataagttatgatgaaattcaaaggtgtcacgcccttgctgaataaacgttaagtaatcgttcagataaatgttactggttaagccatggcgtaaaagcattgttgattcccccagacagtattagatacgttgattgtactacaccaaggttgtggtggattggacggtgtcttgattgtaaattggtattataaacgacgactgttacaattttgatattttcagtttgtcttccaccaaattaattggatagaatgcaatttttaggtaatagggtgatattgtccaatgcggcaaatgctctttcactcatacaagctgtgaacctaatacttttgtttttttatgtggatgctcagtttaggtagttgttgacctttttaatatctatgccgtcaattggctgatttaataagcacgaatacgatttggctgccgaaatttattagaaaccaaaaatagagaagtttgctaaacgttggtttaacaagcttctctattttaaaatggcaggtccgaatcgatggtatgtcacgagtgagacttgaactcacaaccctccgcttagaaggcggatgctctatccagttgagctaccgtgacaacaacaagattaattatagttaagaagctggagagtgtcaatttttatttaatttttcaccgatgtgcagcagttaaaaaaaggcgtgagtaagcagaatgatgtaaaaatgtaatatttgtaatgaaaaagcactaaattacagtaagcacattttgctgagataattggtcattatggtgaaagtcaaaaatgaagttagcctggtgaacgaggaaattgttttcatgaataccaattaatgcttgaagaacgacacaatataaacgctgtaatagcggtaactaagtccggtcatcattaatttaatttttgcaagacggggttgttaaatggcgacggcgaagaaccaatatctcctaaaatacttaagaaaagataaagaaattaacaaaactgactaaaatagtttatttcgcttgaaatgttactgtaacaaaacgataataatcatgtaacaaggaaggagaattcttatgggttcagtatttgcaatcgtcgggatcatcgccatcgctggtggcattcaatattattcaaactttgttgccaaagaaaatgcaagcagtaagcatttcactgcttcccgtaatgaccgttagtcaacgggagttcttatcttgcacattggcattatacaatcaagtaattaaaaaagaactgctcattcaagatgagcagttcttttttaattacttgatttttggtgttttttcgatggtgtcagtcttgccggcagcccaacgttggatagcagcaacttctttttcgcgacgaatgcgcttttgcttcccagcaactggccgacgtgatgcccatgtgttatatggttttgcaacaacagtcataagagtatgtccctcctttgattagtccaataacgactatattaaacaagaatagtgtacattgcaaccgaattaacaggaaaagccagacttttcccaaaaattgcattattagtataacggttatttcggtcggttgtcaagataaaatcctttacagcgtttctaaagatcaatttagctttgaattgatgctaaggcatgtaaggactaaccagctagtatgatagtggcaggtaggtgagccccatatcaatcatgtgtcagtcgaatgaatgggccagatagatcactgagaaccatcttagacgtaatctaactatttgtccggctgattatcatctgttagacgctcttagtaattaatgttatattaattatgaaatgaaagtagggagcagatatgagtcaagttgatccgcgtgtcgataaaactcggcggcgcttgcgacaagcattaattacactattacagacagaaacagtcgataacatttccgtgcaaaaactgactagtacggcagcagttacccgcggaacattttatctccactataaagacaagccagcatttgttgatcaggccctagatgacttggtaagtgaattgtttgaaacggccatcgtgacggtttcagtgggtgatattatgaccaatccggctgacccgttacagcgggtgcatgttttttccttatcaaaggcactcggttacatcagtcagcacgcggaagcctttgagacgctattgttagatcagcgccagttagcggtcaatcaacggatcaatcagcagatgacgacgtggatgacgaaatttcaccgtgattttcaggatcaatttgctgatttggaagtaccggtcagcattcaaatcgcgtattacgtttctgcgacagtcggcctgattactgattggttagctaatgatatgatctacacgccacattacttaaccaagtgtattaaaaaaatgcaccatttgatgacggtagggagcattagtttcacggacttttttgtgaagtgaaatcaatccttgactattatgaaaaaatttgataatattttcctgttgtatttgtggacttctacagctacaaccgcacggattgagtcttaagttcagcaatggcacttacattcggcgagtctaagtgatttataatttaaggaggtgcacaaacgtgtacgcaattattgtaactggtggtaaacaatataaagttgaagcaggccaagcaatttacgttgaaaaacttgacgctgctgctggcgacaaggttacttttgatcaagtagtctttgttggtggtgacacaactaaggttggaacgccgactgttgatggtgcgacggttgaaggtactgttgaaaagcaaggccgtgaccgtaaagtggttactttcaagtacaaggccaagaagggccaacatactaagaagggtcatcgccaaccatacactaaggtaacgatcgacacaattaatgcataattaagaaagtaggcattctttatgattcaggcaaccatttctcgtaatgcgaccggtcaagtgaccgcttttaagttgacgggacatgctgattcaggtgcttatggacaagacatcgtttgtgcagcggtttcggtgttagcaattagtacaatcaatgggattgaacaagttgcccgcttgcaacccgtagtacaaagtgatgaaaccaatggtgggctattaattgcagatttcactaagctggacttggcgaacacacaattacaaaccttacttgaaagtttcacacttggtttgaacgatgtggccacgaattacggagattacatccgagttcgtgaacaaacacgataaccacattcggaggtggactttactatgttaatgaacttgcaattcttctctcaccataaaggtggcggttcaactgccaacggtcgggattcagctggtcggcgtttaggcgctaagcgggctgacggccaaactgttaagaatggtaacattctttatcgtcaacgcggaacccatatttacccaggtgtaaacgttggccgtggtggcgacgatacattatttgcaatggctgacggtgtcgttcgttttgaacgcaaaggtcgcgacaagcgccaagtatctgtttacccagcaaaataatttttgaagagcctctgcagggaggctctttttttgtgaagcaatctagggatacctgcgactattattggttcacgggccgcttagccgtaaacgtaattgattgacgaatggccttcaataaatcattaccttcagtttttggaaagtttggtataatgaagcgtgaggtaatgatgggagtgacgaaataatgagtcgagttgaacggttacaaaataagtttgatcagttaaaaattgatgcgtttttagtttcagatggagctaatcttcaatatttaacaggaatggctgatatggccggcgatggttatctgctagtactggcacaggaagcctatctgattacggatgcccgttatcagacagcttttgccggtcactatgatgaccagcacctagtcattacacgtgattatctgggggccgtttgtgatattattgccaaaaccggtactggggtcatgggcttcgaggccgagattccatatacagcctacagttacttagatgagaacttggtcagtgatttggttgcgttaccagacgtggtcgatgagttgcgcatcaccaagagtgttgatgagattgaccggctacgagcgagtgcacgtttggcggatgctggtttcgaatacgtaacgagtatcgtgcgaccaggcatgcgtgaaatcgacgttagcaacctgttagacgcgtttatgcggacgcacggtgcaagtgggccgtcgttcacgacaatcgtacttggtggtgcacgagcggctttgccacatgggacggcttctaaagcactcttgacggccgggcaacttgttactcttgattttggttactttttggacgggtacacgtcagatatgacacggacgtttgctttaggtactccggatgataagttggttacggcctaccaggcggtgcaggccgctcaacaggctgtgatcgatcaggtccaagcaggagcagccactgctcaactggatgcagttggccgcgatttgctgacaaaagcgggctatggtgacgccttcaatcatggtatgggtcacggcattggtcttgccattcatgaaggcccgttgatctcaaaaaacacgactggcaccttagttgcaaacagtgtgattactgttgaacccggggtatatttcccagatttaggcggaatgcggatcgaagatgatgtcttagtgactgctgagggccatgaacgactgacgactgcaactcgtgatttactgattttatagttaagacagttgccacagcggctcggtcttgttatagttataaagatatatttgaggaggatttttaaaaatgatttcaactgcagattttaaaaatggtttgacgattgaagtagacaatgcaatttggcgcatcgtggaattccagcacgttaagcctggtaagggtggcgcgtttgttcgttcaaagcttaagaacttacggacaggagccgttcaagacaagactttccgtgccggtgcgcggatggaacaagcgccaattgaaaagagtacgatgcaatacctttatgccgatggtgacagctatgtcttcatgaatacggaaacttatgaacaaattgaaattcctggcgaccacattcaagacgaattgaagttcttgaaggaaaacatggaagttcaagtaacgctttataagggtgaagtgttgggaatcgatttgccaaacacggttactttggaagttgctgaaactgaaccagggattaagggtgataccgcttccggtggctccaagccagctacgttggaaactggtgcaattattcaggtaccattcttcgttaaggccggtgacaagctgatcgttaacaccgttgactccacgtacgtttcacgggcttaatttttagaaaaactaataccggcaaacatggaattggaggaatgtcaaaatggctgacagtagcaatattacgttacaaagcaaagaacccagcttaggacaaattcaaattgcaccagaagtgcttgaaataatcgttggtatcgcggtaagtcaaattgatggcgttaaccggatgcaagggacgatttcttccagtgtaaatgagttgttcggtcgcaagaagaatcttggtaagggtgtcaagttaacaatcgtcgatgatcagattagtgttgatgtgttcgcatacttggactatggtgtttcggtaccaaaagtcgctttagcgattcaagataaggtcaagcaacaaatcttatttatgaccgacctcgccttaagtgaagtcaatgtccacatcactggtatcgtgactgagaagactgaaagtgccattgatccaaacaacttgtttggtgatgaagatacccagaccgatgaaaatgaagatggtgaagaatcgtgagtttaacgcgtcatgaaatccgggaaaaagcatttcaagctttattcgcgttgaatgctaacccagacgctgatgaaaatcagttgttccaacagttactcaaccctgaagaagcggatgcagttgaaattcccgcatatttaagtacgttagtaactggtgttcgtgaacatcaagttgaattagacgctcaaattcagccttatttaagtcagaagtggtcgttggaccgactggctaagaccgatttgattatcttacgcatcgcgttctttgaattgcaatttgttgacgacgttccaactaaggtcgcggttaatgaagcaattgaattgacaaaggcgttcagtgatgaccgctctcggaaattcgttagcggggtgcttggtaaagtggttaaaaaccaagccaattagtctaaaaccgaacaatcttatgttctaccgtaaaagtctggcgatttgccagactttttttaataacttattagtaaaccggtcataaatcattgtggtgaatatgctaaaataagaccagacagagaaagaggagtgtggcacttgtgacgaagattattgatggtaaggcagtagctaagaaagttaacgcgcagacggcaacggcagtagcggaattggctgctcagggaattcaaccagggattgctgtaattattgttggggacgatgcagccagtcaaatctatgttcgaaataagaatcgtaaagccactaagttggggatgcactccgtggtgcggcagttgccagcgactactagtcaggacgaactgttagccattattgcggcatacaatgcggatgacagcattcatggcatcttggtgcagtcgccactaccagcccaaattaatgaaccattgatcacgatggccattgatcctaaaaaggacgtcgatggttttcacccgacgaacgttggtaagttgatcaccaattttccaggtaattatcctgtagcaaatacgcctcgcggtattatgacgatgttggctgactatggggttgatccggctggtaaaacggcggttgttattggtcggagtaccattgttggtaagccgatggccgctttgttaacaaatgctaacgcaactgtaacgattgcacatagtaaaacagctgacctaaaggcggtcgcccggacggcggatatcttggtggttgcaacggggattgcacacctgatcactggtgctgatatcaaaccaggcgcgacggtcattgatgttggcatggatcgtgatgaaaatggtaaactagtgggtgacgtcgattttgattctgctcaaggcatcgcagggttgattacgcccgttcctggtggtgtgggtccaatgacgattgccaccttgatgcagacaacggtggaacttgcaaagtggagtgatgtaagtgagtgaaagtcaacaatatttgacagtgacagctttaactcagtatttaaaacgtaaattcgaggttgatccgtatttaggtaaagtgtacctaacgggggaagtttctaattatcgtccccggcctaatacgcatcaatatttcagtttgaaagatgaccatgccaagatttcagccattatgttcaagtcggcgtttgccaaggtcaaatttcagcctgaagaaggtatgaaggttctggtcgtgggccggattggtctgtatgagcccagtggtagttaccagatttatgtggaacgcatggaaccagacggcgtgggtgcgttgtatcaagcctacgaacaacttaaaaagaaattagcggctgagggcttgtttagtgcacccaaaaagccgcttccgcgctttccaaagcgaattgcagtggtcactagtcgtagtggcgcagtgattcgcgatattatcacgactactcggcgccgttttccgattgcgcagatcgttttgtttccatctcaagttcaaggtgatgcggctgcggccgaaattagtcggcagatcgaacgtgccaatgcgcaaggtgattttgatacattaattattgggcgtggtggtggttcaatcgaagatctgtggccattcaacgaagaagtggttgcgcgtgcaatcgcacagagtcaactgccagttatttcatccgtggggcatgaaacggatacgacaattgctgacttggtcgcagatgtgcgggcggccaccccaactgcggctgccgaattagcggtaccagtatataacgatgttttattacaattaaagcaagaccagacccgcgtgttcaatgcatttcagaatttcgttcaacgcgatcgacaacgacttaataaattacaaacgtcgtacgtgtttactcagccgaaccgcttgtacgaagggtatttgcagaagttagacttcttaaatgagcgacttaaacaggctggtcaaaataactttaatctggcaagccagcactaccagcgtgtttttcaacaattacgacagcaaacgccgattcaccaagttcgccaggcacaaacgcaactgcttaacttgcagcaacggctgaatcggggtacccagttagtcgtgcggcaaaaacggcaacaactgacgcagaccgtccaatcgttggatctacttagtccgcttaaaatcatgacgcgtggttacgcctttgtgacggcggatgaacaggtggttcacggggtcaaacaattgcagccagaacaaacggttgcaattcacatggctgatggtgaggctcaggcacagattacgaagattgatggaggaaaataatggctgaacaaccaacttttgaacagaatttatcacaattagagacgatcgttaatcaattagaacaaggcgatgtccctttagaacaagccttggatcaatttcaaaagggcgtggcacttagcaagcagttgcaagcaacccttgaaggtgctgaaaagacgctcactaagatgatgaatgaaaatggcgacgaagttccatttgagcaagctgacgccaatgaataagcaattattaactgaatttgaatccaagtggcgtcctcagattaatcagtatttagatgagcagcttcaagcgtgttctgaccaatcaaccctgactgacgccatgcgttattcggtactagcaggtggcaaacggttacggccgttattgacgttagccattttagatacttttgatatcacaacgacggctgcaaacttgcgggcaagtgtggccgttgagttgatgcatacttattcgctaattcacgatgatttaccggcgatggataatgatcagctacgacgtggcgaaccgactaaccatgttaagtttggggaagacgttgccattcttgcaggggatgctttacaaccgttgactttcgaatggattgcggatagtgggttaccggcatcgatcgtcgctaatcaaaccttagcattagcgcaggccaccggacctcgcgggatggtggctggtcaagttgctgatgtccttggagcgggacaacatctggctttgccagccttacaacagctgcatcgcgagaagacgggggcgttaattcactacgctgtccaggcagggttgattcaagctcaagtgcaaccaaccgtgcaggaattgctattacaatatgctgatgcctatggattggcgtttcaaatttacgatgatattttagacgtgacgagtacgcctgctcagttaggaaaagctacgcataaggatgccgatgagcataagaatacgtatccaggtttgctggggcttgcaggcgcacgaacagcgttagaacaagcggtaacagctgctcaaacggcgttagtaaaagctagtactgctagtcaacgaggcatgggcttgcttgcagcttttctaacgtattttacagattaaggacttaaatttagatggaaaaagaacgagttgacgtattattagtacaacaaggattatttgatacccgcgaaaaggctaagcgtgccgtaatggccggtgaaatcttaggtgtcaacgaagaacgcttagataagccgggcatgaagatcccagtggcaactgaattacatttgaaaggcaaaccgatgccctacgtttcacgtggcggtctcaaacttgaaaaagcactcaaaagttttgaaattgacgtgaccgacaaaacggtcctagatattggctcgtcgactggtggttttaccgacgtggttttacaaaatggggcaaaaatgagttacgccttggatgtcggtagtaatcagttggtctggaagttacgccaagatccgcgcgtggttgtgatggaacatactaactttcggtatagtgaactggcagatttcacgcaggggcaacctaacttcgcgtccatcgacgtttcatttatttcactacacttaattttgcccccattacacgcgattattgaaaacggtggttcagtcgttgctctaatcaagccacaatttgaggctggccgtgagaatgtcggcaaacacggaattgtccgtgatcctgctgttcatcaggcggtgttgacagatatcgtggaatttgcgcaagcgaatggttataacgttctagggcttgattattcaccaatcaagggtggtgaaggtaatattgagtttctaattcatttacaagctaccgatgaaacaccacggattgcgccgactgtgtcgattgaaaaaactcaggcggccgcttatgaacaattaaatcaagcttaaaattgaaatccggactttcatatttatgcattttggcttatgatgtgtttaaataagtatgaatagctaccgggggtgatcgggtgaagaagcaagagcgccaacgctacattaaacgattattgagttcgaacgaaattgaacgtcaagaagactttgtcaagctgttacgtgctgaagatattgacgtgacacaggcaaccatttcgcgcgatattaaagatatgcagctggtcaaggttccctcggcaacgggcggttaccactatagtatgccagttcagaaacaaatggatacggagaaaaagctcaagcggacactgaaagatgcttatgtctcgtatgcgactcaggataaatttgtcctcatcaaggtgttgccgggtaacggaccagcactagcaacgttgattgaagcaatgcattatgacgaaatttttggaacgctaggcgatgatgctcatgttctgattatttgcaagtcgttagcgatgactttagagctacaacaaaaaattcaacgcttactgagtgatcactaattagtaagctatcttcgacctgctcacatgtgtgtcaggtcgctttttttcaaaattaactaacggatgctggtaaccaattgcttttaaggagggcttgcagtgttacaagaattatcaattacgaactttgcaattatcgaacacttagacattgcttttgaagccggcatgacggttttaactggtgagaccggtgctggtaagtcaattattattgatgcagtcggtttattagcgggtggccgcggctcggcagagtttattcggaccggtgctgataaagccgttttgcaaggcatgtttattttgccggctgacggcgtgacggcccaattgttggacgaagcggggatcgaacatgcggataataccgtcattctacagcgcgagattactaaaagtggccgtaatacatgtcgcatcaatggtatgctggtcaatacgacgactttgaaacagattggtgaaacaattgttgatattcatggtcagaatgaacatcaagagttgatgcaacctgaaaaacacctgggattgctggacgagtttgccaccgctaaaattcgtaaattgaagcagcgttaccagcaacagtatgatcgttatcagcagttaaaccgtgaactgcggcaaaagaatgcgaatgaaaaagagtgggctcaacgcttagatatgctgaactttcaagtggacgaaatcgcagcagcacaagtcaaagtgggtgaagaggccagtttgactgcggaacgtgaccgcttggataattaccaaatgatcaatcaagcgcttcaacagagttacacattgttagctgcaggtgaggagacgactggtgcggttgatatggtcggtacggcgatgaatgcactagaaccgattgctaatttggaccccgcctttaatgagattaccgtgaatgtcaagaatgccttttatgggctgcaggacgcggccggtcagatttctaatcagctcgatttgcaagaattcgacgagggtcgcttggatgaaatcgaacagcggctggacgttttggcccagttaaaacgtaagtatggggactctgaacaacaaatcttagattattaccaaaaaatcgcggctgagttagccaagatgactgactctgaagaaaatagtgaagatctggcccagcgggtcgccgatctgaaacaacaactacttacgacaggcgaagcgttgtccgataaacggcgggctgcggcgaaagtgttacaacgacagattcatcaagaactcaaagatttgtatatggataaggcaatctttgaagtacgattcaaaccgactaagggtcagatctatcggagtggtctggacagtgttgaattttatattcagactaatcctggtgagcgcatgcgcccattggctaaaattgcgtctggtggggaactctcacggatgatgctggctttgaaaaccattttttctgaatcacagggaattaccagtatcatttttgacgaagttgatacgggcgttagcggtcgggttgctcaagcgattgctgagaaaatcaacggcattgcacacttttcacaagtgctctgtattacccatttgccacaggttgcggcgatgagtgatcaccactacttcattgccaagaagattactggtaaacgcacgaaaacgagtgtgactaagctggataatgcggcccgggttcaagaactggcacgcatgttggcgggaactaaagtcactaagttatcgcttgagcatgcggaagagttattgcgactggccgatgaggaaaaagacgattaggcttaattgatcggtaccacaagggacggacaactatggtcggtccttttttgatggtgttaattagtgacgatagtgtcgagtgaggtttcggtattattgccaaggcgacgataattctttacaatataaaacgcaaatagacgaaatatgggtcaacggacacgttttaatgaactgtcgggctggttggtagtgggtggctaatctgaagctccgactaccaaaatataccgttaaaacgataaaatgttcagtttacatgtcatgacgtttgcattttgctttcgttataagttatgcttaattacagtacagtttattcggcaacgaaataaactgagtaaatgattggagtgatgaggttgtttctgacaatggaacatttgaataaaacgtatcctggtggcaaagtagccgttgaagattttaatttggaaatcgaaaaaggtgaatttgtttgtttcatcgggacgtctggttcaggtaaaacgaccacgatgcggatgattaatcggatgttaagtcagacttccggtaccattaaacttaatggtaaggatattagccagattgacccggttaaattacggcgacaaatcggttatgtgattcaaaatattgggctaatgccccatatgacgattcgagacaatatcactttggtaccacgattgctaaagtggccccaagataaaatgaatgaacgtgctaagaagatgatcaaactggtggaattgccagaagattacttggatcggtacccgtcggagctttccggtgggcaacaacaacggatcggggttgttcgggcgttagcagcagaccaagatttagtattgatggatgaaccatttggggcgttagacccgattacccgtgaatctttgcaagatctcgttaaggatttgcaggaacgcttaggtaagacgttcgtctttgtaacccatgatatggatgaggcgttaaaattagcgacccgaatcgtaatcatggatggtggcgacattatgcaagtggatacgccagacggtatcttacgtcatccagctaatgaattcgttgagaacttaattggtaaggatcgtttgattcaagcacggccaagtattaccactgttgggcaagtgatgttgaaagacccaattgccaccacaccaggaaagtcattgacggtcgcattacgacaaatgcatgataaacgcgttgactcgttgttagtcaccgatgaagccggcatcttgaagggtgtgatcggcattgaagacgttgattacaactttaactcggctactagtgtgggcgacattatgaagactgatttgttctatgttcagtcaaattcattgattcgggatacggtcgaacgtattttgaaacgcggcttgaagaacattccagtcgtagatgaacaacatcgcctggtcggaattgtaacgcgggccaccctggtcgatattgtttatgatgctctctggggtgatgaagacgaagatgaagctgaaaataatattcatcatggggaggacgatgcgcccgctgaaggcggtgaacaggcatgataactttcctacaaaactacggcatgcagctgctggttaagacgtggcaacacttgtatatttcagcgttttcattgttcttaggcattatcgtagcggttccgattggaattctgcttacgcgggtgaagccgattgcgaatgtggtcatgtcaatcgctagtatgttacaaacgatcccagcgatggcgttgttggcattgatgatcccgtttttcgggattggtgcaattccagctatcattgcgctgttcatctattctttattaccgattctccgcaatacctatcttggactggaagacgttgatccggccttgatcgatgcggctaagggaatgggaatgaccggttggcagtcaattgttaaagttgagttaccgatggcagccccagttattatggctggtattcgattatccgcaacgtacgttattgcctgggccgcgttagcatcatacattggtgccggtggccttggggactttatctttaatgggttaaacctctatcgaactgacttgattttaggcggttcgattccagtgattatcttagccctcatcgttgattggctgttgggtaaactagaagcagcggttaccccaagaaccacacaagcgtaagggggattaaagatgaagaaaattaaaaagtggttgttaggtgttttcgcaacggtcgccagtgcgttattattggccggctgtggctttccgggtttgtcaggaacttcatccgatacgatccggattgcgtcacaaaacacgactgaacaacagatcatggcgtacatgattcaagatatgattaagcattattctaatttgaatacgacaatcattaacaatttaggttctgggacggttagtttcaatgctttgaagaatgatcaggctgatatttcagcgattcgttacactgggacggacttaacgacgattctgggtgaaaagatggatcggagtaatatcaagtcgattgaccaaaaagttcgctcacagttcaacagcaagtatcaaatgacctatttcccaagttatgggttcgcagatacctatgcttttatggtgacgaaagcgacggccaaaaaataccatctaaatacggttagtgatatgaaaaaagtagcctcgaagctgacggtcggtttggatcaaatctggactgaacgaaaaggtgacggctatcctgcctttaagaagttgtatggctttcaatttgggaagacttatccaatgcaaattggtttagtttatgatgccttggaatcaggtaaaatggatgccatcctcggatactcgactgatggtcggattggtagttatgatctgaagattttaaaggatgataagaatttcttcccaccatacaatgcgagtgcggttgcaacgaacaagatcttgaaagctcatccgaagttgaagccaatcttgaatcgattaaacggtaaaatcagcttaaagacgatgcaaaacttgaactatcaagttgataataacttagtggaaccggaagttgtggctaaacagttccttgaaaaacataattactttgaagggagtgacaaataatggctcagatgaacttactgcaacagttgatatattattaccaacaaaacggtgtgtacgtgttaagccagttctcacgtcacttcttgatttcaatttatggcgtgctgtttgcggcaattgttgggattccaattggcattttcattgcccatcatagtcggttgagtgcgacagtgatcgcgattgccaatgtgattcaaacgattccgtcactagcgatgttatcaatcatcatgattggcttgggcttaggtgtgaacacggtaatcgtcacggtctttttatacgcattgctaccgattatcaagaatacctatactggaatgcaaaatgtgagtgctagtattttggattccggtaaggggatggggatgacacgttggcaattgttacgaatggtggagttgccactgtcactttccgtcattatggctggacttcggaacgcattagtgttggctatcgggattacggccattgggactttcgttggtgccggcggtttaggggatatcattattcgaggaaccaatgctacgaatggtggtgccattatcttggccggggcgttaccaacagccttaatggcaatcattgctgatacggtcttggcttggattgaaaagcgtgctgatccaactcaaaaataacgtcagtgagcgacaagtaaaagaagcaatataaaaattaagttactaaaaaagattgatttacaggtactccgtactcactcattcagggaagtcagtggagctgtaacatcaatctttttgatttgcatcaaaaacaccatgagaatacgcaaggttgtattgaacatgatttcatcttttgatgcaagtattaatgattaaactaaacgcgtttgatataacggatggcgtccgggtcgaccaagtgggtcaggtgtaactgccgattaactagaaccaactgaccactagcgagggtttttaacactccgtgaatattatatggtcgggactcagtgagctgaggctgcatctggagcatgatttgatagtgttccgtgtgcgcttgagctaagaacaaatcccgctggaaagccggcatcattggcagtaacggcgcaacgacggtcggggcagcagtaaagtcatccataaattggcgataggaagcgtgtaagttcttggaaattagtttcaaattagattgttgattttgcatattagccacctcgaacatttgtttgtgtttccattatacgaacaggcgttctaaaaagcaagcctaaaatttgagaaaattcacgaataaaaatgaaaaaaagctgtgtaaccttgataatacttgcaatatagggttaaaaagtgcaaaataaactttaaaacatattttaattaaggggaatttgtgatcatggcgaaacaaggcatgttaatcgtcttatcaggtccttcgggtgtcggtaaaggtaccgtccgcaaggaaatctttgactcagatgataacgattttcaatattcagtctcgatgacgacgcggcaaatgcgtccgggcgaagtagatggcaaggactactattttgtgtccaaagaagagttcgaggatgaaattaagagcggcggtatgcttgaatatgccaagtatgttgacaattactatgggacgcccttaaaatatattaagcagtcgttggcggctggcaaagacgttttcttagaaattgaagttaacggggccatgcaagtccgcgaaaaaatgcctgatggcgtcttcattttcttgacgccgccggatttgatagaattgaagcaccgcatcattggtcgtgggactgatgatatgagtgtgatcaacaagcggatggcaaaagcggttgatgaaatcaagatgatgcgtaattatgattatgcggttatcaatgatgaagtcccgctagctgctgaacgaatcaaggctattattcgtagtgaacggtttagtgttaaacgggtcatgcccgagtatgaagaaatgttaggagatgcggaatcatgatcttatatccatcagttgatgacttattgaagcaagttaattcgcgttactcattgattatgttagctagcaagcgggcccatgaattggacgctggtgcagcaccaatgcttagcgaatacaaatcggttaaaacgattggtcgggccatggaagaaattgcggccggtgacttaatgatcgatccagatgaaactgacaaagattagtaacaaaacggtgtgctgagccagctggggcttggcactttttttatgaagaatgacgcggacgttcagcttcacgttactgtcgattcttgatacaattgttttattaaagtgtaaaaatctcgctggcacggttgcgagatttttcaaaggacgtgaagaagtgagtatatggacaaaacgccatgtaacggtagtcgttagtggtgggattgcgagttataaagcgttagtattgattcgtagtttgatgaaacagggcgccgtcgtgcgagttgcgatgacaacccatgcggcaaagtttatcacgccattgacctttcaaactttaacgcagcagccagtggtcattgatgaattcacaacgactgacccgcatcacgtcgtccacgtcgcgttagctgactggactgaagtgatgattctcgttccggctaccgccaacttgattgctaaggtggctaatggtctagccgatgatgccgcaacgacgacaattttagcgacgaccgcacccaagtttgtggtgccagcaatgaattcacatatgtacgctaatccagcaactcagcgcaatttgaagcaactgacgacggatgggttacacgtcttaactcctgctacgggtatgttggcggaaggctacagtggtcaaggacgcttgccggaaccagcggtgattttggcctggttgacagatcaactgattcagttgacacctgatttgccattagcaggacggcgagttgtcgtcactgccggcggaacccgagaagccttagatccggtacgatttatcacgaatcgttcatcggggaagatgggctacgcagttgctcaagtcgcacgggagttaggtgcaactgtgacactgatcagcgccacgactcatttagcagcgcctagtggtgttaaggtcgtgacggttgattcggctcaatccttattgacggcagtcagtgatatttttgatgatacggatatcttggtcatggcggcggccgtatctgattatcggccggctgaattagctgatcagaagattaaaaagccagctgaccatgctgacttaacgttacgattgacagaaacaccggatattttaaaaacgttagcggcccggaagcaccaacagtatgtgattggttttgcagctgaaacgcaatcattgctggctaatgccaatcgtaagttaactagtaaaaaattagatttaattgttgctaacgatgtttccaaaccgggagttgggttcaatggtgatactaatcaggtcacactgttgcggcctgagcaacaaccagttacgacggaattgacaacgaaaactgcaattgccaaacagatcttgatgacggcaattgcggatggtgcaggaacacaggcatgattaagtagagaggaagagttgtgtggcacaaattgcccaagtattagtcgatgtgcccactatgcagacaaatcgaccttatagttatcgaattccaaccgcctggcaatcacaagtgcaacccggcatgcgcgtcgtggtgccattcggccgtggtaaacggcgggtgcaggggtttgtgttagctcttgatgacgttactaactttgatggtgagctgaaaccaatcgacgcggtcgttgacctagcaccggttctgaatactgaagccttagcactgaccaagtggttggctgccagcacgttttcatttcagattacctgtgcacagaccctgctgccggcggtcatgcgtgcaaagtatgaaaaacagttgcgaacaacagcaacaacgcccgcgacgattcgaacgacgctgtttggggaccaatcgatggtgccgtttgatgacgtcgccacgacgccggcaatcgtcagccagttattacggctgcaggcggctgggcaagtcgatgtgtactaccaagttaaaaatcaagcacggcgtaaaacgcaaacggcggtgaaagcggccttaactaacgaagcgctacaggctgcagtggaccaggtacgcgccggggctacacaacaattggcggtgctccaggggttgctcactttaaatggtgaacagctctcgcaaaaggcgttttgtactcgttttgatgtcacggacggtgccattcgtacagcagtacagaaaggctggcttaaaaaagtggccgtcgaggtttatcgtgatccctacgcaactagtgatattaagactaccaaggcgttacaattgaatgatgaacagcaagtggccgtcgatcagattacgcaagccgttgaccaagccgcaaccaccacgttcttgttagagggtgtgacggggagcggtaagactgaggtgtacttgcaatcgatggcggccgcattggcacaaggaaaaacggcgttgatgttagtgccggagatttcactgacaccccaaatggttcaacgcgtgaagggtcgctttggtaaagctgttgccgttttgcacagtggattgtccagtggtgagaagtatgatgagtggcggcgaatccaacgaggtgaggctcaggtggtggttggcgcacgctcagcggtgtttgccccgctaaaaaatcttggcttaatcgtgatggatgaagaacatgagagcacgtataagcaggatgatgccccgcgttatcatgctcggcaagtggctttatggcgtagtcgttaccataactgtccagtcgtactgggttcggcgaccccatcgttagaaacgcgcgcccgcgcagaaaagggcgtttatcagcgcttactgcttgcggatcgggtcaatcgacggccccttcctaaggtttcaattattgatatgaaaaaggaaatgcaacaacacgctgaaagcaatttctcagcgccactgttagttgccttgcaggatcggcttgaacgtcatgagcagagtgttctaatgctcaatcggcggggctattcatcgtttgtgttgtgccgagattgtggttttgtcttgaagtgtcctaattgtgatatttcactcacgctacacatggatacgcacacgatgaagtgccattactgcggtcacgaagaagccattccgcggaattgtccgaactgtcatagtcgtcagatccgttattatgggacgggaactgaaaaagtcgaagaagaattgcaagacttgcttccggacgctaacattattcggatggacaatgatacgacccgtaaaaagggcgcccatgccaagcttttagcacagtttgggagtggtgaagctgatattttgattggtacccagatgattgcgaagggactggattttcctaacgtgaccttggtcggtgtcttgaatgctgatacggccctaggattgccagattttcgcgccagtgaacggaccttccaactattaacccaggtgagtggtcgagctggacgggcggaaaagagtggtcacgtgtatatccagacatttaatccggatcattatgcgattcggtttgcacaacaccacgattacgaaggctttttcaagtatgagatgcagatgcggcaccggggtggctatccgccgtactactttacggttcaaattacagcgagtgacttagatgaaggggtagcggccaagcgcatgtatcagttattgcaatggttacgcccgcggttggcaccgtcaacgattctattaggtccaacgcccaagccaatcgcacgagtcaatcgccgttattattatcaaatcgtgattaaatataaacaagaacccaatttagctcagacgctgacaacgctactgcatgagacgcaggcgcaacaacgacaagggctacagattggcattgacgtagaacccttacatttcatgtaatgggattaggaggaagtttgacaatgacatcaatcgtttttatgggaacgcctgcgtttgcggcaccgattctcaaaagtttaattaaagaacaataccaggtactaggcgttgtgacccagccagaccgaaaagttggtcgcaaacacgtcttaacagcttcgccagtcaaagaagtcgcggttgcccatgatattcccgtcttccaaccggaaaagattagtggtagtcctgaaatgcaacagattattgacttgcagcccgatttaattgtgacggccgcctttggacagtttttaccaacaaaattgttgaaagctgccaaaattggtgccgttaatgtccatggctcgttgttgcctaagtatcgtggtggtgcgcctgttcaatattcaattatcaacggtgagtctgaaactggaattactatcatttacatggttaaaaagatggatgcgggcgatatgctggcgcagcgtgcgattccaattgaaaaaaacgatgacaccgggacgatgtttgataagttgagcttagttggtcgcgacttgttactggaaacattgcccaagttgattgctggcgaaattacggcggtgccacaggatgaatcccaagtgacctttgcaccgaacattcagccagaacaagaggtcttagacttctttacaaaaacggccgttgaaattgataatcaagttcggggtatgcggccagcaccaatcgcctatgcggtcttggatgggaagcgcacgaagttctgggatgtgaccccgttagctgacgaagtggtcacgcaagctcctggacaagtggttcgcaagacgaaacatgagcttgtgattgcagctgctaaccacacagcgattgcaatcaatctgttgcagccagctggtaaaccgaagatgacaattacagactatttaaatggtgcggcagataagttcgctaccggagagcaggttattaataaatgagtacagttggtaataccccccgctggttagcggtcgccgccttagcgaagattaagaacggtgcatattcaaatttgcaattaaaccagttaatcaatgatcatcagatggatcggcgtgacattaatctgctgacaaatatggtttacggtgtcattcaacatcggttgactctcgaatactggttgaccccgtttgttcgacatccgcaccagattgacccctgggtacgggaactcttattgagcgcattgtatcaatggcagtatctggataagattccacaacgggccgttttcaacgaaacgattgaaattgctaaggtcaaaggtcaccctggcattcggcggtttgtaaccggcgtcttacatcaaatggatcgctcaggattaccgagttttgatgcgattaaggatcctgatgaacggttgagtgtgacttatagcatgccaatatggttgattcaagaattgcggcgtcaattaggtgctgaaaagatggagcgaatcttatcatcattgaaccaaccagctaagcaagccttacgtgtcaacccggccctgtcgacggttgaagatgtgacaacggtgctgattaatgatggtttgacaattacgccgagtgaaatctcaccgttagggctgattgcaacggatggtcaggctattaatactgaagcgatgcggtatggcatgtttacagttcaagatgaaagtgcacaattagttgtgccagcactcaatctgcagccgagtgatcgagtcttggatgcttgtgcggcccccgggggcaagacgacccagattgcggctagtttagatgctgagcagggtggcacagtcgttgcccttgatattcatgctaataaagtgaaactgatcggccaaaatgcggcgcgcatgcacgttgctgatcgcgttgaagccaccgaactcgatgctcgtaaagttgagacgcagtttaatgctgaaagttttgatcgaattttagtcgatgctccgtgttcgggactgggattgatgcgccggaagcctgagattcgctatgagaaacagttgcaggatagtttgaacttgcaacgaattcaactggcaattttgacagcagtcgccccaaccttgaaaaaaggtggtatcatgacgtatagtacgtgcacgattttgcaacaggaaaatcaggatgtgattaccaaattcttagcggatcacccagattttgagttgcaaacaacgccaactgaacgagacttgaaaactgatcgaacggaaaagactttgtcgatttatcccgatgattatttatccgacggctttttcattgcttgtttgcgaaaaaaataatggtggagtggtaaacaatggattttgcataccggtcggatattggccaacaacgtgaagaaaatgaggactatgtcggcttttttcaaaataaagcgggcatcaattttgcaattgttgcggacggtattggtggccaccaggggggcgatgtcgcttccgagatggcagtctcgcacatgggttttcggtttgaaaatacaacattcaaggaacccaatgatgccgtcaagtggctagcaagtgaagttcaagatgaaaatcagcatattattgaaaaggcccgtgaattttcagatctaaacggcatgggtacgacaatggtcgccgctttgctttttgatcaaaagtttttgatggctaacattggtgatagtcggggctatctttttcgcgatgggcaactccaccaactgacggaggatcattctttagtcaatgagttggtcaagcgaggagagatttcagccgaacaggcccgacaacatccgcagaaaaatattattacgcggacactaggcatctcaccagatgcggatatcgatacgaacctttaccagatacaacctggggaccaattgttattatgttcagatgggctgacgaatatggtgactgaccaacagcttgcgacggttttggcaacgacgcagacttcgacccagaagtgtgagacgttgatcaaattagccaatgcagctggtggtaaggacaacattacggcgctgctgatggcgcttgatggtgaggtggccagtaaatgacacccaactatacccttagcggacgatatcggatcgttcggtccttaggtgaaggtgggatggccaacgtttacttggcacatgacttaatattagatcgtgatgttgcggtcaaactgctccggttagacttacgtgatgatcctaagaccatcaagcgattccaacgtgaggcactggcaacgacggaacttgttcacccccacattgtcagtttgtacgatattggcgaagaaaatggcatgcaatacttggtcatggaatacgtcaaagggatggatcttaaaaattatattaaagagaactttccgttaccgttacagcaagtaatcgacatcatggagcagatattaagtgccgtggcaacggcccacgcgcataatattattcatcgggatttaaaaccacaaaatattttaattgatgagcagggcaatgctaaaatcactgatttcggtattgcggttgcgttatctgaacataccatgacgcagactaacacgattttaggttcggtccattatttgtcaccggaacaggcccgcggtagcatggcgacaaaacaatcggatatctattcgttagggattattttatatgagatgttaacaggctcagttcctttcaagggtgagacggcagtttccattgcgttaaagcattttcaaaatgcaatgccatccgtgcgagagtttgatgcggatattccgcaggcacttgaaaacgtcgtcttgcaggcgacaacgaaagatccacgggaacgttatgctacggtcgaggacatggccactgacttattgacggtgcttgctagtagccgtgcgggcgaaaagcgctttgtaccgcaagatgtcggtaatgatgagactaagatcatgcccagtgcggatattcaagcagcaattgcggccaatcaagacggtaagacccaggtcgtggcgcataaaagcaagcaaccaacactccagcgcccggctgaaacgactgagagtcagacagatgctgatgaagaaccgttaccaacacgttcttggtccaaacgacatccgttgcggcgtcggctcctcttttggggcggtattattttgttattagtcgtggccgtgatcgtcggtttggaattaagtcggccacagatgacgacggtgccgaaagtaacgggcttaagtcagcgtgccgcaactaaggtcctcaaaaaacaccatctcacggtcggaactgttcaacatgctaaaagtaatcaggtagccaaaaatcaggtgatcaaatcaacgcccagtgttaagacgcgggtccaagaacgtgctcgcattaatttggttatcagcaacggtgccaaggttatgagctttggtaattatgtcaatgataattaccatgatgttcgacagacgcttaaatcggcggggttcaaagttaaggaaacttacagtacgtcgtcggttgcagcaggacaaatcatcagtcaggatgttgtcgctggtagtcgcgtgatgccgacagatacgacggtgacgtttacggtcagcgctggtagccgctacgtcgagctaaaagatttaactggtgagagcaagagcgatattctggactatgctgaggcaaatgatcttaatgttaactttaagcagggctactcttcggaacagaaggcaggttattcctatgatcaagatccagatggcggtggcaatgtccggactgggtcgactattacggtgaccatgtcaaggggcagtgataataacgtgacgacaccacagaatttttatgttaaactaacggtgccatacaaagcgttatcggccaccactgcccaggccaacgatgttaagatttatttgtatgatgatacccatatgattgagaccgtttatcgcgatattgcaatcatgcggtcgactaagattagtttaccgtttcagctgaccggtaatacgaaggggcattaccgaatcgtgcgtaacggggttacgatcatggaaaagaagaatattacaagcaaaaatgcaacaaaataaagataagtcatgcgcaatgcatgacttttttggtacaatagagaaaagtggaccgtaccaaataatataaaaggtggtgctaatttgaaaattggacaaattcggcaatcgctaagcggcttttatgacgtttatgctgatggccaaatgtatcggacccgtgcacgcgggaatttccggaagcggcgcattacgccacttgtcggcgacaatgtggagtttgatgcggcgaccccacaagagggctacgtgttaaatattcttgatcgacagacccagttggtacggccgccagtggctaatgttgatttaggtatcgtggtaaccgctacaacggaacaagaattttcaacgaatttattggatcgacaactggtagctttggcagtggcaggtattgaaccattactctactttgcgaagactgatttactaaccgatgaggtgtaccaacaacgattaacattagcggacgcttatcggcagattggttaccaggtcatctgcgaacgaaccgcattttcaccggccgccttagccgcagttaaaacggctctggctggtcatgtggcggttgtcatgggccaaactggtgctggtaagtcaacactgctaaatcatttacaaccagggctggcgttagcgactggtgaaatctcgcaggcgctgaatcgtgggaaacatacgacccgtaaagtcagcttgatcccgattgcggatgggttggtcgctgatacgccgggtttctcatcctatgaagttttcgatattgccgctaacgagttgacccattattttccagagtttgtgcgacttagcgctgattgcaaataccgaggctgtgtgcatattaacgaaccgcaatgtgcggttaaacaggcattggcagctggggagctgttagcgagtcgctatgataattatttacaattctatgaaaccattaaaaataaaaaagtaatctataataagaaaaagtgagtgagactaatgattaaagttgccccttcaattttaagtgcagattttgcgaaccttcaacgtgacgttcagatggctgaaaatgccggtgccgatgcgttgcatattgacgtgatggatggtcagtttgtccccaacttgtcattcggaatgagtactgtggcggatttacggccagtaacgtcattaatgttagattgtcatttaatgattatggacccagagcggtttgttgggcagtttgcaaaggccggtgcagatttgattggtgtgcacgttgaaagtacccgtcacatttatcacgccttacaattaatcaaagatgctggtgtgaaagccgaagtggtcgtgaaccccggaacaccactcggcatgattagtgaattattgccactagtggatcaagttttgattatgaccgtcaatcctggctttggtggtcaacattttctggaccagatggttgctaaaattgcggcgttgaacgaattgaagcaacaacacggttatcaatttgagattgaagttgatggtggaatcaacgaccagaccgtcaaggcgtgctatgacgctggtgctacggtcgctgttgctggttcgtatgtctatgacagtgcggacccagcgcaacgtattcaagatttgaaggtggcgaccaattaatggcaaccatcgtaaacttactggttggcggaccgactgctaattatccagcagatttaacgacgattccaggaccatgggtcggcgctgaccgtggcgcgttgcgtttggtgaaacgtggtatccagcccgtgatggtcgtaggtgattttgattcaattgatgcggctgaactccagactgtcaaagatgcgttggtgggcgctatcgttgtcaaacccgaccaagaccatacggatacacaattggcgattaaatccattttcgagcagttgcaaccggatgaagtgcatctatatggtgccacgggtggtcggttagaccatttactggccaatatgtggttagtacttgatccggtatttcgtcagtgggctccgcagatcaaactgattgataagcaaaattcggttcggttctttctaccaggggactaccagatcacgaaggaagcggataaacgctatttggcgtttgtaccgctgatgccgatgcatctcacgttacccgatgaaaagtatcagttggacgctgcttataatgcgtacccgatttcatgggccagtaacgaattcagtggcaatactggtcactttagctttgatgcgggggttctagctgttattcaaagtcgtgatgacagcatggcagatgcgtagggtaccccaaggtttcagctaaaataagaccggtcggtgagtcataaactcatcaaccggtcttttaatatgcagtaacgacgtatcatcggggagcttgttggtgaaacgtgctgatgtttaggtcggtggtcgttagtagacctaaccggaaagcttatgttgaagcagaactttttggtcagacccagctggttgtttccgacgatggtatggcaagcatcctcaatgattcaggtcatcataatgggctggtcaaggctgaattataaactttataaaaagttgacgagaaattagtaattttagacaacaaaaaacgccagccacaaaaaatgtgctggcgatttgctgcgctaaacgcgcgtaactttacctgatttcaaagtccgagctgaaacccaaaccttctttggtttaccatcaactaaaatgcgaactttttgcaagttagctttccagctgcggcggctgtggtttaaagcgtgagaacgcgtgttaccaaagtgcgtccgtttgcctgtaacgtagtcttttgccatgttgatctgcctccttcggtaattcattgataaaaggtcgtctttatcattcactagaataatttatcatagattaataaaggttgcaatacatttctatcaagtaattttactttactgctaaattcccagtttccgggcttctgttaagcagtcgcttaatttttctttcaagagtggttgtgctatgataaactatcgtaaatgaacgcgttaaaacaaggaggctattttcatggctgtcaaaatcaaaacgcaatttggaaccattgatattgataatgatgttatcgcgacggtcgtcggtggcgccgcaacggataactacggggttgtcggtatggcgagtcggaaccagattcgtgataatgttaatgaaattttacgccgcgaaaactatgcgcgcggtgtggttgttcgccaagaggataatggggtggctattgatgtcaacattatcgtcagttatgggaccaaaatttcagaagtctcacgcaatgtccaagccaaggtcaaatataacttacaaaacatgcttggcgttacggccaattcggtcaacgtcattgtccaaggtgtccgggtaatgaacgactaaattgatgttggtggaagccaaggaggaattttgaaattgaaaatcaccacgattactaatcttgaatttggcaaaatggtgcaggctgcttcacaaaagctgaaccaacgtgctgaatttattaattctttgaacgtctttccggtaccagatggtgataccgggactaatatgagcttatcgatggccagcggtgccaaatatgaacgtgaagaaaccagtacaaaagtaggcgacctagcgtcagccttagccaagggactcttgatgggggcccgtggtaattctggtgtgattctatcacaaatttttcggggcttttctaaagccgtagcggataaggagagcttaaccgctaacgatttagcagccgccctcgcagccggtgctcagaccgcctacaaggccgttatgaagccgactgaaggaactatcctcactgtcatccgcaaagctgctggtgccggtaaggaagctgttaaaacgaccgatgatatttgtgaagttatggatgccgtcgttacggctgctgaagctgcattgaagtccacgccggacttgttacccgttttaaaacaagttggggttgttgattccggtggtcaggggctgaccttcgtgctggaagcctttagtgactcattaagcggcaaggtcgacgaatcacaggactatgttccggacgatgctgaaatggattcgatgattgatgctgcccaccatcaaagtgtgcaggggcaattagacccgaatgatatcaagtatggctactgtaccgaaattatggtgcgaatcggcgatggtaagttagttgatcacaagttcgactatgacactttctatgagtacttagcaagattgggcgattcattacttgtcatcaacgatgatgaaatcgttaaggtgcacgttcatacggaacatcctggcgatgtcatgacgtggggccaacgttttggggcgttgatcaaagttaaagttgataatatgcgtctacaacaagaaaccatcatggaacatgataaggaagacgaagcgcaagccgctgctgagcccgccttaccttcacaaccacaagttgacatgcatggttatgcgatcatctctgtgtcatcgggtgatgggatcggcaagctatttaagggcttgggtgtcaccgacatcattgctggtggtcaaacaatgaatccaagtaccgcggatatcgtcaaagctgttaatgacagtggtgcccaacaagcattagtattgccaaacaacaaaaacatctttttggcagctgaacaagctgcggaagttgccgatgtcccagttaaaattatccacagtcagacgatttcgcaaggcatgactgcaatgttggcattcaatgctgaagctgatttagacgataatcaggccgcgatggaagaaaccttgagtacggttgttagtggtcaagtcacacatgctgttcgcgacacgacgattgatggccttgaaatcaagaaagatgattacatgggcttagttgatggcaaaatcgtaattacgaatccagatcgcgataccgctgctttggatatggtcaaagccatgctcgacgaagatagcgaactcgtaacgattatttacggcaaggatgcaactaaaactgacgctgatcatttggcagctaaggtgcaagagttggatgatgaattagaaattgaaattcatgaaggtgatcaaccagtttacccattccttgtgtcagttgaataggactaaccgttaaaaatagggcttagcagtgatgctggggcctgtttttgtacggacggatacttcccgcgggattgaaacgtttttttggtataattaatattggtaaaggcaattattttagaaagggcggtggtcaggcatgggacaacagttgagtgacgcggttgcaactttaagtggtgtcggcccagcccgccaaaaaggtttagcggagcttgggattaatacgattgcagatctattgacctattatccctttcgctatgaagatctacaggtcaaagacgtcaatgaaatcgccgatcaagaaaaggtgacactaaagggtactgtggcttctgaacctgtgctagcacggtttggccgtaagaagaatcgcctgaattttcgcttgttaatcgaccatgacgtctatatggtgactttttttaatcaaccatacttgatgaaacagattgagactggccaagatttagccgtttatggcaagtgggacgccacgcgcagtagcttgacgggaatgaagatcatcaatcccaataatgcggattcagcgtttggttcgatttatccggccagcaagacggtcaagcaggggacgattcagaagatgatcaaacaagcatatgagttatatgccccagtcattacggacattgtgcctgctaacttacgtgctaaataccgactgttaccgcggcgccaaatgattcatgatatgcacttcccagctagtcaagccgattcaacggccgctcgacgctcagcgacctacgaggagttcttgttgtttcaaatgcaaatgcaagttctgaagcaaacggacgcgacgacgaacggtattgcgatcgcttatgacaatgaccgactaaaggcgtttattaaaacactgccatttgaattgacccacgcccaaaaacgtgtcgtcaatgaaatttgtttggatttgaagtcaccgaagcatatgaatcggttgcttcaaggtgacgtggggtccgggaaaacgattgtggctgccattgtcatgtatgcggcgattaccgctggttatcaggccgcgttgatggcgccaaccgaaattttggctgaacaacacgcaaataacttggcccaggtctttgccgacacggatgtcaacgttgcgctgttaacgggtgcgaccaagccagctgcccgcaagacattgttagcagcgctggctgctggtgagatcaacttattgattggcacgcacgccctgatccaggacggggtgacttatgctaatttgggattagttattaccgatgagcaacatcgctttggggttaaccaacgggccgcctttcgtcaaaaaggcgggcaacctgatgcactagccatgacggcaacaccaattccaaggacattggcgattacggcgtatggtgaaatggacgtttctgaaattgatgaattaccggctggtcggcaaccgattcaaaccacttgggtacggagcaaccaagctaattcggcgctaagctttgttcatcaacagattgacaatggatcgcaagcctatgtggtgacaccattgattgaggaatccgagacgctggatgttaaaaacgccgaggctctgtcagctaatttacaagagtattttggggcgagtgttaaagttggactgttgcacggtcgaatgaaacctgaggaaaaagacgcggtcatggcggcttttaaggcgggagacattcagttacttgtttccacgaccgtgattgaagtgggtgttgacgtcaagaatgccacaatcatgatgatttatgatgctgaccgttttggcttggcgcaactacatcaattacgcggacgcgtcggtcgtgggaccaaggcttcatactgtattttggtggctgatcccaagaaccagcaagggattgagcggatgcagatcatgacgcagacaacaaatggttttgttttggcacaaaaagacttagaattacgaggagccggtgatgtgctgggggtcaagcaatcgggaatgccggaatttaaagtgggtgatccgattgcggatttgaccgtgctacaagttgcccagcaagatgcccacgcaatcgtgcagcaaccggattggcaaagtcaaccggataatcgggcactagccgcctatttgagccagaagttggctgcggtggggacgctcgattaataacctaaatacagtactgtgatgagaggaatggtgacacaatgattaaaattgcgattgatgccatgggtggcgattacgcccctaacgctgtgatcgagggggtcgagcaggctcgtgatttgtttgaggatacggtctttttattatatggtcaacgcgacgtgattaacgcgcaactgaagaaccgtgatcggattcaaatcatcaatgctgatgaagttattacgatggaggatgaacccgtacgtgccgttcgccgtaagaagcattcatcaatcgtaatggcggctcaggccgtgaaggatggtcaggcggacgccttcttttctgccggtaattcgggggccgttctggcagccgggttatttatcgtgggccggatcaagggcatcgaccgaccgggattagtgacggtattgccagtggtacgcaatgctaaccaatcgaactttgtgatgatggatattggtgctaatgctgatagtaagccactgaacttgcaacaatacggtgtgttagggacgtactatgcagaacggatgatgcaagctaagcatccacgggtcgccctactcaataacgggacggaagatgacaagggaaataaggtccataaggcagcgtttgaactcttgtcacagactgacggtatcaattttgtcggtaatgttgaatcccgggacttgttgaacggggttgctgatgtcgtcgtaacggatggttttacgggtaacgccgttttgaagagcattgaaggtacggcgcgttccatgctcggtttagtgaaagatgccgtctataacaccggtatcagtggcaagttaggcggcctattgcttaagaatgggtttaatgaaatccggtctcaaatggactattctcagtacggtggcgcggtcttactaggattgaaggcgccggtcgttaagacgcacggttccagcaaagcgccaacaatcgtgaatactatccgtcaaattcgccagatggtcagtacggatatcgtcccaggagttgcggaatattttgctaatcaacaagctaatcagcaagcaagtgtagacattcctgctgaaaacgattagaatactttagtgaattcaagttagtgagggatctttacatgacgaaagaagaaattttcgataaaattgcggatatcattgctgatcggttcgaagttgataaagcaacgattaccaacgaaatgaacttgcaaaccgatttggatgctgattccatcgattttgttgagtttgtactggaattagaagacacctttggtagcgaaatctcagacgaagatgccgaaaaattgtcaacggtcggcgaagtcgtcgattacgtggcagcgcaccaagcaaaataagttaattgaccaagcaaaaacaggtagccaacatggttacctgtttttacttgtctgactacgaaagtaccgatatcattgttattgaccactaaatcatagtataatgttatgatatgcaatgtgtgacctgttgactgactgattatcagatgaatccttacttaagcggacctttaacttgtgtttctattttgttagcttctgatcatccacggtcgactgccacggctgggtgagactgaacattgcgtgtaagagtagcactaaatacatgtcggaagcactcgaacggcagatgaatgaccaccttaaataatgattcatgctaagttaggcaccaccagtaacagattgtgataactggctgatccaatggggttagtcgatagaatgataacgaaaggaagtttcaaatgattacagaattagctgcaatgttgaaggaacggtttggcattgtgtttaacgatcccgatttattggcggaggcgtttacacaagcctcgtatgtcaatgaacatcaggaccaacagttgaagtattacgaacgggtcgaatttttgggggatgccgtcttggagttagtggtgtccgaatatttatacaaacgttataaagacatgccccaaggtaagttgactcgtttacgggccgccatggtttgtgaagaaagttttgcaagctttgcccgtgaatgtgactttcctcagtacatccggttaggcaagggcgaacaaaaagcgcatgcttgggaacgagattcacttttatgtgatatttttgaatcatttgtcggggcattgtacctggatcaaggacgggaacctgttttgaagttcgttcatcaagtaatttttcctaagctggatgagggtcgttttgatggcgtttttgattataagacgaccttgcaagaatacttgcaacgggatggcgatgtcgcaatcgactatcaattaattgaacaagatggtccagccaatgagcggtcttatgagattgccgtacttgccgatggtcaaaaaatcggtgagggctgggggcattccaagaaggaagccgaacagagcgctgctcggcaagcttattcacaattacagcaaaagtaaccattaataattacaggaagtttgtgtcgaatgcaacttaaatcattagaaatcagcggatttaaatcatttgctgataaaaccaaaattgattttcaagccggaatgacgggaattgtcggcccaaacggtagtggtaagagtaacattattgaagctattcgctgggtcctcggagaacaggccgtcaaaagtttacgcggcactaagatgaccgacgtcatttttgccggctcggctaatcgaaaaccgttgaatatggctaaagtcacgatcacgtttgataacagtgaccactttttacctttggattacgcagaagttagtattacgcggaaactctttcgtaacggtgacagcgattatttaattaataatcagagttgccggttgaaagatattacgaatttgatgattgatactggtctgggaaaagactcattttcagtgatttctcaaggtcgtgttgaggcggtctttaatgcgaaaccagaagagcgccgcagcattatcgaagatgtcgctggggtcttaaagtacaaaaaggataagttcacgacggagaataaattagcggaaacgacggattatttagaccgcgtgaacgatatcattgctgaattgaatcagcaaaaggggccgttggaagaacaagcgagtcttgcccgggattatcaagatcaaaaacaaaaatttgattatttggaccgttcgcggctcgttaagaagttgacgattgctcgtgatcaactgcaaggtgtcaatgaaaagttagctagtgccaaggcgttagtggctaagtatcagcaacaagttgatgctggggcaaccaagctagctaatttaaaaacccagcagacagctcaattaaagcaaaaagatgagctggtagcacaaaatcttgagctgattaagaccatcgaaaacacgcaaggacaacaaggggttgacgctgaacggcggcaaaaccaacagtctgagcaggaacggctgacggccagtttgaccgcaactgagcaacagattgcgacgcaaaccgagcaacaaacccaattagaacaaacattatctgagcagcaagcccaagttaaggcagtcaaagcgcaagttgccgagttaacgacggcaacgagtgcggccggccgtcagcagttggctgatgagctggaaaaattacgcaatgcttatattgatgaaaaacaagttcaggctgaactgaataacgaagcgaagaacctcgttaagcaacatcaacagtctggcagtcagagcacagcgttagcagaacggctagctcaggctcaggctaacttgaaacgggtgcagacgaccgtggacgtgcacaatcgtgagcaacgtgatttagaaaatcaagtcagtcagcagcaggccacgctaacagcccaacaagcccaagtaaaaacgaatgcagagcggatcgacgagcaacagcaacgttggttagacgcggctggcttgatgcagcgtgaaaagtcacggctagaggcgttgcaagctgttcaggaacgctatacgaacttttatgcgggcgttcgaatggtcttacaacatcgccaacagtttagtggcgttgccggggccgtttcagaactcctgaccgttcctgatcagtatactaaggcggtcgaagttgcactgggcggacagttgcaaaatattgtttgtgacacacaacagacggctaaaactgttgttaatttcttaaaacaaaatcacgccggtcgggcaacctttttgcctatcgagcggatcacggctcgtcaacttcccgttaacactgagcgcgatttatcacaacaacctggtgtgttgggcgtggctagcgagttggtcgattgtgaatcacgattgacggcaatcaaacgttacttgttaggaacaacggcgattgtggacacgctagaccacgcgatggcaatttcacggagcagacgttttcggtgcaaattggtaaccattgatggtgaaacgattgcggccagtggggccatcaccggtggtgcgactcgccatgatgataatgggctactccaacagcaacaatccgcggaaaaaattgcagctaacgttgcccagatgcagtctgaattagtaacctatgaacaagggctagcagaccttaaaaaagctaaccaagacttgacggttcaggttgaaacgacccgccaacaactaagtgaacttaaggatcgccttagtcagacacaggcccagttacaggcggcacagagcgagcaaacgcagctaagtcgtcaagttaaggctttaacttatgagcagcaacagacgcaagctgatgatagctatgaagacttagtggctcgtaatcagcaagcgcaagcggctaatgcggctaagcttaaagactatcaggaccaaatgaaaacagtccaacaacagcaaacggattacgaaagttatcaacagactcaaacgacgaaattacaagcccagcgtgaacaactgatcacgttgcaggaacacgtgaaacaaacgcaacgacaattagaacaatgtcaggcgaccttggcgcaaaatgaagagacgaaaaagcaaattcaagcggatttagcagcaattaaaacaacgttagcgagccagcaaatgtcggtcgcagaacgcgatacggtcttgaaaacagctaaggctaaacaggctgcggttgaagaacaacggaaaacgtgtgaacaacagctagcaacgcttaatgatcaggttgaagaattatcgacccagcaagttcggttgcaacaactcgcagcggccgcaacggatgattaccgtcgcttggaattaagccaaacaaaattgactggcgaagtcgaccacgccacggctgatctggctgaaaagtaccagttgacagttgccgcggcacaagctgacgtcagtgacttagcgttacctgcgattacggaacagttgaaactgcttaaacgaggcttggatgagattggaacggtaaacctcggcgcaattgacgaattcgagcgggtcaaggaacgctttgactttctcaataaccaagcttccgatttaactgaagccaaggaacacttactgcaaacaatggctgatttggatacgaccgttgccacccgctttaaaacggcatttgatcaagtcgctagcgaatttagtacgatttttgaacagatgtttggcggcggtaaggctgaattgatcttgaccgacccagaacatttattgaccagtggggttgatatcatggcccagccaccgggcaaaaaatttcagcgattaagtttactttctggtggggaacgggcgttaacggctattacgttattatttgccattttagcagtgcgccccgtgccattcagtatcttagatgaagccgaagctgcgttagacgatgccaacgtggatcggttcagtcagtatttgaatgattttcaaacgggaacgcagtttgtgatcattactcatcgaaaaggaacaatgatgcacgctgacgtactttatggggtaaccatggaagagtcaggtgtctccaagatggtctcagtctccttggcagatttaaaagatgaacaaaaataattaaaggaagtgttgaagatgggactatttagtcggttaaaaaaagcgtttagtttaccagaatcagatgacgctcaaacaacgtcagctgccagtgaagcacctgcaacgacgagtcaagctaacgcaccggtcagtgacgaccgggccccttcgtcacaacagttagctcgctcggagggcgcaacaactgaatcaactgcgacaccggtgtccagtacagccgtaagcgaagcgacaagcactgcggacgaaccagcgacagtaaaatcggcagctactagtgaagccccggccgatagcacggcggcagtgagtgcacagtctggttcacaagcaccaatgcaatcggcgacggtgtcggaagcgccactcacagccagtgcaatggttgcccagtcactagctgcattaagtgcgagtgcggcacaagttagtcaagcggccgcgagcgacgtggcgttagcgactaagtctgatgcggtagttgaaggcaacgctatgtcagaatcagtagctagtacggcgccagcagtcaagtcatcagcgccaacagcgactgaatccgccgcaccgactgttaatgcggcggctgattcggaatcggctgagccggagccaactgaggcagaacgttatgatgaaggactgaaaaagtcgcggaaaacgtttggtgatcgtatcaatgccttcttggctaatttccgccatgtcgacgaagcgttcttcgatgatttggaagatacgctgatcgaatctgatgtgggttatgagaccgcgatgcgaattagtgacgagctacgtgacgaagttaaattaaagaacgcgaagagcaagaaagaaatttcaagcgtcatcgtcgaaaagctcgttgatatgtacggtgaagctggtgaaggcgaggataactcgattcacatggctaagagtggtccaaccgttattttatttgtcggggtcaatggtgctggtaagaccactacaatcggtaagatggcgaacatgtacaagcagcaaggcaagaaggtcttgttggcggcttgtgatacgtttagagctggtgcaatccagcagttgcaagtctgggggcaacgagacggggttgacgtggtcgctaaggccgaaaaaagtgatccagcggccgtttgctttgacgcggttaagaaggctaaggccgaagattatgacgtgctctttgtggacactgctggtcggcttcaaaacaaagtcaacttgatgaatgaattggaaaagatcaagcgggtcatcacccgtgaaatccctgatgcaccacacgaggtcttactggtgctggatgccacgactgggcaaaacgcgctgaaccaagccaagttgtttaaacagtcgacggatgtcagtgggattgtgttaactaaacttgatggtacggcacgtggtgggatcgtcttagctattcgtaatgaattgcatcttgctgtaaagtacgttggtttaggtgaaaaggtgactgatttacgaccattcaatgccaatgactttgtctacgggttatttaaagatattatcacgggttaaatcagttgatgatggtcttaaattgaaagccagttaacgaaatggtaattgttctcagcacgaggacgattaccatttatttttaccacaaatagcgactgatagttgacgaatggcgataaaatcggtactcttatttagtgtgtagtctgtatgataagcgtgaggagtccccacatggaaattgaaaaaaattatcgaatcaattcgttattcgagttttatgaaccgttattaacgaataagcaaaaagcctatattcaactgtactacgctgatgactattccttaggcgagattgcagcagagttctcagtttcgcgccaggccgtctatgataacatcaagcggaccgaaaagattttagaaggttatgaggctaagctgcatctctaccacgactttgtggaacgtaatcacgaagttgacgcgatctctgactatattaagcaaaattaccatggggatacccagttaattaagatgattcaacaactagtcaacttggaagctgactcagaataataataaaggttaggtgacactaatggcatttgaaggcctaacggaacgtttacaaaaagcaatgaccaatttacggcgcaaggggaagatttcggaaagtgatcttcgagcaaccatgcgtgaaattcggttagcattacttgaagccgacgttaactttacggtggtcaaggattttgttaaaacggttcgcgaacgtgcgctcggcgcaaaggtgctggaaggtttaaatccagcccaacaaatcgttaaaatcgttgatgaagaattaacgaaaacaatgggtgaaaaggcagttccactgaacaaatcgccgaagattccaacggtcatcatgatggctgggctccaaggggccgggaaaacgacgacggtcggaaaattagccctcaaattaaagaacgaacaggatgcccgaccattaatgattgcggccgacgtttaccggccagccgcgattgaacaattgcaacaagttggtcgccaaatcgacgttccagtcttccaactaggaaccgatgtcgatcccgttgagattgtgcgtcaagggatggcacaggcacaagaaaaccacaatgattacgtgtttattgatacggctggtcggttacaaatcgatgagcagttgatgaacgagttggccaatattaaagatctcgttcatcctgacgaaattttgttagtgatcgatgcgatgactggtcaaaacgccgttaatacggcggagggctttaacgataagctggatgtgaccggggtcgtcttgacgaagttagatggtgatactcgtggtggggctgcactatcaattcgggccgtcactggtaagccaatcaagtttgtcggtcaaggcgaaaagatgactgatcttgatgtcttccatccagaccggatggcggatcggattcttggtatgggtgatatgctgacgctgattgaaaaggcgcaacagcaatatgacgaaaaacaagccgaagaaatgaacctgaagattcaggaaaacacttttgacttcaatgactttatcgaccaattagaccaagttgacaagatggggaacatggaagatatcatgaagatgattcccggcatggctaacaatccagcgatgaaaaatatcaacatggacccgaaagacattgcccatatccgggcaatcgtttattcgatgaccaatgccgaaaaagcagatccggatttgttgaacccatctcggcgtcgacggattgcggctggttccgggcggccaattcatgaagtcaaccggatgatcaagcaattcaaccagaccaaaaagatgatgaatcaaatgtccaaagggaactttgctggtatggaaggtctcatgggtggtgccaatggcggtggcggtatcggtggtaagatgcaacaaatggccatgaagcgaatggttcgtcaaactaagaagaaaaaacaaaagcgcttagccaaagcaatgcggcgtcgcaaacgctaatttataagtttttttagcctgtcaagaaaaagtcctttacaagctattgatttactggtatattattacctgttaaagaattcgggaggtgtttaaatgtcagtcaagattcgtctaaagcggatgggttctaagaaaaatccattttaccggattgttgtcgcagattcacgttcaccacgtgatggtcgttttatcgcccaagtcggcacatacaacccacttacagaaccagcccaagttaaacttgaagaggaagatatcctcggttggttgaacaatggtgcccaaccttcagatacggttaagaatatcttatctaaggccggtatcatgaagaagtaccacgaagctaagttcactaaataataaagcggtaatagatcatggcagatattaaagctttaatcaccacggttgtcaccccgttagttcaatatccagacgatattaaagttgattttaaggaaaccacgcgttatcttgaatacaacttaacggttaatcccgaagatatcggccgggtcattggtcggcagggacgggttgcttcggcaattcggacaattgtgtatagtgtccgagtttcaggacctaaacgtgtccggcttacgatcgaagacggacaacaaaaaaactcttgagcgaagcagtgatgttttgtttaagagtttttttatatcttgttccggtttttgaggacgagtcaaagtatctcgatgaccgtcgttgagtagattagttgtaacatgttgatgacatttaaaacgaataacaatcaagctaattaagaggaggaagctaatggattactatcgtgttggcaccctagttaacacccacggcattcgtggtgaagtgaaagtcgttgtcgtgactgattttccagaagaacgctttaaagtagggcaacaattgaatttatttaaaaccccagatgaaacgactggcgggattactgtcaaaatcgcgaaggcccgtgagcaaaaggggctgtactttcttacctttgaagggctcgataacatcaatgatgtggagcgctataaggggtggacgatcaaagttcctgctgaagcattacatgccttaccagcgggtgagtactactatcaccagattgtcggcctacaagttgtgacgaccgctgacgagcctttagggactattaaagagattctgtcacctggtgcgaatgatgtttgggtggtcaaacgggatcatggtcagtctgacgtcttactacctaagattccccaggtcattaaagatgttgacttggatgcgggcgtggtgactgttgaactaatggaagggttgattgattaatgcaaatcgatattttaagcctgtttccagagatgtttgcggggccgcttcatgagtcgatgattggcaatgccattgaaaatgacgtcatcaatgttgatgtcactaattttcgggattttacgaccgacaagcataaccatgtggatgattatccgtatggtggtggtgcgggcatgttactccaaccacaaccaatttttgatgctttggccagcgttcaggaaaaacacccggcacccggtcgcgtgatcttattggatccggcgggagtccagttcaatcaacacgttgctgaagactttgctcaggaagaacacttgacctttatttgcggccactatgagggttatgatgagcggattcggtcattagtcaccgatgaagtctcgctcggtgattacgttttaactggtggtgaactgggtgcaatggtcatgattgatgcgacggtgcggctcttaccaggtgtgcttggtaattcggaatcggctccgggggattctttttcgagcggtctcctggaatacccacaatatacgcgtcctgctgattttcgtggtatgaaggtaccagatatcttactgagtggtgatcatggaaaaattgatgattggcgcttagaacaggcgctgaaacggacctatgaacggcgcccggacatgttgacggggctatcattgtcaggaaaagctaaacagatgttagcagatatcaaggcggatgagtcggaagtgtaggctatgccgttaattaggacaagttagtcgtgaagagttcaaaaaaacttgcgtgcccaccctcgaatatggtattctatttattggctattgtgcccattaacgatgttccgctgaccaggttgtcacgaatgtcggcgaaaggaagaaatacattatgcgtcaaaaccaattgatcgaaaagatcaccaatgaacaacttcgtacggacatccctgatttccgtgctggagatacagttcgtgttcatgcacgagttgttgaaggtactcgcgaacggatccaattatttgaaggtgttgttatcaagcgccatggttccggtatcagcgaaacttatactgttcgtaagatcagtaacggtgttggtgtggaacggacattcccattacacacaccacgcgttgccgcaattgatgtcgttcgtcaaggtcgtgtacgtcgtgccaagttatactacttacgtaacttacatggtaaggctgctcggatcccagaacgtcgtcgtggctaaatcacaacgtcaacaatcatcggttgcagcttaggctgagctgatgatggaaagctagttaatcatttttaatgattaactagctttttttattggcgaagttagtgacacgctcaatcgtcaaatcatcgaccaatttaggtcggttcacaatgtgagcatgctgtgcttggatttataatttaacaatcttacgagatagctcgtaattcctaatttgaagtattatgatagtaatacgagtacgcgatgcttcttgggatgcgtcaattagctgaatatgaatcacttgatatcagactaaactgatttatttgaacagggttgtcgcgtacctgacgtgtataactagtgctaagctggcggccgggttaactaaacgggagattgctcaaagcgagcacgataaaataaaagagagttaggtgaaagccgatgtttggatgtacggggaaacatcaggtcgatgaacaggcgttattgagtcagttagttgacttcgttctcgacactagtcttaccgaccgtgaacgtaaaatcgggttgatggccaaagccgatttggagcatcatcgctattcaattgctgtgttaaataaattagtggttagttttcaaatggaggcgctacgcaacaagggcctttcgaaggctgcttcaaacttttatgatcagatttatccaatattagtcgcggccaaaccaatgggaacgaatttaggctatattgggatgcatagtacctatttagattagggtgtgtcagtgatgaagttactagcgaaaccagaccgtcttcagacggctgacgatggtttttgaacgtaagaggctggcgttcatcggaagtgtgttggtaacagcttaaatgagaacatcgtgcgcatgtccgtgcccctttgaatgaaacctattcagaggggctttttggtgtggaaaaacagttcatgatctgcgcgtcttaacaatattaggtgatatggttggcgggcgataaaaattgtttggtgctgctaaatagctggtaaacgattttggccgtagaacaaatgctatacattgtttgataagtaccgaactgggatgtggatgagccagattcaaaataagtgtgtcaatatgttggttatatcagtattttaatgcagtgttatagcgtgaactgatactacaattaaataatctcaaaaataatttcgtctattttttgttatgcacttgttatttcaacttatttgaacgcatactaatgattgaaggggtcaattaggtgatagtttgttgattaacacaatcgtttcggcacggtacgaaacgcaccaaatattactcagctaaataacttgattgctccaggtacggttgaactttggaggcagaattatgcggaatcgtttaaataagttgggattggaaagtaagtctcactataagctttataaatcggggcggcgctgggtggctgctagtatcacagtattttcagttggcatcggtttgacttttagccaagttgaacaagtgaaagccgcaacgggtacgggggttgacacggccgacaatagcgctagcgttagttccgacatggcagaaccgagcaatgccgtcgtactaaaatcagctagtacggcgacagttactaagaccgcgactcaggatgcaaaagctgctactgatgtaacggccgcgactcaggatactaaagcgactactgattcaactggggcaacatcagcttccagtaatcgtcagtcgacagcagctacgaagccagctgccgaagtcggtactgcttcaagtcgcgctgactcaagtgctagcatatcaagtactgatggcgcaagtgctagtgcaccaagtgtcaccagtaaatctactgacacggaagccacatcagcatccgtaactaaaacggctactacgagtgctgacacagatgtgctaaacactgagacgacaagttcatcagtggcaaatgatctcactgatgctacgacagctagccaaacgcgtacggaaactgggaaaacagccagcatacctactgctgaagcaccgaccattacgactgcagtgacaagtcgggcactcccattgacgggtgcgctagcgagcaggtcagcaaacacgccggtcactaagtctacagtacaggcggtttcagctatcaccagtgaagctgaaacgaagccgaccgtatcgttagtaactacggggaccgtgtcgatggactatggcgaggcgtcgctggcggatctagaatctcatattagttctccagatgagacgccggctaacgacgtcgcctactacattcaagatgcagcgggcaattacttagaagatgtaaacggcaacaaggtcaatttgctatatgcactttttctggactctgctgatgtcaatgattacgttgatgttgtgtatacggatgaacatgggcaggtcacgaaatattccggagatacggacttttcaacgctcgaccaaattggtagttactcagtgacgatcaatgcagcgggtaaagctgggatgagccgggttatgcaagactataatgcttacgatacctcgaccagtgatttggatgactttgtcccaaccttttcgactggggcctccgattatacctttacaattaacattgtccctgtaaaaatcacagccaccactggtaagaatgggctaattatacttcggccttcacagttgtatacgggatcattgacaatgttgccggtagtcaccgttaaaaatgcaacaaagcaaaatatccttcaaattagtaacggcgaaatcggcgatgctaaaccaggcgtagccggcaaggtcggtcaacgtgttttaacgttggcagattttacttatacgtatcaaggcaccgaaactaacttgaccggtgcggacactggcaaatatgcaatcacccttaatgacgctggtgggaaggcagttcaagctgcgctggggtcgaattatattctggatgatgcggcagttttcaccacgattggtgcggtgcaggctgctggtctcaggttaacgatagccaatgatacagtgacctataatggcaagcctcaggggacatccgtagctgtaacgactggaaccgtgtatgatcactttgattttactacgacgactgacacgaacgtcggtacctatgacaacctgacatacgcgttagcggatcccacgcaagcggcgattttggttaaaaactataccgttaccacgacggatgggacgttggtgatcacgccagcagatctgacagtcacggtcaaggatgataatgcagtttatgacggccgagcacatggcacgactgcaactgttactagcgggaccaattatgatcagttagcatttaccgcagttgcagcagatggcagtggtgcgacgacttatactacggtcggcacttatgcaatgactgggactacggcagccgataccagtaattataaaatttcgtatgtcaatggaacgctgacaattgatccagccaaagcaacaattacgattcccaacaagatttattggtcggatgggacgcaaaagaatttggcggcggtggttactgggacagttaatggtgagaccttaaagtatcgtgtgaccaacggcatgagtgcggttggaactaagacaattacggccactcctgatgctgatgattcggtgaataaaaactataccatttcagtcattcctggcaccttgacaattggtgatattgcggttaagtacctctacgaacatgtagatgctaatggtgagactcaggtagatgcttcggaaactggtacggcgacacatgctacggacgcaacggccacggactatttgacctacacgacggcagccaaacccaagacgggctatgtgttagcacccaatactggactagcctataatggcacgttaactgatcagggcggtaccgtgacgtatcgttatttggccaagactgaaacggcgatcgtaacgtattttgaccaaactgataacaaggttattaagacggaacccttacaaggagcgtacgggacaacggatgcgtatcggacggctgatacgattgccgcgtatgagaatgcgggctacgacctggtcgatgatgactatccaacagccggggtggtctatgatcaggacggcagtgttcaagagtaccaggttacgcttgttcataaatttgtaacacgcacgccagataatccgggtacgccaggtgagccgatcgaccccgataatccaaacggacccacatatccagtggggactgactttgaggatttaactgagcaagtcagtcaaaccattcagtatttatacaaggatggtcgcactgctaaaccgaacaatgttcaagcggttaattttggtcgtaacgtcacggtagatgaagttaatggcacagtcgtctacacagattggttgactgatgatggggccgtgactggtcgttttaaggccgttgattcacctttgattactggttatacggctgacccaaccagtgttgcgggtcgtgatacggtgagtgggacggatctcagtccagatgtacaagtttattatcaggctaatcctgaaaaagccacggtgacctatgaagatacgacaacgggagcggtgctgacgacagatccggtaactggtgattatcagaccgtctcgaattatcggacagcagatcgaatcgctcagtaccttaatatgggctatgaactggtcagtgatgattatccaacatccggtgctgtgtttgataaagacggaagtactcaggcttatactgtcaaattgcaacataaactcctgccgctcaccccagagaacccgggtacgccaggcgagccgatcgaccccgataatccaaacggacccacatatccagcgggtacggctgtgcaagacttgattaagcaggttggtcaaaccattcactatcagtatcaggataaaagtactgctgccgacgctaatacgcaaacaatcactttcaagcgcagcgtgacggtcgatgaggttaacaataagctaacttataccgattggttgactggtacggcaacgactggtcattacatgccagtcgattcaccggaaattaagggctatgttgctgattcaacgcgtattgcgggtaatgacgaggtgcacaatgcggatgctgacacgaacatcgtggtcacgtatcaggctaagccagagaacgccacggtcacgtatgtagacgtcactacgggtaaaacgctcgctataaaaagcttgactggtgactatcagactacgtccagttaccggacggctgaaacgattgcgagctatgtcaagaatggctatcaactcgtacgtgataactatcccacttcaggggcggtgttcgacgtcgataattttgccaaaacttataccgtgacactgaagcataagttagccacggttacaccagagaatccgggtacgccgggccaaccaattgatccggacaatccagacggaccgaaatatccagtaggaacgaccgctcaagatctgacgaaacaagttagtcaaacgattaagtatcggtatcaaaatggggcttcggctggcactgacagcgttcaactgattacgtttaatcgggatgccacgattgatgaagttgagtctaccgtagtttatactgattggctggatgggacttcagctactggtcgttataccaccgtgacgtcacccgtcattactggctatacggctgataaaacacaggttgctggtcgtgattcagttgctaatacagattcagacacacaggtggtcgtcacctatgcggcaaaacctgaaaaagcaacggtcacttatgtggatgtcacgacgggtaaaacgctcgttacggccaatttgactggtgactatcggacacaatccaattatcggaccgctgaaaccattgcaggttatgttaaaaacggttatgaactggtacgtgataattatcccgtatcggggatgctgttcgatgtcgatgattttgctaaaacttataccgtgacactgaagcataagttagttacggttacaccagggaatccgggtacgccgggccaaccaattgatccagacaatccagacggaccgaagtatccagtaggaacgaccgcccaagatctgacgaaacaagttagtcaaacgattaagtatcggtatcaaaatggggcttcggctggcactgacagcgttcaactgattacgtttaatcgggatgccacgattgatgaagttgagcctaccgtagtttatactgattggctggatgggacttcagctactggtcgttataccaccgtgacgtcacccgttattattggctatacggctgaccgggcgcgggtcacgggaaacgatgcagtaactagtgcggcgcaaccgaccaacattattgtgacgtatgcgattaacgcagaaaaggcgacggtcacctatgttgatgtcaccacggataaaacgctcgcgaccgtcagtttgactggcgattatcagacatcatccgattaccgcacggctaacacaattgctgattacagtaatcagggctacgtgcttgtccgcgatagctatccagtttcaggagctattttcaatgatgatggtgtcgttcacagctatctggttcagcttgcacatgtgacaactgcgacaaccgagaccaagacaatcacgcaaaccgtacattatcagagtacgactggcacgtagttgcacgatgatacggtcagagcgatgacattcactcgtactaaacgggttgatcaggtcaccggggacgtaacgtatagcaattggtcgactaatcaggcggatcacacttttgagcgcgtcgcggcgttcagtattccgggctatcatgcggtggtaatgggtactcaggcagtcatggttacgccagctagcgtggatgatgttcaaacgattcgttacgttaccgataggccttcaaccggtgagacaccaaaaacaccggtgaagacggtgacagttaataagtcggataaaattaagacgactgacacgccagataaagtcgcaacggtcaagacgccggataaggctcagaccgtcgcaacaacaactgctaaacaagctagcgtcaagcggtcagtggatctcaaacaagcacaggctgttgaacagcctgctcagacacgaccagccaatgtaaaaacggttaaactggcgaagacgactaaatccgttaagccaaccgcggctcatcaatcagccacccacaaacaagcgactttaccgcaaaccaatgataatcggcaagctagtgttgcggcggaactacttggtttgaccgcagcaaccttactagttggtgtgagtgcaattttgaagaaacgtcataattagccgttaaatggaggcgttaatatgactactttaatcgatatcacgggtcagaagtttggccgcttaacagtcattagacgttgtggaactgccaaaaatggcaatgccctctggttgtgtcagtgtcgctgtggcaatcagaccaaagctgattcgtacgcgttgcggcatgggcgagcaagaagctgtgggtgtttgacacgagaaagtcggtcgcagttaattcgacgtaatcccaaaacggctgccagtatggggcggttaagcaatctgaaaattcatgatcatcacactgatttaccgtcaaagattatgtctaagcgtaataagagtggtgtcatcggtgtcagctgggatagcaatactcaaaaatgggtggcgacatttttctacaaggggcgctacctgttacacaagccgtttcagcattttgaggacgctgttcttgcccgccaggcgatggaaagccgttatttaaataacaaagtgtaaattaaagttcttccttgatagggcctgatgccttgtcagagaagaacttttttgcgttacagcaacggtaccagcttcttaattggacttagtggagttctttcagaattgtaagtaacaaaaaggcctaacatgggaatgccagcggataaattgtgcttgatttatggagatgaaaattcctaaatgatttgcttgtatatgacaattattaaaaataagacggtccctgatcgaactagaatcataagtatcttgggggcaggtgatttaacggttcttggttgcaatatgttttttaatcaacagtctgatgaaacttgccctagaagttgaggttaactgatgcttctggatcggtgaaatcgttagtttcgtgatggaactagtcattggcgacagaagcgttaatcaatgagcaacgtaccgctccggtttcgaattttcggacgattccggtataataaacgtaactgatgactagggggataatcacatgattgaaattcacgaattaacgaagcgttatggggataagacagcattgaatcagcttactttaaccatcgcatcaggacaaatcttcggtttgttgggccacaacggggcggggaaatcaacgacgatcaaaaatttagtcagtatcattaaaccgacgagtggcacggttacggtcgatggcttagaccttgaacagcaacgacaagccgtcaaagaaaagatctcttacgtaccggacacacccgatatttttcttcaactttcggcgatggaatattgggacttgatagctgccgcttaccagcaatcagaggaagccgttcagcaacggcgacagcagctggtgtcactgttcgatatgactgaacacgttgacgaacccatggctagttattcacacgggatgcggcaaaaagccattttgattggggcgttgcttcccgatccagatatttggattttagacgagccgctgcaagggttagacccccaagctgcttttgatttaaaaaatttgatgaaggcccatgctgccaaaggcaagacggtcattttttccacccacaatctggatacggcgcagcagttatgtgaccgattggcaattttgaagcaggggcaattgatttataccggttcggttgaacaattactagctcaacatccgcaacaatcacttgaggcgatatatttacaaatggccgggcggttgacggatgatcaccttgtcgatgcgctggagggtgagcatgatgcataaaagtcagttacgtgttttgttggctgttaatctcaggttgttgaatccgcaactaacggatcggctacgtaaaaagggcgcttcggggccagccttgagtaagaagctaatgcggcaattttacttgaatgccttgatgtttcttggcatttatggcttgacgatgttggcctttgattttagcaagttgccaggcatgtttacgttctatgtggcgttatttatcttattgggagtttcacagagtatctccggtatttataacgtcttttttgccggcaatgatcttgttgaatacttaccgttacctttccgcaatcaagaaatttttatgagtaagattttggtcgtgatattcaacacggtaccctttaccattccgttacttttaatttttatcatgaccgcaacacgggccggaatctttgtggtgttaggtgtgctgatggccgtcttgatgtatggcctaatactgagtctgttactatgcttgtgcgccctaatagtttttggcttaaccaagctaaccgtgtttcgcgcccatcaaaaaatggtgatgaacgtcatgttaggccttaacgctgtcttagtgctagtcgggctctacttcatgaatcgcggctcatcatctgacaccggaacgcaggttgaccgcgcagcattacccctattgataccgatttttaaagttttcacgacgccgttgacaatgacgagtttgctaacctgggcgagtttaattgtcatctcgctgattttgttcgcactgacaggacggtttgttttgacccacttagcggaacagcttacgcaagtcaactcagtgttagtggcaacaccaccgcgtcgacattcacgacaacataaccgcaataaaattttgcgtacctaccagtttcagttactgaaagaacccagtttagccttacaattattcacagattcaatcctgctgccattgattttagtcgggaccgttttcttttcggggaccgctcctaattttagccggctatcgctgaactggctcggtgtctggtttgtcagtgggatggccggtgcgatcgtcaatgttaatcaaacctcattagtcggtaatctcatttcacttgataaaatgaactttgactttgtgcgtgcactgccaatcccaatgtcccgttacttacgacaaaagttttacttgggttattggttccaggtcatgattaatggcgtgatggttctagtggtgggtatcgctgggcgagcaccattagccctagatttggctctaatattgggcgctgcttgggggacgtacctagctgcccaacattactttaagcgtgattatcagctacggctgacgaattggactaatgtgacccaattgtttaatcggggcggcggtaatcttggtttgatgcttaacttgttggcctgcagtattgtgggtgtgctgacaattgtgatctatagtgtgctgattcagctgttcgcggcggcagctatgctgattaatatcattgtattagttggcgtcggaattatttctgctggtttggtctggcattactacaagactttttggcagcaacttgactaataagtgttaatttcacagtcacataatattaaattaagataaaagtgttgacaaattgctcattgagttttaatgttaatgacaacttaatattcgtccatgaaaccgatgaagtggagatcaagataatgatgcccgtaaagagagtcgccgttgctgagagtgcgatcgaacgcaaattattaaatggaccactgagggcgcgactaacgaacagttttgttctactacctcgcgacgatagggagtcgtcaattcccgggaatgtgtttgcatttcgctaagctgggacccaagtctaacctgaatggggtaatttggtgtccaaccaaggtggtaccgcggaaaaatccgtccttgactgtcattagtcatggacggatttttttgatagggggcagttcaatgcagcaacgatggcaattaaccacaactcaagtaaaactatcttattaatgaggagtggttcaatatgaatccaacattaccaaccttgattccttatcaggatcattatccctacgtaccagtgatggtcaaacgaccactcgtcacatttgaccctattgcggttgctaaaattatccaccagatggggaacggtttcgcgctgacgattgatcggcaccaacgatatagctattttagttttaaaccacagcgaagtctcacgggtcggcaactagccaagcaccaacgaccagctaatgagacactccaagccattctaaaccaatatcgaacaccacgaattcatggattaccaccatttacggggggcttgataggatacttcggctatgagtatgttcaacaatttgtacccaagttgcatttgaaatcaccagcaaccgcagatctcgatgacttaggtttattcttagttacgagtgtgctcgtctatgatcatcgacatcatgagcttgggttgacacagctgattccaactgcggatttagcggcaacttacgccgtgactcaaacggctctaacgcaacagttagccgccattattgaacaattgcagcaaccaatagctttgccaccatttgacttgcagcaaccattacacatgcaagtggaccaagcgacctatgcgcgtcaggttgaccgaattcgccaacacatctacgctggtgatattttccaaatgatatatgctaatccatgtttggggaccatgagcgggtcattgctggcagtttatcagcaacttcaaaaaacagcggccccgtatacctgttattttaaacaggctaatttcgaaatgacggtggcctcaccagaaacgttagtaacgaaggatggggaacaagtcgcgacgtatccattggccgggacgagacgccgtggtcgaacacctgccgaggatcggcagttggctcatgaattacaaaccagccctaaagagattgccgagcacaatatgttagttgatttgggacgtaacgatttaggacaagttgcaaagtttaaaagtgtccgggtgactaatttacggcgattaattcgttattcgcaagtcatgcacttagggtctcgagtggccgcagaagtggcgccgactactacagcactccaagtgcttgccgctacttttccagctgggacgttagctggcgcgcctaagattgaagcaatgaccctgattaatcattatgagcaggtgccgcggggtgtttatggtggttgctttggttacttggattgtaacggtaatttggacatggcgattggcatccggctggcctaccggataaatgaacggttggtgattccagcgggtgcgggcattgttgctgacagtatcggcgctcaagaatttaaggagtgccagaataaacaacgagtgatcgttaatgcagtacaagacgcgaaaggacgagttaaagatggaattattaattgataactatgacagctttacttataacttgtatcaactaattggtcgtctgacgcccgatgtacgggtcattaaaaatgacgatttgacggttgctgcaatcaaggcattacaacctgaccatatcattttatcaccagggccggggacgccagcccacacgggagttagtccacaagtcgtgcaacaattagctggtcaggtccccatattggggatttgtatgggattagaagtgatggtcaccgcttttggcggttcgctgcaaggcgcccagcatttagttcacgggcaagccacgttaatgcacgtgcagccgtcatcactatttaaagattgtccgatgcagttcatggcagcgcgctaccactcgttggtagctgatgcgggccgtttgcccgttaactttcgaatcattgggacaagcgatgatcaggaaatcatggcagtggaagatgtgggccgtcagctgtacggcgttcaatttcatccagaatcaatcatgacgccagccgccgttggtgagcaactgatccgtaattttttagcacttaaacattaagcagacgagagtggaggaatacttatgattgaaacagcgattgcacaactcactaaccaagaaaatctagactttacaatgagccaacaagtcattacggaaattatgaaaggtcaggccaccgacgcacagattgggagctttttgaccgccttagccatcaaaaaggcaactatcgatgaaattgctggtgcagcaactgcgatgcgttcccaggcgttaccttttaaagttaaacggcccacgctagaaatcgttgggacgggcggtgaccggtcgaattcgtttaatatttcgacgaccactgcgctagtggtcgccgctgcgggtgtaccagtgaccaagcacggcaatcgtgcggcgtcgtccaagagtggtgcggcggatgttttagaagcactcggtatcaaaatcgatctaacgcccgctcagagtctagcattgctagagcggaccaattttgcctttatgtatgcgcgcgaatatcatcaggcgatgcgatttgtcgctccggctcggcaacaaatcaagattccaactatttttaatatactgggtcccttagccaacccagctcatgctgagatgcaactattaggggtataccggcaagctttaatggctccattagccgaagtgttgacgcgtttagatgttaaacatgccatggtcgtgcatagccgagacggcttagatgaaatttcagcggcagcccctacggatgtgatcgtaattaatcatgggcagcaagtaacgcgaatcctgacgcctgaacagtttggactgacgcgttgtgaccatgcggctcttattggtggtagtgcccaagttaatgccgccatcacgcgggcagtactcactggagaaccgggggcccctcgtgacgtggtgttgatgaatgccgccgcggcgttgcatattgccaagccacagttggatctagcggccgcttttgagttggcccagcaaacaatcgatcaaggagcggccgcggctaagttggcccaattaattcagagtagtcaggcggtgatggcctcatgattttagatcaactcgtccaggcgagtcagcaatgggttcagaaggtgccagttagggagcgtgtgaagcgcattcaacaagctcgaaaaatgaccacccccgttttatcatttgaagcaatgctggcccagccgggcttacagcttattggtgaagttaagcgggcgtcaccttctaaggggctgattgcggctgagtttgactatttacagattgcgcaagactatgttgctgctgggatcgatgccatctcagtgttgaccgaaccccggtattttaaaggacagttgtcttacttacaagccattgcgcaaacggtctcggtacccacattacgtaaagattttattgtagctgctagtcagattgcgagtgctcgtattgctggtgctagtgcggttttattgattgttgctattttaacaccggttcaactgcaggctttcattacgttggctcatgagctgaatttaagtgcgctagttgaagtccatacaacggctgagattaagcaagcggtggcggctggggcccggattattggcattaataatcggaatttgaaagatttcagtgtcaattttgcaacgagctgtcagttacggcaagcagttccagctgagtgttatgtggtcgctgagtctggtattcaaacggccacacaggctcaacagttggccgctgctggctttgacgccatgctagttggcgaaacattgatgcgtgcaccagataaaggtcaagccgtcatgcaattgcgggcgggggtgcgtggatgactcaaatcaaaatttgtggcttaatgcgaccagcggatgtcgtgatggttaatcaagcgctcccagacgcaattgggatggtatttgcccccggtcgtcgacgacggattacgatggcgaccgcgcgccaactgtcacagcaattagatccgcgtatccggcgtgttggcgtgtttacaactaatcaattatcggaaattttagctctcgtgcaacaacacattattcaggtggtccagctacacgctaccgtcgatgatcctcggattgcgtcctcaatggccgcccatgtgccggtgattcaagcgatgacgccagcgaatgctacgcaatgtcaagcggattacttattattggataatgcccgtccaggtagtggacaggtgttggattggaatcaattacaatcacagcgtcccgtccggccgtttatcttggctggtggtttaacaccgacgaatatcgtaacggcaatcaacaaggtgtacccggcaatggtcgatgtggctagtggcgtcgagacggcgggcaataaagaccgtgaaaaaatcaatctgatggtccaacgggcgcaccaaacgggcgtgtcaacaccattattaacagaaattaggaggaattagtatgattaaaaatcaatcacaggcggggcgttacggcgactttggtggtcagtacgttccagaaacattaatgaccgagctacagcggttggatcgcgcctttcaacattaccgacaggacgcgcagtttcaagaagagttgactgacttgttgaataactatgcgaaccggccatcgttgttgtaccatgcacaacgattatcagatcaattaggtggtgctcagatttattttaaacgtgaggacttgaaccatacgggtgcgcacaagattaacaatgtcttggggcaggcactgttggcaaagaagatgggcaaaaagcgattgattgctgaaactggggctggacagcacggggtcgcaactgcaactgttgctgctttgttcgggatggaatgcgacgtctttatgggtaagaaagacacgaatcgtcaagcattgaatgtttaccggatgcaactattaggggccaaggtccacccggtcacgactggttcaatggtgctaaaggatgcgatcaatgcggccttacaagagtggacgcggcgctgtgatgatacagcttatatcatgggctctgcaacgggaccacacccatttccaatgatggtacatgaatttcaaagtgtcatcagtgtagaagcccgacagcagatcctggaccaaacaggtcatttgccggatgccgtcgtggcttgtgttgggggcggcagtaacgccattggaagttttgcggcttttcttgatgatacgtcagttgagctgattggctgtgaggcagcgggtaagggtgttcaaacgccgttgacggctgcgacgattgaacgtggtcggactggtatcttccatggcatgaagtcactctttttacaagataaagccggacaaattgccccggtctattcaatctcggctgggctggattacccgggcgtcggaccggaacatgcctacctggctgcgagtggccgggcgcaatatgtggggatcaccgatgaccaagcagtacaagcatttgaactgattgctaaggtcgaaggggtgatctgtgcgattgagagtgcccatgcagtcgcctacgtacaacaattagcaccaacgatgcgacgtgaccaaactattatttgtacgttatccggtcgtggagataaagatgtggcggcaattgcaaagtatcgaggggtgacaattgatgactgatttaacaacaatttttaaaaatcataaggcgtttattgcttttgtagtggccggtgatcctaattttgaagcgacagttgaccaagttgttgcgttagcagaagcgggttgtgatctcgttgagattggcattccgttctcagaccctgtggctgatggtcccgaaattcaggccgctgatctccgtgcgtttgaccaacacatcacaccccaacgcgtttttgaattggtggtggcaattcgagagaagacaactattccactcgtatttttaacctatgcgaacattgtttatcagtttggttatgctgcctttgcccagcagtgtcaaagtttgaatgtcgcaggcttgattattcccgacatgccactagaagcctctggtgaacttcgaccaaccttagaccactatggtattgctttgattccattgattgcgccaacgagtgatgatgcacgcatcgcagcgattgcccagcaggcgcggggcttcatttatgtcgtatcatcactaggtgtcacggggacccggcgacacatcatgactgatttagcaacactggtggcgaagattcgccatgcgactacgttacctgtcgcaattggttttggtatccatgagccagcccaggcccaggccatggcacaaattgcggacggggtcatcgttggtagtgcagtcgtgcatttgattgcgacgcaccaaccagcgacagcagtcttaagagactatacgcgacggatgcggcgcgcattggatggtcgcacggctgatacagttgactgatcttgtttgttacgatgttgttgtgccgggctacttcgattaaatgctgggaaacgctaggataatgtgctagtctaaaaacagcttactgctttgtgggcgtcgttaataatagttgacgctaaccaagccagttaaattaatttaaggagggctcaacatggcggatgtactgattattattgatatgcaagttggtgtctgtcgcgggtcccaaccggttgccaatttggcaaccgtgattgcgggtattcaacagcgcattacgagttatcgggctcaaaataagccaatcgtgtttgtgcaacatcacgatgctgacttagtcactggttctgccgattggcagatgataccagagttgccaattgaagcaaccgatattgtggtccagaaaacgcacgccaacgctttttatcacacggatttacaagcccaattgacggcgattggatgtcaaacacttgaaatctgtggtgcgcaagttgagttttgtgtggatacgacggttaaaatggctcatgggttaggctaccacctcgaaatggttcgggggttgacgacaacgacggccaattccatgatgagtgcgcaacaaacgattgatttttatcaagatcggatttggaaccaccgtttcttgacgttggtaacagcatcgggccgtattgacgatttgttagaaaagacgggtgattagttgaaagcattattttttaatgattttggcgatgcgtcggtcctacagtacggtgaggtggcggacccaatcgttactgcaaatactgtattggttaaaacaacgtatatcgggctcaactttgccgacatttatcgtcgtcgtggtacctatcatttggaaaagcatcaaccgtacattgatggttatgaaggcgtgggaacggttgtggcagttggtaagcaagtggcgaattttaaacgcggtgatcgggtgttattcgttgacgtgccgtttgccaacgctagccttgtcgcggttccagctgatcaggcgattaaagtaccacgggcaatcaatgatcagcaggtcgctagcattggattgcagggcatgactgcggagttcttagtccatgacttagcacaaagccaaccgcacgatcgagtcttgattcatggcatcagcggtggtgttgggcagctattaacgcaactgctcgtggccaatgaggtggctgtttatggtgtggcgtcaacaccggcgaaagctgaattggcctatcaagctggcgcaaccaccgtttttatgcgccatgatccttgggacacgacccatcataatttttttgatacggtgtttgatggggtcggtaagacactaccagttagtctggcgactaccaagcaccgtgggcgggtcattttttatggcatggcagctggcaatccaccagtaattgatccagtcaagctaatgtccgaatccaagagtttgatgactggtgatttatgggattatttggacagcgcggctgctcgtcagtgccgtgccaatcaattgtttgatgatgtgctcacgcatcgcgtgacgatacgaccagcgacagtctattcattagcagaaggagccgctgcgcaccgggcccttgagaccgggcaagttgctggcaagattttattgcgcccatgaagtacttgaatcgtatttgaaattaactggtttaatcgaatatcaccaaacggcatcgggcagtttttccgatgccgtttttgtggtggattagtagtgcaggctgaatcgagcgccagttagtcaattcaacaattgaattattaaaattcccagtcatgaccacggactgttacactaagtgctaaatcggtcaaatggaagtgtgatggtcatgattcaattagtacgttattcgacgacacggggagcactgaagcaaatacaacagtatcaactggttaatgtgatgtacacggcgacgccacaacaagttattcgtgcttgcaaatctgatttagaacgaacggccgttatgattatgaatggcaaccaattagtgggctttttctgtttgcatgttggtcaaggaccgctcagttacggtgaaacggaagtgaatacgattttgttgcgagctttatctgttgatgatcgctttaagcatcagcgggttgcgtctgacgcgcttgccgaattaccacgttatcttgccagtcattatccgatgattcaaacaatattattagcggtcaatcatgccaatcatgtggcgcaacatttatacctgacccatggtttcactgatacgcatcgccgcatagatggtcgattggggcgtcaatttatttatgaacgcccagtccattgtcccatggatttaaattttgattgaaatttgcttagttagttcagtcaatctagtatttggaatcttatcggaactaggtgcgatactttagaatcgtttgtgtcgttgcgaatgagattagatttaaacgaaatctgattgaacggctcgttctacgattggctttctgttagattatgataatacgattagaaaaagccgatcgtaaattaagctaatggaagtgatggtaatggtagcaattctttctctaatggttgtcatgggttttatgatgcttggcgagtgggtttccacgcgcagtcgggcctatgttccatccgtatttattacggcactcttatttctagtgggtttttggacaattgttcccaaaaacattgtccctgctgcttcttttggcactgcctttattcaaattacccaagccgttttattggttcatatggggacgttgatggatctgaaattgttgttaaaacagtggcgcgcagttgtgattgccctgagtggcgtggttgggacagtggtgctcacgatgggaattggccgtcttttatttgattggcacacgatcgttgccagtgtgcccccgttgacgggtgggttagtggctgcctttctgatgacagctggactcaaggcccaacatattaccgcacttgtggcgtttccggtggcaatgtttgtcatgcacagcatgctcggttatccgctaaccgcgtggatgctaaaacgggagagtcgccgactattgcaagtccgacatgtagacgtcacggtcgcgaccgctgattctgccaccagtgcgacagttcaaacaacggcgcaattaccagtgggcccgctaccaaccgtaccagcgaaggtgaaatcagttcaacctcaattacggcattggcaactaccggctgcttatgatacttcagcttttatgttatttaaagtcgctgctgtgactgggctagctgaatggactgcccagttagcccatggcacgattaatcagtacatcatttgtttagtgtttggtgttatcgcgcatcagttgggctttttagaagatgcggtgttggagaaagcgggcgtctttcactggctgatgtatggtttgctagcttatatttttgccaatctaaacattgttaaaatcagcatgttaagtggtattttgatcccgattgtaacgttgatcgttcttggtgttttagggatgtggattgcatctagcttattggcgtgaccgttgggatttagccgcgaaatggcttttgcaagtgcattgactgccttatttggtttccccgcggactatatcgtcacccatgaagtgaccgaaattatgggatcgactgcggaggaaaagcaatatttactagaccagatgttacctaaaatgttagtgggcggttttgcaaccgtctcagtggcgtcagtgattattgcgtcaatcttcttgaaaattttatagggggcttttcagatgatgacaacaactttagcagcttggatgacaaccttgcgccatcaattacacgcacacccagagttagcactgcaggaagtcgcgacgaccgctttaattaagcaaacattgactgagttgaacattcggttggtagactatccgggagaaactggggtggtggccgagattgggcatggtgcgccaatcatcgcgttgcgcgcggatattgatgcactcccaatccaagaagacaatgagttatcctttagatcaacgattcctggtcggatgcacgcttgtgggcatgattttcacacggccgccttattagggggagcgcgattattgaaagtgcatgaggcagatctcaatggtacggtgcgactgatctttcagcctgcggaggaaggacaccgcggtgccaaaatgatgattgataatggtgttctagcaggtgttcgtgcgattgcgggattccataatatgccgaatttaccagtcggcactttagcgatgaagtctggaccactcatggctagtaatgataattttgacgtcacaattttgggccagggcgcccatgcagcgatgtccgaagcaagtcatgatcccatcgtgacgcttggtgaattgatcagtaatttacagaccattcgtagccgaaatattgcgccagacgcagcactggtgctaacgattgctgccgtccaagcgggaacgacttttaacgtgattccaaatacggcgaatttacgaggcacgattcggaccttcaacacggctaaccgggatctagctaaagtacgtttttacgatattgtgcgtgcaactgccaagatgaatcagcaaaccgctacaattgattgggaccgaggaccaagctgtgtcaacaataacgcggcacttaccgctgtactatcacgtgttctgaaagatgattttgatattgtgcctgcccagctatgcaatgccgacgatgattttgcgttatatcaagaatgtattccaggattctatggattcttaggttcaggcggcaatgggaccttacatcaatcaaattaccgctgtgatgacgcaggcctaacctatggcgctcgcttccatgaattggcagctacggcactattaaagtgggttcgagcttgaattgaaagtggtcaatcgacaaagggaagacgcccgaccttgctaggaaactaacatggttgggcgcattttttatggaaagcttctgaatgataagtaacaagcgagtctggtcacaattatctgagtaactaaagtatttgttgatacccgacttggtgcaatcattaactgatacgtgcagattattgttataatatatgtgtattagttttaatattattattttaatgatgaagggaacgaccgctgattgaattttggttgaggcggccaaaggtgattaggatgaaatcaacaattttcgaaaaagctggactagtatctgttcaggaagttgacaaaccaacattacaatctgatgatgatgtcattgtgcgcatcgtgcggacttgtgtttgtggttccgatttgtggtcatatgcgcatggtgatgacaaggctgcccattcgatcaacgaaggacatgaagctatcggaatcgttgaggcaattggctcggccattacgacggtcaagccaggcgactttgtcatcaccccatttacccatggctgtggtgagtgcacggcttgtttggctggtttcgatggtacttgtgatcggcatccggaccacacaaattggtctaatggctttcaagcagaatacattcgcttcacttatggtaattgggcgttagttaagattcctggtcaacctagtgactatacggaagggatgctcaagtcattgttgacgctggcagacgtgatgccgactggttatcatgcggcacggtgtgcaaacgttcaaaggggcgataaagtcgtggttattggtgacggtgccgttgggcaatgtgctgtgattgcagctaagttgcggggtgccgcgcaaatcgtcttgatgagtcgccacgaagatcggcagcaaatggcacttgcttctggcgcgaccgcggttgttgctgaacgtggtgacgaaggcattgcaaaggtacgcgaaatccttggtggcggcgcggatgcggcgttggaatgtgtcggcactgaagcggccattgaccaagctttaggtgttttgcataatgggggtcgcgtaggctatgtgggtgtaccacattataataaccggccacttgggtcaacctttgctcaaaatattgcggttgctggtggttccgcctccgttacgacttatgacaaacagttcttactcaaagcagttttggacggtaatattaatccgggccgggtatttacgcaaacgtatccattagccgacattaatcgggcttatcaagacatgcaaaatcgaaagacaattaaggctatgattaccattgattaatctcgactaggtaactagtcgcttaaaagcaatcgattaaaagtcgtttcagtactgattcatcgtgctgaaacgactttttcgatggcgataatttaatggtaaaaatcaatcaagcttagttgatctagactagtctttgcgttggtattagaaaaaagacatgcaaccagttgaaccgtgtcattaaagctagctggtcgcacgattgtagttggcttcgataattaaccgtttaaaagaacgcattttgctgtccgtgctgtcgccagcttgctatactgggtcaaaaatgaggtgagcgtaatgcgagtctttacttggatcgtgcgaacaattgtggctggtgccgttttgatatgtgtcattatgattggtttggcaccgcaaacagttgtcacacattttaatagtgccggcttggctgattcattcggcagccgctggtggctagtgatgttaccactattagttgtggtaacgggtgaagtcatgattaagttagcccgtcaaaaacggcgcaagctcggactcttgcaactgccgacgctaacaggctttgaagggcagtgtttaggtgtcatggtgggtttcagcgtcctgttgtgggttatattgcaatcggaagtgcagtgccggctagttagcgggggcattggcggatggtgattaggatgagaaattggcagcaggatgtttatgaattcgcctgaaattaatttcaagcgaatttttggtggtgtagttattttaaaatacttagaccatcagggcttgatcaacagcgccaggcgtaatgagtgcgattttgcagttgtctgagttgattaatatcagctgttaatggcctgcgccaaaaaatggcatgttatgttatgatgatgacgtgataaatcattaagccgttgcgattttctatgtaaactattgttattgaaaaacataggaggtcattgagatggcagttattttaattacgggtgcaagcagcggtattgggtttcagacagcgaaagacttagcacagcaaggtcacgttgtttacggtgcggcgcggcggttgaataaacttgaagcactagccccatacggcgttaagcccttgtcactagatataaccaatgagcagtcgcttagtcaggccgtagcaactttaattgccagtgaaggacgcattgatgttttgatcaacaatgcggggtatggctcatatggcgctgtggaggatgtttccattgatgaagccaggcaacagttcgaggttaatttatttgggatggctcggctgacacaattagttttaccgtatatgcgcgcgcaacgtgaaggacgcattatcaatacctcttccatgggtggacggttggtgagttatatgggcgcatggtatcacgcaaccaagtacgctgtcgaagcgtttagtgacgcattacgaatggagactaaagactttggcattaaagttgcaattattgaacctggtgggattaaaaccaactggggattcattgctgcggatcatttagaagcctcagcacgtcacagtgcatatcaaacacaagcgaccaaggctgccgcgggtatgcgccgacaatactcgtcgcgaatgatgtctgatccaaaaattatttctaaagctatttcgaaggcggtcaatcagaaacgaccacgggtgcgttatttaattggatttggggctaaaccgctggtacttgctaaggcgattttaccgactcgtgtttttgattttatcatgatgcatgccagttagtaggagtgattagtgtgaagattatggtttctgaacagtttcagtgttttatggcaagccttggcgttgatttaaatagcctgcttgaagctgccggtattaataaagtggtttggcaagaacaattaatgctttctgatgtggagtattggcagttaatgaacgaattcgacaaccaattgacggatgaaatgattcttagtttagggaatattactaacattaatacgtttatgccgtccttttttgcagcattagctgctaaaaatggtgaacaagcgattgcacgcatggcaaactataaatcattggcaggtccggttcatttagagatagtgaccaagccagatattgtcaatattcatattttgggaaatagtcttggcgtcgagttgccgcgtttcacgattatgacggaacaattgttgttaatcagcttgttacgagtaggtacgggaaaactcatcaagccaatttcagttggtagtaagtatccgtatggtgatcagattgatgccgtgatgggcattcgacctcaacaattggctgataattgcattcagtttcaagtcacggacttacagcgggcgcttatttcggccaataattcaatgtgggcatttttgcaaccagggttagaccaacaaaaactggctattgaacacaaccaatcattgctcgcgactgttcaagcactattgttgaagaaaattcctagtggttccttctcaattgacgagattgcaacaagtttgaatctcagtaaacgaaccttgcagcgtcatcttagtactttaagcaccacatttaatgatgaagtccaaattgcgcgtcgaaccctagtggtacccttgatgaaagatcaatcgctaaacttgattgaaatcagctatttgttagggtattcagacccagagtctttttcgagagcttttaaaaaatggtttcatcagagtccatccgtttaccgccaacaatctctggggatgttcaaaaattaacaggcattgccgtttaggttaaaagttatgggcgttaaaatcttatggatgtgatggctttagactgatgggtaatcctttaaattaatagatcgtcataacaattgtgtttaagaatgctagttcttagatgcaatttttttttgcgtgcatttaagctagtgacagttgaacagattgtatcactgcttgctgaagtcaaaacttgttagcaatttgattataaactttatagtcaaattgctaaactgtgccagttcgttgacggattatgaccgcaaaaaatggatcgtcaagaaattttcgcaaaaaaataaagctcgattagagcccagcttaccgggatttggctactaaaaaatgtaacatactgtaaattaatctgctgaaatcaattgacaagatttggccggacgattaacttaatgccattcccaaacgccgtgaaaggagcgactaactatgagtgtgttagaagcaagtgaaattatgcaattaatccccaaccggtacccaattttattcatggaccgggtggatgaattaaatccgggtgaatcgatcgtggtgacgaaaaatgtcacgatcaatgagtcatttttccaagggcactttcccggtaacccggtcatgccgggcgtgttgattattgaagctttggcgcaagccgcgtcgattctgattttgaaatctgaaaagtttgctggtaagacggcttatcttggcgccattaaggatgccaagttccgcaaaattgtccgtcccggtgatgtcttgaagttgcatgtccaaatggtcaagcaacggtccaacatgggaacggtgagttgtcaggcgatggtcggtgacaaggcagcctgcacaactgatttaacctttatcgttggtgcaactgattcaaaatagaaaggtggtaatggcaattcggcgattgtcgtttgggaaagttttttaaaagcattgccgaattgtaaccaaccatgacaactaatttttcgattttagcgagtgctaaggcactgccgacgaccaaagtcacgaatcaagaactaacgcaactgatggcgacttctgatgattggatcaagcagcgaacgggaattcgttctcgccacgtcgcgaccgatgagacaacgacgagtttagctgtttcagttgcccagcagttgttgcagcaaagtcggctagcggcgacggcgattgatttgatcatcgtggcaaccatgtcaccggattatttgacaccggcgacggctcctcaagtacaggcagcaattggggctgaaaaagcaattgcctttgacatcaatgttgcctgtgcgggctttgtttatgggatgcagttggttcaccaatacttacaaccgggccagaccgctttgttaatcggtagcgagaccttgagtcggttagtagactggcatgatcgtagcactgccgttttatttggtgatggtgcgggtggtctattgattactgctaagcctaatacggccactgggcactggctgggcggtcattacgcgacgtttggcgctgacgggcattatttaacggcgggacagcaacctcaggtgaatccgtggtcgacacggactgatggtgcagattctaaccgctgggcctttcagatgaatggtcggcgggtttatgactttgccactaagcaagtgccgcactcaattgagcaggcgttgatgcaggcacggctcgagtcgagtgatattaaagcatttgtgcttcatcaggccaacgcacgtattgttaagagcgttggtcaaaaattaaacttagctacggaacaattaccgatgaacattgcacagtatggcaatactgcggcagccagtgaaccgattctatttgccgaaatggttgcccaaaagcaagttcaacgtggtgacaagctggtgtttaccggttttggcggcgggttatccgtcggtagtgtcgtaattgagtattaattgataactgaaatcaagcatttaaaattaatttaaaaattctggaggaatcaacaatgactaaaactgaaatttttgaccaaattaaaaagatgatcgtggaacaattagacgtggatgctgacaagattacgatgacaacgaactttaccgaagacttagcacttgatagtctggacgtttttgaagtgatcgataagatcgaagacgaatatgatatcgaaatcgaaacggatgacgctttagccacggttggtgatttagttgattatgtggcgactcatcaggaaaatagcgaggactaagttatgaaaacggcaatcttattcagtggtcaaggacaacagtttgccgatatgggggccgatctttatcaaacgttaccagcgtaccaagccacgattgacgaagctaatcaagtgttggactgggatctgcgggtaactgctgattggatcgatgatgctcaacggatgccggttgcaattacagcgatgaatatggggttatatcgtgctttaacagcgttgcttaatgagtgtccaaccgtgttaacaggattgagccttggcgagtatgccgcattgattgcagctggcgtcctgccatttgctgatggcttgaagttagttgccgatcgggctagatatatgcaacgagcgggattacagcatcccggggagatggtcgcggcgttgaaggtaacgccggcactggttgcagccgcttgtcaaagtgcccaagcagtgggggttgcgtatcccgctaattacaatctagctgatcaaattgttattggtggcgatgcagctggtattcaagctgcgcgaacctatttaaaaacacacggcgttaaacgggtggtcccattagacgttgcggtggcttcacacacgccgttaatggcagcagcgagtgaggcgttggcgcaacgattacgatttgttaatattgcagcaccccaaattccggtcatcagtaatacgaccgtgaccccctttagccaggcaactgtcaaggaaacgttggtaaaacagttagtatcgccaacgcactttgcggcctgcttacaacgaattgcgacatatgaggtcgatgagattattcaagttggaccggggcatagtttagcaacttttaccaaacaaacattgccgggggtaagggtttggtcaattgaagatatgacagattggcagaattattgtcaggatactgaggaggtacgtgagcgtggatgaagtgattttagtcactggagctgctaagggtattggtttggcaacagtcaaacggttggcagctcagggggccagcgttattttaaacgttcatcatgaaattgaagcggccgattggcaagcattaacggctgaatatccaaggttgacgcaattagttggtgatgtgagcgatgatcaaacggcggctgatttaattgagaccgtgatgacaaattttggtcgcttagatggactcgtgaataacgctggtgtgacccatgatcagttattaacgcggctacacgcggaagatttcatgagtgtgattcaaacaaatttattgggcacatttaatatgaccaaatacgctttaaaagtcatgcagcgacagcgacaaggcgccatcgttaatgttgctagtgtggtcgggttacatggcaatatcggccaggcgaactatgcggctagtaaggctggaattattggtttaactaaaacgacggcaaaggaaggggctcggcgccaagtgcggtgtaatgcggtggccccaggaatgattacgacggccatgacggcacaattgaatgaccgtgtaacggcggctgccttaagtgatattccactcaaacgctttgggacgcccgacgaaattgcccaagcaattgactttttattgcaccaaccgtacttaacgggacaagtgctaacagttgacggtggcatgacgatataagatatgggaggttatccaatgacagaacgagtagttgtgactggaatgggtgcggtgacgcccctcggtaatagtgttgatgaatttttaacggggttattcgcgggacaagttgggattaagcccatcacgaagtttgacgcgacgcccactgggattacagttgccggtgaggttaaggattttcagccagaagaacgaattgaaaagaaattagcgaaaagattggatttattttccgtttatggtctatacagtgcaagtgaagcgatggcgcaagccggactaaatgaagcaaatattgatccagaacgattaggcgttatttatggttcgggtatcggtggtttaacgacgattgaagcgcaagtgatcaagatgcacgacaagagtcccaaacgagtttcaccgttattcgtccctaattcaatcatcaacatggttgttggtaatatcgcgatgcaatttaacgcacagaataccagtcaagcgattgtgaccgcgtgtgcgtcggcgacgaatgccatcggcgatgcgtttgaatatttgcgtcaaggaaaggcagatgtgatcatcacgggtggttcagaagcttccgtcaacgaaatcggtattgcagggtttgcgtccctgactgcgttgtcgaaagccactgacccaacgttggcttcattaccgtttgatcgtcaacgcaatgggtttgtgatgggtgaagggggtgcgacgttagtcttagaaacgttggcccatgcccaagcccgaggcgcccagattcttggtgaagtcgtgggttacggaacgactagcgatgcttatcatatgacagccccccgaccggatggtgctggtgccaaacgtgcaatgcaacaagccgttgcggaagccggcattcagccgcgtgatgtggattacatcaatgctcatggaacagccacacatgcgaatgatagtgccgaagctcaagcaattagcgcgttgtttggtcaagatatacaagtcagcagtactaaaggaatgacggggcacttattaggcgctgcgggtgcaattgaagctgttgcaacgattggtgctctgcaagcgggtcagttacctgcgaatattggttgtacggaccaagatcctgagtgtccagtcaatttagtaacgccagcaactcaacatcaagccgcaacctatgctttgagtaattcatttggttttgggggccataatgccgtggttgcctttaagaagtgggtgaatgtatgagtatgacggatacggaagcgatgaccgccctgatcaatcagtttaatcaatccagcgctcaagtcatggacgtcaagacgacaacctttgaactgcatttgaataaacaagctgaaactgctgagacaaattcagcgcgttcacagccggcagtgaccgactctacggtaccagtggtcaaaccgacgactgaagtggcgactcaatcgggaacaacgatggtcacggcgcccctagttggggtggcttacttagctgccgacccgaaacaggcgccgtttgttcaggtgggtgatcgtgtcaagtcaggggaaaccttgtgtgtaatcgaagcgatgaaaatgatcaacgaagtccctagcccagttagtgggatcgttaaagaagttttaattaagaatgcaactatggttgaatttgatgaaccattgtttgcaattgaggagacgaccgtttaatggaagttacggatttaattccccaacggtttccgctgcaattattagaccgtatcatagcggtccaaccaggtgtcagcgcaacagcggaaaaattagtcacgattaatgaatggttttttcagagtccgacactgaccggaagaacgatgattcggccagtattattagaaattttggctcaaacgggagttgtggctttactatcgatgccggagcatcatggtaataacgtcttttttggcggaattcggcaggctgattttaagacggatgtgcgcccaggtgaccggttagaagcgatggtaacgttaactaagttgcgtcgtcaaatcggaacaggccatggcgtgattacctgtgctggtcgtgaggttgttagtgctgatttaacctttgtaatgcaagcctgaaggaggtatggcgattgtttaaaaaagtcttagtcgcgaaccgtggtgaaattgcggtccaagttattcgcgcgcttcatgagatggggattaaagcggtcgctgtctattcagtggctgatcaggagagcttatttgtacatctggctgatgaggcggtctgtattggggcgagtcccgtcaaccagtcatatttgaatatgcaagcaattattagcgctgctaatttgaccgggtgtcaggcgattcatccaggctacggctttttatctgagaatgcggaatttgcaaaaatgtgtgcggattgtcagttaacgtttattggaccgcgtcctgaggtgattgaccagatgggtgacaaagaaaatgcccggcagaccatgcaacgattaggcgtacccgtgattcccggcagtccatcggtgcttaaggatgttgaggcggctatgcaagctgcccataccttaggttacccagttatgatcaaagccgctgctgggggtggcggtaaagggattcgcgctgttagcaatgatcaagatttagcgaaggcctttcgaacagctcagcaggaagctcaagcttcatacgatgatcatcggttgtacttagaaaaaatcattgccccggcgaagcatatcgaagtgcaggtcttagccgatcaacaggggcatgttatttatctaccagagcgcgattgttcgctacaacggaatcatcaaaaagtgttagaggaaagtccatgtgcggtcatcacgactgctgaacggaccaaattgggacaattagtggctaacgcaaccaaaaagttgggttatacaaatacgggtacctatgagtttttaatggatcagcagcatcatttttattttttggaaatgaatacgcggttgcaagttgaacatacggttactgaaatggtaacgggtattgaattgattaaagcgcaagtacaaattgcagctggtataccattaaaaattaaacaggcggatgtgaaaattcatggtgttgccatggagtgtcgcttgaatgcggaggatccgtaccacgattttcgaccgcaacctggaaaaatcacccggttgatctacccaatggggacactgggagtccggattgatgctggtgtggtgactggtagcatgattgcaccgttttacgactcgatgattgcaaaaatcattgttcacggtattaatcggaagatggtcagtcgcaagatgcatcgttgtttattggaattgaccatcgatggggttcaaacgaaccggaccttcttagcaggattagttgcagattcgactgttagccgtggtacctataccacagcttatatcgaacaagactttttgaaaggatggttaagtgatgcccaagcgcaagtttcaagcacccactgaacggcagttagctgttcgacgggataatatcccagacgcgttattgacgcgctgtccagtttgtcatgaagattgttatacccaagatctcggtgaattcaaggtatgtccccattgtgattatgggtttcgcttgcctgcttggcaacgtgttcaacaattgacggcgagttttgaagagcgggatgcggacctaagtgcgcccgtcagttttgatgaccctgcatatttagaaaagttgcagcgtgccaaagcagcctcacacttgaatgagagcgtattgactggtattgggacgttagcgacttatcaatttggcttaggtgtcatggaaactaaatttatgatggggagtttgggggcggcaaccggtgagaaaattacgcgattatttgaaacttgtacgacccaaaaacttcccgttgtgatggttactgcttctggcggggcgcgtatgcaagaaggcgctcgtgcattgatgcaaatggctaaggtgtccacggcggttgcaaatcaccgaaaagctggactgttgtatattacaattttaactgatccaaccactggtggtgtcacggctagttttgcgatgcagggtgacattatgttgagcgagccacgagcgctcattggattcgcgggtcggcgagtcattgaacaaaccattcaacagacaccacctgcggattttcaacgggcggaaaccttattagccaatggatggttagatcaaattgtaccccgaccagccttacggaaaacactacaacgattattaacaatcactcagggaggtcatcaggatgtctaaagtaacggcctatgaacaagttcaagcagcccgtgatgctagtaagattagcattcaaacgttgattgatggcttgacagaggatttttttgattgtcatggtgatcgtcaacgggcggatgatccagctgtaatcgccggcttagcaacaattgctcaacggcccgtcaccattattggtattcagaagggtcaaaatttggccgagaatcaagctcggcattttggctgtgcgacgcctagcggttatcgaaaagcattgcggttaatgcggcaagcagaacaattacggcagccggtcgtgaccttaatcaacacgccgggtgcctatccgggtgttgatgcggaatatgagggacaaggacgagcaattgctgactgtttgttagcaggattacaattgcgagtaccatttttgagtttgattgttggtgaaggtggcagtggtggtgcattagccttagcatgtggtgatcaagtctggatgttggcgaatagtacttactcggtgttatcacctgaaggctatgccactattttatggaaagaatcgcaacgtgctgctgaagctgcggaaaaaatgcgcttgacgccgacagaattattggcagatgggattatcgatcggattattcctgaagtagcaaccgcagcagattgtcaaccgctgaaaacagccattgacgagacgttaactgctttaacagcaaagtcggtggcggaactggttacgcaacgccaagcccgttatcggcaattttaaataagtgaggaatgataagtatggatggaattttatcgggtaagaccattgtggtcatgggtgtggccaatcagcgcagtattgcctgggggtgtaccgaggcattaattgcacagggggcccaggttatcttgacttaccaaaatgaccgtttgaagcaaagcttacaacggtttgttgcgccagatgtgccgttaattgcctgtgatgttgctgatgatgacaatgttgagcgggcatttgcaagcattaaacaacagtatggtgccatcgatgggattatccatgctattgcttatgcggataaagcaaccttagaaggtgattttgtgaataccacgaaagctggatatgatttggcacaaaatattagtgcgtattcgctgattgcagttgcccgagcagctcggccaatgctgaaaccaggagccagtctcgtaacgttgacgtattttggatcagagcgagccgtaccaaattataatatgatgggggttgctaaggccgcgttggaagcaaatgtgcgttacttggcacgtgaccttggaccacaacaagtccgcgtgaatgcaatttcagccggagcagtcaaaacgttggcggtaacgggtattcatgagcatcagcaattattaaaattatctcgcagtatgacagttgatggagaaccggtaaaaacgcgtgagatcggcaacgtggctgcctttttattaagcaatctatcgactggaatgaccggggacgtggtatacgtggataaaggggtccacttaagttaatgccaatcactcaagttgtctttaaacggcagtggcttcagatgccggtcgatgtttctaaaaaaatgcggcgggtcactcagcgaaccgtgagtcgccaattaattcagcaagtgttatcggtaccattagcttatcatcgattgggccagccgtattttccaagtcatcctcgattaggtgttagtgttagtcacacgcaccagttagtgatggtggcggtcggtccgggacctttggggatcgatgttgaacaggtccgtccatatgatgtaactgccattcggcgagcctttacatcggcggaatggcagctattacaggctttatcggtgcaagatcgttatcggttagggtggcaactttggacggctaaagaagcggtattaaagttagtgggctgcggcttgacccatgcgccccgccgtgtcgaggttcttgatttacaacgtggactagcgtgctatcaaacacagttataccagttgacgccgttagaattgcctgcgacccacgagggatttttggctcgtcccttgtcggttggctgattggagcgcatggttggtattaactttagtacgctcttttttaagtttagtgaacaatggccactggattttattatcggccaactggttgacctgctagtgcaagccttctacgtgctgactaaaagcagttctgagcaagccataattgtgggctcagaactgctttttaatttatccttcaataatttatctataataatggcaatgcaaaattcatccataaccatgaaatcggcatgataacgaccatcatcggaatcatatcggcggtcggaaacatcttgacggcaataatgcgaaagccgctggcaaccattaaaataccaccgaccgctttgaaatctagaatcatgtcaggagtggtcaagggaaagactaggtgagcgactaagaataaagcagtcaggatgattagttggggaacagcaattaaggaaacaactaaccctaagctagcaccgaaaattaccgcagcaaagaagtccagaattgatttggaaatcaaaattgtggcgtcgccgttcatcccttcagttaaagtcccataaataccagttccactggcacaaaataatacgattaccgtgaccattgtctgttcaaaggcctgtttctcaaaagttgctggtgctttgacaaaccgtgaaatgaaacgttgcatcgcggcagcgccgtgattgattgcagttcccaaatggcaaagcaatccaatacctgttccgataataacggcaaagatgaccgccgctagattttttaatggtgcaatcgcgtaaatccccatacacatggaacagatcccaaaggacatattcagcccatcttttaaacgttgtgacattcgtttgccggtcaatgcgcccacaatacccccgaaaaagatcgcacacacgttagtaataattccaattggcacgcaagccctcctcaatatttaattgataaaaacaacagctattagtttagagcttgtttcggataagaacaattctgaatatgtggtaaactattctaaataggaatagttagaagagggttaattatggaaacacggaaattggcagtgtttgttgaccttgccacgacccagaactatagtcgcagtgctgaacgcatgtttttgtcacagtcgaccatttcaaaatacattatggctttagagcgcgattggcaggtccaattatttgaacgtgcgcatcggcaagtcacgttaacacgggttgggcaacaattattgccacgggcccaagcaattctgcgcgaagagcgtcagctataacaagttctggccgctaataccgctcataatgcgcagtcgctggttgttcagggactaccatctttagcacaataccaggcttttcatattatcacggcatttacgaagcggtatccggaagtgaaattacaatttagtgaggcgagtgtcgatcggttagcgcatgcactggatcatacgaatgtcgacattgtatttacacggattttcggggatcaacccaataattatgacgttttattgaatgagaccgatcagtttgtggtccttgttccgaaagacgatccgttggcgcaacaagctgagattagtctgtcgatgctggcacatgaatcaattttattattgaaagataccatcggtgaagataacccgttgttttcggcatttcaaaaaatgcatacgccacagatggtttatgatggtcaacgaattgatctcattttagaaatgctgaatcagggtgatggtgtctcggttgtcatggcgcggtcatttgatctcactggttttgacaacattaaagccattccactgacgcctactattcgcagtcagatggctttcatgaagcgtccagataatcacgctgccgtggttgctaaattttgggcgtttgcgacgaagtatagccaatcgctttcagattaattgtggcggctgatcacattctaacgatgtgtcttgaatcggaatcaaagccgacgatgacataaggataaaagcagtcggtttcggtggtcgtagcaggaaggacgtgtccgaacaacaatcgagctagctagtctgttttaatcacattgtaggtcgtttgcagtgatataaataaaataattaaagatgacggggtgcagacatggaaccaattcatatttcacagactttatcaattagcaatcaccgtgtgttttcagctgatttgaatgagcacgacacggttttcggcggaaaaatcttggcgactatcgatgataattcatcgattgccgcatcgcgagtggctcgaattgagacggtgaccgtgtcagtcgatcaggtcaattttttattgccgtttcggttacaagactcaatgtgtgcggaatcttacgtttcgggcgttggtcaccgctccatcgaggtatttactaaaatcattggtgaacacttgaagaccggcgaacggtttttgggattgacctgcttttcaacgttcgtggtgacggaccgtaatattgaattaccactgttagtcgctgataaaccagaatacacgtttgttgctcagggctatcaagagcggcaggccgcccggttagccaaactaaagcgccagcaagactttaatgcgcacattagcgttgaattgccgtggtgaatcgctttaaattgacaattttggtgagacttgttaaattgtaattatcaaatataggaggggtgttttatgtcgggcattcgttagggtgttgttgagcgaaaaaagtgggttggacccgcttagtttcgtgtaccctaatgtgacgaatagcctggcagatagacatgtcggacggtttttgcgcacagttgggataagactgggcgcatttttaattcgcagagcgttagggtaagtcactttgcgaaaggattataaaaattgacaattaatttaattaaatatggattgacgacggcggttcaagccgacttgactaaggaaaacggtcaaatacttggccggattatcggccaacatcgtgattggtaccaagtcatcacgacggctggggaacgttcagcacaagttacgggaaaactggcttatgaagcggccagtcccgcggcatttccggcggttggggattgggtgtgcctatcttcatccgctgataatcaggcgcagattgaagcaatcgcgccacggcagagtgtcttggcgcgcggtgccgtgaaccgccaagacggccaaatcattgcgacaaatattaataccatctttatctgcatgtcattgaacgcggattttaatgtgcggcggttagaacgttacctgacgattgcgtgggatagcggtgcacttccggtcattgtcttaaccaaggcggatctctgtacggatctagccactaagttacgggctgtggcggatgtcagtgtcggcgtaccgacgatcacttgttcggtcgaaacgggtcagggtttggatgaattgcaaccatacctaacgactggtcaaacggtggccttcgtgggctcttcgggtgtcggtaagtcgactttgattaaccgattgttgggccaggatatcttggcgacgaaatcgattcgtacagatgatgacaaagggcggcacacaacgacgagtcggcaattaataccgctaccaacgggcgcctgtgtcattgatacaccaggaatgcgtgagttacaaatcttcatgggtgatttaaatcaaactttcgcggaaattgcctcattggcgacacagtgtaagtttagtgattgtacccatactagcgagcctggttgtgcggtacgggcagcagttgaggtgggcacggtaacgtctgaacggttacaaagctatcaaaaattacaacgtgaaatgagctatcaaggactcaattcacgccagttggagcaggctaaaattcagcggatgttcggtggcaaacaagcgatgaagcgtgttaaacaacgttaccatcgcgactgagttgataagtaaattaaagaagctactaaacgggatgtcggcaacggcaccccgttttatttaggacctactttcgttatcgcgtagagtgaaccgagtgacctgttgagcgagataggccggtgtttcaaccatcccattctgttgccaatgaacgagcatattgatgaccgcaccagaaaaataagccgtgtagtacggttggcgaagcgcggtattgcttgaaccgataatacggtcttgtttgatgagtaatgcaaagacggcttcgaaactttgaataaaaatctgggttttttcatttttgatcaataacgcatttgtcgctgccatttgttgcatgagagtgaaatattgagtcatcaatacctgcaatttaacctttgattgtcgcggtaattggcgcagatattgaaggatagtctgtttttgataggccaaaataatctgatcgaagttggtgaaattacggtaaaaataggtgcgagaaacctgagcgtgctgacaaagttctgtgattgaaatacgactgagtggtttttgcgacataagctgtagtaaggccgcataaaccgcagttaaattttggcgttttcgtgtttgtgggttcattggttacaacatctccttttttgtaacgtaagtatttatttatgaccattttaccagatatactcccattaacttaacgggaggcgattatgatgaaaaaatcgacgaaagtaattgcaatgatgatgattggcatttttctatgtatgcttgatacgacggttatgaatattgcgttgccagcaattcagacgggactaaatactgatttgacgcacctgtcgtgggcactgaatatttacaccgtcctgtttgctagtctggcgattccactcggtcggttagcggatgtctggggacgtgggcggatgtacttgattggactcgggctctttggtattggttcactaacttctggattgagtctcagtgtcgggctgctgattactggccgagcgattcaaagtattggtgcggccatcgtcttcccggctagtatgacgattggtattcagagtgttgcactcagcaggcatacgggggtcattgcaagcttgggcgtgatgcaagggctagccgcagcgttaggaccaaccattggtggtgcggtcactcaattttgggggtggcggggaattttcctgattaacgtgcctttagttgccgtcgcgttgtgtggttgcatcgcctggctatcatggcggcaccctagtcatggtcaagtaaaactagacctcggtgggagtgccttagtgatgacgaccttattggcattgacgttggtcctggttaaaggtaatgactggggatggacgagtcgcgtagtcctgagcctgggcgtcactagtgcgctaacattgattgcctttgtctggatggaggcccacgtctcagcgccgatggtcccattagccctatttaaagaccgacagtttaacggtgcggcgttagcgaccgtgttatcaggggtctttatggtgggactattagtcttgatgccgagtttcttcacgaaagttcaaagtaagacggaattgatggcggcgattatgattacgcccgcttcaatgatgatttttattttttcaccaatcagtggtttcttgttagcaaagcttggtgcgcggcgcgtgatctttagtggtagtctcgcaatagctacgggttatggggtacttagcctgatgagtcctagtcagtactggcagtttgcattggcggcgttactggttggtgcgggctacggcacgattattgggccaattacggtattagcggccggtgattttaccggtgagttactgacagcgtcacaaagtgtgattggcgtgtttcggcaaattggcacatcgttggccgtagccatttttgtgtcagctttagccgctaatttgacaacggctaagacacagatacgaacgtatgcaacgacgacggtcactactttatcaattcctaagcaagccaaacgtgatacgttacgcgtggttgaccaccaattagcaactgagcaaaccgcgcaaacggtccacgagccaatcacggcggctaaggcccgccggttggttgctgccaattatatgcaagtgttaaaagcacggtcattgcagtccgctccagtgcgtatcaaagctcaaattcatcagcaggtggcccaaaaggttcacagtcaagttaaacacactaaccagcgaataaggactgctgcatcagcgattaaggccaaagccaaaattgagttaactgctgcgtttatgcgcccctaccaagtcgcttggccattcacgctattgctagtgatgacgacctggtgttttgcgggacgggagcggaaaagtggcaagccgagttaagtcacgttgatggggatggacttcacgcacgtttgaatagttgagccggtagggccgcgaaggcgatcgccattactgactttggaacttgccatcgaacttagctttgcgagcatgtgagacgcttatgctataataagggccaaagggggtagtcttgatgaaagaaaaacaagtgtttcatatcaatggctatattggtctagtgttagcgatcgcatttgtgttagttggcggttggctggtttgggccggtgcgactggcgatcattttgcgagtatctttttgggcgcattgctaattattattgcggcctttggggctagttcgctaacaattgtgggccccaacgaggcgcgcgtgttaacattttttggtaagtatatcgggacaattcgtgattcagggctgtttatgaccgttccgttaaccagtaagttttccatttcactgcgggtccgcaattttaacagtgccattttaaaagttaatgacctccggggaaatcccgtggaaattgcggccgttatcgtgtttaaagttgttgataccagtatggcactctttgcagtggatgattatgaacaatttgttgagattcaaagtgaatcagcggtgcggcacgtggcctctgaatatccatatgatacgtttgatgacgacaagaagattacgctgcggagtaatccaaccgaagtttctgaccggttaacggaagaacttcaagaacggctaaatgttgcgggggtcgagatcgttgagacacgcttaacgcatctcgcatacgcgactgaaatcgccagtgcgatgttacaacgccaacaatcttcggcaattctatctgctcgcaaggtcattgtggaaggggccgtttcaattacggaagacacgatcgcccgtttagagaaagatacggggatgcagctatcagacgataagaaactgcaactgatcaataacatgatggtcaccattatttcggagcggggtactcagccgattgtgaatacttcggaagttaagtaggaacgttgatataacaacaatcaaagttgtagcagtaacataaaaggcgctcatttgctgagcgccttttatactacagttaagtttaaacagtaacaaaaattgacatcatgacccgctaatcttttaaaaagatgctcttttggggatgcctgcaatgggtcaaatcgtagctggaacactctttatgaattgctaggtttactttccaataccgctcatggcaattaggccataccaaccgtgggcaaacattttatttgtagaagttgttaagttggcaattaactgatcttgttcagatgagaaatggtattttttagcgacagccatcacttgaagttgaccgattaattcattgattgcgtcgggtatttgttgataacgcttagtaactgaatctggttggttgatagttgcgtaggcttggctaattaattttctgatttcaactttttcaattggaactgaagtgtttagctgttctaaaagctgattaacagttgttaaacgcgctaatttctgttgctgtttcatcattgaatcccccagtgtagtgtttagtttaaacaaatgaattagttatagtgatataaatttcacgtcaccactatataggctaacatacaaatgaatactgtactgcatcagcaatttagtttttatgttaatttagttgtccgtttagataggctttgccaataataataattaaccctattatgattaataataaactaacataattaagtggccgacttttgctctgatagtgagtgaaccagccatacttgatccgggtgttaaagacattgatgatgaggccaatgccagtgatgaggccgccaattgcgataatgaaatccatttgtaatacctccatttagtttaagcaatttagatgtaatgactgcagtaaatattgatgctgaacaatctcgatgtttggcaacagacactagttcttggtatttaaaaaaataggtcattctgaatttaacatcagtagtttaagattatcaatataaatattatgaacagcataattttcagtataaataaaactggcagtcattgctattattagaaataccgttggctgttcaatacaggttcagtgaaataaagacaatcaatctttcagaaaatcaaattcaggtatataatgtttcatacacaaaacattatataggagactgttatgttagacaaaatcatttataaaaacttatttagtaaagcgttcgatgttactattgaagtcacttattgggatgggcaaattgaacggtatggtaccggcataccagctgttaaagttcgattaaataaagaaatcccaattaagttattaactaatcagccaacattggttttaggtgaagcatacatgaatggggatattgaagtagatgggagcattcaggaactaattgcctctgcttaccgccaaaaagacagttttttgacacataattcatttttgaaacacttaccaaaaatatcacattccgaaaaaagcagcacaaaagatattcaaagtcattatgatatcggcaatgatttttataaactatggttagatggtaccatgacctactcctgtgcgtactttgaacatgacgatgatactttaaaacaggcacaactcaataaagtgagacatattttaaataagctggcaacccagcctggtaaaagattattggatgttgggagtggttggggaacattattatttatggccgcggatgagtttgggttagatgcaacgggtattactttaagtcaagaacaatatgattatacacaagcgcaaatcaagcaacgtcatttggaggaaaaagtgcatgtgcagttaaaggactatcgagaagtcactggccaatttgattatgtcacctcggtaggtatgtttgaacatgttggtaaagaaaatctagggttgtactttaataaaattcaagcgttcttagttccaggaggccgagctttaattcatggcattacaggtcaacatgaaggtgccggcgttgatccatttattaaccaatatattttcccagggggctatatcccaaatgttgctgagaatctcaaacatattatggctgctaagttacaattttcagacattgagcccttgcggcgccattaccaaaagacgttagaaatctggtatcacaattatcagcaagtcgaacaacaggtcgtcaaaagttatggtgaacgatttgatcgcatgtggcaattatatttacaggcatgtgcagctgcttttgaggccggaaatatcgatgttattcaatatctattagtgaaagcgccgagtggaactggccttccaatgactcgccattatatttatgattgatcttgtcggttctgcggtagtcgtatcgaaatatagctccacaataaacatgtagtttcattgatctgttatgatccctttatggttgtcagatgaaatgatataattcatctgatatttcatggagggattttcgtatgccaagatctagatattcagcagttgaaaagttagctctaattactgagttccagaacgctaaccgttgtcaggtccgtcagaagaaacgttcacgtatccagcaacaggaacagtatttacaagacaatgttttagaccaacagtttaacgctagtcggccaaatcaggcctggttggccgattcgactgaattggtctatggagtcaatggccaatacaaagtgcgtctaagtggcgtgctggatctttatggtcggcatttaattgcccataggttaagtgagactgaaacttcaaatgcggagattcaggtttttcaatgagcctttaatttcgcgggtgatgtccatcccttagtgcatactgatcggggctcagcgtacacttcgagcgcatttaatcagtttttggcacagcatgaagttacacgcagtatgtcacggccaggaacgccatatgataacgcaccaatggaacgttggtggaatgaatttaaggtacgctggatagcgcggcacgccagaccagccacctataaggagctggccgctttagtcgaagaaggtatcacctattttaatcaattagaccgttcaccagcaagaaacgacctcacaccagcagaatattggaataaggccgtttgaagtgaatcaaaacttatattatttcaaatgacaacttgacagggactagtacatcccttataagaacacgagggattttttattatgcatttggaatgattgacaaggagggcaaccattccagacttgttcagtattaggctggaatcgataagcatagaaaagatttcggatctctgtgcatcttggtggctatcatgttttcagggcgttatagtgacaattgaggaggggatcttatgttgagcaccaaaaagaatcatgtattacggtacttatttattatagttggtatgatgatcgcgtttttaggttgtggcgtgattcaagtttcagcacatggctttgtgacgaacccgggtggaagagcttatctggggagtacttggtatccaggtgggcctttgaataccaatattggttcggttatgtatgaaccacagagtattgaagcgccccaaaatacatttattgatggcaaaattgccagtgccggtattgctaactttgcaccactggacgagcaaaatgccaaacggtggtataagacacctgtgaaggccggcaatcttagtgtgacttggcagttaactgctcgtcataaaactagtacttgggattactatattaccaagcctggctggaatccaaacgcaccacttaagtttagtgatttcaagaagatagctagttataatgacaatggtgccatccctagtgaatttgtaacccaccaagtcaatatttctgctaatgaaaaaggctatcaagtgttactcagtgtttggaatatagcggatactggtaatgcgttctatcaagtctcagatattgacgtacagtaattagatgaggtctaaatttactttgaggtgattttagactataaaagttgtctttgagatatcgtaaaggtcttactggcgtttattggctagtaagacctttttaaatgtgctttaaggattcatagaagcgaatagcgatgaccggtctttactgattagtgaagtacaggttgctattgtaaattagtggtaataattaagcggatgccgggaatcggatttgcgattacagcttggcagctggcattttagcattaaggggtacgcgcatgagcatcctctcaatgcaagttagctgaacaaaggtggctcaaatttgtgattcaataggtgactgtcagttgcgctcatgtgactacagtaccaagtcgctagtgatccatccgggtaatttcaggctcagttatcagatactcgttgatatgggcgagaaagttttgaaagtgcggcgtttcattgtgaaaattaacggcggcttggtcttgccagtgctcaataatctcgtagtcactgttatgatccagttgcttgaagtggccgtagaaaccgttgccgggttcttgtgaagaattgaccactagttcatgaataaaggcttcatattgagtggttaactcgggtttgacgtgtagtgcgacattaatgactttcattgaatactccccctgttgttcgtgcttgtagactgaccgccactcggtggtgaactttaaaattgcaaaattcgttaagtgactaaaggtcaccaccatactacggtaatcatacaaaaagaatattctgattatatcgtacgagaccaggattgtacaatgaaaacaggtatcaattatgcaactgcatctgattaattactcatttatcaaggccgattggtgcgggcgaaaatttaaacgaattaggcggtatatcggggtatcagtgacctgtacgattatcattttttagtaataataaccagcagatgtatatttatggatttgtcattcaagacgcggtatattaacaatgttaaatactaattcctagggggtggacaataatgagtaaagtttatacggatgtgttcaacatcaagcatacggattgtacggtagtcgataccattaacgaatttagtcgaatttttattatccaggataaacacggctcacggtttacgtgtctcaaagatgatgcccgcccagctaaaaagggtagtggccattggacgagtgccagtccggaagatgcgccacaagattacgctgtgccgtatcgttcaagaaaacggcaacgtagaacgctttaaatagttgattggtaatcagtgccgatacacggggccctggcggtgacaacaccagttaagccgcgttaaaactttaatacaataagataacggtcccatcagtaacaatgactgatgggaccgttatttgatttgcgattatatttaatttaataatgcgacgcctaatgtcaaataagttgcaaaacagatccagaccaagtaggggaccatcaaaattgcggctagccgactactgcgatagaactgtaatatgcaaagtaagacgactaaatcaagcacaatgataatgactaagccccaccaataagccgactggctgaaaaagatgatgctccaaataaagtttagtaacagctggataccaaacagggtggcgtccatgaggcggtcacggtgtgtcgtagcctgctggaaaactaagtaaccagcaatcgcaatcagcgcatataggatcggccaaacgatgccaaagaggccatctggtggtgatagtactggcaagttgagcccattgtaaacggccttaatgtctcccgcgagccatgccgacagactaccgattgcttcgacgaccacaatgaaaatgagcagatgaagccaattgaatttagggcgttctttgatcattgatttttccttccttctattagtcgtctaatcagggtcgtcaattgtgttaatgactgtcacgttgacttccgctttttgtacgacgtacgcggttgttgagcctagcaaaattcgagaaaccgcgttggtgccggatttgcccatgacgattagatcaattgcatattttttgggaatatcagttgcaatgctagcttttggtgaactattaacttgaattggtagggattcgacttgtgctgccgaagccatttgctgaccacgatccagaatgtcctgactattatcttttgcgacttttagaaggtttgtatatagcgttcccccgtaagctgcaggactatacgcattcaggcgtgtaatatcaataacattgaccagaaataatttagatttaaacgtctgggctagtttgaccgcgtgttttaaagccatgtaggcattatcagagccatcaagcgggactagaatattttgatacatcctcaggacctcctaaatgaaatgatgttatttattatattaatgataacattcacataattagtgcgtctattaatatgattaactgccagcgctcagtcacaaaaggcgcaaccattatgggccgcttagccaataaaagttgcgcctagttaaattattgccaacgatttgagcgtgacggcaacaccattaagatgaagaaccaaatggtcccaattattggaactaagtcaattaaaatccaccatgcagtgtgatcactgtcatgcaatcgccgaaacttcaacgagagtgttcctaaccaaatgattaatgcgatgagtttactcatcgtattaacactcagatcgctccaattgtaaatatcctcgatggggtgtcccataatcatctgaataattgcaatgataataccaccaagaatgtagttaatgataacgggccaccagtactcagagcgtgttgctgtacccgaaaagtttaaaagattgtcccaaaatttgcgataagcagatgccatcgtaatccccccaataaagttatgatgtgaacattattattttttccctgtgttaattgggattaattaataactatgtttaactataatcaaaaagttaatagtacgcaatcaatatgttgattatattaataaaaaatacgtcgttattcgatgactgctggtacgatcaattcgaagcggtccgtcaaataggtcaattcaattggtagtttaaccgctgggtcgccgtcaatacgtgtcgtcacggcttgaccagttgcactcgtaattcgtgcactggttgccgttagctgtgtaatggccttggagttttgcaagttccccgttagtgcgaaccaaaaatatggaattacttgccgccagccaatgttgttaagtagactaatatgcatttttcctggagcagacgcgctatagacgtgtccaccgactgatttggtcgttgtaatcaaacagaaccatgtttttaaggtgtggcttccttcgtgtttgaattgatatcgaattggcagtgacttattgtgaccaatatggcgaatagcacggtaaagatagcttaatttaccgaatcgctgcttctcagattgtcgaacttcattggaaatgtcagccaaattaccgaatgtcagtgaactcacgactgcccggcgttgattacaaactagcatgccgactgcttgggttgccggctgagtacaaattagttcgatggccgcttgggggtcagttggtaactggtagcgggttgcaaaattattaaccgttcccatgggaataacgccgatacgaatatgtgcttcagcttggattagggctgtcattgcaacgttcagtgtgccatctccaccaacaataattagtgctgacagttgaggaagcgtttgcttaattaacgcaattgcccgggggattcctggtgttgtcagtaattgagactcaatgccgtggttcgatagcgcttgcgcggtttgatgggcgacggttgccgcttgcccattacccgcttgtccgttatagaaaatgccgtaagttgttgccatgacaatcacctcttgattaaaaaattaagtttattcatcgcttatttagggactgtctgaaaactaaaaattcaggtataatctgaggaaaaacgaatcgaggcattccgatgacaacacctaaacgatacgaactggaagatgc

SEQ ID NO: 3 - DNA, 293368 bp, synthetic construct
  source 1..293368: mol_type = other DNA; note = Lactobacillus plantarum PDG8 - Contig 3
caaaggactccaggacaccttggaagcatcatttatttaagttagatacatattatatgtacgaaggcatttcatttacacaagattcttgacactcccgtatcaaactgtagtgattatcggttagggctgtttgaattatgctatgcagatgagcgtttattcaatttgaatcaatttcaaaatttaatatttttaaaattaaaacacaaaaaatgatacagagaataggcttgatgtttgtcaatgtcgcaattaaagcgttttgataatcattatcgtccttattgacttcgactctaaaaaaatcaaaacatttactaactcctaggcccgtcagcaaagcaaaagtaacaccatgaattagaaaaatcaattcatggttctggcctaacttaatgctcaaaataataaaagagaatgcagccattgcaccacaagctatattattatctaaagatttgatcacatttcttgagaactggacagcaattattgtgttggcaaaaacttgtaatagctgaactaatacagtcagctgatttatcaaaacagcattacttgcaacaaagtgttctaagtgaaagataacgacaaaaaatccattgtcagtcattaaggcttgtaagatagtttcaagaaaaccattaacaacaattattggaaaagcagctattaatgcgtcttgcaaataattaaaccattttaaagtactgattctgtaaagccaatcaattatggactgaatattatatttcttcattgattgtttcaccatttaaatcatacaaaagtttcattttcccaagttagctcaatgtagcatatcactccatcaataccttacttttttattgactagaaatttctcaataccctttcaatagtatccactaaaagagtcaggcgcagctaaatctcaacaaaaaaacaccacatattatttaacttatacgtaataatactagttctgtcgacaatatatttcatactttaatagaatttattataaaatatcgaaatggaatattacacgattggctaccgcaaaatccctgaaaatggcacttattcaatacaagttagtttcttatctttgtttaattcaaaaataaacttgcaaaccagactcctcttaaagatacacgttaagattagatatacatgttgtttttaaatttctaagattttagtaaagtgcaaaaagatttagtttttaaaatttagacagtcataacgtgtcgtcacgttatttcgcccgcgcaattcgaatttgcacatggttacccatgcgctgaataatttgataatagttatgctcgtcaacataaccaatttcaccctgattaccggtgtgaccgcttgacaattcacgtgcaattgcttaaacagcactggaacgattcaaataagcaggccagttggtgccccttcactgtggtcgtaatccgccgtgcgactaggttattttgcaaattactatgattagaagatttaattctaactgactgcgatcgtctcaactgatttacgctttgaccacatactgataatcctaatacacccatcaatagattaaaaaacactaataacagggcgtaactttaaaaacactaaagtcatgccctgttattaattggccttatataacgatgcgacttatcacgccactctttttaatttgtttgttaccacgattattaattatcctgtttatttaactgcttcaaccaagtcgccgttgcaagtaggcccacaactgcttcaaaatctgagcgagtatcgccaacgtacaagagttccgcggcgtctaacgacttagtgcgcatcaattgtcgcagattgtcagctttattaggttgacaatcagaaccatacaaccgcgtggagaaataggacgtcaggccagtcacgtccaaggaaatttgacaactcttagccgccttacccgtaatcagagctagcgccaccccttgctgctgcaacagttctaaaagtgtgacgattcccggatacggtgctgacacccgtaaatgtgcgcgagcgtattcttgataaaaggcggccaaagcgaccggccaccgttgaccagccactgctttgaccatcccaacctcatttagcccaaacgtctggacgatagcttgcttggtcagttcgtgctcaacgtacggtgcaacgctacgacgaaagacgtcaatcaccattggaatcgtcggcgcgagcgtgccgtcaaagtcaaaggcgatcatcttaagcatgcggttcaccttgattaatctgccgaatcacacgacaaggattgcctaccgccaacgaattagctggaatgtctttgacgaccacactaccggcaccaatcacggatccccgaccaattgtcacgccgggaataataatcacgccaccgccaatccaacagccatcctcaattgtgactggccgcgctaacgtctggcaaaaatactgatcactatctggctgccagtccgcacgtaaacgttcatgcagttcgaccggatgggtagccgtataaatttgaacatttgaggcaatcaagacattattgccaatggtaatccgattacagtcgatcaaggtacagttcatattgattgaaacattctgaccaatcgaaatattacacccgtagtcacaaataaatgggctccccaccgaaacattcgatccaatcttggcaaacatagcctgcaatatcgtacgtttctcacttttttggtcataggcgagctggttatactggcttaaaagttgccgtgtacgccgttttagctctaaaaatactggtgcgtgtgcatcataggtctgaccgctcaaactccgctgtcgttcatccatcattaagcacccctttcacttccaagcttaaaaaacgaatcgttactattcaagtcacgattcgtttctttagttatagtcgttttgctaaggtctcaatcacatagaccacggggacctgggtcgttatattataattaccattaattctctggtgagccaattgatatgaaaaattccaatcggaaagcttcgctagcgtggattgggactggttagtaatgcttaagactgcgcaccggcgttgttgaaaatgctgaacaagtgcaattagttctggggtttcgccactctcagataacgcaaaaacgaccgtatcgtgaatctcaaaagtattcactggataattactatcctcaagtccaaacgcaaccttaccagcgttggtaaaacagcgcgcggcatagcgggccaaacttcctgaggaaccaatgccgacaaaaataaccagcgtggctcgacgcaaatacgtgagcgctggcatcaacttacgttcatacgcgctagaattagtttttgcaaaaaagtgtgctagctcactgacgtcgctcttgggctcgtaggtggacaactgttgttgttcacttttaagagcccgtttaaaatcacgataaccttcgaacccatttttaagacaaaaacgcaaaatcgtcgaggtcgacacgtgcaactcgtgagctaactcacgaatgctcatgtagccgaccctatccatattattaataacgtacctgtaaatttccacatcagtttcattatatttttcgagctgctcataactaaacatccgccactaccccccactccaataatccgttgcttggtcaccataatgacctggtttgttcgaccctcattagtcatacaatcgattggacgcgcaactactatcaatagcctactataatcagccactctgatcgcgctagcaaacgaccaacaccgttaccagtaatcagtctttatctatttaagcgcgaataccccgtcattacaagttggtagcaaccaaaaaactaggctaatcactgacaaacgtcagctgactaccccagtttctttagcgtcaattttaaaaatgcgaactcgccagtgcctgtccatcagactgccccactttaatgtgtgggccataaaaaatcaatcagtaaccggtcgacctgcgcattttcatgtaactggctgtgttgcgcatgtttcccagtaatcttaacctcgcgataagaacgcgcacgcgccgcaactaagtaccgtaaagagcgtgatgaagcgttactgacggacccatccgaatgcgtcccatcgcccttatcaccataaatattaaggacccgtacttgctgacgtggataaacccgccgtaatcctaataactggcggtaggccggtcgcaatttattcggtcgtcccgcagcgttcaacgtcatctggttagggctgtcgtccatgcctaaaataccattgaaatgtccagcaattgcgacttgttgcctgagctgcggcaaccgctcattttgcgcattcgccaatagataataggtaatcgccatattacccatggaatgaccaaccatgttaaacgacgtgatgccataagttcgttggagcgccaccaccacattttttgcccagcggcccacggttggataatctgaagaccggttattagcaaagttcacttcgacaattggtcgataatcacctgatctaaagtggcctttcaaagtcaccgtcccgtttttagcaaccatcgcgcgtacaatagtttttgttttgccggctttaacgatagcatctgccatgtgcgtctcagcatggtaactactgccccacccatggaaaaacagtgttggaatgtagcgatgcctctgagtcgtaaccggtttagtcaccccggtcgtctctgcacgaccacaaccaactaataataacagcaggcctgctatcagcccccataatcgtattcttttcaataactttcccctgaattctatttaataatctattcactgttagttcgtcatttaaatttgtgctaccccgcatcggcgtgcatgtcgtctgagcgttaacgcttattttagcattcaattaaggctcatgacaggaattacaaccaattaggccgatcacccgccgtaccaggtttatcaacccctaaactgacacgctgataattttcaggatgcaccattaatttaaagactaaatcggcaacactcgctcgcgatacctcagttcctttgaaaggttctgcgccgattgtcagttcataatcaatttcggcagcatccgttagccaggctggtcggatctccgtataaaccagtttggaagcactaagcaacctcgctgcttctcgaaaaccgggtaggaaatcggcaatggcttgttcgttccacgcgccaaattttcctggcacctcatgatgggcgccgagtgcgctaatgaagatcaaccgttgccgctgagttcgggccattgcggccaaaatgctcttcgtctgggctgctagatcagtcccaccaacattggaatagactatgtccaccggtgccattgctgtggcaagttcatccgtatcaagcacgttgccatcaatcagcgtgacccgtggttgctcccgatactgggctaaacgttccgctcgacgtaggaacaataccagttcatcgtcagtttctgctaataaccgttgcgtcagcttcctggcaatcccaccattagcaccaataatcattattttagtcatttctattcacctttcttagatattcgtggcatcacttggaccgtcgcctgccgcggtccacttgctagcatcggcattaaatacggactaccggcatatttttgtcgataagcttggtcaatctggttatttaactgttcatcacaaatgggcacaaaattcaccagatgattgctctcggccaagtgaatccggccagccctttgggttacggccgatcgataccagcgtgagcgcggaccgttccaagcacggataaatagttgctgccctaccacgaccgaccaaatccaggtcggtgtcccgtatgtctgcccatcactataaaatggggagacttgaaaatcatccgccgtgctaaaagcggctaactgtgctctggaccactgcatcgtggttacagtggttgacactacgggctgattactttttttcatcgttaacattcctccattctggcaaaatagtggtgcttaattcagagcacttcggttaaatggtgccctgccttgatgcttgacacgttattctctgaataaccaactattctgcactaacctcaagtttcatcttaaagcttgacagcaaccatgtcgaatgcttatatggtatttaaaattatacttaattgtaatagaaagaagtgctttagatggaattacgagttctacgttattttcaagcagtggtcgccgagttaaatatcagtcgggctgctgaacgcttacacgtctcgcagccaacaatttcacgacaattaaaggatttagaggatgagctgggcgtgaccctatttgaacgcaatggccgtcatatcagtctcacgagtagtggtgaatactttgccacgcaggcgaaccaaatcatcgccttagccgataagacgcttgccaacattaatacagccaaagaaatcagtggcacgattgaattagggagtgccgagatgcgcagttttttgacgattgctcagtcgattaagaaactacaacaacagtatccgaaaatcaggatcaatgtgacgagtagtaatgcgaatcagattcgaaccaacctcaaaaccgggaactttgactttggaatcgtcacggaaccaactgacaaacacgacttaaactttatccatctgcccggcgaaagtcgctggggattactggttccgcggcattcgccgctagctgaccatgattacattagcttagctgatcttgaaggccaaaagatcattgtttctgcacaacacggtacgatcaatcaacttcaggattggtatggtgaaagcacgcccaaattcaccatcgtcgccacttataatttactctataatgcctcgttactagtttctgcgggcgtcgggtacgcgttagggattgatggcatcatcaatacgaaccaatccgatttgattttcatcccactaacacctcgaataaccgcccgcactagcctagtctggactaagggacaacgcttgtcggaagccgccaaaacctttttaacgcaactggcgacagacctgcagcaacaaatacctactgactaacagtatcgactcagctctcaccaatcaccacaacacactacccaattgatggctgctgaagacgacgcgcatctaattcacgctaattcgaactaaataattgaattgagcacaactaaaatgctaagctaggttattcagtttcagggaggaattatttaaaatgaaagcagtcattattaatcagtacggtgggcccgaagaactccagatggccactatcgaacgtcccagcattgatcaggacgaggtcttagtcgccgttcaggcaacgagtatcaaccccatcgattggaaagctcgtcaagggttgcttaaaggcatgtttgactggaaaatgccagttgtccttggttgggacgtcgctgggaccattgttgaggctggcgcggccgtgaccaactttaaggttggtgatgaagtctttgcccgcccagacatttatgcggatggccggcgcgggacctacgctgaatatgccgcagtcaaagaagacaagttagcactaaaaccagccagtctttcttttgaacaagccgccgctttgccgttagcggggctaactgcttaccaagtcattcatgaccaattaaagattcaagctggcgagaaagtcttaattcaagccggtgctggcggggttggtttaaatgccatccagattgctaagtacctcggtgccgaggttgcgactactgcgagcgccaatcaccatacgctgttgaagcaaatcggcgctgaccacgtcattgattaccacacgacggctattcaagatgtccttacagactacgatgccgtctttgataccattgacgccattgatgagggcttggcaatcttaaagccaactggccgactcgtgacgattgatgggcaaccaacggcggctcaaaaatcccaaggtcccactgtctccagctggtggttacaacccaacggccgggagttagccatcttggggcagctcgccgttgaaggacacttacaagtcatcatcgaccaagtctttccgtttagtacggctggtctccaagccgcccaccggtatagcgaaaacagtcacagtgctggtaagctcatcatcaacgtcggcactgaagcttaatacggtatcggctccagcctcagccaattgaccaatcgccacattgactgtcaaacgacgcattaaagccttaaaagggcgcttcaagaatccactacgaattcctgaagcgcccttttttaagccccatcgcccgaataacgctagttgtcacccctgcattttcagccgcttgtcccatctgtgcctcggcgtgatacctattaccgccaccgtggaaaaataacgtaggcgtatttgactgtacatacttcatgcggtgttgttgtgccatacatccactgagccccagtactagcaaaaccactagcaaccccgacagccatttcacttttacttgcatgtcctgatccccacctttgattggaacctattatacagggttcctgtcagcgtaagtcaagctttttcaacaattatgggatgacgaacagtgctttcatcatttggatggcataaaaacagacttgggaaatgatcccaagtctgtgatttaatgcgcctgtgctgctttacgttaggtcaatgcttatcactactattcgaccagttaccacgagctgtaattcgtggtgtttgattgcctcgctgatattcttgtttgacggctagttgccccaccaaatttaaatagttgaacggttgattaaaattcggctgaaagaacatatccacgtaagccaaatcatcaatcgtattctgattttgaatcattactgagatcgtgtttgcagcttgggcaatgtcgtgacgactccagaattgcgcgccgagaagctgacgattctgataattataaactagttcaatcgtgactttggccgtcgtcggcatataagctggccgccaattgccttgatagacggcgtgtcgtactggtagttctcgtctttgcgcggctagataggtcaaaccagttgtggccatcgtgtgatcaaataattgcatggctgaggtggcttgcgttcccatgtacggctgtaaatctccgaaaacattgatccccgccaacgcaccttggcgcagtgcgttagttgccaatggtgtatacgccggctgtcccgtgggattataattgaccacgcaagcatccccagccgcataaatatccgggtcagaggtttgaacataatcattgatcaagatagcaccatggcggtccatagcgacctgcccgcgtaacaattccgtattcggcataaagcccgcgcaaacgacggccagatcaacctcataatcaccctgcgcggtttcaacgatcaactgatcattcgaaccgcttgcgaatccagtcacccgttcattgaggtggatatcgacctggtgatgttgtaagagtttagttgcagcatccgccatttgggggccaagataattattcaaaatatgtgaatgcgaatgaaataacatgacttgttggtccatactagcatagctttccgctaactcggtccccatatatccggccccaacaattgcaacgcgttggttggcctgtagagattgataaagttgttccgcctgctcgtagtttttgcacagtaatactttctcatgatcgatacccataattggtggcacaataactgatgaaccagttgccataatcagcttatcataagtgtcatcaaagacttcgccagtctgcatattggcgacctgcaccgttttatggcccgtatcaattcgtaaaacattatggcgggtcttaacttgagcgcctaactgcttcaagtcagacggcgaggtgtaaaacatgtcttccaggtgttggatgacacccgttaagtacaaataaatcccactcgaaacaaacgaaacgttatcattccgctcgtaaatcgtcaccgccgtctccggatgacgtgttaaaatttcgcgtgccgctgccgtaccagcgtgggtactaccgatgatcattactttcatcttaccggatcttccattcttccagatttgccacgtaattagtaagtgggctcaacattaaccactgttcaattaattatatcgcgcaccaaatcatttgtatatgtgttgatgaaaacaaacctagttggcccctcgttcaaacagcctagctttacaaccactgattagctttcgccacacgaatcgcttctaatcgattgtgaacccccaatttgctaaaaatggcggataagtaattacgggtcgtccccgctgacaagtataaattggccgcaatcgtcttcgtgggcaaccccttctcagcttcgaccaaaactgctagttcccgttcggtcaatggattgttgtctgctgacaacatattcgtgactagctcgggcgcatagatggtgcggccggtcatcacagctcgaattgcatcaattaggtcatcactcggactatcttttaacaaatatcccgcgacattggctttaactgctcgttcaaaataacggcgttgcgcaaaagtcgtcaaaactattactttcgtggctagctgcgaactgtccaatagatcagcaacatccaagccggttatccctggcatttcgatatccagaattgcgacatccggttgcagttcttgcaactcctgccaggcgtttatgccgtctactgcgctacccaccacgtgtagatcatcttctaattccagtaattgggtcaaggcagaattcaacatgctttggtcttctgctaagtataaagttatcatgctgactcactactcctttggtaaagttaagatcaactgggtgccgcgccgactactcgtgatggcaaaggtgccctgtttagcttgcaagcgggttcgcatcccggcaatcccgttggcgccctgacgaatcaaggttccacctttaccgtcatctttcagcttaatctgataaatttttgccgtctcgacaaaatcaatccgcacctcgtgcgcgtgtgcgtggcgcatcacattggtcatggcttcaactaacaccgccgcaaaacaactttggaccgttgtcggccacttggttgcctgtgtctcaccagtggtcgtcgtccagacaccaaccgctgctagattacgagtttgggccaataggacttctgtgagcgattgttcatgcaaattattgacgatttcgcgaactaactgtaaattttggcgactggtttgttcgatttcgtccaattctggtgccactttctccggtgctttgacgagtaattttttagctaattccgttttgagtgtaatcattgaaaagctttgtccaagggtatcgtgcaagtcacgcgcgattcgttcacgctcgttacgttccacaattgtttttaatcggcggttagtttggttgagttggcgctgtcgttcaactgaccacgaaaaggtatacgcgagtatgggtgataacaatggaaaaactaagcccatcacgtcaccattatgccacccaaacacaccaggatattgtaaatagtctcgtatacagccaccaattaaaaaggcataataccctaaagcaaaaccataaaattctcgtttaggacgacgaccaagtaaaaagctcacttgccagccgggaaagatgatcataaaattgttagccgcaaataccgcaaacagtcccgtcacaactaactccgctggcatcgtcactgcacgccaatgtggcttctcgacaaccaagatgtacaacacaagaaaaccaccaacaagcaatagccaaagccaatcatgccaagatttaacgggtatgtaagccgcaattgtatacggcaaataggcgagccacacgtagctcgtccattcaatcgtcttcaatttatttttatgatgcgtcaacaacgccattcccccgtttaagtccccgctgaatcacccaactaacaatcactaataggccgcacacccacagcccgataccaagcaaatcgattaattttagtgtaccatgggtgccccagttgaccaacaaatcgttcacataatatgttggcagtcgtttaccaatcacctgtagccagcttggtaataggctaatgggccaccatagaccactaataatggccattggaaaggtaattaaattactagcgacactcaacgtttcggcacgattcaaaaatgagagtccaacgcccataagcaatgtcggtaattgaccaatcagagcaattccaagtatccctagccattgaaccacggttaaatcaacgtggttcacaacgaccgcaatcgcgcctaaaataacgaccgttaacgcattcattcccaaactcatcatgccaatcgaacgatagtacggtactaccccgtgtggcgttaaccgtagccaccgtaatagtccccgttcccgatcatgcattagaatctgggcaatactgaacagcgtactgatcgtcccactataaacgatcatactgcccatataagaccgattaaaaagtgcgatttgagccgttgtgccaccggtaaccattacttttgtaaataacaagtaaaaagctgctggcatcaccaaggcaaaaaactgaaacgctgcgtttcgaataatcaaacgccgtgcatcaaatctcagttgagccattaaaattttcatgctgagactcccttcgtcagatgaacaaaaatatccgtcaatgattcacgactaattgagacttgatgcaactcactgattatgggcatcatcgcttgcagcgtagcgtcaccgtcttcactactcatgcgtagttcgtcgccttgcttagtaaccgcagttactgccgttaaatttgtaaaccgatccgctggcagtctcgtttggcaacgaatctccacttgttggtattgtttttgcaacacggcaaacgagccttgaaagacaaagcgcccgtccttcagcaacataattcgatcagcgatggcttcaatctccggtaggtaatgactggtaatgataatggttttaccagcggccttcaagcgcctaatctgttgccaaaatgtctgttgcgcattggtatccatgccaacggtcggctcgtctaaaaataacaaatcgggatcacctaccagtgccaaagcaaaggtgactcgtcgtaactgtcctccagataacgccgtcaagcgttgctgggctatgtcttgtagcttcaaggtggctaataatgcttgccaatcaaattcaggcagacgttgtgccgcagctagccttaacatatcacgcaccgtcacgccttgaattgtcatatcaccctgcatcattgacccaatctttaatcgcgccgccaggctaccggccgcttgcccgaacaccttgagatggccctgctgaactcgtttgattcctaataacaaatttaacaacgtcgttttgccggccccattttcaccaatcaagccaacaatctcgcccggcatgatcgtcatattaatatcagtcaaaactgactgttgaccataactaaatgcgaccttagttgcttcaatcaacggtgtcattatccccgcctcctttaatgactatagtgtacgccaacgtaatcgggtcgagtagtcgcgtttgtcataatgatcaggtgacaaatgtcattatttcaacagtattgataagttagcataattctttagaaaataacccagacaaaaagtgagcttctggatttacatcaaaagctcatttgaatcacaattaataacgctagttaccgtgctttcaatacccaatgtgccaattgcgaaacgataatgattccaataacaccaatgatacgcaaactcaatggcagtgttcgaccataaatgagccaggcagctaacaccagtaattcaccgccaaaaattacaaatttcattccaacacatccaatccacttttcgctagtatacgagccagccaatacaatgtcgattgatctgccattcctaactgagggtggtcgctgattaactgtgatttcacttcgtttagttgttactcgcctacgtatgtatgtctttaatccgccattctccagttggaaaatgattagtccatcaaaagttcaatacattcaaaggtcattccaaccgttaaattagttttggcactgacaccggctcttatgttaaacttaatcaatcacaacgaaaataaggaggtcgaccattgttaattaagtctttcccgcctgccgagcgaactccgcaattgattagccaattaactcaactctggcgacagtccgtcgacgccagtcaccactttctaacgcccgctgaaatcacaaccattgagcacgaagtccccacagcattacgaaccgttccacaactgctcgttgcagtggatgatcaaaataccccaactggtttcatcggtattgatggttcactagtagccatgctttttatcgccccagccgctagtggcgctggtattggaaccgccttactgcaaactagtattcaggattatggtgccacaacgcttacagtgaatgaacaaaacccacgggcgcgtcaattttatgaacaccgtggtttccaagtcactaatcgccaaccaactgatgatcagggccgtccatatccactattaactatgacttacaactgtgacccattaaacgactgacttgacaaggtcgttttttttataaataatagacttgtccactatttataaaaaaggagtgctgactatcgaatattttagtctaactaaatatattgcgggtatttaccgcgaatccaaaaacagcatcaacacccaactacaggcgctgaacattcgggcgaccgaaagtgacttattactggttgtttacgatcacccggcccaaactcaaaaggacttggctgccagtctgatgctcgatcctagtttattagctcgaactgttcgtcaacttgagcaacgccaactcgtcatccggtttcgtgatcctgccgatcagcgtagtctacgaattaacttgacaccggctggtgaacaaattgctatcgccattaagaaaacattgattgactggtggcatgacttcttcactgctcatccagaagtcaacgagcaagtgtttacgaaccaattacaacaagtttacctcgccttacaagagaaaagagattgaaatcgtcattgaaaaaattcattaaacactttggagtcctcgtaattggtatcctgtgcatgtcagctggcgtcgcactctctaaattatccttattaggaacgtccccaatttcaagtattccgaatgtcattagcaatattacggcaattccaattggccagttgacaattgcttttattttcattttagttctactagaagccatcgttttgcgccggcagttctcctggcaaaacttattgcaattaattccgggtagcctgttcggttggttcatcgatgcttttgtgcggtttttccatagtcttcctaatcaaacatacatcgagcaactcggacttgtcttaatgggaacggtgctcttatcgttaggtgtctttttagaagtcaattcacacgccattatcatgcctggtgaaggacttccgaacgccatcgcactgatgcatcaactcaagtttgccaaagtcaaagtttataatgatttcattctgattggcatttcactagtcctggcactcagctttactcattctttagcgggggttcgggaaggtaccctcattgcagcctttttaactgggcgactcgtaaatttctttaccgaacatgcaaatcgatttgttgcttggatgacaccagccgctgacgcgaacaactaatttccagaattatcaaataaaaacacggtcactggctagtgatcgtgttttttggcttgtgttcacgccaattcgttagtctgccagtgcccgaattctttcagccactaatgcaggtgaacatcggctatccgttaattattctcctaattgatttactttggacccacatgctcgttattacatgttgtagtaattgtcgatcattttcatcgctaccaaacgccacttagcgctggatccccagtcgttacaggcggaccatttattgaccctaatagcaatcaaatcaagattaccttctgtggtatgctgaacagtcatcaacatctcagttgccagcagttaagtacttaagcgcatactctgcatcttcatcaaccctcaataagataactttaatcacttcatccaatttcggcagtccaactctttgtggcaagtgtcgagaatcaagctggttgaaaatcgacttgagccgcacaatctcagcagccatccgcaatataactcaatcgctagcaaccatctcagtcacgagctgtaaatcatgcgaccgtattgatgcaactggtttgatttaccgattatctgcaattaacgccccattggcaccaatcagtagtccgtcctcaaagcccggaatcattggtatcaaatctcgaagcggttcaaaactgattgattttattttgatgctgtcaaaaaacactcacttaactaaaattagctaagtgagtgtctcgtcaactaatggccacgatgttgagcacgatgttttgccaaccgctttgctcgtatcaactgagcatggtcatgtcgggcacgacgctgctgccgcttcttcattaccaagttacgctgatgttctaacttcaacatttgcattgctctagtcggtttgaatcgaacgtgatgttgacgacattgtcgtgccgcacgacgatactcgcgaaccaattgctgctgagcaaccgcactagccgtcgtccattgcagcgttgaccaccgatcttgaattaacaacctaatctggggttcactaggattctgcgtcccaaaggtcactcgggcgacttgatacccgtccgtcgaccaacgctcaaaaacaccctgataaaattgttgatcaaaaaacaccgttaatttgcatcggttaatcaaattaacccctccttaatttcactaacgaaattcggacaaccaaggaaggcaggttactgacagccgttgctgcgtctggactaccgaccagaccgtgtttttaatttcgctaataattagtatgtcagattaagtcagtttgtcaaattagcacttatgtatcaatggaataattaatgcacttagttaatccgacatgaatcatgattaaaacgtgacagtcaatcagactcctgctcgtcagcttgggctactgagcactgtcaccctgccgctcccatcggtcaaccactcgaatggctgataattatgcctccagttagcgtggtaagaatccaccgaaaattggtgcaaactcaaactgtttccggttgatccaagctggcagttgctgaattttaaaatcaagacgttttaaccatagttattgctaaataataacgagtacaacaagtaataattaagattatattaaatatcgtaatactacactattacactgtgattaatagtatactttgtttgtaaaataccttgaagtggttattattagccgcttaaggtttagggggattccaatatgaacacaccactactgaccgtcacgcaattaaatcaatacttcagtcaccagcacattttaaaagccctgaccttcaccattcaaaaggggcatatcgtcgccttagttggtgcaaatggtgccggcaaaacgacactgatgaaatcaatcttagggctcacttcctttactggtcagatttatttaaatggtcagtcaattacgccatgccatcaccaagctttaagcgctgtgggcgccctaattgaatatcccggactctacccattcttgactggccggcaacaactctcactgttcgcaaccggtgccaatcgtacagcacgcattaccaaaatcattgaagcacttagcatgcaagcatttgccgatatactaacgaaacactactcactcggtatgcggcaaaaattgggtgtagccttggctttgctcaatcagcccgcactagtcatcttagatgaacccatgaatggtcttgatccacaggccacaaaagaattacgcgatttaattttatgggcgcaagctcaaggcaccacctttttaatttcaagtcatctcctgagtgaactgcaacgggtcgccaatgacgtcttagttcttgatcacgggcaactgatcgccaatatgagcatgccagcgtttcttgcccaacagcgccccacttatgaattagtaactaatcaagatcaacgggcttatcagctattgcgttctgctggataccacctagttgcagcaacaccaattcgtgtcttaataacgcccggatttcagcttaatccattactgcaactacttttgaccaatcagattcagttacagcggattcaaccccacactgaagacttagaatcatccttattaaccatgctgaaaacggtcaaccactaaggaggtcaatctaatgttcacattgttacgacaagaaaatcgaaaattaatgcaccatcgtgtgattcaactgtttattccatttataatgatttttcaattcataattgcgatatatgccgctcactacccacagctactaacgccatatgatgcatttgtaaacaacgactacggctttattccgctactatttttggcaatcacaattggcagcacttatttaacgaatgaacggcaaaatggcacgttacgagcgctactttatcgcagttattcgcggacccaagtcttagtcagcaaatggctcacgatactcggtctgatgattggcttatctggctttagcaccctcatgagtctcggactgaagttgagcttctttcggcggttacctaattacggtacaatttggcacacttggggtctgaacatgctatcaacaggactgaccctactatttttaatgagtgtcgtcttagaacctgtttaaaatctagctaatttggtatgatagttcaaaaaaggtgattagtcatgaactacccaagcaatatttcccgccaacaatttgaactcattcgtcccgacttagaagctgcacggcgttcaacgaggcctcgaaagtatgatctttatgagttgttctgtgcagttgtctatgttttaagaactggctgtcaatggcgcgagttaccagttgattttcctcgctggcaattggtctattactattatcgcgtatggtctgaggaacagattattgatgaactatcaatcttagatcagtgtttaaaaaaattgtctttaccctacgggaaaaacagtcacgctcggctagaacatctttcataatcattgacgcacaaagcgttaaaaataccgatactgctgagcatcgcggctacgacggtggtaaacgcatatccggcatcaaacgccacctagcggttgatattaacggcttaccacaagcaattcacatcaccacggccaatgtttccgaccgtaatggagccagtgccatgttagctctaaattctgggcatttacagcaagttaaatcggttcttgtcgatggtggctacactggatcgaattttgccgctgatgtttacactaatttaaacgccaccgtccaggtggctaaacgcaatgagcttcataaattcgaagtactgccacaacgctggatcgttgaacgttctttcagttggttggataaatgtcgacgactttggaagaactgtgagcataaactcaattcaagtcgtcaaatggttatcttagcgtttctggtattactcctaagaagattttaaacaggttcttactattgggcaccctattcaccagttcaacaccagccattctgaccggcatcattgggtactttattgtgaccattttcaatcaactttgtttttatttatacgccaaagtcagctggttaaagtggaatccgctcaacatgatcaatctaggcgagcaaatccaaacaccacaactacaacaattaacccgactaaatctatccacgctggcgattggttatatcgcctatctactgttattcttaacgcttgccaactattcttttcaaacccgtaacgtttaaaagcatccagccggtcaaataagattactgaccggctggatgctttatcgattaattgttaatttcatcatattagcgtaactgtcgcacaacttgccaaaagtagcgactccagcgcggttgataaatccaagcaatcagaccaattaatgttgctgaccaaactactgctacatatgaccaactcgtctgtggtgccagcataacgtcggtaatcaatttagtcagtatgatgctcaaccctatcagcattggtacccgccaagccggtaacaaaatcgcttggtggtcacgctccgtgatttgctgggcgctcaaataccgaccaagtatcccgcccaagccccagactagacatccaattgcgatacccaacaaccagtgttgattgaggaacgccaacaaataattaccaggttgaccgaatgaccgtatcaatacaaaccaactgattggtttaacgactgcatagccgacgagcattgccattaccaggttaggcgtgaccaataacactaatgcagaagcggtcatcaaaatcagtgcaacgagcgtggtactgattacattgccgccccagacccaccaattgaattgcgcgaaataaattccgggaatattctgtaccagcaccagcagaaccattaatttcgccaaactatacgcaatgatcgtcgttaaactatagctcaaaaacgtcgcaccaaaaatagctgctcggcgaaatcctaagctctgtaaccactcattctgatgccggtaacgtggaatggcaatgagtgctatgcccactaaaatactgattccccatagaaaatcatttggttcaacattactcccaacgcgcaaattcaccaataatccccgccgatcagcatgataaacttgtaaatattgattcaagtactgctgtttcgaaggtgctactaagccatctacatcctgatactgttgccgccggtggtcgtatttaagacctgaaattagcatgtcatgattctgatctagcatttgccagtgttgattcattctgaagccagtccacgcccccagtgctataaacaaaatcagcataccaatgagaagtggcgcatgctgccaaataatcaagtgccccaattttttattcatctcacaacttcccccagttgatggtaacgacggccaacacgatagacgagcagtgccatcatagtcagcacgattccgaccaattcataccacggcgcaattgttcccatcaaaggcagtagtaggatgtccccaagtgttgagccaatactcaaactaatcaaagcactggcgataaccccattaaatagcgattgttgccgcaatgtggtgatatccgctgaccattgacgacaggccacccaagttaatcccagtagcatcagcaagcccactaatgccatgattgccgctaccccgtagtgaacatgtaaccagatactaggcaacgactgaatgtgaaaccaccgcaaccacatatttgtccgcgttaacattcccgacgcccaacgccaggtcagagtgctgatcaggattgctaaccataaccgctgattaaagctccccaccagccaagcaagcataattaggcacccactgaccatcgtcactgccacactacttcccaagagggcggccccgttacggtattgctgataaacttgggggattgcagccgtgatccagccataataaatcacttgacttacaaaaacggtgaccattaatagcagcccgagccgcagctgttgccaccaaatttgccaacgcgtaacacctaaaccagccataaactcgaagcggtgtgtgcgacgaccccataatgcaagcagcaaaccgctgacgagtcccaaaacataatacaaacggttgggttgttgggcccgcactgcctgattgggatccgtagaagtgtattcgccaggccaaaaaaactggtcaagatgttcataataaacatgcaggctaaccgccggacgaccggcaactttatagtctttcgggtgtttaacaaaatccgcagcgttgatccgttcaccacgtacactccgggcatgttccacctgccaagtatgtgtcacattaattgccattaataagctcactaacagacacgttgccgtcacaagtcgcacccaaggccgattttgttgccaccataaccgtctcaattttacagttgccattctacacaccaccccaaacagcttgccggtcgcccaatttaactcggaaaacatctgtaatggtcaacggctggacggccatcatcaatggttgagtttgttggagcgctgtctcaattgtcggcgtgtagtccgcaaagtacacttctaagacccgaccgtaaactttaatcagctgcccatgctctttcacaaccgctggtatatgcttatctgcaaaaacaagctgaaacttgcgggccgttgctcgtaaactttctaggtcgtaatcagcaactaattcatgatgttgcaaaaacagcacttggtcgcataaaccgtcaagttcatcaagattatgtgatgaaatcaagaaactgacgccgtgttcggcgacctcctcaaccatataggctacaatccgctcgcgcacgatgatatccaaaccatcaaacggctcatccaaaataatatatggcacgtgactcgctaacgctagcaagatttgaaataacatctgctgaccctttgataaccgctggtagtagcttttggttgataaatgctcggccactaataacgctgttagttgcgattggtcaaagtcatcgtaagccaacgcgtatgtcgttatgatctgtcgcaaccgttgaccaccaaaaaagtgacgttgtgtatcaatataaaataatttttgccgacagtatggttgctgcaaagtcgactgcccctcaatcactaattcgccttcgtccgccaaatagtgatcagccatcgtccgaaagagcgtcgtctttccaacgccgttccgcccgaccaacccaacgattcgacctggctgccaagtaaaagtaatcccccttaatatttcacgattatcaatccgcttacttaatgctttaacttggatactcatcccgtgactcccccttttgataagccgtggtcacccacgcctgaacttgctgcgcactgattcctaaaaattgtgcttccgttaacagtgattgtaagcgcgtctgaagatcatcaaccgcattcgaatcagttgcaatctgactcgattcactcacaaacgtcccccgaccttttacagtatacacggctcgctgatgctccaagatttgataagccttactgaccgtgttcggattaaggtgtatttctgacgccattgctcgaattgaaggcaattgatcccctggtcgtaagacttcctgaacgatctgctgcttaatctgcataactaactgttcgtaatacggtgccccattagttgcaaacggcattttatcacctcggtattgtgtactacgtgtattactacaattagtacactaacatactaatttgagtttgacaactcaacaatcatattcctggcacaaaatgattacctcaaacgtgagtgcgacatcattacagtatgccaaattactgaaaagagtcttaaatttggttgccagttcatcagtgcttgttcatcctattccgacctccgggaaccctgctcgcatgacagatgaacggccactcaacttagtgcaattggtcgccgaattcaattactgcttggaacattgaacaaacgttaatgtggtctcagttgtttggaatctcagtcataatatggtgactgagaattaatgaacgaatcacagttcgattatcaaactgacagttactgataaaattgctgtctctaaaatagcaacgaccaagccagcaaaagttggggacatccctgtcagccattcgaataccttcccaactggaaggcatttcggccaatgctcagcactgccaaagtgtgtggttcagacggcttgagactgaggattagcccaactaaggtgttaagcggtaaactcatcgcgtcgctacccggaaggctcatcggacccgaacacgtttcgtcaatatggcattaagacgtgggttgcggcttaaatcagtgtccaccacgttttaacatctacataagcaaaaaaaacgcctgaccaatcagcacctttagctggttagtcagacgtcatcatctggtgattattccaagaaatcttttaactgtttactacgtgatgggtggcgtaacttccgtagcgccttggcttcgatttggcggatccgttcacgggtcacaccgaagacttttccaacttcttccagtgtccgggtccgaccatcatcaagtccgaaccgtaagcgtaagacgttttcttcccggtccgtcaaggtatcaaggacaccttccagttgttctttcaacaattcataagccgcggcatccgctggtgaggttgcgtcttggtcttcgatgaagtcacctaagtgtgaatcgtcctcttcaccaattggcgtttccaatgaaacgggttcttgtgcgatcttcaagatttcacgaaccttttccgttggcatgtccatttcagccccaatttcttcaggagttggttcgcgccctaaatcttgtaacagttgccgttgaattcgaattaatttgttaatagtttcgaccatgtgcactggaatccgaatggtccgcgcttggtcggcaattgcccgcgtaattgcttggcgaatccaccaagtcgcgtacgttgagaacttgaatcctttacggtaatcaaacttttcaacggccttcattagccccatgttaccttcttgaatcaaatcaaggaattgcattccccgacccacgtaacgtttggcaatcgaaacgaccaaccgtaagttggcttcggctaattcttgcttggcagattcatcaccttgttcgattcggagtgctaaagcgacttcttcgtcagccgttaacaagtcgacacgaccaatttctttcaaatacatccgcacgggatcattgattttaattccagaagccgagccagcgtcactaagttccttcttagaaacttttttgacacttttgaccgctcgagcatcaggatcacctttttcatcaacaacactaatcccagcatcttcaaccttttgtaataatttatcaatgccactagcatctagtttgtaaggcgctgctaatttatctgataattcatcatattgaatgctaccagttttcttatattccttaattaatgctttaacggctttgtcgtattccgtcgttgcttttgcctttgccatgtagtagcctcctatttagtatgcatctaccagctgatcggttgcaataccgagccaaccttaagtatatcattttcacgcctagttatcagctcgttggacctgctgttgttgccgatataggtcaattaatgccaacgttaactgctgaaccaaatcacgattaccgatctgcttggctgccattaactcggccttcttactgttgatttgttctaccagcggctgttgattcatgatcacgttgactagatcagcaatctcttccttggaagattcattggcaacgtccataaattccaaactcgtgacgacaggctgtaaatctgaatccgtcataaaatccgtaaagttgcccaaatcaaattgattatgcgttttaaaataagcctccgcatacaccaagatttgttgatacgaatcatgaacaaaatgaaaaccagcaatcgccatcactcgtaaccaaacatcgtggtcattcaacaaacggtacagtaacaaccgctccgctttctctacccgacttaacgggccactgttcgtactgccatccaccgtggctgggggtggccctagcggcgcaggtgctggtggcggagctacttgcgtttcatccgagtgaccaccaccacgtcgaacggcctgctgaccgaccagtgatcgtaactgttgctttaaatcatccttatcaagatcaaactccgccactaattggtttaaatataaatcctgttcgacactagaggacagttgtgctaattgttgcaaaaccgcctgtaaataagtcaattgatcgggcgtgttttgcaagttcaaatcatgttttaaatactgcatttcaaatgcagtgggcgtttgcttaccgtcttcaaatacttggacaaacttctcctgcccctgagcacgcaaatactcgtcgggatccatcccatcaggcatttggatcacacccagattaaggcgactgttaccacctagcaatttcagagcacgatcagtcgccttttgccccggcatatcgctatcgtaacagacatataaggtgtcggtaacgcgctcaagcatgtaaatctgctcatcagttaagctcgtccccattgatgcgaccccgttctgaataccagaacgataagccgcaatcacatccataaagccttcaaacagcaccaccgacttttgttgtcgaatggggccccgtgctaagtcaaagttaaataatactgaacgcttgttgaacagcttcgtttccggactattcaaatacttaggttcattaggtgactttttgaggattcgacctgagaaagcaatcacccgaccactcgcgtctttaatcggaaacaagacccggtcaacgaagcgatcacgtaagtcacccgcttgattttcaatgaacagtcccgactgccgtagtagttggtagtcggtctggtgttctttaaaaaaatctaacaagagctgattagcaggtgcatagccgataccaaacgttttaatcgtctcatcatccagcccgcgctcgtgcaagtacttaagcgccggttcacccagttcagtattcactaaaatatgttgatacatcttagcactatccgcgtacaactttaacagatcggcttgttgctgatccttaggtgcggccggttgtgactgcgccgtatagctcgccggcaagtcaatgtgcccaaaatcggccaccttgacgactgcttccggaaaagacaagttttcgagatccataatgaagctgaacacgttgcccccacggccacagctaaaacagtgaaaaatctgcttttgctcattgaccgaaaaggatggcgtgcgctcttcgtgaaagggacacaggccaaataaattcttaccagccttcttcaactgaacgtattttccaataaaatccgcaatgttgactgctgagcggacttgctcaaccttttcctcgggaattcgattggccactttgccaccccatttctactaactaaagtctgacaaaccaaccaaatcattgccgcaatcaaaagccgcatcacgaaatttggatgcgactttgtgcgtgcaaactcttacagaatatatattaccacaagtttgacagcagtgcaataataagttgcccttattagacacatttgtcaaatttgtttgtcagcaagctaaaaaagaagctacagcgcgcttgctgtaacttcttttgattatccacagtccgtgcttatttaacgattaattgattcaagtcacccatcacgttgatcatttgggcgatcgtcaagagttgctttaagtgattatcccgcaccttttcatccttactcatcaccatcgtctgttcaaagtaatcgacgatcaatggtcgtaaggcggccagggctttgaaacggtcctccatgctcatcgctggggtaaattgcttttgcaattcaagaacagcatcgtacaagtgttgttccgcttcattttcaaataaacttggatcaacagtcaaatcaccggctgccagcttagctttcgccgtgatccgcaacagacgagtaaaggcttcaattgtgtccttaaactgcggatcatcttgatgcgcattcagcacatcggctgctttgaacatttcacggatatcctgacgactccctttgataaccgtatcgacgatatcgtagcgaatcttacggttgttaaaccattgtttgacgcgatccgttaagaaatcagcaactggtgccgtttgcttttcgaagtctaagttgtacgtagcatcatgggccactaattccttttgaatatcggcctcgagttgacgaattgggaaatcccaaccttgttcccgtacgatccgtacgattccaaacgcttgacgacgcaaagcaaacggatcattagagccactaggagtcaagccaacggcaaagaagctcgtaatggaatcaactttgtccgcaatagctaacaccgcgccgaccttggacttaggtaagtcgccatcagcgctgattggcatgtaatgctcacgaatagctttaccgactgctggatcttcacccttcaagacagcatacttgtcacccatgaccccttgtaattcagggaattcgccaaccatccctgtcactaaatcaaatttatagatttgcgctgcccggtggagttggttcttttcagtctcagtcaaaccaaaccgatcagccaaaaaatcactgataaccatgacccgctgcatcttctcatacatcgtcccgattttatcatggaagctaacctttttgagtcgttccacatattcttgaatcgagtgttgttgatcttcatgatagaagaaagctgcatcttctaagcgtgccgtcaatactttttgattacctaaagccacgttttccaagtgatccgtgttcccgtttcgaacggaaacaaagtgtggtaataagttatcctcggcatccgttacgtagaagaaccgttgatgatcacgcatcgaagtaatcaagacttcatccgggatcgttaagtatttggtatcaaaatctcccgcaaatgcagttggatattccaccaagttattaacttcttccaacaagtcttcattaactttgatttgccagtcgcgttcattcgccaaggccgcgatctgttcacgaatcgttgccttacgcttagcggcatccgcaataacttgaacactagctaagtcagcttcatagtccgcagcagtagcaatttcaacgtcatggcccaagaaacggtggccccgtgaaacacggccagccgcaacgtccagaatttgaaccggcacaacctcgtcatctaataatgacacgatccaacgaatcggccgaatatacttgaaactgtacgtcgaccacttcatcatcgttgggaaattcatcttggtgatgacatccttgattccgcccgtcaatacttcggccgccgttttaccagccgtaaaggtttgtacaaagacatacggggtacccttaacatctttaaagacgatgtcatcagttgacgccccttggcccttagaaaaaccaatcgctgcctttgtccagttgccatccgcatcctgagcaatcttcttagctggaccccgaacttcttttttcacatcagcctgcttgtcagctaagcctaacacctgaaccgttaaccggcgtggtgttgagaaggttttaacatcttcaaaatcaagccgggcatcctttaagaacttgatcattcgttctttaagttgtaacacactcggtgtaacgacgtgggccggcatttcttccaaaccaatttcaagtaaataagttttcgccattatttcgtctcctcctgtgcgtgttttaataacgggaagccacgtttttcacgttgcgccacgaattccttggcaatcgacttcgccatgtttcggattcgatctaaatagccggcacgttccgtgactgaaaccataccgcgagcatccatcaagttgaaggtatgactacatttaagacagtagtcgtacgcggggtgaactaagccgttcttaatttgccgcttggcttccttttcatattcatcaaataacattaataataattcttcgttgctatcttcaaaagcgtacttagaattttcaaattctggttccaagaagatgtcgccatacttcacgccatcgccccattcaaggtcaaatacggaatttacatcctgaatgtaagatgagagtcgttccaaaccataggtgatttcagaagtgacgggatcaacttcaagaccaccaacttgttggaagtacgtgaattggctgatttccatcccgtcgagccaaacttcccaaccaacaccggcacaacccattgatgggttttcccagttatcttccacgaaacgaatatcgtgttctagcgggttaatgccaagtttttccaaactttgtaagtataaatcctgcacgttttctggtgagggtttcatgaccacttggaattggtggtgttggtacaaccggttggggttctcaccataccgaccatcggcaggccgacgtgaaggttcaacgtacgccgcgttccatggttcgggaccgattgcccgtaagaacgtgtaggggctcatcgttccggcccctttttctgtatcatatgattgcattaacatacaaccttgatccgaccaaaacttttgcaaggttaagataatctcttgcactgataactttttgctcattagtatcctcccaaaattagtgactgaacggctgatggctttgaaacgggggcatcgctattcccagacttatggcacaaaaaaagtcccctgtcgtcgacaataacgacatagggacgattggtttcgcggttccaccctacttctgagtaacctcagcagcttaattacacggtattaaagctccgaaagcgccaattaacaactttgactgaccgtttttcaccatcacggtctcactgtaagtcgaatccgttaaccttctctcatcaacacttaactattcagttcttcatcatcatagctgatggtcgttcgtttgtcaatcctcattcttccggggcgccaacggttggtaccaactgcccatctgatcgatgaagcgtttagatttcaatcgaacgcccactgagttctgatagatttcatccaaaatccggcgtaactccgccgctgtccgcggtttgaccttgatcgaatgaaccttagccaaatccaacacggaaaactgacgtagataaaagattgctgctggactagcatgcaagcggtggggatccaaatgccagtgctgttgacagagcaaaccgccgtaactttcagaataatctaacggtaaatcacttcgaccgcaaaccgtacaccaacgcaactctggggccaccccaaacggttgcagtaactgaatttcgaccacgttagccaccaacgcgggggccacatcttgatcaatcagttgcagcgcactggtcaactgttggtaccaccgccccaccggttgattatctggaaaagcgacgtccattaagttcataacgtacgtggcataagcgttcaaagcaatgtcttgactaatatgttcaagatactgtactgacttgacactattaatatacgagagaccttgatcacgtaaatcaccaacgtattcccccatcgtgaacggcaataactccgccgccattttgaagccacgccgacgcgcaccgcggataaaaaacatcttcttgccatactcggcagttaaaaacttgattagcatatcgcgttcccggtagtcccggcgaaagagcaaaatgccgttaaaattcgtgaccatttgttgggccatccggatcacctagcgattctaatagtcatcttgccgatagccatagctggctagcaagtcttgacggtccttccagttctcttggacttttacccagagctcaaggtagaccttatccccaagtaagtgttcaatatcacgccgagctaacgagccaatcttcttgagcatgctaccacccttaccgatgatgatgcccttttgcgaagaccgttcaataataatcgtggcctgaacgtgaattttttcttcatcttgacgtttgatcgaatcaatcacgaccgccgttgaatggggaacttcttgacgagtcaattcaagaaccttttcacgaatcaattcagaaatgataaaccgctctggatgatccgtaatttggtcggacggataatactgcggtccttccggcaattggcccttcaaggtcgtcagtagttcatcaacgttatttccttcaagcgcggaaattggataaacttccttccacggcaaagcgtctttatactgatccataatctccaagagatgatctggatggacttgatcaattttattaatcactaaataaatcggttgtttaaccgttttaagacgatcgataataaagttatccccggcaccacgccgttcgtccgcattaatcatgaatagtacggcatccacttcacccaaagttgacaaggcggacttgaccataaagtcacctaatcgactatgcggtttgtgaatcccaggggtatcaatgaagaccatctgcgtatccgcagtggtataaatcccctggatacggttccgcgtcgtttgggctttgtcagacataatggcgactttttgcccaacgacccgattcaatagtgttgatttaccgacattgggacgaccaataatcgccacaaagccggaatgaaatgcttgttgttctgccataattaattcctttcaatcttgtccaatcgttaaccaattactagtttaaccaactgacaattaagttccaaattttaggtgcaaacaacactaacccaactaagacggcaaaggccgcggcaaacactaccgcaccagccgcaatgtccttaatttttttagctaggggactgaaattaggcccagtgatcatatcggacaggttttctgcaatcgtattgttaatttcacataagatgaccagaaaaatcgctaatgctagccacagccattcgttaacgctcaagtgaacccaccagccagcaaacaaggccaccgcccccagtacaaggtgtgttcgcatattacgttcttcaatcacaaccgttttaagcccagtccacgcgtgtagccaggactgccaaaacgagtgatttttgccaacctgtagccgatctggtctatttttcgaggccataagcgtccaaaatctggcgttgcaatgtaaacatttcggtttcatccgctggctgaagatgatcatacccatttaaatgtaaaaagccgtgaacgaccaagtaacctagctcgcgcgcctccgaatggttcaaaaaagcggcttgttcgctaaccttatcaactgatatcataatatccccgagatttagtggcatttccgccgccatctccggatccatcacaatcaaatcatcctcgtcatcgtcgtgcatcgcaaaactaataacatcagttggacgatcgacaccccgatactgttcattgattttttgaatagcatcgttattcatcagggtcaccgagacctcggtatcatcccgtaactttaacgtctgaccagcaagatcaattaaatcccgaatcaattgcaactgttctggctgcgctcccgttgttgtttggtcgtataattctaaatccataagtgccccctagcgttgttccacacgatcgtacgccgtaataatcttggcaacgaccggatttctgaccacatcatccgccgtaaacttaacgaacgcgacattgctaatgccgcccaaaatctgttcggcttgaatcaagccactcttagtatggtgtggtagatcaatttgtgagatatcaccattaacaatcatcttggcaccgaaacctagccgcgtcaaaaacatcttcatctgggcattcgtcgtattctgtgcttcatccaagatgacgaacgcatggtcaagcgtccgtccccgcatataagccagcggtgcgatttcgatgataccacgatccattaagcgctgcgtatgttcagcgccataaatatcgtacaacgcatcataaattggccgcaggtacggatcgactttttcctttaaatcaccaggtagaaagccaagactctcaccagcttcaaccgctggccgcgtcaaaatcagcttctcgacatcgccccgttttaaggctgcaattgccatcacaacggcaagataggtcttcccagtcccggctggaccaataccaaacgtaatatcacttttagcaacggcttgcacatactgccgctgaccaaagtttttgacacgaatgggccgtccacgattgtccttaattaaggtctctgaatagaggtctttaaagtaatccaaagtcccccggttgaccatcttaatagcgctaataacatctggcgccccaatctgaataccttgtttaattaaactcgttaaattatctagtactgcttgcgtattatgaacagcaacctcgtcatcactgctgatcgtcatttgatccccaaacacgtgcaattgaacgtgtaacccatcctcaagcaaagctaagtgggcgtcttctggtcctaatagcgcgactgactgggccggatcggcaatgagaaatttttgttcatattttgagttttcggtcaaaaacatggactcctttattgacagatttaatcaccattatttaataatggcacccgcagttagcgtgataaccacgctgatttcagcaggtatttgttagttaatcatagcataaaagcccccatcgaaccagtacaaggacgcctcggcattcgacaacgattttctgaacagcatttttctttcgagcgattaaattggcacgctatcaatcaacgtaagcccagttagatcagtccctgcacccattgctgatacttaatctgaacaaccggtactgcatttctgatcaaccagaagaaacaaaaaaaccggagaaaaatttctccggttaaccgttaattcaataatgatttaactgtttggttgatcagcttgccatccgcctgacctttaagttttggcatcactgcccccatcaccttgccaaagtcacctttaccagtagctccgacttgttgaatggtgtcagcaacaatctgttgaacttcttcgtccgacaattgttttggcatgtactgctcaacaattgcaatttctgctttaacgccgtcgactaaatcttgacgacccgcattttcgaattcacttaatgattcgcgccgttgtttcagttcacgtgagagcacgcttacttcctcatcagccgttaaatcatggccaacattaatttgttcattcatcaatgctgacttaagcatccgtataacgctgagggcttgcttatcgcgtgccttcatcgcagcttttagatcaccattgagtgtatcgattaaactcattggttttccctcctcgttaggtcattagtaatcaatactaattacttgaaacgacgacggttcttacgcttacgtgctgcttcagattttaacttcttcttcacacttggtttttcgtagaattcccgtttgcggtattcttgtaaagtaccactctttgaaacggtacgcttaaagcgacgaagagcatcatcaagagattcgtttttacgaacgactgtttttgccatgttaaattccctccctccgagctcaaaaagtaaccgttaaattatgcatacttacacataacgcaactgttctagtaaattatacataaattgaaaaaggccgtcaaccaaagtttacaatttccttaaaataaatcgttaagagcaacgtcagttcggacagtaaatcgttttcatcccccgccagctatgctacactaagactattatcgaaccgaaatgaggttattctatgtcagcaattaaagtctttattttatctgattccatcggtgaaacagctcataacgtggccttagctgccgctgcacaattctccgactatgacattcgctatcagcgtttcccatttgtccgcaccgactcactgctccagacggttttgtcgcaggcactgaaggaacacgccgccatctttcatacgtttgtcgatcgccggctcagccaaatcgttaaccaattttgcgaagcgcacgagttgccttattatgacgtcattacaccagctttagatactttttcacagattacgcacgtccaaccgtccaatcaccccggtaccgtacacgcgttaaacaccaactacttcgaccggatcaacgcgatcgaatttgcggtcacttacgatgatggtaagaatccgagtggctttttagaggccgacgtggtcttactgggtgtctcccggacctctaagactcccctgtcactctacttagctaatcgtaacctgaaagtcgccaacttgccactagttcctcaggcccaaattcctgacgaaatttggaaagttgatccgaaaaagatttttggcctaactaacgatcctgaaaagttaaacgatattcgccggcagcgaatggtccaatatgggcttaatcccgacaccatgtattccaacacggataaaattaaagccgagttggaatacgccgacaagatcttcaaaaagattgggtgtttagttatcaatgtcgctaataagtcaatcgaagaaaccgccactttaattaccgaaagcttgaatactgacgacactaacaatggctagtatcactaattgccaactcaccgatgccgcctaagttttcctgacaatcagcgcgtgccaccttctaacggtcagcgcgcgcttttttgcatcatttttcttatcattaattaggtcagctactaatcatcagtcgtgtcactcacacgagctcgacaccaccgtcaacgtgcaacacttgcccagtcataaactcattttgcatcaaataaacatacgccgacgcgacttcggcgggcgttgccacgcgtttcaagggattaccagcactgacggtcgcagcctgggccgccaattgtgcgtccgatagttggcgccaaagaccagtcggcgtccaagtcggtgcaactgcattgacgcgatagtcagtcgccaactctacggcaagtccaacgaccatcgtattaatggcttgattgccaacaatcgctccggaggcattatctggccgcccaccagcacccgaagtaaaaatcagcgaaccgtgttggttaagatggtggctggctaattgggccacttgcagatttgcaaaaaatttatcttcaaccgtctgccgaatcgctgcaatcgaattgtccaagaaccccccacccattgcaccacctaacattgagacgacgtggtcaaatgcgggctgagctgcaaaaaaagtttttagttgcgccagattttgtgcgtctaacgccgttccagtcaaatggtctgatgggcctaattgggtgatggcagctgttacgtgcgccgccgtatgaccgataatatggacatcggcgccttcctgtaaggcttggcgagcaattgccatgccgaaacccgaagtaccaccaatcactaatagccgctgttttttcaattgcatcgtcattttcctccttctaaaacaaaaaacgacaaccgactagcgattatcgttcaattctcattaacgttgctgttcaatatcttcaatcaaatgcggattaaactccccggcccgaagcattgcaatctcatacttataaggtggcaattgatgtttcttatcttccccgacatacggcgtttctaaaatcttgctgatgtctggcaattgtggatgatgggcgaccttattcaaagtatcaaagccaatcgttcccataccgatattcgtgtgccggtccttgtgagcaccttgaggattcttagaatcattgagatggatcactttcaaacgatccagcccaatcacatgatcaaattcattcaggacaccgtcgaaatcgtccttaatcgcgtaaccggcatcactagtatggcaagtatcaaaggtaaccgataacttttcattataagtcaccccgtcgatcatctgtgcgagttcttcaaacgtccggccaacttcagttcctttgccagccatcgtttctagcgcgatttgaacgtgctgctctggccgaataaccgcgttcagtcccttgatgatctgcgcaatggcaacatccgctccggcaccaatatgtgctcccggatggagcgttaattgtgttgcgccaacggcatctgcacgctggatctcttgatagagaaagtccgttgcaaactcaaaataacccggctttttcgtattacctaaattaatgatgtatggggcatgtacgacgatctgccggaggtcatgagcctcgattatcggctgtgcttcgtcaattttcagttcgtcaattggtttacgccgtgtattttggggtgcgcccgtatagatcataaatgtgttggcgccgtaacttgccgcctcattggcagatccgagcaacatgtcgggtgccttcatcgaaacatgtgaacctaatctaagcattgtagtcccatccttttcgcaagtttactaattcctgtcataccttaaagttgccggatacatatgataccggcatgatcactcattatccaaataaatctgtcaagttattctaagcggttgtggtcacccgtggataaaagtacgccaaggtccgctcaatcgcatgaccgtcattacgcgtattccataactgattaaactgggttaactgtaacggcgcacccggcattgctaggacatgattcaagtccaccaccgtccggactaatggtcccggcgcccagtccctaaaatcagcttgcaggcccacttcttgctcatagtggtcccagtcaaagacataaaaaacgattttttgacaatttggtaacaacgcgtagtcaaacacaactgaggagtagtcactgaccaaagtattagcgaccgtcaacaattcatcggtactaaactcaggtaccaatgtcactaggtccgggtaacgggcttgcaaatcacgttcctgctcggccaaatggggatgtaacttaataatcaagtgttgatcgggccgcaactttaattgcttaaaatcagccggcaacgcaaattgaacaccggctcgataagtcggcgcatacaaaataacttcctgttgtttaaacgccggatacttctgataaatggccgttgcggtttgcatcacccagtcggacttacaataccgatccgaacgaggatatcccaagacccgcatccgcgtctgtgggacgtgataactcgctgcaaaaatcgttcccatcttctcagaaccaaccacgtaatcagtaatctgatcatacacggtctgaaatcgacgccgatcatctgcgggccgctgtgccgtctgtggatcaccccaaccaaatgttttgaccgcgccagcagcatgccagagttgaatcagtcgttgtggggcctgccgcgtcaagccagcggtaaagccataataattatcaagataaacgtccgctgcccgggtaatgacgggaattcccgtcaaggcaaatcgaactgaatcatgaaacggccgtgtcacaattcccgcctgtgccagttgtgccgccccggtggctgcactcggcaagtaataaacagtcaagcgcccgggaacgcgctggttcaactgctgaataaaatccaaattgtccgcaaagctcatcaaataaatcacctgatcatttttgctaaagtgcgctagccacgatacaactcgcaccagccagacataaattactttcttcacactggccatcctttcatttcatcattaattattggtaaagcgtgccctacgtgacaatcaaaaatgtgccagctcaattacgcttaaaaagttcagattagcgtcaacttacttgagccgtctgccttagtccactaaatataaacaactatttttcaagtctgttccccgttagttgttcattagctctgggtctaactgatatgcacttatgatccagcaataacacaatgcttgtattatataacagatgcccacacttcggctagtcgggtcactattaatagtggtgtaaaagtcgtccccgaacgcctaattaaaaagtgcttgcaaacaagtcccgaaagtcctgtttgcaaacacttttaatctgataaattcatcaaggcttcggttcataaaagtgaccgagaatcttgaccgtatctgaaatgctaacgaaagcgtgcgggtcagattcggccatggccgccttcaactcgcccatttcgtaacgcgtgatgactgtaaataaaatcgttttatcatcatgttgataagcaccttcagcgttgtgcacgatggtaacgccacgacgaatccgattttgaacgctatcaatcaccgttttagggcgactcgtaataatcatcacttgcatcttctgttggcgcgtatacgtcatatccatgacccgaccatttacaaacaacccgagtgcggaataaaaggcatatggccacccgtaaacaaagccagccgcaatgacaatgatcgagttgaacgccatgttgatcgtcccaatactgcgacccgttttacggcgtaacacgataccgataatatcgaggccaccggttgaaatcccatttttgagggccgttccggtcccgaaaccattaacagcacccccaaaaatcgcacaaatgatggggtcatgggtcaaaccaactggggcaatcagtttgatcataatactagatagcgtaacagctaagaacgtatacaacgtaaacttatgcccaatcgatcgccacgcaataataaacattggaacattcaaaataaacagtaacgccgcagttgaaatctgaacgggaagaaacttgctcatcaaactattaatcaattgtgcaagcccagtgattcctgaagaataaatatgccccggcgtccaaaagtagttcatggcaatggaaactaaaatggcgtatataaaagcagttgacgctttcacaacatcacgatggtgtttggataactgctgaaaatcatccatgaattaagtgtgctcctttacgtttttgctttcgttattgtaacacgccgattcgcaaacggccggtcttttgcagtattctgctaaaagtctcacgtttctcagcaaactcccattaatcaatccgactaatttccagaacgagccccgctacgatagttattattagatcacacctatcgcgatgaccagcaactcacgcttagtccactttaggtgcatcggcccactgctcggcgatgaaatcagcgcggccacccgcttcttgttccgcaaataccactggattatttttataaaagcgttggtggcgtgcctcggctggataaaatggtttagcatcctcaatcgccgttacgattggtttactaaatcgttcgctcacctgtaatgcccgtttagacgcttccgcgatccgccgttgttccggaccattcacaaaaatgaccggccgataattatcaccacgatcttgaaattgccccattgcatcggtaggatccgtttgatgccaataaatattgactaattccgtgtaactaatgatatcgggatcaaacgtaattttgacagcttcagtatgacccgtcgtatgcgctttgacgtcttcgtaagtgggatttttcgtgtgtccaccagtataacccgagacaacactgtcgattccgggttgactatcaaaaggctgaaccatgcaccaaaaacatccacccgcaaaaattgctgtttccatgagaattcctccaattaaatattaatataaatttaacactaattaaaaagaacgtccatttctggacgctcttaatatttttattcggttggttcatcatccgttacgggattggtaatattcaaatccaaatcagctaattgctggtcagaaacccgcgatggtgcattggtcattggttctgacgccttggaattcttagggaaggcgatcacttcacgaatgttgtcgttacctgataataacatcgcgaaccggtctaacccgattgctaagccaccatgaggcggaaagcccatgtcaagggcatccagtaagaacccaaattgttcttgggctcgttccttagtgaagtccaatgccttgaacatcttttcttgtaattcgcgggtatgaatccggatcgacccgcccccgagttcataaccattcaagatgatatcatatgattgtgcatgggctttgtgtggatcttcgccatcattcaagtaatgaacatcttcttcattgggcattgtgaatggatggtgagctggtacccagcgctcgatgccttcatcatattcaaacaatggccagtcaacgatccataggtaagcgtattgatcttgatcaatcaagtcaagttccttagcaatcgcggtccgtaagtaacccagcgtgtcagaaactactttgaaactgtcggcagcaaacaataataagtcgcctggtttagcagcagcagcactcgtaatggcttcaaagtcaccatcgttcttgaagaatttcgcaacgggaccactaaagccgtcgtcagtgaccttcatccaagctaagcccttagccccaaaccgtttaacgtactccgtgtacgcatcgatttgctttctagaatattgatcagcaccgccaggaactgcaatcgccttgaccaggccaccattagcgagtgcattatcaaagactttaaagccggcgttagaaacggccgcgcccatgtctttgagttccataccaaagcgcacatccggcttttcagaaccaaaacggtccatagcttcttgccaagtcatccgcgtaaacggcgtcttgatgtcaacacccttgacgtccttcatgacttgcttaatcaagccttcagtataggactgaatttcctcagccgttaagaaggatgtctccatatcaatctgggtaaattcaggctgacggtcaccccgcaaatcttcatcacggaaacagcgtgcaatttgatagtagcgatcaaaaccggcccccatcagcaattgcttaaagagttgtggtgattgtggtaacgcgtaaaaatgcccttgatagacccgcgaaggcactaagtaatcccgggccccttctggcgtcgacttcgttaagaacggcgtttcaatatcatagaacccgttggcatcaaaatagctatgaactgcttgggtgatgccattacgaattttcaatccacgttgcatttctggccgacgcaagtccaagtaacggtacttcaagcgcaattcatctgatacgttaatatcatcttgaatataaaatggcggggttttcgccttatttaagattttggcatcgtgaatctcaacttcaactttaccagtcttcatgcggtcattaacagcgtcagcattccgattaacaacggttccttgcacttcaatgacgtattcgccccgtaactgatctgctaccgccaaagcatccgctgaaaattcctgactaaagactaattgcacaattccttcacggtcccgtaaatcaataaaaatcaaactcccaaggtcgcggcgtttttgtacccaaccttgtaaagtgaccgtttggcctaaataatcctcattgatgagacccgcatatgtggtccgtttcataaacgcttcctccttataaatcggcaaacttgccgttcacactacttatctaaaacttgatgagcatcttgatagatgtccgccatcgcaaccttggtttcctcaccagtagccatagccttcaagttaacgacctgatcagccagctcggtttcgcccaccgtcatcgtgtaacgggcattcaagcgatcagcactcttgaactgagctttaggcttgcgatccaagtaatcccgttcggccttataaccggctgcccgtaatgcctgtaccagcttcaaagtcgtagcactagcagtgtcgccaattcccacaacatagacgtccaactgatcatcagttggtaccgcaatgttttcagcatccatcaacactaatagtcgttcaacacctaggccaaagccaacacccgaaacttcagggccacctaattccttaaccaatccgttgtaacgacccccagcacagatcgtcgtgtagcccttgcctaacgcttttgagtgggtcataatttcaaaaatcgtatggttataataatctaatccccggaccatcgtggcatcaatctcgtacggaattgctaatgcatctaaatacgtcttagtttgatcaaaatgcgcttgagcttccggagacaagtaatctaaaatcgatggtgcatcggccacaaattgttgatcttccggtgccttactatctaaaacccgcaatggattcttgtgtaaccgttccttggagtcatcactcaattcatcaaagtgtggttccaaataatcaatcaaggcttgtcggtaatcatcacgcgtttgttgatcacccaacgtgttgatgaccagtttcaaatcagtcaagccaaaggttttaagtaagttatagcccattgcaattacttcaacgtctagggcagcactttcactaccaaaagcttccacgcctaattggtggaactcacgtaaccgacctgattggggccgttcataacggaacattggtcccatgtaataaaccttgtatggtttgagaacttgcggaccgtacaacttgttttcaacgaacgcccggacgacgccggcagttccttctgggcggagcgtaatgtgccggtcacccttgtcatgaaaatcgtacatttccttcgttacaatatcagaagtatcccccgctgaacgtgagaagacctcgaagttttcaaacatcggtgtccggatctctttgaattgataagtcttgaagacggcacgagccgttgcttcaacgtattgccacttttcactatcgccaggcaaaatgtcggcggtgcctttaggccgttgatatctcattaatagttcctcccttgattgcaatcgacaaaaaaagcgcccttgattatttaccaagggcgctattagcgcggtaccacctttttgagtactaattgataacgtctgtaatcacaggcggaacgctgccgttcacctcaaaagcgtctcctcattgcgcactatccggaattctcagcactaccggtctctggttatagtggcgtacaatgctcttactttctctgcggtcgattgattaatatatggttaaagttacacgaaaatcacttaaaagtcaacgattctagttaaaattatctcaagatttcgtcggtcagctgtttttttggtatactatttgcagcacttcaaattgcaattatcttaaatctagttggtgacagagcatgcaagttttaaaacaattttggcgtcaaatcacagtcacggttatttttatcggcctagtgattggctttgtagtgctattagcgactaataacactgcgactgttaacattgccaacgtcaatattcgtagcggtccaggcatgagttatgcgatcgaggacgctacgtctaagggcaccaaggtccacattatgaaacgcaaaaataattggctatacgtccgttatgcggatcataaattcggctggattgctagttggttagtcaacgaacataacagtcagttgactaaaaccaccaaaatctctgaagccaccatcgttttagatcccggacacggcggttctgattccggggcgctctcgagcaagggcaagatggaaaaaacgtacacgttacgggtcgctaaagctgtagctaaaaagctccggactgctggcgcacacgttgttttaacccgtgattcagatgaatacgtcggcctgagtgcgcgtcccgcaatcgcaaacaagcttcatgcagacgccttcatcagcttccactttgacagctcaccagaaaaaaacacggcttctgggatcacgacctattactatcataagtcaacctcactagcactagccaaggcgttaaacaataacgtctcgaccttgccaattcctagtaaaggaacggacttcggtgactttctggtcattcgtgataattcacgaccatccgtattgatggaactgggttatattaatgataagtcggacttcaagacgatcagttctaaaaagtaccctcaagaagtagcgcacgcggtttacgccggattgagtacctacttcgccaatcaataataatgcagtcagcatgaagtctttgaaagtggccgttattccagtgactgggataacggccacttttcgcgactactcaatcgatgaatcgcatatcaactgacgcggtttacctaaataaccgtctatttgcctgcactttagctccgtaccggacgtctaacctcatttcacactcttacggatcagcgccactaattgttaataacaattaattgcgttacagtgatggtaaccgtatttaacatcgcagcaaggaggagttaacatgcacttaacaaaagcttggctcgcacaactaccactcactgacattcagcaagtgcaaccagtgagcggtggcgacatcaacgcggcctttcaaatcatcacccttcatcaccaatattttttaaaggtccagccgcacaacgacgttactttctttgaccacgaagtcgctggattgcgactacttggtgcagtgactaagacaccgcgtgtcatcgccagtggcacgattgccacggacggctatctcttattagattggctagcgaccgggactggcagtcaatccgcactgggagcggctgtcgccaaagttcatcatcaacaccacgcccaatttggtcttgaccacgacttcacagctggcaagttaccgaaaattaatcattggcagactgattgggcaactttctatacacaacaacgtttagatgtattagtcaatttggctaaggagaaccatttatggtcagaaacgcgtgaaatacattatcaccgcttacgacaacaactgttgcaagattcccacatgcatacggtaaaaccaagcctgttacatggcgatttgtggtcaggtaattacttatttgacacgaccggtacacccgttttgatcgatcccgacgtgttttacggtgaccgagagatggatctggccatgacgacgatttttggtggttttgatgctgatttttatcaggcctaccaagcggcctacccggttgcgcccggtatgcaagaccgcctaccaagctaccaactctattatttactggcccacctgaacctgtttggtgaaacatacggaccagccgttgaccgaatcctcatgcaatattaatacaagcctcgtgaccgaatcctctcaatgagctgtacgggtcgcgaggcttgtatataattttttagctacaatcatcagttatcacaatatttcgagtgtctagactagtcgacaaaggtcaataagtcgtttaaatccgtaacttgaacttccggggcactagtcaccgtaatcaggcggtcaatatcaaataaatatccggtaatcccagcattgtgaccggcatcgatgtccaagttgcgatcacccaccataacggcgcgttgacagtcgacctggtgtttattcaataaataattcaacgcagctggatcaggtttacgtgggaatggctgagcagccgtgaccgcatctgtgaaatattgggctaaacccgctcgttgtaaataggcttgtgcgctttcgtcacgatgggtcatcaaataattgtgaccaccaactgcgataactttttcaagcaccgcttgagcacccgcaaaggcggccggtgcatgctgtaattgtggctcccaacgttgatagcccgcccgtaaatcatgccaatcccaaccatactgagccgcaaccattctttccgcataaccaactgactgttgccgcatcagctggtacgttgtatcagccggaatagtcccacctaactcggcaactgctttttggaaagcttggaccatggctggataagtatctaacaaggttccatcgaggtcccataaaaactcacgcatctcattcactcccgctaataattgtaatagccaaaaagctgaaagtaccggattggtctttcagcttttacttcaacgttgatcagtatcataacaaatcgtgaccggcccatcgttaaccaaggaaacttgcatatcggcaccaaattcaccagtcgcaacggtcacgccactggcagctaattgctgattaaatgtatcatacaatttgctagccaattcaggattacccgccgctgtaaaacttggtcgattaccatggcgcgtctccgcgtataacgtaaactgcgatatcgacaagattgctccaccgacttgttgaatattcaaattcatttttccatctgcgtcactaaaaacgcggaggtttaaaatcttatgcgcgatgtaatccaattcggcttgaccatcgccatcttgaaaaccaaccaataggacgaaaccgtggtcaatcgtgccccgaactttcccatcaatactaacttgtgcctgctgtgaccgctgaacaatgactcgcatagaagcctcctaaaacattttccgttcgacaacgtaaaggtcctgaacatttttcagactgtcaatgattcgttggagatgttccaagttgcgaacccccaacgaaacactaataatgaccatcttgttgtgatcgaccttaccgttgacattggtcaaaaatttcgtgtgattattgataactttcaacacatcgttgagcatgccattacggttataaccttgaatttccaaatcagaattgtagttcgttcggtcaccctcgggattctcccactgaacatcaatcaaccgttcaccatttgcttctgcgctcttaacgttcggacaatcaacacggtgaaccgaaacaccgcgccccttcgtaatataaccaacaatctcatcacccggaattggagaacagcaatgacttagacgtacgagtaagttgtcgacgccttgaataatcaccccaccagaagatgagaccttttgccgcttccaatcctgcttctcctgatcctcattatgatgatctttcgatttcttcttcgctggcgcttccgtagagtctgccaaaatggcctcctcacgttcacgctgccgattagcctcgcgctgtttacgaacatcactcgttaaccggttagcaatccctaccggttggacgtcaccaaaccccaaggccgcgaacaaatcatcctcactaccgtagtgcatcttttgagcgaccgccgtcaccttgtccttagtcatgatttcttttggattaaactctaaatcacgtagctgcttctcaagcaaatcacgacccgtaatgatgttttcctcacggtcagcattgcggaagaactgtttgattttattacgggcccgccgcgtatagactaatttctgccaatcacggctaggaccagttgaactagtggacgttaaaatatccacgatatcaccatttttgatttggtaatccaatggaacgatcttgccattgactttcgcaccagtcgtatggttacccacttccgtatggatcgaatatgccatatccagtggtccagcgccctttggtaattctgtcacgtcacccttgggcgtaaaagcatagacccggtcactaaagaggtcgcccttgacgccctccataaagtcggcagcgtccttactttcatcctgtagctcaatgatttctttgactaagttcaacttgttgcccgactgagtctcttggacctcgtcgcgtttaccttccttatacgcccagtgtgctgcgaccccgtattcagcgacccggtgcatttcaaacgtccggatctgtatttcgaggggcttaccttcaggaccgaccaccgtggtatgcaaagattgatacatattggccttgggcatcgcaatataatctttaaaacgccccggcatgggcttccattgtgtgtgaatcgcacctaaaactgcataacagtccttgattgaatccacgactacccgaattgccagcagatcgtaaagttggctaaactgtttgtgtttgtcccgcatcttcttataaattgaatagatatgcttcggacgaccataaatttcagcttctggtagttccagatcatggagcgccttttgaatgtcttgaatggcaatctcgatgtacttttcacggtcctcacgccgcgaattcatcaagtggacaatgcgataatactgttgaggattcaaataacgtagtgaaatatcttctagttcccatttaatcgtgctgatccctaatcgatcggcaatgggggcgtaaatttccaacgtttcatttgcaattcgccgctgtttatcgggccgcagatgctgcaatgtccgcatattatgcaagcgatcagctaatttgacaatcatgactcgaatatctttagacatcgccaacagtaatttacggtgattttcagcaagctgttctttgttggacttgtaccgaatcttacccagcttggtgaccccgtcaacaataacggccacgtcatgaccaaacagttcttcaacgtctcctaaagtaacaccagtatcttccacaacgtcgtgtaagaaacccgaagcgacggtttcagggtccatcttcaattcagctaagataccagcaacttgaatcggatgcataatatacggctcaccagattggcgatactgatccttatgcacataagttgcaaaatcacacgcccgtttaactaacgcgacgtgatcactattcatatacttttgaaccatgtccaggacatcctgggcagtccaggtaggttgtttgggcattttatcaccacgacttccacaaagattctatttaataaaaggcacgtgaggttcccacccaacgtgccttgacaaccgttttaacgcaaactcgcgcggggaccagttaacccatatgctaagtaggatatgcctaaatcaactaacgctaagtaatagacatacgttgggaaaaatagatagagcccgacaaaacagcccactgggaatagccagactaaccagcccgtccgttcagtccgacgaatccaccagccaacgactgctgccagcacaaagtcaactacaaagagtagccatacaatctgatgaaaccggctaatactcgtaaatcgtagcaaccatggtatcatcaccccaacgacaagcgcaatcagccaatactggccattaaacttacgaattttttccgtcaaactaactccctcgcttacgctttattgctaaatgactatgattatttattgtacaccaccgaccgcaaaattacactagttcgcaccaaaaagaaacgctacttagtaagtagaggggtgccgtttcggcccgcatgattcgtggacccaggcccactgccgcgataccagcagtttgtaatgtcgccacttcttgtggtgccaagcccccttcaggaccaaaaatcgccagcagtcgttgtggtgcggtcatcgtttttaacgtctgcaccagttggctgctctcaccttgtttggctgattcctcccacgctacgaccccggtatcatatgacacgtgtgctaacaactggtttaaatccgttgcgtagctcacactaggaatcatcgtccggtgtgactgttcagccgcgccctgcgcaattttcgccaagcgggccaacttgcgggcccgcttattcgctgcccatttagccactgcccactgactatcgaaaaacacgaaggcgctcgcacctaattcagtaccacgttgtacgatctgttcgggtttatcgcctttagacaacccacaagcaatagtcactggcaacggcaattcaacatggggcgtcgtaacggccgtgattgtcgctgtagctgttcgaccatcgcttttcaccaaatccgccagcacgacttgatgtgtcgtcgtaacaaattccgcagtgtcccccggttgtgcgcgcatcaccttgacccagtgtttgaccgtctcacccgtgatagtgaacgtttgcccaatcgttgtcgtaatcggtgttgataaaaagtatcgttgcatttcagtcccccactaatcttcagctgttggtagataagccacaataccgtgccagtcacccatttgcgtatgttgtgtaatttggaagcccgcttccttaattgtcgtcatgacgacctggaacttatcatcgatgatgccagaggtaatgaaatagccgccccgttttaagttttgacgggcttgtggtaccaacggaataataatttcagccaaaatgttggcaacgataatatcagcctgcgtgtcaatcccagctagtaaatcattggcagccacgtgaacatctttggcaactggattcaagtccaaattcgtttgagctgatgccacagcgacatcgtcaagatcgtaagcttctactgcaccgacgcccatcgctttggccgcaatactcaataccccggacccagtacccacatcgatcaagtgttcaccaccattgatcacagtttcaagcgcctgcaaacagagcttggttgtcggatgcgttccggtaccaaaagcctgaccaggatctagtcgcaacacaagctcacctgattgcactggttggtactgttcccaacttggcacaatcgtcaaatagcgcgtaacccggacggggtgatagtattttttccaggccgtcgcccagtcttcatccgataaagccgtcatactgacttcattaggtgctggattcaacccaaaatcagtcagctgactaacccgctgcttgatcgttggaatgacttccggtacaaacaccgtctcaggataataagcagaaatcttcgccccactggtaacgtgtggaatcgtcgccaaatcgatgatctcaccataccgatcaggctttaaattctgataatccaaggcatcatcaattttgacgccactggccccggcttccattaaaatgtttgccaccgcttcgacagcttcattagaagtactgaccgttacttcagtccatttcatatctttatattttcctcccatcgaaagctagagcgccaagcgccatcgcttaagactatcacgtttttcttagtaacaattatataacaagcctgattaacttgacaatcacctggtcatccaaccatgatgttcatgatcgatagtccggcgagaaatcttggatacgaatggattgccggccacaaagtaccgcaatggtgccgttgtccattcacccttgttgacaattccaattcgcggagtcgccataacttgttccggttggcgataatgactcaaatccaatgataaggtcgccggttgcagcgtttgtccatttaacgttttatctaacccaagcgcctgcattagcttgcccggtccgttggtcaagttcgcaatgggcactggccgctgctgttgcattcgttcaagccccacatctggttcaattccgcgaatcaagacacattctggcgtaccggcagcttgtgtcacaatattcagtaagcaccaggccctcatttgataaatataaatcgttcccgctgattgccagagtgcgcgattgcgcggcgtttggtggttctggtacgcgtgagctcctgcatcacgggcgccaagatacgcttctgtttctgtgatccaggcggtcaatacaccgctagatgtctgtaggtgcaactgtttacccagtaggctcgccgcaatttcaggtgtcgtacgtgtgcttaaaaatcgttcgattgctgtcataacttgttttactcgcccctaatagaaaacggactagccaccttgctagtccgtcctcatgttcatttaatcattatttgcggtctttttggttagatgcttattcaaatacttaatcatgtcggcttcatgcttaaagatccgcgggtgcttttgcttgtgcaaccgaaccgcgatctcattgattttgattcgcccggtccaagtatgactgtacttaacgaccacccgattgttgcgatggtccttaccgaatttcaacacgtaaacgctgtcgggcaccatcagcggtctaatatatgttttatcgtagtcataatgtattgatcgcagaaactgtttcgtgcgttttaacatgtcgttgatctctccttcacaatgtgaaattgattaaataataaattaatttatcgttagtatattttcatatctagctattattatagcagactttaaacaagtagtgtaccaatttgccattggtttagcaagtatcgaactttaattcttataaatttgctaaccatttcagaattgtttttgccgcatatccgggtatggtaaaatatgattaaattagtaaggttatcaatattagggggaatttactgatgatactcatcgaaagaatttatcgtcgtggtcatgaacagttgacaacggtcgaccaaatcgaaaaatttcaaaccaatgacggttatgtcacatccaacgaagtcctcgcccgcgaaatcggtgcggatagtgaaaactgcttctacaaaaatcaagagggcaaacgcaaaaaagtcgttgcgaccaaggacgatcagggcacttggcatttaaagaccatcggcacaactgacccgactagcgatggcttattgcaactaccgcatatggatgatgtttggggttaattggtgcttcgtttagaagaactgataattagtgttcgtcagttagaactaccatcaaagactcaggtttctgatggtagtttttttatatacatatcgtacggtatacaagcaacgtaattaatagcaattagtatttttattgaattctaatctatcaatgatacttgcattgatataatctaataagcatgctcttttttattgttggcacagtctgacttcaatgtctttggagccaacactcataacaagctagaagtcattaaaagtcaacttgaaaaacaccttatttggaggagtcttatatgaaaaaagtagtcactggggctgccattgttgcgtcattatttatattaagcggttgtggtaatagttcaaaaacatctactcaatcaagctcacatcacaaagaaactgcgaccaatgtcaaaaaggaaaaaactattacggttaatcattcgagcattgtcacttctgacaatagcaagttctcagttcaaggaagaacggaagaaaatatcggtgtttatcttctcaataagagtggtcaagttaaggatacggttacaagtgattctaaaggcctatttcattttaatgaagacaacgatgatgcaaagactgtcccatattaccttacaatcgatgatattgacgcagatactgatcctatttccaacgaacctaataaaaataacgttaacaagcttaaggtttataaaaaaataattgttaaaccttcttctgaggccgttaattcttataaatcttcatctagttcggctatggattctatggttgctgccaattcttcatttgacgaatcggtatccaaaaataattctagtgatagttcgtcgtctgctgctaaatctactactcgtagtatccattatgataaagttgacttagaaacatttgcaactgaaactgataaatacatcggtaaaaacgtcgaaactagtggagaagttgcctacattcaaaagaatccagataatacagatatctattatgttgttatcctccctaaagatgaccatgcatcttcaggctactcatacgggactgttacagagatcaatgtggatacctttgatgaaactaacattaatgaaggcgataatattactgtaaaaggtggcgcactcacatctaccataaaattaaatggtaagaccttaaaatctgatattgttgttgattcagtatctgtaaattagaaaattggcccccaacacgggcttttatttaaaagtaaaaaagaacatacgtttggacattaggaggatattatcatgattattcaaaaaattaccggaaaagaacaaaaacaattggagctgcaggacaagttttatcccggaccaggacgctcaaaaactaccggctacatcgtcgatgataaatggtccgtgtacatcacctacgtaccatttacaggctatcacgtttctattggggatcatcgctatggacttgtccgacccaactatatcaccgttgacgctattgcacggttggacctattcccctatcgcaagaactacatgctttattctgctggtagtgaagttgttcattttgacattaaagactgaaaggaagtataaaaatgcgaggatcaattagaagacgtggcaaccgctggtattatgcatatgaaggccccaccatagacggtaaacggcagcgaatcgagcacgttggtggtcggacccgtgaagaagcagaacgggccctgcgcaaagcaattgatgagtttgagcgcggcggtgttgtcatcaagttgacagagatgagtgtagcagactacttcgattattggcacgagaattttgttgtaaagactcttaaatataacacgcaaacgaattatcgtaatattatcaacaattacattaagcccgatatcggcatgtaccgaatgaaatcaattggtccagcatcaattcaaaagttcgtaaatgacctacccacagacaagctctcaaagcacactattgagatcattgtttcagtcttacgtaagggctttaagatggccgtcttcccttaccaattaatcaaagaaaatccagcaaactacattgtaaagcccactaataataatgatgatgaaataacccagcaagctgctcgagataagctcaaaatcatcaatatgggccagttcaagcagatactagcacttgttcctgaatctaaccccttgtatctcccacttattatcagcttcaacactggcttgcgccgtggtgaggtttcaggactcacatgggacaacatcgattttgataacaaaaccttgaccgtgaacaagcaaatgattatgaagaaaaaagaatttgacgttacgtcacccaaaactaaggcaagctatcgtacaattgcagtcggaaattcactgctaactgttttaaagcgtttcagaacttaccagaaggaaaataaagtgcgttacggacaattttactttgatagcccatttgtttgtaccaaacaaaatggtaagccgattacccctagcgtaattaaatactacacaactaaactatcacaggaattagactttccatttaattttcactcattacggcacacacacgcaacgatgctgctagaaaatggagccaagtacaaagaaatacagcaacgccttggtcactcacgtatttcaacaacgctagatatctattcccacgtaaccaataagatgaaacgtgatactgttgatatcttcgaaaatatgttaaaaaacaacagttaaaaagatgatagacactttttcgatatatgtatattttgccaacatcacagtttcaatgttggcaaaatgttggcaaaacggaaaaataaaagagctccgcttacgcggaaccctatcagttcggcttttcgtcttcgtcggttttcagaacagccatgaacgcttcttgcgggatttcgactttaccgacagccttcatacgcttcttaccagctttttgcttttcaagtagcttcatccgccgcgtccggtcaccaccgtacagatgggccgtcacgtccttacggtaagctttaatattcgtccgagcaatgactttagaaccaatcgttgcctgtaccggaatttcaaagttttgccgggggataatcgtcttgagcttggcggcaatctcgcgtccacgcgcaggtgcaaagtcgcgatgtgcgataaaactcagagcatcaacttggtcaccgtttaataagatatcgatcttaacgaggtcactggcacggtagccgtctaaatcataatctaacgaggcatagccgcgcgtgttcgactttaatttatcaaagaagtcaaaaatgatttcggacaacggaatgtgataaaccacgttgacccgattactatccaagtactccatcgtatcaaactcgccccgtttacgctgggctaattccatgaccgcaccaacgtaatcattaggcaccataatctgagctttcacatacggttcacgaatttccttgattgcagacgcctcaggcatttcagccgggttttccacctttttctccgtgccatcagtcatccgcacatgatacgttacggacggcgccgtggtaattagttcaagattaaattcccgttcgaggcgctcctgaatgacgtccatgtgtagcagtcccaggaatccacaccggaacccaaagcccagtgcttgtgatgattccgcttcaaattccaatgcggcatcgttcaattttaatttttccaacgcttcccgtaaatcggtgaatttggcattatcagtcggataaatcccagcgtagaccatcggattcatttcacggtaacccgccaatggcttttcggccggatttttcgcgttcgtgaccgtatcacctactcgggtatcctgaatatccttgatgctagccgtaatgtaaccaacatcccccgccatcaaataatcccgtgctaacggtttcggtgaattaacgccgacttccgtcacttcatattcactaccactgttcatcaaccggatccgatctcctggacgaacgatgccttcatgaatccgaacactcagcaccacgccccgataatcatcatagacggaatcaaacactagggccttgagtggcgcatcaagatccccctgaggagccggaatcttatgcacgatttgctcgagcagatcttcgataccaataccggctttcgctgaagctagaacagcatcttccgcatcaatcccaatgtcatcttcaatttctttgcgcaccttttcaggttcagccgatggcaagtcaatcttgttgatcaccgggacaatttccaagtcatcatcaatggctaaatacacgttggctagcgtctgggcttcgaccccttgcgccgcatccacgactaaaaccgccccttcacaggctgcgaggctccgtgagacttcatacgtgaagtcaacatgtccaggtgtatcgatcaagtggaagatataagtctccccatcctttgcttgatagtgtaactctaccgcattcaatttgatcgtaatcccacgttcacgttccaagtccattgagtccaacacttggtcttgcatctcacgtttggaaatcgtatcagttagttccagaatacgatccgccaacgtcgatttgccgtgatcaatatgggcgacgattgaaaaattccgaatatgttgttgtcggtcttgcattgtcgctttatccattgattttcctactttcttcctaaatcctaatccctacaattataccaagttagtggcacaagcacaatttttctatcagaccgctccagacaccccgctgcgccactgaataaatgacgtaacaaaaaagtacaagccaatatggcctgtactttttagcaggttattcaaaatccttgatttcactgggtttgagtaattgccattcttttgaatagaagtcgtcattaatctgataatgaaccggcttcgtcttcttagtcaagaatggatcaaccttttgatccacggctaaccaaccacgccagccaagatgaatcgtatcagtcatgaagtagtccttaccaccgtcctgggtcaggtccaagacgttattaaacccttgactcttcaactggtactgaatcttcttgtcaaactgagcaatcatcttcattgacagtccggtataagcagaccagcgctgattgattggtggaatgatgaacaagacatcggtgtgtgtctttgcaaactgattcaaaaccagttgaaaatcggcaaattctggtgacttcgtgtaattcaagtgtcgctgtgaatctttgagtcgcttgtaattacgttttaacttcgtgttccaaaattgattgctgatttcaagactgttcgagtccgtttgcgccgcaccgattttaccggctaattggtttaactgattaaagttatatgtcgctggtaacttgttagcttgcgcattgacagtccgtaaatttttgcccgcaattccaaaacgtgagaagaactcatcctcactgccaaggacacgtgccttatagttaatatacgtcatttgtgcgctcgttggtttaaacccagctgccacacgtgccagggcgccttccaaaatgcgatcagaagaacccgatggcatctgtaacaaacgttgagcggcataccggtccattgccgtattctgctcatcctgtaaccaatcaatggtctgcagtggtgagtaatagtacgaaaacgcatctttccgcgttccttgtggcacaaaccattgtggcgaaattacaaagacggccttcttatttgtaatctgctttttcaccgattgcatcgcgaaatactgcgtcaacgactgggtcccccgcgcaccgagtagaaatggtcggtaattgcggtgatattttgttgccagtacggacggatgcattggatcaaatcgtgaccattctgaagaaccaaagaacgggacatagccatcatccagcgcctgtcgtttaactaaccgaccttttaatacgttggctgacaaggaaacggccgcttttttctcagtatccttagaaatatggtttaatccaaatgagaacggtgaaagcagtacggccaataataagacggctgccaaaataattggcccaaaaatcttaaaaaggcgtttggcaacgttcattgcaagttctcaacctttgcaacaatcttagccggtgtatcccattctgaccgttgaaattcagagaccggcacttcgattcctaattgattttgaagttccaataaaagttggacggaacccattgaatctaagattccttcatcaaacaggttaacgtccatgttactggaaacatcttcccccgttaagtctgctaaaattgataaaaccgttgcttttgtatcatccattgtcattacgctcccttattgtaattatattatggccgggctccaaagaataacgtgttcaagaatcctgagaagatcaagaaactgaaacaaacgacgttaaacgttaggaaaatcgcaaagtattccgtaaatttattagacggcaactgcgcttgatgtttcttcttgtaccgtaaccaagcatcgttgacaaccattgctaaaccatggaatagcccataaacgatgtaataccatgtttccccgtgccaaaaccccatgatcaacatattaataacgtatgccacgttggccgttgtgatccggctcttaaagaccttgtgtttcatcataaagaataccaaccgcatgtagatgaaatcacggaaccagaaggacaacgtcatgtgccaacgattccagaagtctttgatgttctttgacttaaacggttgattgaagttcatcggagtttcaacacccatcaggtaactgataccgacggcaaacaaactgtaacccgcaaaatcaaagaataaatccatactatagacgtacatcacaccgactaacgcccatgacatgccgtgagcttgcaaggccgcgtgttcaacgacaggtagcatccgcgtaccaaagatataagccaaaatgaacttatataagaatcccaagaaaatgtagcggacccctttttcaactaacccgagatacttttcacgggtcgggacactatcgtaatccttaacgaaccgccgataccggtcaatcggcccagacgagatcgttgggaaaaacagcaagaactggccaaacagtaccggatggaattctttaatcaccccatcacgggtctccatgatcatctggaccactttgaaagtcaggtaggaaattcctaagaaaccaataattgaattagcaccatgtgccacggctggtgtgatcttaacgacagctagtggaataatcgctaaaatcacactgacaacgaaaacccagcccttattaggtgaatctggtcgttgtcgatactttgagtacaaccaaactagtgtgatctgatagaccaaatagataattaacgcgatcccagtgcgccacttaacaccgccaaaggtcagcattaagaagataaacgatatcaatgattcataccaatgggatcgccgaccatataacagaccaatcattaacggtaacaacgcgataaagagcagcacaaagtacgttgggttaccatatgggtcaaaagaaatcattctgggttaacctctttaatgatcgacttgacatcaatcttaccgttaggcgttaatggcaagctcgtttgatagacgaaccgttgtggaatcatgtattccatcatcattccttgtaggtcctttttaattgcagtggtcaaagcaaagtcactttcgaagtcattcggctttggtaccacgtacgcaatcatttgcgttactttgtgctctttatcgtattttggaacggcaacggcttgtttaatatgctgttgctgtgctaagaagtgatccacttcttctagttcgatgcggtaaccatgcattttaatttgaaaatcaacgcggccacgataacggaacagaccgtccgcatccatcgtgccaatatcaccagaatgataggcgggttgcccgtctaattcaaagaaagccttggcagttttttcagagttgttcaaataccccttcgaaacggatggtccggcgataatcagttcaccttccgtgccatttggaaccgcctcaccattttcatcaaccacaagtatccgcgtatcagctttggcataaccaattggtagccgatcatactgcgctaatgcggcatccgtaatttcaatttgagttaccgcgacgcaggtttcagttggcccgtacgtattgaagatccgggcatctgggaaccgtttcttgagtgtcgccgccgtcttatgtgtgagttcctcaccacagaacaagaagtgcgtcaaagttggcaagttttcagcattaaactttggttctagcaaacaaatgtccataaatgatggtgttgagacccaaacgttgattggtaacgtcggcaacgcagcaaataattgtttgaaatcatctgtcacggccttcggtaatgcgtatagtgtcccacctaacgctaaggttgggtaaacgtccatcacggataggtcaaatgaatatggtggttgcgacagcgagttcggctggtcaggcaatccgaagtcatcactcaacatccagtcaacgtaactgaccaagttatcatgactaatttggaccccctttggcatcccagtggtaccagaagtaaagataatatagtaattatcatcgccactaacgacatgatccgcttgataatcaacgggagtcgcaaagatagccgccaattgatctggtgtaatcacgggggttgtcccgacaccggttggcaaatcagcaacagcaataacggcagctggcttagcaatctcattaatcattgttaaccgctcatttggtgaatgtgtatcgattggaatatatgcccgacctgacttaacaactcctaagaaagtcgcaatcatttcaaacgtctgaccaccaaacacaataattggatccttggctggtaaatcgagcgtgtcaagatgcgccgccaaggcatctgaataagcttttaattccgcataagtgtgcgttacaccttgcacatcataaaccacgttattgggttgcgtccgtgcataatcatcaatcgttgtaatgatgttcttaatcataattaaaactccccccaaacaatagtgttactgcatccatttttaaaattcgttgtaaataaacttcgcttggttgatcccactataaccgtaaagataaaccaaggcgagcatgacagcaaagtaaaatactgtaagtgcaatgaattgaacgaccggacgttgaaaccagcttttcaactttgcaaacatgccatcacctcctccactaacccaatgtcagttacttaatatcacccttcattaattccgtaaaaatcttgttggctgttgcttgaataccagcagctttgcgatagtagttactcattaatacaacaccagtcttcccatccggtgagaggaagatgctggattcatagccataaccaagtccgtgtgaccgaataccattactcatgttataaacaccaccgccatattcacctgtggctgtgcgcgtgtgcaaaattgcaacgttcttttttgacagcaactgccctttaagaatggcactttcaacggtaaataaatccgcggtactcatataaacttgcccagtacctaactcattggccatttgtgatttgctttctggcattgtttgatcataattcggaagtgtttggtctgcaagcgctcggtaaccagttgtcgcatcttgaccttgaccatgaatcaaaaagcccgtttcattcagattcaacttgtcaataaaatgtgttgtaaagaagtgctgatatgattgaccagttaccttgcgaataatgccagctagcaacagaaaattaacggatgaataattataaattccatttttatctgggtagtaaaaaacattgtgagccgcaaaatcaattacttgattttctggtaagaattcttttgaaccgctcttcaaacggaaccctgttgtcatatctaacatttggcgaagcgttgtctgacgcccatgctttaaagttggataatacttcgaaatcggatcagtcagcttaactttccccgcctgcaccaactgcataatgccaaccgccgtcattgacttttgaatcgataaaatttgatactttgaattgactttattacgttgatttttagccttgtttgcgtaaccaaaggcacgattataaatgacatggtcattcttaacaactaatgctgaccccacaaaatggcttaggtttaaagccttagtcacttgctcatccgtgttcttattattcgaaaacgttgtctggttaatcttacgactaagctggctattttttaatgccgctttcttattcaatgctttgtcagtttgacgctttttagcaatcgctgcttgccgctctgtatgataaacatagtagccgccaccagcacccacaatcagcagtccaagcaaaactgttactaaaagtttgctttgcttcacaatgattgacctccccattagctatcaattacgaaccgattggtgatattagctacgccgccaataggacgtaagttcaagttatagtgtaacaacctaccgaccaataacggttaggccggctcaaaaagatcaaaatcctgcattttcgttcgctgatacgacatatttgtaacggttttgtaacatcaacgttacgtcccccgtaagctagcagcgtattacttcacctccttgactaattctagcactcactaatccccggacgacaggataacgaaacagtttgcacaaaaaccgtgttactgaaaggtcacttaataaacaggccggagtgcttgattgacactaaaaaaagctgaacaatcctcatcacatttttgtgatgggcatcgcccagctttttgtatatttctggaattagttcgctcggttaaacaccccgaagcttgtcaaataacgaactcttgccattgccagcaactgatttgccgctagctttagcaaaggtcttcaaagcttctttttgacccttgttcaagtgcgttggcgtttcaatattaacggtaacgcgttcatcgccgttgccattgccacgtaatcgtggtgcacctttaccacgtaaccggaaagttgtccccgtctgagtaccagctgggatcttcaacttaacgtccccgtgaaccgttttaacttgaacttcatcaccaagagcggcctgaacgaagtcgatcggcaacttgaagtaaatcgtcgcgccatcccgttcaaagtccttacttggctcaactctgaagataatgaataaatcaccataagggccaccattcgttcccgcttcaccttgattttgaagccgcatttgttggccttcttcaactccagcaggaaccgtcactttgatggaatgactttgttcagtatgaccagagccaccacaagtggcacacttgtccttgatttctttaccagttccatgacaaacgtcacaaacttgttggctcatcattcgaccgagtggcgtattagtctgtacctgaatatagccagcaccatgacatttcgaacaggtcactggtgacgttcctggcttggcaccagagccaccacaagtctcacactgttcctcacgattgtaggtgatggtcgtcttcttaccaaagatcgcatcttcaaacttcagtgtcatctcatactgtaagtctcggccttgttgcggggccgttgggttagaacgccgtgaaccaccagcgccaccaccgaagaaggaactgaaaatatcttcaaagccgccaccgccgccgaagtcaccaaagtcttgaccgccgaaaccgccggcgccaccgaagccttgttggccaccagtcgatccgaattgatcatactgtgcccgcttctgggcatcgcctaacgtttcgtacgcttcattgacagctttaaacttttcttccgcgccaggttcatgattcaaatcaggatgatacttcttcgaaagcttgcggtacgccttcttgatttcgtcctgactggcatccttttcaacacccagaaccttatataagtcttgctctgccattgtaacctcctaatgaaccttaattaagtctcattaatactagcatatttaaagcaaaaaggccaaagccacgtggccttggcctttttgttctgccggtgctacttcttatccttgtctttatccaagtcttcgaaatcaccgtcaaccgtgttgtcatcactgcccttggctgagtcggcattgccagcagcattactgtcggcaccgccttgtgcaccctgagcttcttgagcttgttgatacaacttaactgataagtcctgaacgatcttgttcaaatcgtccttcttggccttcatttcgtcaatgttgttatcatcttgagctttcttcaaagcatcacgagcatctttggctttcttaacttcatcttctgaaaccttgccttcaagatctttcaaagtcttgtcggtagtaaagatcaattggtcaacttcgttcttcaagtcaacttcttctttacgtttcttatcggcttcttcgttttccttggcttccttgaccatttgatcaatttcgtcgtcagaaagacccgatgaactcttgatggtaatcttttgttctttattagttcccatatccttagcagatacgttaacgatcccgttcttatcgatgtcaaacttaacttcgatttgaggaacaccacgaggtgcagccggaatatccgttaattggaagcgacctaacgtcttgttatccgctgccattggccgttcaccttggagcacgtgaatgtcaacagctggttggttatcagccgccgtactaaatacttgcgacttgctggttggaatcgtcgtgttacggtcaatcaacttagtgaagaccccacccatggtttcaataccaagtgaaagtggcgtaacatcgagcaaaacaacgtctttaacatcaccagtgatcacaccaccttgaacagcggcccctaaagcaaccgcttcgtcagggttgatagaatggttagattctttgccagtccacttttcaacagcttcttgaacagctggaatccgagttgacccaccattcaagatgacaacgtctaagtcactagccgataaatcagcatccttcaaggcattttcaacaggaatgcgcgtcttttcaactaggtcagcagttaattcattgaacttagcacgtgttaacgtggtttccaagtgcaatgggccactagcaccagcggaaataaatggcaaactaatttgagcttcagaaacacctgaaaggtccttcttagccttttcagcagcatcctttaaccgttgtaaggccatcttgtcttttgataaatcaacaccgttgtcagctttaaagccatcaactaaccagtcgataatcttttggtcaaagtcatcaccaccaaggtgggtatcaccatttgtggataatacttcgaagaccccgtcgcctaattccaagatggaaacatcaaaagtcccaccaccaaggtcatagactaaaatcttttcatctttgtcggtcttatccaaaccataggctaaagctgccgccgttggttcgttaataatccgttcaatgtttaagccggcaatcttaccagcatccttagttgcttgccgttgggcatcattaaagtaagctggaacagtcacaacggccttttcaaccgtgtcacccaagtaatcttcagcaaagcccttgatatattgcaaaatcattgctgagatttgttgtggggtgtagtccttaccttcgatgctaactttgtaaccagcttcacccatgtgacgcttgattgaagctaccgtattcgggttagtgattgcttgccgcttggcaacttcaccaacttgagtttcgccatctttgaatgccacaactgaaggaaccgtccggccaccttcaggagtggtgataatcttaggttcattaccttcaagaaccgctaccgcagagttagtagtcccgaggtcaatcccgataattttattacttgccataaattaacaaacctctttttaatttagtatttttattgattaattactgtgccacaacaaccattgctggacggagggtccggtctttcaataggtaaccccgttgtaagacttgtactaccgtatcagctggatgatcatcatcaactggcaccgtttgaacagcttggtgaatattgggatcaaacttttcgcccgcagccgcaatttcggtgaccccatgttttttcaaagcatcctgtaaatggccatagaccatttcgacacccttcttcaactgttgggccgcttcatcgtcagctggcgttgccaaagcccgttccaagttatccagaactggtaagacatcctttgcaagtgcttgaccgtcatatttcaacagcgccgcttgttcttttttgttgcggttttgcatgttgacgatctccgcctgtgcacgcaataactggtcatctttcgcatctaattgcgctttgagatcagtaatttgttgtgtcggatcgaccgctgtcgtttgctcagcttgatcatcagtcgcactcgtcgctgcctgtgtcgcttcactggcagttgacattgctgctgaatcagttgttgacgcttgtgaatcttccggcgtcgtccgcgttgatttctttgccaatgttttcatctccctgtccgtcactcgtcaaagtaccggtaataatctaataatttgcgggctaattctcgttggaacgcacccatcagtccaatcatccgtgaatacggcatggcggtcggcccgagcaaggcaatcacaccttgtccgtgttgatcaacatcgtaagtcgcggtaattaaactgtagttcttcaacaaatcgttggtgatctcattaccgattcggacttgaatccgttgaccgggtggaccaatcacgttagctaaccggtccgtttggtcgagtaacgagtacaatgactgtaactctttagggctctgctggtccgtatagttgaacaaattcaacttaccaccaacataaaagcgctcggaagctgccttggacaacacactgccaaaaatatctaagaaaccatctggatcttgcaaatactgtgcaagttttaacggaatctcatgcgttaattggcggaggacgtcttgtaacggcaggccaaccagttgatcgtcgatgaaacgaacgaccggttccagctcatcgccggtaatgtcactaggaatagtaaacgtctggttttcaacgtcaccattattcgtcactagaatcgccattacttgatgattccccaacggaacgagtctgaaaccactcaaccgactatctttaagttcaggtcgcaatgtaaaggtcgtgtaacttgtcagttgcgacaagatatccgccgactgagcaacgatctcatcgatcttgtgaaattcaccgcctaatgaatgttgaatcaccttcaagtctttgccgtccaccttttcaggctttaggatatggtcaacatagtaccgataccccttaatcgatggaattcgccctgaagacaaatgcgttttgacgattaatcctaaatcttctagtcgggccatttcattacgaattgtcgctgaactgaccttgatcggtagttcttgaactagcgatttggatccaactggattaccgccctcggtatagtcacggacaatggcctttaaaattaggctttgtcgttcagttaacgtgatcatcacctctttttagcacttaacttaatggagtgctaacacaattactaatataacaaccaccctgatgaaagtcaaggaaagacaaagtatttctagaaaagaatgcttaaattattaggaccccagtcccactatgactggacttatttgaccgtcgccccccaattagcactccttacttacgagtgctaatatacaccctcacccttcacaatgcaagcatggtgcctagcagactactcgcttttctgctgccattactcagcacaccagccacaacaaaaaaatctcaagagttacagactctcgagatttttgactagcctgatgtacattgccaacagacattctagtgaaacctggccttaacggtaatcagctttcaaactaatcaacgttcagctttattaatggcatgatcaatggtttcattatcaaattgttcttgtaagtacgcttcattgtcgattggcaagtgcacatgaaagtcagcaaaatgttgaactttcagcgtcgcttgttcgacttcaaaccccagcaagtgtccacctaattgatggtctttacttagaaagtgtaagtgaaagccaccgaccgtagcgccttggaacaaatgcggtgcgtagtagccaataatcgttccgtcaacatgttcaccggtgaattccggttgtgttgccgttgccgcgactaatgttttgtacggtggctcctgacgaggcgcgactcgcgtcttgacttttgcaaaggtcccatcgacgcgaatagccgcaaacacgttggtcaaacgatagtcatgaaccacttgttgctcgaaatcagtttgtgtgattgcagctaattgcgcactaatatcaggcttttcaaagtgcaccgatgcaaatggtaacgtctcttcgggctgaatttcccgaatttgaccatcctcacgtgcttgataggcgtgacctcctagaataatcacttcaccattgagaccgtctaacgtcccaatacccgtatcaccatgggttaagagttcaccagccgtaatcgtcccgtcaaataatccgggaacaagtaagcctaatgtgccgtgttgaaaaattgttgttgtgtccattcattgtgcctccaaacgatttgattgttgtgcaacttgaatccggggtgtgaccacaaagggatgcgccacataatagtcacgggtgttttgttcatcccgctttaattgcgcaaccaaggcatccgccccagcaaatttaatttcaccgcgcatccggtgcccccaacgcaccgttaaattgtggccataaagatctccttggaaacctaataagtatatttcaaccgtgattggtcggtgatcaccaaacgtgacatttcgtccaactgaggccattcccataacccagcgtgtcccaatctgcaccatcgtcgcgtaaatgccaattccgggaacccgggtattgggcccgtgagcaacgttggccgttggaaagccgagcgttcggccccgcgcttcaccatgaactacttcgccggcagtttcatattgatagcccagtaaccggttagccgtatcgatatctcccgcgtccaaagcgcggcgaatccgcgtggaactgatcttttcagcatctaattccgccttaggaacttcaatgatttcaaaccggttatgaccatagtcattcaaacgctgcatatttgcaatttcagctggcccgtacgtgtaatcaaaaccagcaaccaccgtttgtgcgtgtaatccaacaattaactgatcgacaaacgtttggggtggcatggcaccgaccgtggcatcaaagtgaagtacatataagatgtcaacgccgagctcactcatcaatgccgttttttgatcaattgtcgttaaataacggacttgctgcggatcagtgtgtttaaaaacaactgacggatgctggtcaaacgtcatcaccgctagtttggcgtgttgcgcctgagcggcctggcgtgccattgcaacgacttgctgatgtccacggtgaacgccgtcaaaaaatcctaaggccaatacgattggtccttcgggaatctgactaaacgccacggggtactttaaattaatcacctgcatgacaaaaactccttaattgaccgcaaacattttgaacggcttgtaccgctgttcgtccggtcgataactatatagacattttaggctgttttggtaaactaacgcaaccatcgtgttcgcatctggatcagtttgttgcccttctgccgccgtaataaaggccccattcttgacccgttgccactgctcatccgttaacgtgactcgcgggtactgacttaaagctttatcaattggcgccaataatgctccggccgttccagcatcgacgtgggccgcgatttcctcaaaggtcacggtttcatctaaagtaaagccgccactctttaatcgggtcaaatcactcatcacagcgggtaccccgagcactttgccgacatccaccgctagcgtgcgaacataagtccctttactacaagcgaccgtaaaatagatcgtctgagtctgggttgccgagtcataggtagatgcctgccgttgcttgaagctgctaattgtgacatgccgttctgggcgctcgacagtttcaccactgcgcgcatagtcatataaacgccgcccatttacttttactgctgaaaacatcggtggaatttgcgtaatggcccccgtcatctgtgccagcgcagcatcaacttggtcacttgtgaacggctctgtgaccgcttggcgcgcaatctcctcaccatctaaatcttcagtagtcgttgcaaatccgagggtaatgctcccttggtattctttgccagaagccactaaaaattgcacaactttagtcgcattcccaatacaaatcggtaaaacgccatccacatttgggtccagtgtccctgaatgacctactttgcgggtctgatagagtcgtcggattttagcgacacagtcaaagctcgtcatcccacgaggtttatataatggtagaatcccgttcaacataaaaaacgccttcaatcatttaaattcggtttctagtggcagccaatcaccgtgccacggattcgatcgttcttaatcgacggttttcagtataccacacctcacaaatatgtaagcggattatcacagaattcaaggccctgagcaccgcaactaagataccccaaatcgacacgctggtccggtgccactgacgaccacgtatgtgcctggcaaagctgtatttaactcattgatccagaaaaccgtgagcttaatccctattagtcaaataaaacgactgaaaaacaagaatcgcacaaattagtccccttatcaaaaggataccgcgcgggaccgtccctaattacgccgatgactttcaacatatgctgccatcaaaaaagcgtgcaacggccttagtgtggctgatgtacgcttattcaatgttatcgtcttaaaatgcaaccggcacgctaaccgcagttgacagctacatggttcttcaagcttggagcgcaactggctgctgattcaaccactgctgaatttgacgggcaatctgctggggtgtcagttgatcggttgcgatcgtcaaatcggccgcatcagcatataaggcttggcgccgctgcttcaacgcaatcagtgcccctgtatccaattcattgacaagtggtcggctagtatcatttttaacacggttaatagtggtttgatcactagccgtcaaccagataactggcaccgcgctttgtttcaggctaattgcattcattgcaatggtcggagtaccaccaccggtcgataaaatcccgggtgtttcgagtgcttggagcaaagtctgatgctccaattgccggaagtacccctctccttgctccgcaaaaatagtcgtaatcgaccgtcccgcccgctgaacaatcaaatcatctaaatcagcatgtttagttgctaacccggccgccaaaagccgaccgaccgttgttttcccactacccataaatccaattaaaattgctcgcattcttaattcctccttacaatctgataacccgcatcagctaacaacgacgatgcttgcgttctcgtctttagatcactaaatgtcagttgcaagacaccatcaatctcttcacgagtctctaaaatatgaatattgactaagctcagctgagcctgtgcgagccgctgagtgacatccgcgagagcgccaacacggtcggggacgttcaaaaacaaatcataaaagtttggtagtcctcccaactgttccggtcccaagtgatcacgcgtcaccttagctgtcgcaaaaaattcgtacaatgttgcttgatcatgcaccctaatggctgtcttgatgcgcaacagttggtcaatataatcctgcaattgattggttattagttcagcattagtcatcaggatggccgcccacatcgtggggtccgaactggcaatccgagtaatacttttaaacccaccagccgctaatcgcaacccgagtgccgaatctgccaaagccacctgagtctgatcaactaaagccgcagcgacaatatgtggcaaatgacttaactgtcctacaatccggtcatgctgtattgcagtgaccgtcaaccatttgacgtgagtcgcttgtaacaatgcttgcagccgttgaacggctgcttgattagtccggcccggcaccaacaagtaaaaggcgttctcgaataagttggcgcggccagccgtcacacccgatttatgtgaacccgccattggatgaccgccgatgaaagtcacaccgtgctgttgtatggcaagcgcggcatgcatcaccacttgtttagtactcccgacatccgtcacaagcacccctgccttgagtggcatcatagccagtcggtgcaagtcagcaacgatcacatcaactggccccgctaaaataatcacatcagcgtcgctcgcgaccgcggccaaatcagtgccactagcatcgatcataccctgttgacgcgcataactcaggctgacatcgtcacgatcaatcccaataatgtgcaccgtgggatgggcctgcttaatgcttagtgccaacgaactgccaattagccccaaacctttgatcaatacagttgtcatcttcacaccccctggcttaaacgtgctaaatcttcaaagaacgtcgggtatgaaatgttcacagcttcggcggactctagttcggcgggagcggctaatcgcaacgctgcaatcgccatcatcataccgattcggtgatcgccatggctggctaatggctcggtcggctgccgccaagacttgcgaccatcaatcacgaagccatccggttgcgaagtgatctgcacaccaagttttcgaagctcggtcacaatcgttgcaatgcgatcggtttccttgactcgtaattcagcagccccattgattgtgctaataccattcgcagtcgcagccaacaatgcaactagtggcagttcatcgattacggcaggaatttcagtagcagtgacttggaccgggtgcagttgtgcaaaccgcacgtcaagcgtgccaactggttcgcccattcggtgtccatgatcgaccgtcacttgaccacccatccggcgcaaaatgtttaagaaacccgttcgtgtcggattcagtcccacgttcgttaaccggacatgtgaatttggaataatcgtcgcggctgtcacgaaaaaagcagccgaggaaaaatcgccaggaatcgttagtgaccgaccaaccaaggctggctgcggttggaccgtgattgttcgctgatcaggcgccgtttcaatttgaccaccaaattgttgcaacaaccgttcagtgtggtcacgagtcggtaatttttcaataattgtacttgcttgatcggcctgcaaggctgctaaaatcaaggcgctcttaacttgtgcactagcgacctgcatctcggtacaactaccatgtaaagtccgaccagtgatcgtcatcggtaagtgcccggctgttaattgtacctgcgcccccatggcttgtaatggttgacgcactcgctccatcggccgttgactaagagacgtatcaccgaccaaggtcgtctcaaacggttgaccggctaacaacccagttaataagcgagtggccgtccccgcattccccatgtctaatggttgttgtggttgggtcaacccatgtaagccgcggccactgattgtaacggtcgtatcgacacgcttgattggcacccctaacttttgcagcgccgttaaagtcgataggcaatcggcggctggcaaaaagtgatgcaagatcgtcgtcccttgactaattgcccctaaaatcaagcctcgatgtgagacacttttatcgcctggtacacttaagtcaccttgtaacccactagctggttgaatacttagtttttttatcattaatcatcatcacctaatttatttgatagacgcaccacaccatcgaaggtgtcaaacgtgcaagttcacgttcatgagtcgtcagtgtcacgtttttctcattagttagcacgtaggccgcctgattacgttgataagcctgatacgctaaatatttactggcgactgtttgcaccacgacctgatgcacgaccctcgtcaacaattgggcggtcgctgcatgcgtgtaaccaatttgattatcggcatttactcgttggagcacgacaagtggatcgagctgggtcataaaacaactgctcaacgttaattgggacaataatgcgtaatgtatatccccccagctggcattcagtgtgtctgatttgaaagcagctggtatcaccagttggtcaccagaataggccgttaaatcagttaaaatggtttcaaagctcgggtgttcgacaatcaccgcttggtcctgccagttgcgatgattataaacttgcgcggccgcgtaactatccgtggcggtcgggcctaaagtatgaatctgcataagccctcctaatattgtcggagttcttcgcggtatgccgtcactgtttgctggaagcgagctaagttactcccgtcaaacgttgccgtcaatgctcgcgttaattcaatcgctaccacactttcaaccacaatcgaggcggggacgatggccgtcgtgtctgaacgctctacgctcgccttttggctgactttggtcgcgatatccacactttgtaatggtttgtaaagtgttggaatcggcttcatggcggccttaacaacaatcggcattccattagtcatgccaccttcaaagccgcccaaatgattggtcaaccgtgaccagccggcgtgttcatcccaactaatctcatccatcacttggctaccataatggctggcagccgcaaatccatcaccaatttcaacacctttcatggcgttgactcccatcactgctgcagctaactgtccatctaatttggtatcccagttcgtgtaactgcccaaaccagccggcacattttcggcaacgacccggataacaccacccaaggtatccccggccttcttcgttgctgtgatcagctcatggatttcgggaaccaaggccgcatctggtaatcgcaaatcattttgcgcgatttgggcttgtaattgatcaacggatagtgttaaatcggccgtcacttgcttagggccaatttgttgaacgtagccaactaggtgaatatctagctgcgccaataattgcttacaaatctgaccgatagccactcgcatggctgtctcacgagctgaggaacgttctagcacgtttcgtagatcgcgatgaccatacttcattccgcctactaagtcagcatgccccggacgtggacgagtgacttgccgcaacgtattggttgccgtagctggacttaccggatccatgattgctgcccagtgcgcgtgatcgcgattcataatcgttaatgcaatcggggaacctagcgtaacaccgtgccgcacgccaccagtgatttggacggtgtcatgttcgatctgctggcgattgccgcggccaaacccaccttgccgggctgcgaggcctgtattaatggcatcaatgtctagctgtaagccagccggaataccggtcagcacccctgtcaattgaggcccgtgcgattcgcctgccgtaacgtaattaatcatgatcaatatcctccttgtgtaaattcgtgtgtaaatccgtctgatatgcgcgtgagttatgcataattgcttgataaatagcttgtaaataaggggtatgcgcggtctgggtactcttcaccgcaacttgttgtaacacccgttgttcacgttgctggtctaataccggaagttgctgttgttgcttcaactccccgatggctgtaaccgtctcaaaacgttgattgagtaatcggacgatttgctggtcaatatgattgatacgttggcgttcttgactaagtgtggttgggacatgtagcgcccatacagctaggccgacaaaggcgagaccactgacagcaataactaaatcaaagcgcatcgcggtcgcaatattttgctttgacagccacccagtcacgagcggaatcgtgaaggaagcaatactgccaaacgtgaaataaattcctgtgattcggcccttgatgtggggatagcctttgataaataaattgaggccgacctgcatcacgccacccgcagcagtaaacccaaacccgaaagccgccagcatggacagcccagccgctggactataacagataaccgctaacgccagcagcgagccgccattcattgccaacaacaatttggtttctgccaccccacgacgtaacaaccagaaaatcacaataacgccggtgattgacccaatgctgtaaagtgaaagcaaccagtgcgctaacactgacgaaaaatgcaacgtcgtagtggcaaacaagctgacccactgcgtgtagaggatcataagtgccatcgaagtatacccataaccagctaaaccaactgtcgccaaccagcgccggttcttaagtggttgctgggatacgcccgttccggcttgagcaacttgattttttagtggaaactgctgccggttcaacaggatactgttgaccactaggattgccgcggccaggataaatgaccagccataccagattcgttgtgcttcaaagttggcaacgagcagtggtaataagaattcaccggcagacatgaaggcctttaacaagacattggctgagccttgccgcccacccatttcaataaacgtcgtgtaggttcccgcatccaacgcggagttcgcaataccggccaaaatcgccaaaccgtatgccagctgaatattagtgaccaatgccatccccacaaagaacgtgaagtagcaagccatgccaagattgacgaagactttacggccaaaacgatctgataaatttcccagaataaagtaggccagtaagcgcccaatgccaatcccagaaatgacataggaaaccgtcgctaacggggtctgccagtgttgacttaacgcttgcatgttttgcgttaaaataattaagccaataccatgaataaagtagtttaagtaaagactgattgataattggtgctgacgcatgaataacaactccttcgtggaaataaaaaaagccggctagattgtgaaaatctagccggctcatcaaaatttaatcctaattgatgatattattccagctagactcacggtgtctagctggccaagatgaattgacttcgcttagacacgaacgtaggtgccgtccgtatctaaggttccaacacgggcgctacctaaaataagcaaagccataataataagttgcgttgaatgctaacgtcgtcataatcatctatcctttccgtttcattgattgcttatattaaaacattctcattttgattcgtcaaccctaatttcattttaattttgcaattaagaaatcattttcgcttgtaaaagcgccacgatgcgtaattcgcctcatcctactactatttacaaaaatcgtcttcagtacgactactcattaaaccaattgtttgcgacggtcgcgagcaggctaccttgattagtcagtctaccgacaacgttcaagcagtgtgtgaatgactagtgtgaccctacaatcagcaccatctaaaccgcttaacctcagtgattgacagcgaacggctccattcaatttgaacacaaaaatagtcgctgtcaatccatctggattcacaacgactatttttccagcgcctaatcttgacgctttaagttattaattaattcatcaatccggctaccgtattgaaccgagttgtcgcgttcaaaagttaattccggggttttatagatgctaagtcgtgagcctaattcactacgaattaatcccgtcgccttagtcaatccagccgccgtcttttcaccatcggatgccttatctgacaaaatactgtagtagatggtcgcttgttgaaggtcgccagttaccgttacaccggtaatggttacacccgcaacccgtggatcacgaacccgttttaacaaaatatcattaacttcgcgttcgatttcctgttccaaacgaccaactcgataatgttgtgccatctgctaatcccccttttaaaggttattcaactggaacttccttcatcacgtaagcttcaatgacatcgttgactttaatatcgttgtaatcttcgattcgaagcccaagttcaaagccttgtttaacttccttaacgtcgtccttgaaacgccgtaagctagctaacttgccatcataaataacgacaccatcacgaatgacccgcacaccagaatcccggtggatgacaccatcagtgaccatcccaccaccaatcgtaccgatcttagaaaccttatagatttcacggatttcggcttgaccagtgatttcttctttataagttggttcgagcattcccttcatcgcgctctcgatttcatcgatcgcgttgtagataacttgatgcaagcgaatatcaacatcgtcagtatcggcttgggctttggcttgtggtgttggccgcacattgaacccgataataatcgcgttacttgcttccgccaaggccacgtcactttcgttgatcgccccaaccgctgtatggatgatattgacccgcacaccttcaacgtcgattttacgtaaactaccagctaaagcttcaacagaaccttgaacatcagccttaataatcacgtcaacttccttaagttcaccttgtttcattgaatcaaacaagttatccaaggtgacgtgagcagtttgcttccgttcttccatcaatgcctgcttagcacgttgttcaccagcatcacgggccgtcttttcatcatcaaagaccacgaagcgatcaccagcatccggcacatcattcaaaccagtgatttcaattggcgtcgatggcacggcttccttgatccgcttaccatggtcattggtcatcgtccggacttttccgtaagtattccccacaacaattggatcaccaacatgcatggtcccttgttgaacaagtaacgttgcggtagaaccttttccacggtcaagactagcttccaatacagatcccgcagcattttgcttagggttggccgttaattcgagcacttctgactgaagtaagatcatatccaacaattcatctaggttcttaccgaacttcgctgaaatctgaacaaagatcgtatcgccaccccaatcttcaggaatcagaccatattcagtcaattgttccatcacgtggttagggttggcacccggcttatcaatcttgttaacggcaacgatgattggtactttagcagccttagcatggttgatggcttcgattgtttgtggcatgaccccatcatcagcagcaacaactaacacggtgatgtcggtgatgtcagcaccacgcgcccgcatttcagtaaaggccgcatgtcctggcgtatccaggaatgtaataaccttaccatcatgcttaacttggtaagccccaatagcctgagtgatcccaccggcttcgccctctgtaacgtgagtatgccgcaattggtccaatagggtcgtcttcccatggtcaacgtgtcccatgaccgtaacaaccggtgcccgtggcgccaaattgtcggtattattaacttcatcatcaaagaacttgtccaaatcggtcacatcaacttggaccttttcttgcgcattgatcccgtaatcagtggctaagatttcaatcgtatctttatccaaggactgattttggttaactgcaacacctaacatgaataacttcttgataatttcagcaggctcacggtgcaataatttacccaaatcctgggcattcatgccgaccgtgtaaaccagtgtttctggcaacggcttgtccttacgaactggcgctggcttattattgacctggcggatccgttgattcttattgttccggctcttattgttccggttgttacgccgacggttattgttgttaccgccacgataacgaccaccaccgttattgttgctattcaaactaccaccaaagcgaccgctgccattacgcgaactattattcgacccattgctccggttactgttgttattattgttgttcgtcgtagtccggttgttgttccggttctgaccaccattattggtgcgattaccggtactgttggtacggttgttactcgtatttgagcgattgttattattagaccggttattattattgttgttagaccggttcgtattgctcccaccgttattacgagcactgttgctccgtgaagcattggccgaacgattgccgttattactgttagtacggttaccgccattattgcttcgattaccgttactattacgactttgactattattttggttattattacgattattattcaaagaatcaccactctgttgatgacgcgagttggattgctgctgattagcagttcgtgtcacattttttgctacggcttgcgtagcccgactcgttttagctggagccggttgagatttaggatgggtaactgtggtcgtgccttgtaactggcgcgcctcactgtcaccgagtgtcgacatatgatttttgacggagaatcccaactgctgtgcttgcgcaatcagctgtttacttgggacgttgagctccttcgctaactcataaattcgctttttccccatatcttcaccctcctttactgtgtcatgatcgccaccattttcttggcaaatccggcatcggtaattgcataaacagtgcgcttattaccagtaaccgtatttaattctgctttagtaaaggtatcgatcactggaacatcataagattgggccttatcatgaaactttttggcagtcgtgggaccggcatcgctggcaataaagaccagtttagccgtctgattacgaattgcagccagggctagcccttcgcctgcaatttgcttgctggcacgccgtgaaaggcccagtaggtttaaacaagcttgcttaggcgtcatttccgaagagttcctttcgggcttgttgatgatcaacataagccactaactcatcgtaaaagtctgcacccactttgataccaaacgccttatcaaaagtcttttcttgcttggcacgttgtgcaacttgtacgtctaaggcaatgtaggcgccgcgtcccggctttttaccagtcggatcaacggacacttcatcctgcttattcttaacgacccggactaagtcttttttgggatgcatttcacccgtcacaatgtcctttcgtaacggcacttttctttttttcataatcccagacctcctttagttacttcactcacttagtgacgaacttattcagcgtcacttgctgattcatccacagcagtttctgaggcaggcgtcgccacggctgcgtcggacgttgctggttcctcatcttcgccggtatcggactgcactgccgcgtctgatgctgcttcagtcgtttccgtttcggcaactgcaacatcatcagggtttgcatccattatatcagaagcttcggtttccgatttaatatcgatcttgaacccggtcaatttagcagctaaacgagcattttgaccacgcttaccgattgccaatgataattgataatctggaacgaccacggtacaaccccgctcattttcaggatcaaaaataacatccaaaacttccgctgggttcaatgcattcgcgataaatacggcttgatcatccgtccattccacgatgtccatattttcgccgtgtaattcattgacaatcgtttgaacccgttgtcccttgggaccgacgcaggtaccgactggatcaacgttaggattgtttgaacgaacagcaactttcgcccgatcaccggcttcacgtgcaatcgaaacgatttcaacgatgccatcgaaaatttcaggaacttcttgttcaaacaaacgtttcaacaaatctggtgcagtccgcgaaacgaatacttgggggcccttcgttgcgttttcaactttcgagacgtaaaccttaattttgtcatgaatccgataaacttcaccaggtaactgatcagaacgacccatgaccgcttctactttgcccaaactaacgtagacaaatcggttatcttggcgctcaacttcaccagtgacgatttcattttcatactggctgtattcgtcataaataatgccacgttctgcttcacgaactcgttgcatgatgacctgcttagccgtctgcgctgcaattcggccgaagttcttcggtgttacttcaaatcgaatatcatcaccgatttcgtaggctcggttgatagccaatgcatcttgcaaactaacttctaaacgtgaatcaaagacgtcttcaaccacttctttaacggcataaacgtgaatattacccttaatttggtcaaagtcaacttcaacgttttgagcctggccataattacgcttataggctgaaacgagtgccgcttctaaggcttcgatgacaacttcttttttaatgcccttttctgattcgagggtgtctaaggcccctaataattccttgctcatgtgtagactcctttacttatttagaactttaccgctaagcgggcttgtgagatttgttctcggttgatcgtcaccgtcttgtgacgtgtcttatccaagtaatcgatggtcaaagtggtcggcgtcaccgccgtcaaatcaccttcaaaaattttcttgccatccaacttctggtataagccaacgtgcacgtacttaccaatagcattttgaaaatctgcttccttcttcaatgggcgttccgcaccaggagaagaaacttccaaaaagtaagcttggggaatgggatcaggctccatcgcatctagcttttcactaagttcatcactaaccattgcacattcttcaatattaatgccgcccggtttgtcaatgtataatcgcaaataccagctttgaccctcgcgaacaaattcaagatccacgagttcaaactggtgagcactgacaatggctgcggccactggctgaatggtttcaacaacattactactcaaggctgcgcctcctattcagattagtccaataaaaagagtgagcatcgctgctcactcgttaacgagttttaaattacaacccatatattagcacaattatgttgaaaccgcaagtttacgccatttatagcatttagccgttagctttcaagtcacggtaaacttccgcttcaacagcctgacaattgccggtgtatcaacattacaggccctaaatcagataaatctgtctgagtgctgttaaatgcatcaaccaccgcaaaaattcatcaaactttaacaattgtcgtgttttctagaacaacgagagttggttttcatctggcaaatcacttaacacaccattttcagtcataaagtcgatcaaactcttcgacacttttccacgcttagacaggtcttccttcgacaggaacggcttgtccgctcgggcagcaacgatttgcttggcaacgttcaaccctaaccccggaactgctcggaacggcgcaatcaacgtatcaccatcgatcagccaatccgaagcatcagatttgtcaaggtcgaccatggagaatttaaagccccgctccaacatttcgttggctaactctaaaacggtcagtaagtttttctccttggcgctagcatccatccctttgtcagtgatcgccttcattgacgctttgacagcatctttaccatgggccatcgcaaccaggtcaaaatcgtcagcacggactgaaaaataagccgtgtaataaatcaacgggaagtacactttaaagtaggccacccgcaacgccattaagatataggctgccgcatgggcccgcgggaacatatacttgatctttagacaagattcaatgtaccagtcgggaacgttggcatccttcattgcttgttgccattcatccgggatcccccgacccttccgcacgtgttccataatttggaaagacatatcagattccatgccgtagtgaatcaagtcggtcatgatgttatcacgacaaccaataacttcggccagcgtaaccgtgccatccttgatcaattcttcagcatttcctaaccacacgtcagtcccgtgtgaaagtcctgaaatctgaagtaattcgttaaacgtggatgggtgagtctcttcgagcatcccacggacaaaccgcgtcccaaattctggaattcccagcgtccccgttttcgagaaaatctggtcttctgtgactcctaaaacttcaggactggagaaaatcttcatgacgtgcggatcaactggtggaatactctcaggttggacacccgacaaatcttgtaacatccgaatcatcgtcggatcatcatgtcccagaatatcaattttcaaaatattatcatgaatcgaatggaaatcaaagtgggtcgtttgccaggccgcactctgatcatcagccggatactggacgggcgtgaaatcataaatatccatgtaatccggcacaacaataataccggccggatgttgcccagtcgtccgtttaacgccagtcgttccctttgctaatcggtcaacttccgccgaacgaagtgtttgattcgtatcccgttcatacgccttgacataaccataaccagtcttatcagcgaccgttccaattgtcccggctcggtacacatttttctcaccgaacaagactttggtgtaattatgggcaataggttggtagtccccagagaagttcagatcaatatctggcaccttgttcccataaaatcctaagaacgtttcgaagggaatgttttgcccatcacgcaccatgtcagtcccacattcagggcaatccttaggtggtaaatcatagcccgatccatactcgttattcgtataaaagtgcgagtactgacaatttggacaccgataatgcggtggcatcgggttcacttcagtaatcccagacagcgtcgctacgatactcgaaccgactgacccccgagacccaaccaagtaaccatctttattactcttaaacactaggcgttgggcaattaagtaaatgaccgagaacccgttaccgatgatactcttcagctctttatccacccgtttttggacgatttctggcaacggattaccgtaccacgcatgggcacggtccatcgtcagtttttcgatttccgcttcggcacccttcatccgcggagtatacaacttatccttgaccggtcgcacgatttcaaattggtcagcaagcgcgcggggcgtgtcaaccacgacctcatgtgccgtctccgtacctaagaaatcgaaatctttaagcatctcatccgttgagcgaaaatgcacgtctggccgttcagtccgatttaacgggttaccgggctgtgaatgaatcaaaatcttacgataaatcttatcctcaggattcagataatgcacatcccccgtagcagcgaccgggatattcatctcatggcctagttccaccatgttgctgataatttcttccaaatgatccgtatcagcaatcaaaccactctcgatcagcgccgaatatgccggtttcggttgtacttccaggaagtcatagtagccggccttttgtcgggcctcttccttccccttttgcatcattgcagtaaagacttcaccactagaacaagccgaaccgaccaggatgccatcccgatacttgtttaaaacactgcggggtacacggggcacgcggtaatagtactcaacattcgacaaggaaataattcggaagagatttttcaaccccgcttgggtttgcgcatacaatgtcgcatgaaatggccgggcatggcggtaagccgcattttcattcatatgatcattcagctgatcgtggaattgaacctgataacggtcctccgcatctttcaaaaacaggtggttcaaatgaccagtcgtctcagcatcatagatggcgcggtgatggtgctccaaattaacgttgaattttttggctagggtgtttaagcggtacccgcgtaaattcggatacagccaccgcgccagcgtcaacgtatcaataattggatttgtaatcggccccatgtgatgccgggcatagcccgtattcataaagccaatatcaaaggtgacgttatgaccgaccacgattgcatcaccataaaattcgcggaaaagtttaaacacttcttcttccgatttagagccccgcaccatatcatcggtgatactcgtcaaattagtggttgtttccgacaagtgaaaaccagggtcaataaattcctcaaactgatcaacgacgttccccttgaccatcttaaccgctgacaattcgatgacccggtcataaatggcggacaaccccgttgtttcagtatcaaaaataacgtaggtggactctttcaaatcaacgtgggcgtcattataagcaatcggcaccccgtcatcaaccatgttagcttcgacaccgtataaaattttgatattatttttttcaccagccgcaaacgcttctgggaacgcctgcgcccccgaatgatccgtaatcgcaatcgccggatggccccatttagcggcttgtttgacataatcactgacactgttggttgcatccatctgactcatattagaatgcaagtgcaattcaacccgcttctcatctgccggcgccgtgtcttgccgactggcatgcgacgtttcgttaatatcatacgcattgatcgttaaatcgcgcataaaactatcttcctgcacagaaccacgtacacgtacccacattccaggcttcagtgccgcgaattgtgcctcgtcatcagcattccgtgagaacttcttgacgaccattgacgaactatagtcggtcacctttagaatcaataactgccgctgggaacgtaacgtccgcacttccatatcgaagacatagccttccacgacgaccgaccgttcttcttcagtaatttggaccatctgtttagccggctcttgcgggttgatctgcttgcctaattggacaggaccatcaattggtgctggtgcatccgcctgcttttgccgtttctcattggcctttttgatagccgcttccgctttttgagccaacgcttgatcagacttcgctttttgttcatgaaattccttgatcttcgcctgtgaagcactctcatcaatcatcgtgtggacggagaacttcgggaagcccaagcgatgataggtactctcaatcggccctaatgcttggttagttagaaaattttgaataacttcattttcagccaacaaaatgacccgaccatcttcataagtcggcacgttgctgttacacaatgattggaccaggggcgacttgatcccactgtgctgaacgatccattcccagtattcagctagttcacgaccattgacctcggtatcatcagtcacgatcgtaaaggtcacgcgtgcaatttctttaaaggcgatttggagtttgttttgaaaagtcataaattgtgtataaggtaaaacatgttggaaatgcaaatgaaattcccaaaccttggaagcttgatgaacggtcaatttatcgatcgctgcttctgtaaattcaggacccgttggcatttcaatttgttcgagtaacttcttgaacatttcttgttggtttaaactcaccagtggtcctccttttgttgattacaatcagttagtaagacacgcaccgtacttgttaatttgcgcttgcatatatattaaagcaaatccaatcttaaaatcaaaagccgctaaccgtgacccgctagaaatagaatctcgtttcaacaatgacttagtcgctaacaactaacccaatgccaagcaagacttttaatattaactagaaccccaattaagtgctcaaggccgcggtccacagttggcactactttgtcagtttgcttaaccgacagcgtgatgcctcggtgattaacggcatctgaaataatcttcagcgaacgcacaaatcgttcacttgaaacgttactattttatcacagtctgaccgttgagccacgtgattaatcggcaaacaaaaatcacccagtcaacagaatccaaccaggtgattgttgttggcgactatcaacgggtagttgccatatttttattaacttagttttgcagcattttaatcgatattcttgagcagaacggccaagttgttggcgatttcttcctgtttaacttccaaagtctcaccagtctggcgaagcttaatctcgacgattccttcgctggcctttttcccaatggtaatccgagcaggaatgcccattaagtcggaatcggcaaacttcacaccaggacgttccttccgatcatcatacaaaacgttgtacccagcggcttctaattgtgcttcaacttggtcggcaacctcaacctggtccgctttcttcgggttaaccggaatcacgtgcacatcaaatggtgcaattgcttttggccaaatcaacccattttcatcagcgcgttgttcagcgatggcagacaacaaccgtgagacaccaatcccatagcagcccataattaccggaatattacgtccattggcatccaagacttctgcgtgcaagtctttagaataacgggtgccaagtttgaaaatatgtccaatttcgatacccttggtgaacttcaagacgcccgcaccatctggtgataactcaccttcctgaacaaagcgaatgtcaacgtaagcttccgcgtggaaatcacgttcagggttgacgttcgtgaagtgatgaccgtcttcgttagccccgaccgtaatgttgaccatgtccttcacatactggtcagcgacaattttaacgtcatcatgaacgttaactgggccgagtgaaccaaagctagcgcccaaatattgttgggcttgttctggcgtagccatttccaagaaatccgcaccaaggtaattcttcaacttaacatcgttgacttcatgatcgccacgaaccagtgccattactggctgatcgtctgcaataaacagaatactcttaaccagttggtcagcaccaacttttaagaactcagccagttcgtcgatcgtgcccactccgggagtatcgatcttttccatatcctttaacgaagcatgtgacttctttgggacgtataaactccgagccatttcaagattagccgcataatcactcgcatccgaataaacaattgtatcttcaccaaccggtgcgatggccgaatattcacgggaatcctttccacccatcgccccaccatcaccgatgattgaacgaaacttcaaaccgacccgctcaaaaatattctgataagcttgcgccatatcttggaacgtgtcatctaatgaggcctcatccgcgtgaaatgaataggcatccttcatgatgaactcacgcccacgaagtaatccataacgtggccgatcttcatcacgatacttagcctggatttgatacaaagtcaatggcaaccgtttatacgatttgatttcatcgcgaacaattgacgtaaatgtttcttcgtgcgtggggccaaggataaattctcggtcatggcggttcttcagcttgaatagttctggaccgtatgtctcataacgcccagttgctttccacaactcagctggaatgactgctggtaccagcatttccgctgcatcaattttttccatttcttgccgaatgattttttcaatattcgtcaatacgcggtaagccaatggcaaataagcgtacattccggctgaaatttgtcggatatagcccgcccgtaacatcatttgatgactcaaggcttcggcatcattaggcacttccttgagtgttgggattaacaatttcgactgtttcatctacaaatcttctccttattgttccaaattaaatatcacttagaagaaatatcgctgaatatcattccaagttactagaatcattaataacatcaggaggccaaaaccaatcaaggtaatgacactttccgtttccacccgtagtggtttaccccgaatgccttcaacaatgtttaataatagtttaccaccatcaagtgctggaatcggtaataaattaacaattccaaggttgatcgacagcacggcgagcaaatagatcaccgtgcgcaccccggacttagcggcttgcgaggtcgtggcaaagattgccaccggcccacctaaatcgttcaaactgaacccgtgagtgaccatccgaccaagcacttgaaaaatctgtttggtaattccccacgaaccagtaaagccgtatgctaacttggcccccagactcgtgtcggtcttagtcgcccattggaccccgatttgaccgattcgattaccagagaccgtcttggcagcaggggtaaccgcaatttttttagtctgaccggcccggttgatggtcaaagtcaaccgttgcttcgggctgtcttgaatcaacagcgaaatcgattgggcactcgtcatttttttaccgttaaccgccacgatttgatcgcccttttgaataccggccgtacgggcaactgagtctgctgtcgtcgccgctacgtgggtcgttgtactcgtaacaccaccctgcataaaggcaagaattgcaaatgtaatgatggccaaaatgaagttattcatcggtccggcaaaattcgtcaacattcgttgccataacttggccgattgaaattggacgtcgaccggtgcaatttgaacttcggtaccatcgctttcaacgatcgtagcgtcatgatcgacggcgtagtgtttaacttcactttcgtccccgttctcataaccttcgatccagagttctttttcgagatcagtcgccgtcactgacagtggaattccattgaacaacgttgtcttcttactagcattgattgaatgaacaatcccatccggaccaatttgcaaactaactggcgttccgggcttgagttcttcatcttcatcatcggccacaccggccatccgtacgtaaccaccgattggcagaaaccgtaacgtataagttgttgcattacgacgaaacgcgaccgccttgggccccatcccgacagaaaattcacgcactagaatcccagcctttttggcaaagtaaaagtgcccaaattcatggacgatgaccaagattccgaaaacgataatgaacgtaataattgtaacgatcaattaagcgctcctttctcccgcgtttcgggtactcagcttaaaagaggccgaataaatgtgcaattggaaaaactaataacatactatcaaatcgatctaggataccgccatgtcccggcaagatcttaccagaatccttaacaccatagtaacgcttcaacgcggattctactaaatcgccaaactggccaactactgataagactaaagtaatcagtaccatactgatgacgctagcatagccgacgtgaaacccaattgcaaaggcactggcaacgatcacaccaatcacgctacccccaatacaaccttcccatgttttattggggctgatcggtgtgactttatgccgacccagtttgcgtccgaccatgtaagccccactatctgtcagccagacaatgaacatcaggaagagtaacatgtaaacactgacaccccgcgcagccgtgaagtagttgaagcccatcccgatgtacaggacgcctaacgtcaacattccggcatcatcaaatgaaaagcgattccgcgaccacacagtgtgtaacagtagcaagataactaagaagtaaaccacgtactccttgtttaattggtctggtaagccattgaaccagttattcggtgcaatttgaatcataactgcaagcatgcttacgattgcttcaaatgaaatcaataattttttacgcatcacgagtaactcgctcatcgcaacggcccctaacagcatggccacaatatctaaggttaccccgcccacaaaaatgactgggataaataaaattaacgcaacgacagccgtaatgactcgttgtctcataccaaaaactcccttttatttatgatccgacaacccaccaaagcgccgatcacggctctgaaaatccgcgatacaggcttgaagggtcgccgctgtgaaatccggccacttcacatcagtaaagaccagttcactgtaggcaatctgccacattaagaaatttgaaatgcgttcttcaccactcgtgcgaatcagcaaatctggatcattgtatggcgcaagtggtgccgtcatcagtgctgcgtcgatggttgcatcatcgatatcaccaaccgccaattgaccatcttgcacttgctgggcaattttttgcaccccggtcacgatttcggcccgtgaaccatagttgagagcaaagttcagcaccatcccatcacaatctttggtatctgcaatcgcattttggactgctttttgcgttgcttctggcaagtgatcaacgtagcccatgacttgcacccgcacattattttttatcaagtccggtacgaaagtatcaaagaaactcactggcagttgcatgaggtaattaacctcatcagttggccgcttccaattttcagttgaaaacgcgtaaagcgtcaggactttaacgcccaaatcacttgcggcaatcgtaatctttttgaccgtgttcataccttccttatggccagcaacccgtggtaaatgccgtgctttggcccaacgcccattgccatccataataatggcgacatgggctggaatacgttcaggatccaattgcacgtcggtgttatctgcaggatcattcttattaaaaaaagcgaacaaggcgcacctccataaaaatagcttaactatgcactattttaccaaaaaaagcactaattaactattcgtcaacaaaaaaaggcttgaatttctccaagccttaataaattggtcggtcattaaccttccaaaatttctttttctttgtccgcaacgatcgcgtcgacgtccttacccgcttgatccgttaacttttgggcttggtcttctaactgatgtaactggtcgtcagtgaattgaccatctttatggcccttcttcaaggcttccattgcatcacgacgcacgtttcgaacggcgaccttggcacgttcaccttccgccttaacgtccttggcaagttctttacgccgttcttccgttaattgcggaataactaaccgaatcgcagaaccgtcgttagctgggctaataccgaggtctgacgctaaaatagccttttcgatttctttaagggcactcttatcaaatggggtcaccattaagacccgtggttcgggtactgtaattgccgccatctgattaagtggtgtttgcgcaccgtaataatctgcagaaatccgattcaataatgatgcgttagcccggccagcccgaatattaccgagctcgcgttgtaaagcggcttccgcctttttcatccgttcctgtgcttcttttaaaattggttctgtaattgccatattatttccccctgactgttgtcccgatgtgttcaccggcgacgactttccgaatgtttccaggttcattcaagttaaagaccacgacaggaatgtcattatccatcgataaggaacttgccgtagtgtccatcacttgtaaccctttgttgataatgtcgagatgggtaagcgtatcaaatttaactgcactagcatccttgttaggatcagccgagtaaacaccatcgacgccatttttggccatcaaaatcgcatccgcgttaatttcagcggcccgtaatgcggcggtcgtatccgttgagaaatatggactcccggtaccaccggcaaaaataacgatccggcgtttttctagatggcgcattgccttccgccgaatgtatggttccgcgatttgtcgcatttcaatggatgtttgaacccgggtcggcacaccaattgattcgagattatcttggagtgccaaggcattcataatcgtagctaacatgccaatataatcagcttgggcccgttccatacccatctgggcaccagcttcgccacgccacatattgccaccgccaacgacgattgcaatttgtacgcccatgtcatagacgtccttaagttcctctgccaccgttttaatgacggggggattgattccaaagcccttctcaccagctaaggcttccccactcagttttaggattacacgcttatatttaacttccgacatcgttttgtcctcctcgaaattatctgtctatcattttaccatatatttcaataagcgtttggtatcagccgtaatccggcgcaaaaattaaccgaattctctttttaaagcggcttcaacccgttactttacaaaaagggactacgccgaaaattgctttccgtcgtaatccccaattagctaatcccttagtcagtaattagtctttaatttggttcataacttcatcgatgaagttatcagccttcttttcgattccttcgccaacttcaaaacgaatgaatgagctaaccttgccaccctttgattcgacaaagtgcgcaacagtttgatcagaatccttaacgaattcttggtcatccaagctaatttctgaaagccacttgtttaaacggccttcaaccatcttttcaacaatcttttcaggtttaccttcattcaaggcttccttaacaagcacgtctttttcatgagctaaccggtcagcaggaacttgttcacggttaacatattcaggattgatagcagcgacgtgcatggcaacgtccttagcagtagcactgtcagcaccgtctaagacaactaaggctgcaatttggccaccgttgtggatgtatgaaccaaaactttggtcagcacccttttcaacaacttggaaacgacgaagactgatcttttcaccagttacttgagtcgtttcgatgacgtcatctttaaccgtcccgttagccgtcttcaaagctaaggcgtcgtcaacggaagctggttcttcttcagcgatcttgtcggcaacttcagttaccaagttcttgaacttgtcagttgaagcaactgaatcagtttcacagttgatttcaacaatggcagctttgttgtccttgattgcaacagcagcaatcccttcggcagcaacccggccactcttcttctcggccttagcaacccctttttcacgtaaaacgtcaacggctttttccatgtcgccttcagtttcaactaacgcctttttagcgtccatcataccaacaccggttttatcacgaagttctttaacttgtgctgcagaaatctttgccatagtttactctcctttgagtatcttgattttagataaaaagctgcccgcaaaatcaggccgtaatggtccgcgatttttaggcagcctaattatttcaattaattatttgtcagacttggcgtcgttgtcgccttcaacagcttcaacgatgtcttccaatgagtcaacggacttcttagcgtccttgttgtccttgaaagaatcttcagtaacatcttcgtcttcaccttgacgaccttcaatgacagcatcagccatcttagaagtgatcaaacgaacggcacgaattgcatcatcgtttgaaggaataataacgtcaatgtcatctggatcagtgttcgtatcaaccatcgcaacgatcggaatgttcaatttttgagcttccttaacggcgatttgttccttacgaggatcaacgatgaagattacatctggaatccgaggcatgtcttcgataccgcccaagaacttttcaagcttggcacgttgcttcattaataatgaaacttccttcttaggtaaccgttcgaaggtgccatcagcttccatcttcttcaagtctttaagacgcttgatccgtgtttggatggtgttccagttagtcaaagtcccacctaaccaacgatggttaacatagtattgacctgcacgggttgcttcttcttcgattgaatcttgggcttgtttcttagtcccaacaaacaagataacaccatcatcagccgcagcgtccttaacgaagttgtaagctgagtcaatcatcttgaccgtcttttgtaagtcaatgatgtagatgccgttccgttccgtaaagatgtatggtttcatctttgggttccaacgacgagtttggtgaccgaaatggacaccggcttcaagcaattgtttcatagaaataacagccataataaatgtgcctccaaaaaatttgttttattcctccccaccgttcaactaatcatggcactctcccgagcaccgccatgattatcgcagtaggtgtgaattggttttaacaccgaaaattagtataccgaaaattactagtgcttgcaagcaatttcatcaagaatttgtgaattcctgaaagtgtgttaaaatacaatctcgcatagggggctcacttaataatgataaaagccatcatttttgaccttgacgatacgttgtatgatcaaaaatcaccgttcactgctgccttaactaaaacttttaaccaggctttgagcagcactgaattggcacaaatttttaaccggttccatgattttaatgaccgtacctttaaccaggtcactgatacaactatgacgctggaagcgtggcaaaccgcccgtattcgacacgcgttagcacccagcaaagtccacatcagcactgatcgggctatccaatttgaaatggcctatcagcaggaactaaatcagatttgccttttcgatgggctgagtgcgacgctgactaaactcagtcacgcttttaaaattggtatcattaccaatgggccagcgccgattcagcatcaaaagttacatcaattacaaattgaacatttcgtgcatccggataacatctttatctcagaagaattgggtattgctaaacccgacccatcgatcttcacgacgtgggcccatcaggttggcatcaaggccaacgaagccgtttacgttggtgacaatgcagcactcgacatgaccagtgccaaacacgctgggtggcaaactttttggtttaatcaccggcgcaatgaccaggtgacaccgagcgtaattcctgatcaaatcatccagagtccagcggaactaaatgaactattgctagcacttcttcaagccgccagcgcttcatagacgcatactggcgttaaagctacgagcaacttatgctggtaacaaccacggtaagtacgtgctagcaagacctttacctagcaacacttaattgtgttatcgctaacaaaatcgctcacttgtgaagcccacagtcgtgcaaccagctctattgtgggctttttgttatggataataacagcattgaaagtacgcttggggttaacgcttcgaaaaggccccatttaggtgaaagcataaaaaatggcgtcactcagatgagtgacgccattttcagtgataatcgagattaatcaaacttaacttgtgtgtcagctttaccagtttcgatgaattgtttgttactgttcattgaaacgtgcaccatgttgtgaacggcagtttcagtgtagaaagccgtatgtggtgtaatcaaaacattgtcgcggttgaacaagttcatgaagaccttgtcatcaatcgtttgaccttcaaggtctttgttgaagatcttagtttcgtattcatacgtatcaagagcggcaccggcaactttgccactgtctaaggctttgatcaagtcttctgaatcgatgagtgtcccacgagcaaagttcaagatgtaggcgccatctttcatcttgctgaaggcatccgcattcaacatgtggtagttatccttcaatgcaggaacgtgtaacgtgataacatcagcttgggcgtataattcgtccaaggtgtcaacgtacatgccttccttttcaagttcagcattccggtaaacatcgtaaccgataaccttagcgccgaagcctttgaaaatatcgatggcagcacggccaatccgaccagtaccgataacaccaacagtcatggtgttcaattccttggcaatatctggtgcccaacggaagtcttgcttagctaacttcttgttgaacaatggggtttgacgtaataattgcatcaattgcgttactgataattcagcaatcgcatttggtgagtatgcaggtacgttagaaatgtttaagccacgtgctttaacagtaggaacgtccaagttatcaacaccaacgttacgaagagagatgttcttaaccccttcgtcggctaacttgttcaatacttcagcagtatagtccttttgttggtatacatcggcaccgtcgaagcctttagctaagtcaacgttgtcttcagtaagtaattctggaactaatttaacttcaacatctgggttttctttcatccaagtatcgaagaatggacgttcgtcatcacgtacagcatatgcaataattttcattacaaaaattcctcctatatattgatacagtaaatattataacagtaaatgcgagaaatagaatcataaattgtgaaaacttcgctaaatttttacatcgtgagctgacaagtattttagcttggcagctcgcgattggtgtttgaaggcatattcagcctttaacgcacttgatttgtcactgaaagtttcatggtaaattaattgcaaaggccgccgtgagctgacccgcgtatatttagcccctttgcccgcattgtgcgttgctaatcgtcgctgcaagttatccgtaaaaccaccatacaacgtttgatcagcacataataggacataaaaataatattttttggttgccgtcgtggacgcagccggcttacttgtgcttgccatagagtaatgtgtgcacctcttccctgtattcaccatcatcacgataaacgacaagcggtggcatgattcgaacaccgttgcgtttcccatccttgatcatttcgatcagaaccatgttcgcttcccgttgtgctttgggatggacgaaccgaatccgtttgggtgccaaccgattggtcgccatggtactgaacaagtcatctagtcgttcaggacgatgaacaaaatatgctttaccattcatttttaacaaatcactagttaccgctaggatctgatctaaattagcggacagttcatgccgtgcaatcgccaaatgaggatttggatttttaacgctctgcggtcgatctttaaaatacggtgggttacataagactgtatccaccgaatctttcggtagttggcgcgtaatttccagtaagtcttcgttcaggactgtcatttgttgggttaaatcgttcaaaacaacactgcgttgagccatatcggccaaccggggctgaatctcgaccgccgtaatatggccttgagttttagcactggcgaataggcctactgcgccattgccagcacagagatccacgatctggctcttaacgcccttcgcaacctgggcaaagtcacccaacagaacagcatccagtgagaacgcaaagacttgagaactttgaatgatttgaatatcttgactatataattgatcaatacgctcatcggcgtgtaacgtgacgtctgccatattcggccacctctccattcaattcgtcgcacagctatcatacaattaacttgcagaatttgccaaatttcgtcatactgtgagcagttattaaacgaaaggaagatcgtgatgttttattcatttatgcgcggactagtccggctaatcatcaccattattaacggtcggccccgctatcaaggacgggaaaacctaccagagggggcctatatcttagttgggccacaccgcacgtggtttgacccgttgtactatgcactggctggcagcccaatgaaatttagctttatggctaaggaagaactatttaagaatcccgttctgcggttcattctcgttcatgcgaacgcctttcctgtcaatcggcaacatccaggaccttcagcaatcaagacccccgtcaaatttttgcgcagcggtaagctttcactaatcatgtttccatcaggaacgcgccactcacaagaacttaagggcggtgcaaccgtcatcgctaagatggccggtgttccactagtcccaaccgtttaccaaggcccattgaccttcaaacaactctttagccgtcagcgggttaccgtccgtttcggtcaaccgattgatattgatcgtaaactgaaattggatgaagctggtcaaaaacaaattgagactaaaatgttgcacgcttttgacgacttggatcgtcaaatcgacccaacgttcaaatacgttgatcctgctacaacccgtcagaaacattaagttcgataataaaaaagtgtcggtgatcgcaatttaaagcgagccgacactttttactacttgttatcgtttttagatgcagctttcatcgaattcaacatctgatgtaacttcttttcggatgggcgttgacccatttgcatcatcatactacgaagcatctcttcactaattggtggattttgcttcaagtaattttgcatatagtgccgggcaccgaagaaaccaccagttaacccaaccaatacgccgataacgacgattaaaatccaaattcctgtagacacagtcattcccctcccttattacagtcttcattaaactagtctacacaaattaataataaaagaaaaggaaaatttgtcagttgacaaattttcctgaaatcggttaatcatctcgaagaccgcgatcgcgttgcacttgacggaccttttctggcgtaacctctttaccatctttatcataaacctgaagcatttcaacttgttgccgaaaaccggcgcgaaattccttcaagtatttttgccgcaactcttgacgttcggcttcttctagctcggtgagcccctcggctttcgccttatgagctaactcattgatccgagcaagcaattcttttgaaatcaaatcagcagcccctttcactcttgaaatatacacgaaaatagaccctaaatcaattaacagtgtttgtcaaccgaacatttgtttgaaagctatgaaacgctatgctacaattggtttaaccaataatgaaaataaaaaatgaggtgccaagatgagtaaaacatcggaaagcaaacaaatggccgttcttcgctttatttatgaacgtgtcaatgaaaaaggatacccgccaaccgttcgtgagattggtgaagccgttgacttatcttcgacttcgaccgttcacggccacatttcacggctagaaaaaaaaggttacatccaaaaagacccaactaagccacgtgccattgaggtaacgccagccggtttcgaagcactgggcgtcgaaactacgccacatcaaattccggtacttggaacggtaaccgccggccaaccaattcttgccgtacaggaagcgacggattattttccaattcctaaggaacttgaatcattcggtggcgaccttttcatgctcaccatccgtggcgaaagtatgatcaatatcggtatcatgaatggtgatcaagtcattgttcggcgtcaaagttccgctgacaatggtgatatcatcattgccatgaccgatgaaaatgaagcgacttgcaagcgattcttcaaagaggccgatcactaccgactacaacctgagaacgacacgatggccccaattatcttgaacaacgtctctgtattaggcaaagttgtcggtttatatcgcgacatgctgtttcagtaaactatcacccacaagatgacaattcaatttgtcatcttttttgttcgccagtttttagagcaggttgatggcatgcctacagattccactcacaaatatttacacccttcccgccgtgccagggacgagagcacgttatttgcgacaaaagcacgcccccattccgaattcaccttgccataatcccgcaatgcccaaccgattgccttctgaataaaaaagtcatcatcaccccgattcgttagtatcgccgtttgtaaattggcaatccgtcctctttcaagcctaatcgaagcgcgatacctactcgtcgcacctatttatcggtagctcgtaaatataccacccacttgttgtaaacaaccgtgcgctgagagatacgctgcaggcaccttgcgccaggcatcaacactatcccactgtggcgttactgtgatttggtggtagcaccattgctattgaatcagcggcgcctgattctcccgatgtatcgacagaaaaagtgctggcgtcaaattggttattagtcggatctcttttcaaaatatttcaaatctgtgacgaacagccaatagttcaatggtataatgattatactattttaaacattgggagttggttacatgttgttcctagccattatgggcttgattgtttttctattagcattattttccgtgatttacgcacgtcaaaccggtggtggttggaaatttctaacactaattacggtcctcagcgccctggtcaccatctacgcggtcgttaaattgccttactggccatacaaccagtcacagcaatcggcgcgcaaagcatcatctagcacgagtactagcgctagtaccagcaagtccaaatcaacgagcttgagttcctcacaagtcgtttttaacgaagccagcaccaaacgcgcggccgcaacgactaagttgaatgaagaaaatatccttaaacaattacaatctaactatcaatcgattggtaccgttgcattcaccaagtcaacgaaaacatatacgattacgccaaccaataaaaagtacgttaaatctttgaagacgattaaatcatatccatctcaaaaccaaaaagcaatcaccacgattacttcgaattttaaatcgttgtcaaaatcgctccaaaagaatcttgccgctggttacacgattcagttgctacaaccagataccactgacaagacgctgttgagtgtccaagatggtcaaattatgaccaataacttcaaataggaaaagtcacttgtctagaaaatttgctagtaacaagtgacttttttgtttaaacttgttgatccaaatattgacgttgttcgttcttttgaccggtcaatacgaatcgatggggatcatcagcatagctgaccgactgatcatcggcccgccattgcaattgatgactgaataaggcttcatactccgccacactaactcggcgacgacgagccaaccgttgtggtaggccatgatctaaaccggtctgataatccggctgaataaccccggtataaaattcaccctcggcacccgagccataactgaataatccgagtcgattccctggttgtaactgaggatcagtcagtaactgcgataacaagctcaaatagagtgaaccagtatacaagttaccaacttgtcgatttagctgacgcgcatgttcgaagtgcgccaaccactgggcttgtttctcggcatcaactaatggtaacacgcttcgaagcgctttaagtcccatctttgtatatggcaaatgaaaaaccaaggccgtcagtgtgtctggactagtttgagtcgtttgcaggtaattcttaaacacatcttgaaaataatcaatatagatattagacgagtatttgccgtcaactagggcttctgtatgatacaacggtcgccaaaagtccatcacatcttcgctcagtagacttgactcagtacccagtactaatactttaggatccgcactaattaacatagcaaccgccccaccaccttgagttggctcgcccggtgtgttcaatccgtagcgtgccacgtcactaccaatgaccagcgcctttttatctggatgaacacgcacgtgatcttgggccagttggacaccagccgtcgccgcatagcaggcttctttcatttcaattgttcgaacccgctgactcaaaccgagcaacttagcgacgtaaatcgcactcgctttggaattgtcgatccccgactcggtaccgacgactaataaatcaatagccgcaatgtcagtcgctgtcagcatcggtgcggcagcattagcagctaacgtcactacatcctgactcggcggaatcaccgccattttagactgaccaataccaatcaaatacttatcaggttctgcctggcgagctgttgccagttccgccatgtctacgtataaatgtgaagttgcaaaatgcaacttgtcgattccaattttcacgtcttttcctccaatttgttaatgacaataagggattaatatgcacgtccgcgtggccctaagtaatgaaaatcagggtcagttccgacccgatagcagccgaaagcccgactaatttcattatgaaaagtcacaacaattgccggtgtcgcccaagtagacgccgcccaaaaaacggtgtcatcaaacacccggttgtcattcgggtagcggtgatagccttgtacattgtcccaaatggtgccgtgcgtattcaaccaatcttcagcaagtccggcgtccacctgcatcatcacgtcttgattatcagcaatcaaactacttagtttttgccaatcgagttgccaatcatgaatatggggattcagtccgcgtgtgccaagtggtgtatgccccaatgcgatcggtgtcaattctacaaagtccatcttgaccaccccgttcgttaaccatcctaagatttcttaactattatagcatttcacgacaaaaatactgcccgcaattgcttgacctgggacgggttccataatttatgctgttattaaataaggcgatcaagacaagcaccaagtaaggagcgcggtaaacatgtggttctcacgtcatcaaaaacgaaatagtcttcaggcacctgtcgctggtacttatacggcgattcccactgccacatcaccccaacaaatcgggctattagccatacaaccgaccagtccggtgattaatgccccgattgatggtgatatcattagcctgtcaccctcgcgtctcgttatcaattcgctgagcaatcaacatattgaactgcgtatcgaccggacgaacttccacaacaactgtacctggcaagtacgcgtgggcgattccgtttcaccattaacaattgtagggacactttatggatccttaaaagacgtcaccatcgctgtctatcgaattgataccattcaggccactaattgggtttcactcgcaaataattagctgtttacggctatagattcatatccgctaattgggcatttcggttgtcaaaatataaatttgacggttgtgaatatttctaagtccaccttgacacccatcgcccaatctcaaaaagataaatcacaataatcacttttccaacagcttcaacgggccatgctactgtgcccagttggagttgtttttttgcaaactactcaacactgccaggtgtgaaatttgaaataacatgacgcatcgctgtcgacgtacttgattggtggtgtaattgacaagctatcgtgacatcattacaatttttgtggtttgatatttgattgctttataccttaattcaagctatgatattcatactggtttaaaattcctttctttattaatcagggctcctactgattaatagatcaatctaaaaattataaaaaggtcggatacaattatcatgaaaaccatgagtcttgttgttccatgctataacgaggaaccaacgattgaaatcttttataacaccgttgaaaaagtcctggcagataatccagagtcgttcaaggatatcactactgaatatgttttcgttaatgatggctcatctgacgacactttgaacgtactacgaactttaaacgccgcccatcctgacactgttcactatgtctccttttcgcgaaatttcggtaaggaagctggtttattagccggcttagaacacactatcggcgattacgtcgccgtcatggacgttgatctacaagatccaccaactttattgcctaaaatgctggcgatgcttcaaaccggtgactatgactgtatcggaacaatgcgggaaaatcgtgtcggtgaaccaatgattcggtcattcttatcacgctcgttttactcagttgtcaacaaaatttcaaaagtacaaattattccaaacgcccgtgattaccggttaatgacacgtcagatggttgatgccatcttggaattgcccgaatataaccgattttcaaaaggcatcttcaactgggtcggtttccgaacgacttatttgaagtttgagaatcagccccgctccgctggcgaaacacactggtcaatttggcagctgttcaattattcaatggacgctatcgtcgacttttcagatgtacccctgaagattgcgaccttcaccggtggcttgctctcactaatctcaattatcagtatatttgtcgttattattcgtaaaatattatttgataacagcgtcagtggttgggcttcaaccgtcacaattttgctcttaatcggcggcatccagctgttctgtctggggattatcggtaattatattggtaaaatttatatcgaatcaaaacaccggccccactacattgtgcaggaaaagaagtaaacttttcaacctaaactgagacgcatacgaccatatcgggaaaatggtatggtcgtgtgcgtttcggcatctggatgaagttaaaggttatgaatgaaattattatttaaaagctcttttgggggcatcagtccttgtcaagttgatgaatgaaataatatgatttttaattacttttcaaacggcttcatcgcggtattcaaatgcggtagagccgtttctttgtactattcgtatgatttcattaaagtattaaaagcctggttaaaggtatcaaccaccgcctcgctggttggctgacttaactaaagatgttttagagcgccgtaaatcgggctttgtgcttgttattagcccataaacgacttcggtggaatcggataatcctacttggttagactgagttacttgatttaatttcttacttagtttgtttgatgcgttgaggccgcttaatacaactttaacattttagatggagtacagatacagacatcaagtgtttaactgaaaacccaaaaccaatcgattcatgatgaagccacttattatagactgagcgcgacaaacctggcttgctaaacaaggtggcctgaacaccatgaatatccgagccgacggttttgattccttgataggctaatttatgttgtgcattcaatctttgtgctgtattttttggacttttttaaaaagaagtcaaacctcctgctccttgatttgaatcttaagttgacgtttcttgagccttagtcgttcaacctcagtcattttttcaattggtttcgtccatccaagccggtctttaagtgcgatgtaaccattggtggtggttttgagcatccagaaacggatttgctgataagatacattgtaatgtttcgctgctcgggaatatgcatgttcactcaccgtaatgtattcaacgattctaatgcgttcttcaaaagttatttttctactcataatgtggaccagcaattcactgatccggtcctccagccgtctagtacttctaaggccaaatctgatttgaatatcccacaaactactttcatcattcaagtacgctgatatggcctgccgcttaatctctgagatatatcgaatccaattgtgctgttcttttaatccttccagaccatcctgcatataaaaattttgacatctgatgaaagtacttcgagcgataccacacgctttaaaacacgttgatttagtcaggttagttttttcaagacccaggataatagctaatttttctgtgaccataaaattggttctagatataataaaatctccttaaaattgatagatgaagtatatcatttcatctatcaaccttaaggggactatagcacttaaaactgtctggctcgttttggttactgaatagtgtccacttgctaacgattatcggaatctaatgtaccgtgtacatcgtttcagtcctatctgaaactcggaaaccatttttcaacggcaccgctgctggtaatttaccaatagtagtattaccagcatgacctacgtacacatgcgattggccataatgcgtatcagccttagcttcatcagccttactttcaacgctttcatcgctggcataccgataatgtccattggttgtaaaggtctgcgaaggcaagtctggccgtagcccagcggcggcttgtagttgccgactcacctgtacgcgactgtccggataaacctctaccatactacggccagcaacatcaaacgttcgccactgaaatgtcaatcgttttactcgatatcgcttaaaagttttacgacttttaaacagtgttaacatatcgtgattcgtcaaattagtcctcatttgatctttcaaatcaccgacaactttggcccctttagacgaaagcccttcctgattcaagcgcttgaccattgcgtaaaagacggcttgctgccgaaaaccacggtgttgatcgttgtcaatatgtctttcgcgtgcataggctaatgcacgtgcaccagacatcgattgcaaacctgctttaaatttttctggttttccccagtaatcttgtccgataaaatcacgatcaacattaacttcaacgggaccaatatcatcgattgccctaataaaaccatcccaattaacagttagataataatcaattggtaaattcaaataatgttcaacggtcgctatcgccgctgcatcaccaccataggtatacgccgattcaatgcgctgataaccatgatattgctgcgaatggatcttaacaaaagtatcccgtaataaactacataaggtcattgttttagttttatggtttacaatgactaccatcattccatccgtgcgcgttgtcgataatttgcgcttgccactattatctaaccccatcaataaaaaagtactgaccggttgctgggtcaaattatgatgcgacttaataactcgtgactcatggaacgagtgcaacatgtcaaataaccgaataccttgaattgtgaaagctactaacataaaggttatacaactcgttactagtacaattagtcgttttctttgccatttaggtagttgccgccttctcataaactcagtccccccgcatttcattcatatcgcgcttaaattgatcagtaattgccattgtcttggcccaaatttgttgctcagtacgttgatttctaggcgtcttaatctgataagtgttcataatttgtgcaggtttccctcctagaacataaatgacgtctgaaagacgaaccgcttcagaaatattatgcgttatcaaaacaatcgcttgcattttaaatttcctgcgttcccataatgtgatcaaatcttgccctaaccgttgccctgttaaaacatccagtgctgaaaacggttcatccaaaaggagcagttctggctcaacagcaagtgcacgcgcaaaaccaacgcgttgtttcatccctccagatagttcataggggtacgcatttttcaacccttttaaaccaatcaaattaattaaattgtcaatttgattgtcaacatattgacagtcagaattaagctgactttctaggccaaacatgatattttgacgtactgtcaaccatggaaatagcgcaaagttctgaaataccatactcatacggcgattaggagccgtgactaaattaccatcaaaagtaatggcgccatagctgggccgaataatccccgcaatcattcgtaatagtgttgattttccgacaccagacgaaccaataatactaataaactggtgggtttgaacctgcaaactaaccgcttccaaaatcagttcagactgccgttgttttgaaagtataaatgactttgaaacgtgatcaacatctaataaaactgcttttttcaacttaaactcctcctcgtattaataatgaaagcgacgttcagcaaatcgatataatggttgccaaatcaacacaacgcataacccaacaatgacacaaataatcagtactccagttgcttctgcaggcttattattgatattttgggcaatgtaagcaccaagtccagtaaccgcatactggtgggtaccccagctaatcaattcagccgcaatatcagcattccaggctgccccagcagcattaataattgcggtaatgaacgatggaaacagtgatggaattaaaaagtgtgtccaccaacgccaccctgacaggtgaaaaatattaacaacatctttgatatcactgggaattgccagataccccgcgataatgttgaaaaaaagtaccattgagttccagtcattatcaatggaatgacccaccaatgctgtgtcgtccctgtcaacgtaatcattaatgcaacaattggaatataaatatccgcgggaattgatcctaaaacttgtccaaccggttgaatcagttttaaccgccgcgcattactagcaacccatatggcaagtggaataaaaataagcgccgaaagtaaaacagctatcaacacacgactagttgttaggaaggtccatttaaacaaaacactcaaattaatccaatcaagatattttattagtaatacacccaagcgatatagaccaacagctattactagccaccatgcaatacgccaatataccgtatatttttttaatatttgtataatccgtgaaaagcccagtttttgccattgctttggagcaccatataaccaccaataccggatatgacgatgtaatcgcttaactaacagcggcactttagccataaccatcaaatcatagacttgcgattgctgtggtagttggctatcggtactcgtaccgtatttataatgtgccgttcctttaatcagcggttgaaaaataaacacattgaccaataacacacagataactagcgcaatcactgcattaataacagcaccaaaattagctgtatcaagcgcaatctggatgtatgatccaattcctggtagcactaatgtttcatttttaggaaccacgatcgtcgcttgttcacaagcgactagggcaaaccaagcggccgattgagaaatgacaatattccatagaatgcttggcgtcgcataaagaaattctaagcgccagaatcgttgccagctattacagccaaattgcttagccactgtcatcaagtcttcgggcgtaacccgaagtgactgatagagagccaacataatattccaggcctgtgcagtgaaaacgccgaaaatagcaacggcctcaacacccagcacattattgggaaacaatcccatgaaccatgcagttgtaaacgttaaaaatcccaataacggcactgactccaataaattaacaatcggcaaaataacatagcgtgcacttcgatagcgcgctgctaatatgccaaaaatcaaagaaaacaatattgagtagcccattccaatgaatagtctcgttgttgttcgtaacgcagccgctactaaatatgacattgttaagtagtctttacctcccgtagtatctaaataaccctgagtgggtaatcgactgagcggcaggttcatcttggcaatgcaccagccaatcataagcaatattccaatacttagtccaagccacatcatcgttcccaccacagaacgtactttaatccctctttttaaacttgtcatggtgactcctttccatgttcaagttgtttttaggcaaataaaaccccattagcaaattgcagctaatggggtaaaaaactaaaatggataacgatttttgcatcgacgcattcattgagttttagcactttaagacgtaagaactagtctagttatcttgaaagagccttaattcggcaaattctgctttactcattcctgtctctcgacatttctgggcgataacctatattcttaaagtaacctcacctaattgcaactgatttttattgctgatgtaatcaacaatgctatcatagtttcaagatctttaaccgtcaatagaaaccagctaatgataatcattaacaagtgattatttatactttttaggtttcctttataatcgtaactttttcttaactatttatctctaaacaaattactcgtactgtctagcttgaaatttggactttaattgccacaaaaatcctgttacttagtgaaaaattctcggtaccgaaaaaatggagcgcacgttaggatactgtgtcgcaagaaccaagccaacccccataaaatcgccaattatggccgaacctccctgactaacaaaaggtaacggaattcccgttaaaggtaacagcccaatcgtcatgccaatgttttcaaacatatggaaagctagcattacggctactccagtggaaacatagacataaaatcgacgtcgactagcgaatgctgagcgaaaaattagataaaacaagtacatgtaaacgataagtaagacactacagccaatgagcccagttgtctcaccaacaaccgaaaaaatcatatctgattccctaactggcacataaacagcgttatgagttacaccattcccagttaatccacccaccccaaccgctcgcatactttgccacaattgatagctttgatccgagacgccattgcttgggttaagccacgtattgatgcgatcaaactggtacaatttaaatccgatatgagataacagagattggcccgtgctcgatgtcgctaacaaaattaaaacaaccccaatggatccggccaccaataacacacgccacaaaaaactaaaccggcatggtgaaacaatgagcataccaataaaaattgtcagaaaaactaacgtcgttccaaaatcattgatgattttcaacgcaacaataattggaaaagtgtaaataactaagcgacgtgtcaaccgccaatccgcattaaaattattgtggggtccccactgttgatcttgaacgattaaccggcccatcattaaaatatagagcggtttcataacttcaactggttgaaaagtcagtgtaccaattgcaaaccaacttttagcccctgtttgaacataatattctcgactatagaagaccaataaaagtatcaataacagcatgccaattgaatagccaatcggggcccactgcatcaattgtttttcacttaggtgaagcatcgttgtcgctatcaatgcacccacaaggtaccagagacactgcatcattgtcgtccgaacaggatcaatcacttttaaatcatgcagacaagcatagtaaacagcccacataccaatacaacagagtatgatgacacataatataatcccccagccatagtcgccaatatgtttatgctcttgccaccgaccaagttctctattattcatttgttaccccccataaataaaatttataccgggcttagtatagcggtaaatccaagtattttatattttaagtggcttttttatgcttaattaatcgatttaaccggattctaaatattgcattaaaatcttaataatcgtggctaagcctcttgctagccacgataaattaattgatacaacatttgatcattattacggttaatattttgcacgttgttgactaatcgtcttaaaatcttagcgtcaatctaatatttgacgctacctttaaatcttttgaataaatatttattccagcagaaaattatgctatacttattaagtaccatatggagagttggcagagtggtaatgcaccggactcgaaatccggcgaaccggctaataccggcgcgcaggttcaaatcctgtactctccttaaattgattatcagtaccaaccttgagcgtcgtcaatcgttgaattgacggcgttttttatttttcataatcgctttaaaactatataaatagatataatggtgcactttttggtgcactcttgctaaaaaatactaaattatgctgactttttgcacttaaaagtgcaccaaaaacatttaaacgtgccttgacaccttattccataagggtttaggctcaagcaaaaaagcacacttacacctaggcgggtaatacataaaaaaatcccccacgccgaaacgcaggggaattaatcaagttataactatcatctagaaactacactagagacaattaatattatacttattacttgctattctgtaaagtcttgtagttatctaattagctatattgacagctaataatgctaaatctaaactctcactaacaaaatatacaggcaagcaacacaaaaaaatcttccacccatcaagcagaagattatcctcatcacttccggcaccactaaccgacaatcttggggggatttgaaagctgtgatactaataacaggacaagggacataataacacttgtcggtttatatcacaataccgaaagtaatctatagaaaaatattaataagcccttgttatattaatcaggtttaatgtataataactgtgttctctattatcttaggagaaacagaacacccattttatttatttaaacattgggccagtcttgactggctcttttttatatattttgttaacaaaaaaatcccccacgccgaaacgcaggggattagcaaattcaatgtttaattatactacttttcgcctgcttgtgaggcggattctgacgccgtttcagtgtcagatgatgcagaactattcactacagcgactgtagacgcgggtgcttgcacttcatcagcggcctgattagtggtcgcttcaatctgactttcctcatcgttatcagtcgttggtgccgtcactgtttgaacgtcagtaataacgcccagcataccaaggatcgttagtacagtgttaataacggcaacaatggctgaccagtcaccagtaaacttaatgccaaacatggcaaagatttgttgaatcaaaacgatcagtaacgaaataatcccagcaattaattttccattcaagcttccgtcagcattcttaaaactaatttttttcaatttaatatccccctataagaacttttccgcgatataaataactaacgtgacaagcacgccactaaccaagacaccaatcagccaattttgaatagttgtcacgcggtcaatttgatggctagcttcaatggacttggccagtgccttgtccgctttgtcaccaatatcgtcaacttgattcagcttttcttcgatgttctcaactttcgttttggtggcagccacatccttttgaatatccattaataacttagttgtatcgtcgtattgtgccattaccgcaccaccaatcgctggccaggatagatagtggtgtaaatcgtcttgccgttctgactagctaatgtagtcatgttcaggccgttgcgctgtgcgattgaccaccagctgtcgccatacttgactgtatgatacgtatgactaaccagttgaccagtaactcgtttcccgtaggctgccccgttggtgacgcctagcttgataaagccgtataggccatttgaacgggtgtaacgtgcccatacataatcgtgttcaataatgaccgcattgtaagtcacactctcacccttgtaataggtagccacttgactaacgttgtcgctatccgtgtagcgaacagctagtgttcggttagggtaaaacacccctcgttggtcatatttaacaaccttaaaggtggcctttctagttgcctgtttacgagcctgtttaacattggcctgtgctttagctttgctagcagtcgtatatcccgatttagtaatgcctgttaggtcaacattgccatctaatccgcctgctttatacatgctagtgaattggaagatagctacgccgtccatgctagggaaccagttgtaatcaggactagttctaaccaaatagtccggatattcagctagccacaagcaattaccataggcacgtacaatgtcgctagtgttaacgtgagcgtttagataagccttgccggaatacagcataggggtataaccagccgccttaatgagggccatctgggctagaatgacattagtgttggctgtcacgctattagacgcaccatcctcatagtctagtgcgacaatactacccttgggcgtcctaatccgtggtaagtaataggacatcatcgccttggcattggtcatattgccaccaacaccgtcccataaataggtgtgcacccgtttaccagcctgcttagccgatttaacttgactagcataagtggtctgagggatattagtaccaccatagaagccgcccgcctgtgagaatacgaacttatcagtgctgtagccgaatgtcccactattaccgttatatttagaccaatcaaccccttggtcacggctagttgaagcctgactggtaacattgaccattaaaaaggccataaaaatggcgcccaccgttaagatgagtgcctttaacttatgcttattcaactaagctacctcctcattgcacttgatccgctgctgtcttatccgctgctgcctgtgcggccttgtaggctgtaattgcatcagatacctgagtaacctgagcttgggtaatcagtgattttactaaataattgccagcgtatacagttgctaagtccgatggaatcaacccgttgttaacactgctaattaatccttctgttaaaaattcgcttaaatcaaaactcatgacaaagacccccctagcgccacaatagccgcttttatttttgcgtaatctgattgtgtcaaaatttctgctggattaggacaccaatcataagctacactaccaatttgtaggcttgcgtgcgtaatcgtaaacggaaaatcgggcgtatccttagcttgaaaccggataaaacagtcacttacatcatttaatgtttggtctgtaatgttaaagactagctcatatttttgcagagctgtggtccccgctggatagctaaatggctgtgatggccaaggtgacgtgtttaaataaaaccgcgaattaaaatctgctaatagcgctttttgagccgcaaaagtaaagctgattatgatattattttgttttaaacgatcggtattttgccaaaaatcatcactaatattaatacgccagtcccaacctgctgtacctggtggtgttatggtattagtttcactgttcaaaaaataattatgaccacaaacgctcatattatttaagtcgactttaagactatttaaccaagcttcttgggtaccgctataaccggagttaacggctacttcgtaagtcgaagccccggtgtcacctttgtcacctttgtcgcctttaataccttgtggcccagttggaccagtgtcacctttgtcacctttatcgcccttatcacctttatcacccttatcacccttggcaatcgtgcttgcagctttattcattgctttaacaaaatcgtcaaaagtaatggtcgtaattgtggcaccattagtgctctgaatgttattggtaatggtaaaaccggttgacccatcactagggtaaattgacgtcccggtactatcaaccacccatacttcaatggaatagctaccagctggtaaactagtcatcaagtcagcattaaaggtaacggtaacttggccagtcgttgggtcggttaaactagctgggtcaactgtggccgatttaaggtagccgctagcattgcccagtttaacagtaattgaagtggccttagttaagtccgttgccacattatcattgccacaaattaacgtaaaactggtcgtggtatcgccaattttaacagtctgtggtgaagtatcggtaaaactaagcgttttcgccatctttaggtgcctccttttctgccaacttggcattaagctggtcaatttgaacttgtgccatcgctaattgctggtctttaacggcaattgcttgggcatagttacttgtcagcttgttgactaaagcttgtgcgtcaatattcataagttaagcctcctttgtggttgtggtggttgtggtggttgttgtggtaactggctttaaagcggtcagactgtcaatcagcgtgttcaacaccttcaatttaaccctatctgctccaccagcacctccagcaatggcagcgttaaactcgtccatggtaatacttacctgtgagctgataccaagcgtattaatctgaatgctgattgtcataatgttgttcgtgtaatctggtttataatttgtaatcaaaatgctatccatttaatctggcctccaatttgtttaatctagcttccaattccatgttgtgaccgtttaattggtcaatttctttctgttgttcctgcacagtcgctaaagtggcgttcaataacacactgtcatcaaccccatttagcttgccgttttcatcacggttgataaatatgtccggcaatcgccactgcttagtgtcattcacatcatcaacgattgaagacaacctaatatggctagtattatcgtcagatttatactgataagttgctaggtcaattgagttaactagttgcgcccagtaagctgtatcagccttttgcacgtccttcttaacgctcaatagagatgacttaactaggctatcatagtgaacggtaccagcatagatgtcggcggcaccgcctgggcccttggcaaagtgaataggagcaccatcagtactagtaaatgtgtggtaggtatttatgttgaagttgccaatatctaaagaacgattgaattgaatgccataagtacccgatccatccataccaaaactagctgtcttcatattcatattattgccgacataccagatgttctgtgtaccattagggttgatattgccatagggcgtaataattacgccctttggtgtaacgtcagcagaagtaccattaaaggtgatttgttgatcgtcaccatgcagcgtaataccgtcatttgcattaacaatgacatatcctgtggttgtacttaccggattagaaaaagttgtatctttagctgacgtataacctgattgtaaatcaagaccttggccgttaattactgaatcataagctaagtattgcccattaccgatcattgagcgatatttataggcaatcgctccagattcaacacttgattgcaatccaaccatactgtcaaagtacgtcgacttatacgccccgtctggcgtaatagtcattggataatagttagcggtgttattggaattgctactaatatcgccaccatggaacgttgtcccattgatagttgaaccattaatcgtactagcattgattgttggcgaggttaatgtgccaccagtaagcgtcatatttttagctgttatcgcaccatctttatatactgtgaaagttttgttattggtactgaatgtgttagctgtaatgtctgccgccgttaaagtcttgttaacaaggactgagccgatgttagcactaggaataattacaggtttatccgtatcaaagcgaactgtatcagcagatagtgttagttgaccgccagatgaaattaaaatgttcctagcttggacattaatctggctaattaggtcacctttagtaactctaaggttaatatcattagacagttgggaaatcatagaatcttggccgctataaatatactctgtcgcagtgtcaccgggctctaattttaattcagtaaaatctagtatcgaattttttccatcggtcgaaccattattatcaatacgcagataagcttcatcaatcgcccctgttgtaaaggtaaccgtccgataatctaatgttgaataagataatactgccgctgtaattattcgttggacaactgtgtaatcagaagtattaccatttgtccggcccaaaacaaacacgtccatactgcttacattattactagcaaagccttttagctgaaaagtataagttgtgttagccttaatcttaaagcgtgggcttttagcatagacttcggtagaaccagctgtacttaattcatacaaggaatcagcaccgttgtgatagaatgcatgtgtcgttatacttagcgttccacctgttccatcctcataccattgtgaagtatcagcttctggcatagctgaatatggtatcaaattgacgttgttggcgtctactttgctaacaaacatatcagcagtctgttctttataagtcgtgaagtcactagattcaaccttactttcgattgctttggcagttgtagcttgataggctgagaaagcactagtagctaccttgctggaaattaggtcagctgtagttttttgataagctgagaaagccccattagtaaccatttcccctatctgactagaggtctggtatttgtaactagcatattctgagttcgcaaccttagattctaacccattttgtagttgagcaatcgtcatagttgagccgtcttttaggtcggtcactgcttgactggtgacgttaccagtatctattgctttaattgcttgactagaggcgctgtcagcggcactttgagctttgtcgatagctgtagatgtaacagctatttctgaattggcataatcataaaccgattgtgcttgactaaaggcttgactagctgttgaagccgcctgacttgtggcactagcagcactagcaaatctattgttagcatcattttgaaaagcactttgaatatttgctaattcttcattataagcgtcctgatatttcttatatgctacacggtcaatatcgctagcgtggttaggatctgacagaacgtcagccataaatttgtttaagttgttatacgctgtggttaaagcggttgtgtcaattccatcatctttagcgctctgtataataacgttatattgagatgttaaaccagcgaactgtccaatattgttttgcttttcaatgacactcattaaattaggatcatttaaattggtgaccccaccagcggcactgtcagctgtgctttgagccttgataattttgagaccatcatcggttaagatgacctgtgttgcgttagattcagccatttaattcacctcctttcttaatcattgctaatcgtagtcattggcaaacgttctttaattggtattgcaaagacacgttctaaagaagtaccttgatacagacaattgaaagtaaccaataactccggctggttagtctgactatagataatgttgcatgtttcaggctcgataacatcgtcggttaaccctaaattcatatcaagtaaatagttagaagcgaattcttgcccgccatgaataacattaatggcgtacaccatacgagggtctttcatgttgtaatcgcctgagtgaaagtacacatatggaaagtcaatgccttgtgattggtaggtttgctcgcccacgccaaacccatagttggcaatattaaaactatatagcacatcataattaccctgtttaacctcatctagtcgtagcacatcatgtttaccattcacgtagccacacagtacgtacccatgtttgaaatcaacgctgactcttatataacgatcgacagtgcaaaaacgcataatgcgattatcatcattgtctagggtcgtattagcaaggtagggtatgcggctaactgcatattcgttaacatttaaattaggcttagttgcggaccaaatgtaaatagccccatctgcttcttcaatcgagaagctcgaaccatgcccaccatgtgaaacaaccatcttactaatcggcttaaaattagtgtcatgtaagacaaacatgacatcgccggttgtgctttgattaattgcccggctagttatatactgaccattactcaaaggacacatgtactgtaccgcatcagttattactagcgtgctgtcgttttggttaaaactacccaaattgcgaatagcactagtttgtaacttaatctctggttcatcttgaatataatcggtctcaatagttccgtgcagtgtgccaacgtcactatagggtgcctgtactaagtatccagtttgattgaaactagtatcaagggtgccgtcagtattataacggtgccaaataaatcccttgttatcaatataggctgaaatattagtattgccttcccaagcctgtaagattaatcgcttagtctgggtggtatcagtgaagttgttgccatcaggagttaatgcgactggtttaaccgagctagcgtcctcctttgccttttcaatggcgctattaatagcactttgataaccctgcatccatgctggcgttgcaactggcaccgtgacatattcaccaaatccaatggtattgccataagggttagcaaaactaattgtccgttgaatgactcggccactggcatctaatgccggcttgattaactcatctttaaacctaattgtggcacctaatggcgggttaaatttagacgttacattaacttcataatacgtccgtgggtgattatacaattgcaacatttcctcagcccaggctttaagaccagctgggtcttcaattgagttagctgtaacaaccccctcatagtacaacccagattgccagtcagggttatatgtttgattggcttcatcgtcaacaatgtaactcttaccatcattgactagcccaattgtgttgccgttagcaccataagggataagcttagtgattgggtttgacaccgttgttcgctttaagctagtcatattcttaccaaatattgcctcgttgtataccacatcagcattaagctggtcagtaatgacacacacctttttcgtgatatttccttgtgagtcaatctcaacataaggatcaatctcgacatcataggtttgaatgagtgtctgtaatagcgtgctagctttagtcttgccgtcaatggtaatcgatggtgtcattacattagtggtctgatagtctagcgtccaaccagtggcgttaaagcactgattaaaagccgtctgaatcgaactatcactagccgtaatggccactgggtaatgatgagccaagttgtacaagcataggttggtaaagttagccgttgtgacgtgtttaacagcagcggtattgctttcttccacactgtatatgcgcatgacataccagtgtcccgacaaagcatcataataagctaggttgttgccagcgactactttatctgaatcaggctggccttgaatcacgtctagttggccttggtggtcgaacttcttagattgggcgtttagattaatcgtgccggtatagctgtccttagtgccgacattgacgtcatcgtcataacttgtactggtagtatcggcatcagctagttgaatcttgacgctatcgttggaaaacttagtggctccatcaacagtcaatgtgccaatccgtttcaaattagggcctaggattaaatattggttatttaaagccatttgttaacctccttattttagttatgtaaaaaaggccgcccttaatcgggtaacctttaaagtgttgctacagtattcttggtaaatatttcaaggtcatttgcgcatcatctaggtcaccaatcatcgataagccattaacgcccggtttcaacttaggaaaatcggttgaccaaactggtgaaactagcttgccgtttacagtaaccgtatctgcctcacaatccattacaatttcttcaccggcaccagcaatataagtcggctttgttgtatcaacttcattgactttccatatttgaaggtcagtcattgacataaaggggttataatatgggactttataaatatcttccgtaattgggtgctttagaaaaacagatccaatcccacctaagggtgtctgatacttattttgagtatcaacataggttccgtgtactaacatgtgaatattaggatcaaggaacggttggcctgttttagtcgaatactgggtgatactccaagtaaatacttgtcctcgtttagtgatgtccaacactaaccaagcacctgccagcgctgagtcttcctctttattgaccacggctgtgtaggtattaacgttttctttaacggtttgtttagttacttttccatttctggaacgtccatatttagtgacagttttggttgtcgtgccagtttttatttgaattttctggtcaggcttgtttgtaaaagaacctgctggccctgaaccataatacaagtcagtatagcgatcaccatattctaatgttgatccaggctcacatatttgaagtctagccataggtttagcaccataggccatgtcacgcatgccaaagcgtccaatggtgttaccgttaggatctaatagcaagacttcaacacgccccatcgcacggctgttatgagtaccactgtacctgaattgatgaataccagttcgtactcgccagtcagtcagtgagtttgtcatgccagtataacgataggctgggccataccagcggtcttcaccggttgtggggattgtaccaaagtcatatccagcgctagttacagctggccgcattacattagttgcagtcttaatttcactgtggccttgatacgtgtacgtttcaccagttttcatattaccaattgcattggcatcatttgtccacattgccatagttcccagcggatcatcaacaactttagtataaggttgaaccgcagtggcttggtctcccggtgactcaggccctaaaccgaactggccaccatttaaactaaagccaatatactttaaatctcgcttaggtatgacctgaataaccggatctgttcgtgcagtgccatcaacagtaatcgtgtttaagccattatttaagggcttctcaacctgtggcaaggttgcccggggatcggattgcacaaaggtaatcgtaagcgccatgtcatacatgcctgggttaatcggggctgggtcactaattgcggtaatatgcccccaatatgtcaccttgggttcaaagccgaacactagtggatactctttaccattatcaccggggtcatcgcttagcagcagaccacttaggttgtgcataatctgattaaatctgtcttgattatcagcacagtaaattgacactggaatactaatcgttcgactggtaaagtccgtaccgttaaactggttaccatacatggctggtatatcagttacttgttcagccatggccggtgcactaggtaataccacgtttcccatttcaacttgcaaatcgtcccggctattcaagttagcatattcaaaatcatctcgttgtaaagtcacgatttaacctcctttttaattttagctatgtaaaaagggcgtccatttaaggactaccctttgattagtaccccatcatttgtgaatattgtgaagttgtcttattgtcagatttaacagcattaaccacatcagatttagcaatgactgcttgaacactacccatgttgcctagaatggctgacattaagctaattagtttatcaagcttctcattactttcactgctattagacgcaatctgcgtgctagtattgccgtttacaacttgactagcctgtgcgattaactggttagcccgtgatttgttagtcaatggcaataccatttcaggcttgttgtgttcagcaacctcaatcaactggttagtgttgataatgccaccgttctcaaaccgcttatgaccttgtgggccactatgaagccagtcgtacttagcgtgaccccaaattgaggtattaccagtggcattaagatagtcagagttgtttaagaatgccaacacttggtcaaaactagacctgaaattgtgatggcctggaaatgcaaaggcatcaaaggttgtcttagtaaattgcaaaggaccagcagccggattacccgccgcagagttactgtcagagacagtttgtgcaatgtttcggttaccagtttcactatcagcagtcttaataatggctgactgcatcttagaccagtattcacggggaaccttagtcattccaagtgcttcgttaatcatgctatgagtgatagcgccaccttcaatggaaccaccaccattatcgccaaacatgtcagctagcttactaatgaatgaccaaaagcctgagccgacttgatttttaatggtacctaacaggccactagatttagaagacttatccgagctagaactatcgctaagtccgggtactcgtccgtaaccagcaaacgagccatatccaccgccatgtactttactgatacccatgccatcatgttcattttcagcggaatacatatttccaccactgatataaacaccaacatgcttgctaccgcctggaccaaagaatgctaagtcacccggcttagggtcgctgacatgcttagacgccctgtattgctcacctgagttacgtgggaagctaattccaagcttctttagggtatactcaactaggccggaacagtcgaacacattaggtccagcagcaccccaaacgtacttgttagtggcaccatacttttccatagcattaacaaaggcattgttagaagaaccaccatctagactgtcactaacgccaccccacagtgtggaccaccatgtcttagcttgcttctcaacgccgttaaatagaccatggccaatgttactcatgacaccgctaatgcctttagaagaccaactaaacaggttttctaacgacttaattgggtgagcgataatgttctcggctgtcttaaagaacttctctaatccattaacctttttaccaacccagttagtcacacctgaaatgccactagtcacactgtctaaaatgtccccaaagaatccagtccctttagcgtacttagtcacgccttgcatactcattaacatggctgtctcactagcgctcaatacctcagtgccagtgggtaacatcatcttagtgttacggccttgaacaatgcccgagtcaccatttgggagcatgaccatctctttattgccagtttgtgggctgtcattaccatcattgagcattgccatagtaggtcgtgtaatcgggttacgttgtcccgagagcataccagtaccagtagcaaaattaacatggtctaacgtaggtatagttctcttattcttgctaccgaaactatgaattactgcgtcaaccgctttaataccatcattaataatatcaatgacatcattcatgccatctttagcaaagccttttaagtctttccaaaggcctttgaagatattttcaacgccagtacctaaactagaccagccacccttaaatttacccttgaatgttgatagccaatcacccattgagcgtccaaacactctagtgtggcttaggtctttattccaatagctgtgcaggttagaccgcatggtgtcccaatgactgtcccaactatgtgcaaagctctttttccagccaacccacttactgcccatgctgctaaagaagtctctagtatgtttaattgacctgttccagtagtggtttaagttggaacgcatatcattccagtggctgtcccaactctttctaaagctagacttccaaccgttccacttcttacccatgctagaaaagaaatctctagtgtgcttaaccgagctgttccatgcaccatgcaagttactagtcatagcattccagtgactattccagctctttctgaagctatttttaaagccattccacttattaccaacgctgctaaagaagtttctagtgttcttaacggaaccgttccagttgtttctgagtgatttgcccatggctgaccagtggctgttccatgacttcttaaagccgcttttaaaactattaaagctatctgaaacggtcttaaaccacttgccaaacttagtcttgctaaacgccttagaagcgtcattaacctgtttgtccatagccttcttaaagcccattttttgaatgtctttgctaaaacctttagaccacttttgaatattcttaccagttttagtgtcctttaagaaccatgtagctaggcctgcaaatgggttaatcaaagtagttaatatctcagtcttgtgttttttaaagaaaccggtagtggttttagcccatttaccaatggtgttaccaactttgcctaaggctgagccgactttcttttcccagtcatacttgccagtaaacaatttcttcatggcagtccccataccatttactgcatcacggaacggtttaatgtgcttgtaagcctcgtaaaaggctacccctaaagcgacaacagcagttaaaactaggccgattgggttagttagtaacaactttcctaatgacagaaacgatttacctagtgttttaatgccagcacctagcacgctgaatgccttagatgcccctttataggcgattttagccgtccatgacagacccttaccaatccctttagcagtacctttaacggccttgctaaatagggttagctcacgtttaccagtttcaccgttaactctaggcttaaatacaatccggcttagtgctccaccaactttaccagcggcaccagccaccccataaagggtgctactgatagctttaagtttagacacggctaggtaaaccatgatagttttaccaacattttcaatggctgtcttgtgcttggcaatggcggcagttgcatcagctactccattcataccctttgaagcgtccttagaatgcccactaatcagctttaaagaaccggctacagctgaccatgcacctttagctaagctgccaacaatactggcgattgcgccgccggtcttctcgattggcttttcattcttgactaagaaactaataacatcaccgacatactgtccagtctttttaccaagtgtgccaactagacccgtcaaggacttcttaacaccgtccagtgcgcctttcttcttcgataccccatcaatagccttttcgacaccggaaactaagggcttagcaaaggctaccttcaaattggtataagtaccttgaatggctgccatcttacccttagtagtatcgccaaattcagaccatgctttaccacttgttttagcggccttgaccatgtaaccctgtaattgagtaccagtaattttaccagccgctaattgcttgttaaaggcatctgttgacatgccactagctgtaacaatggccttttgaagctcaggcacttgcccgaaggtacgcttaaataggctggatgttactttagaactaccagccagtctagccattccttgtgacatggaagcaatctggtcgcttgatttacctgcagcactaccataactagcaatcacttcggtcatggcacgagctttagtagcgctgttggtcatagcatagaatttcttctgcatctgatcaatagcgccaccggacatgttggccttagaacgaatgtcactaatctgcttggtcatcttgttagcgtctgcatttgataagcctaagtttgtccactgcttcttaatcgtagctccagctccagctagtttataaccttgctcagtgacacctttaatgtagcccatcgcactagatgcggcgctactaattgcgttgccaatagcggcaccaatagcaaaatgcttggtttcgtcattagttttcttttcttcactacgaaccatacccagtttagacttggctgaatctaacatcttagtaaaggcactagcattagccttcttcatggctgaatctaactcattagtctcacttttcagctttgccatggatgttgcagtctcattaacacgcacttgttggcgtttataggcgtcactagtagcaccgctggccgtcttaatccgttccagttcgctagtttgcgccttatattgggactccatgttagaataggcttgttttaaaccacccaaacgagccttgttggcttcggctgacttgccttctgcttctaggcgtttcacataggactcacttaaagccgtgctctgtttatagcccttttgtaagtctgcaagtccgctgttgtaatactgtaattttgacttagcccgatctagttgaccacccattgagtcatatgaccggctagccttgttaatttggtcagatagttttaaataagtttcttcaccgtctttagtgtcccggtttaagcctgattgacgggactttaactcatcaattttagctttttgagcttccattgatttagccagtccatctactctagctgctgcggccttttgataatcaccggctgatttcaacgccgtttcttgggctttccagccactggtattggctctgacctcggctgtcagcgttttaagtgatttaacggcctcagcactatctaagccaaccttactggtcatttcacggccgactacttttttagccattcttttttagcctccttttaggcacaaacgcttatacaccgtatgtctgtttaatggcttctagtgggtcaactaactcagcacggtcttcctttttacgagcgttcaaagtttccatcaaactaaaaaatgagctatcatcgaagtctttcggtgataacccctcggttaatagctgttgagctagcaagttaaagtcttcttgctggttttttaactttatgacctctcgcttaatctccgcattgcgtttgtgccggtttattttgacgacttagcatcttcaattgccttgcgttgcttttgttctgataacttaatgtcatcgtctgagataccatttaaccgcatgattaggtaaccaacgccttcaccgaaacgttcaattgagatggtatcgttaattgtttccatctgcttgtcggtatagcccattacccgttgcacaaagttggtcattttgtcctgtaattctaatccgttcttcattgtgtctaattcagtaacttctttttcagtgtcttgtgattccaacatgccaatttgaactttggtagctaatcgaatgatattgttggttggtgttacatcggccgtcttgttgattttgaaatagtttttagcattaattttcatagttaattttgcccctttaatttagtttgtatgtataaaaaggccacccttagtgggaagcctttaaagcgttgctagtgagtagttgtaccaccagttgtaccgctggttgatggagtgtagccaccaaacgtttcagccataagcttgttcaaatcaaaaccagtatccgttgacttagcaatcatataaggctgttgtaccccgttggcagctaagaagatgtttggctttaatggcgctaatacagaaccatttaggactgttgagtaagcaacttggctattagtatcagttccgttgttagatgcttcttcaacgaactcgatattgttaaagcattcataaattgagatgtcgccatctaatgattgagattcggcaatcatcgcaacgtgtggcttaggcaattgacgaacccatgcaccgctattagcgctttgcgtgtacccttttagcatctggttaatcttgaagtccaaatctaaggcggttaaagccagcgtgggcatagacttgccgtaagctgttctcttaatttgtccgttaccccaacccggagttccggccgcttcaatagcagtcacgttgatttgactgaaaccttcgccattgtgatcggcaacatagattccgtcagcagatagacctttagtagcgtctttaattaagtcgccgttatcgtctagcaaagcaaaggttgctttgacaatgttatgttttgacatttaaatatctctcctttaaagcatttcatttttagttacataaatcgttttagttacttggtcggtatctggatcagttgtgtggtgctgactagatacaattaaccagccggcctgtttaatactcttcattaaagctatctcagcttccaatggattaaagtcatcggctaggtcagccttgtaaaagatttgaatttcaacacccatcgccaatcctttaaacgtgctgtttgcaaggtaggctgggcttgaatcggtctcttgcagtagcatgactgtactagtagtgttgtctaaatcttcgttaggaatttcattcaggtaaactttatccagccagtttaaattgagggcgttaaccagacttgccacctgtgatactggtaatagcattagtcatcgtccccctttttatattcatctagcatggcgttaaagacatcatcttgtgagtcggctaagttatcatcaacaaagtgatcagccttaatgtacttagtcccatcatttaaccgcctggcattcatatcatggtacttattagtccagcctacaattgaacttccatcatgttcaccgtctatatcgttactgttatagcttatgttgtcagccatgtgtccatacttctcatctttatgacttgaatagtgtttctttctcgtggcttcggctaagttatcagccagcttcttagcaccggctgcggttatcttctcttgttcggattcgttagggactagcttgtgggcatctttaagccagtcttctaattggtcgactatgttatcgtttgccatggctaagcccccttagtaacctgtttgagcgtcaaataatcgcaagagagataattactagaatcatccatgctgtcattgatgacatcgtaaagtttacctttatactgacatttaatgccttcataaactttaggattgtgtctaataattactactatttgctccaattgttcagctgtgagttgatacgaatatgcaattgaccgtgtatagggcgcacagtataaactaaactgactaataaaggtctgcttactagttccgttaataggattttgaacagttttaacagtgccaatctgtatacgttggttaaagtcaactggggttaacttattaatcgccattgccatccacctcatcctgcttttggctatacagccctcgcaattggccaatgattgaatcaacaactaagtcaactggattaacagtgtttgaagtgattgatgtccggtaataccagtatgaaccagctaaggcgtaaacagcagtttcaaacaagtccttcgcaccttcaatttcatagatccctagaccactattgtcgtcaccaatggcctgtttaatgtagctggtggctgcagacaaatagccttttagcagctcgtcatcatcatcgccatcaattcgcaaagatgattttaatgtttctaaatcggctgccatttaaatcacatccttacttagccgcccagattgtcactgtactgtgtatttattggcgacatagttggctaattacttactgggggtcgttgtagcagcactagctgcaaagcttgctggttggtcagcaatgctgctaaatgaacccgcaacaaaggcatccgtatcagtagcttcaacatcaaagcgatcaatcacacgaatcttagtttggtctttctcgaaggcaccaccgccgatattagtcgttaacaatgacgcattttctcggtcaaataaagttaccgcttgtgataagtcaccataatacaatggataaactggtgctgatgcagttccagcgttaggcaaccacttgtcagctacttctacaattcgcttaccacggattaaatattgatcaggttgtgttggatctggttgtaataagtagtgccccatagcatccttaacttcggaaagcacatttaaacctgacgtatttgtcattaagaacgatgttgccttgatagcaggatcaacggcagtattaatcatggtaataatatcatcgaacttagctaaggttggcttctttggtgcattgttcatagcagcaatgattttagcattgcgagtaacaacaaccttcttagcaatccatccagatagccaagccaaaatattgtcagcagtgtctttgagcaacgaattagtagccgtggtgatgccagcataacgatggatggtatatttgatgagggatagcttgggatcatcattatcaccaatagtagccgtttcatcatctaaatcagctagtggagtaacgtcagtccacttttcgtaaactcgtgacccagtttgagttgaaacagcttcccgattaacatattgttgtaatgaatcgtattcacgaacaagcgtattaattgctgtttgaatatcttgaggaatagtcaaaccaattgcattcccagctgcgtcagtagatgaagttacaaggttcataactttcgggtcacctttaatcatgcctttgaagttattgatgaactcagctttgatgtctttttctttattgtcaagtggggtcttatctttatcctccatatcggcaatttcttgagccttacgttcttcttccagttgttcatgtaaagcatcacgccgggcaaccgcattgtcacggtcttgtttcattgctttaaattggtcttgatcgaagctgtcatcaaggacagctgcatttaacttgtcgtttaagtctgataccttttgcccttgggcaatccaggcatcattcattgtgttaatattagccattagttggcctcctttaaaatatttaatttgctgtttcgtaattcggcagatttactattagtagtattttcttctttagctggcttatttttatccttgtcagccttgtaaattagattcatcaacttgttaactgcagatttaggtggaatgtgtgaaatagcattcaccggttgcaattgttgatcattagcaaacataatttcgtcagcgaagcctttatcaacggcatcactagcggttaaccatgtttcatttgccattaattgtagtaagtcggcttgatccataccagtttttgattcataagcactggcgattgatttatcaatgccatttaaaatactggcttcatgctccaaatcgtcagcattaccagctggttgtgaccaagccttatggatcataatctgagcagttggtgaaatgttgatatgatcgccagccatagcaaccacgcttgccgcactagcggctaagccttgaatattaaccgttacattgccagcgtaatcttttagcatggtgtaaatctcactagccgcaaaaacatcgccaccgttggaagcaatgtcaacttcaagttcttcatcatcaccatcgtcatcatcatcgccactgtcatcgtttaaaatgtcagcaacacccgaaggtgatactgctggcattccaaaaaactgatagaaaccggctgtttgatcatcaacaatatcgcctttaatcatcactttctttgtcatcattatcacctccttttcctgattgaatcacaacttgttgtgtcgttggattcttagcatcaggcatttcatccggaaaataaccagtctgctgtaacaaccaagttgcttgattattggcaatcgtgccatctttagctagccctgatagggtagctgcaaatgaatcccccaatgggtctacagcagtccgtatattggccgtaatcttagcattaagcttattatcaagctcagctaaaatcgcctgtaaatagcgattaagggcattggtgtacatgcctttgatttggtcgatattactttgttggtcaccttggccattcaaatagctatcaggaatgccaaaaactttagcaatttgcttactcgtccaatccgtttggcttaacagcttggtaacatcggctttcatttctagtggcttgtaatcttcaagttgatcaataactaccgggccaccgtttgatttgttcacctgtttcatgaagttacgtgagcggctggccttcatcttctcgcttaacagtccaccgtgctgaatagacagcactccaggagcgctaattgaacgtgctagtgcagccaacgttaaactgttagatgaactcttgacttgtaactcattcgataatgcttttaatggactgttgccagtcatgccaccatcggtactagcccagcgaatatgaatcatgtcagactgtggtacatattgaagaatgcccaagttaggttcatcaaaagtaaccgtataggttaagccgctgccgtcatctaataagtaggtttgtacttgactaggtcgtaaatattcccagcgcaaatctaagccattaggattacgccaacgatatgcaaagcattcaccacccaataacaattgtgaatacatagactgccaaaacgtgtgaccgtttgctgtcgtactagggttgtttaggattccttgtgctcgtggcatattagccattaattgtaccgttgctaagtctccagatatttggttaaccgctgaataaatatctgaattttctaaagcgtccttggcgctaacatactcattactaccagttggcgacaaaaaattaacaatattatcatcatctactggcacactttgaataccaatagaattatttattgccgttggtggctcaaaaaagggcattgttaatcatctcctttttgaccagctgtaataacttccgaaagccagccaactaaaaacaaagctacagcgattgctaggacgccttgtgcttgaccaaataaaaaggctgcatatactccggcaatcatacctagaataaagcacaacacatcaaagtaatgccagatagttgcaaaaaattgtttaaaaatcattcatatcatctcctagcaatcccgattccgggttattaaaccattcaagaacttgtttttcgttcatacgttcgacctgtttgtcaggattgtttacgtctgcaaagtcttcaaagtgatacatggcttgaaatagggcgtcaattaacgcatcgaccacatcaatcttcaatgtggctttagctttatcaacttgaataccaattttgtcttcataaatttcagcatttagtaatgccttttccatgattcgatcatccaagcggtctaccgatccttcaacaaacatcgtctgcaaaaacttagttggatccttcaattcactagttcgctgccgaatggcttgcaacggccaccctgagttcaaatctagctgcttgattgtaggcgttagtccccatgcgtcataaccaaagaaaacaacttccagtcgatgccgctcaacaaagttgagtaaccactgataaacttgctcatcattgattagcccttgaggatggctactaatcgtgcagaaacctttttgagccaaatcacgataattaataccgtcttgcttttctttagcttcaatcgaaccggctttctgccatggaataaagctgtgctgataaataaaccatcgtggcttgtcattattatcacgataaggaaatacaaacgctagcgccgtgttatcactaaacatcgaatagtcaaagccaatatagacttgccgatcatcaaaactaaatgatgatataatagctcgctcaacgtcaggcagtttcaagaagctgtcggctgattgctctagccacaagttgaggtttttattttggaaatcgttgagtgtgcccgacaaagcgtcagaatcacgcttatctgtcaagccattcagcaacacttcttgttggctcggtaaatctagtaagggattactcttaacccacatatcgggcttataagtttcgtccagattgtcctgtgaccaaataagccccaaatatgtatcagcatcacgcaaataatcttgttccatggcttgctgaatcatacgctcatcatcgtggaatggaacagtgggatcaggatatgccgttgaaatttgaataaattgcttattgcgcaccttaacttggcctgaaacaatcttagaaattttttgtcgtgtcttaatttcaccaatttcatcaaatatagcagttgtaaaatgaaaactatcgtactgaccagcctcatggctaatcgcccgtagcttgttattagtcttgctcatcacaacttggtccgcttgtgaagacaatgtccgagtatctagcccactatcagcaatcaatgacttaaatggctcaatagttgaaatcttggctaacattgatttaatgtagcctagaatcttgctcgtttgcttgtagttaattgatgaaactaaataatcttggttagatagtcccaatgactcaattaaataactataggcagtaataatcgccataagataagttttaccttggcctcgtgcaactgaaacaatagcccgtgaaaaacgcttgccaccgtcatcattacgccagccaattagcatagccataataaacttttgccatggcattagttttgtgggttcacctgtatcaacgttcggacagatggaagcaaatttaagcacttggtccactcgttttactgagtaagcgaacgggaatccaacgctaccttgccgttgcaaatctcgaatatggcggaaggctgctaacttaattaaataaccagcagtcaccttctcatcaagaacttcaaaggcatattttgtgcctgggtcagtgtattgctggcgaacttctgaacagtctaatgattgataagttccaataacatcatgggtttgagttaaatcaatgcgcaaattaatcaccccctttgagaaacagtctttttttatcatcctagaaattctttcatacgatcactaatacttcgctcgtctttatggtcatctaagtttaatttaagcaaatcactacgtgacttaggagacagtcccaattcagcgcctaaatttgttagattttttacggctgaatcataaatttgcgtcatgggattacgcttgtagcctacgaagtcccgaccaatttttttaccggtctgatcttgcaacgttttatagattgcttggacttcaccgttttcctgaatatgtttatacgcattgcgataaatctcgtattgggaagcatattgctctacaagtccgctatcaatgcgcttaactggagtattatcttctaaaaaaggcactaatcgacgccaaacgaccttagcttgccgtcctaagtaagctggcggtgtgcgtgataattgaccatcgttgacgtctttatcaacttttttcattttatatgtctcctttcatcattttggtgaccccccctacctaaaaaattcaaaaattgtttctatcacaaaatgacggcaatgtgtgtgctcttttttggacgtgttagggggcgggggttgttttaattatcatcgtgactaactacattcataaatttaaagccgctcaaatcgaacgacaagtgccaataaatcaattgctcattaacacaacgattgctgatacatcattgattggcgttacgctttgcaactcgttgccttgaccagtgccatagtatgattgctcccagtccgtcttagcacgatgacaactcccacagattacagctaaattatcaatgttagctttcagtgtttcgtcaaactcaatcggtacaatatgatccacagtcttagcaggtttgatgacgccttgcactttgcagtaagcacataagtaatggtcacgctctaggacttgttgccttagatgtgaccattgccttgtccgatagaagctgtattgctgacgcttaccttcattacgataacgtgtaaccgtgttgtacttgtgcgtgtattgcttatcgttaccacgtgcccaacgttgccgactagccaagtactcagcttcatgctcatagtgctgctgacaatagtggtcagggaatgcaaccattgcatggcagttaggatagcggcatcttcttgtccttggcatgttgtttcctccgtttcctatccaaactaaaagcgccatgctgtttagcacgacgcttatccttgtaccacttatctagccgggaatcagcctgcacccattcaggcggctcgtacccatacttgctgtgaattggtcttgacacgattatcaccacttaatttagaaagctcttttatataattagatcataaatatcgccggtaggactcgaacctacattccattgtggcttaccaattagcccacagcgactaccagtctgtaatttggaggattacttcatgcacgtcaatcacatttggcatactaccaatttagcacgattatagaggctagttttctcacttttttccactatagatcatacaatcctaatctctttgcacactcattaacaaatgcgtttcttagttcatatgctcgtgccttaccaacactcaacaagttgttatctactaggccaaccagagtatatcttggatgatttcgaaaatacaattcagtaacaataacctccgtatcatgtcccacatcatctagacaatcgtcaatcacttcccgttgatgtttcaaggcattaatgcgccgatcatcatcaatcgtgataatcgtgttgagtgtcgtttccggatacttgtattgtgccttgccacctccgacattatcatcacgtggtacagttggataacgtaattcctgttcacgtttctcgatatacttgtcaatcttgggatagtcacgtagaatatcttcaacttttctaatcgtcgttcgtttcactaccaattcccctttcaaatattgtagtctagcagcgcacatgtttagggttgcctaaatatatcgtgtggtgtatattatagttgctttaattcctagcgccgtattctcctcaacagatacgacgcttttatatgttatactgacaacggtcattcgagtggtcctgtgactggtcgccttaacgggcggctttttgtttaccatcgcaatcactcaactccatttcgatgtcagtcatgcctgttcgccatccaaattattactgattcaataaacagcaatacaccaactgacgttattaaataccccaccaattgcaatatggaagaattccaaagaagttcaaatatctatttcatttgtcttcctccaccacatacccgtctagccacgcacgggcgaagacgtccgaatgcgttctaatccaattaccaacactaactcgccaaattcccaagtaagtagcatggaacacccatcctagcttataatcaccctttttagcttgcttaattatataagcgacattttcaggaattactggcaattcggcatatgtcttcttgaacacatcgtctgcaattgcccagtgctcgccattgacgccggttgcaatccaatatccattagaaacaagcatacttccttctagcgtttccagataccagccaccacgatacttaaatagtcccaattgatctgcgctttgttttgttccatcgaactgttctgccttgatagtggctgttttacgataaaatttaatcatttctccgccatctccttgactagtttcattccaagatacttttcttgtggtaaggaacagtcataattgacgtattctgacccttttctctgaaatgtttcgcgtcttttcgtgcgtttttcctgttggaatagacagccgccacatcaccattaatcatcaatatataagccattttcaatcctccccgaacgcttcaaacgcccgcttgcgttcctcgttagttggttccttgacgattatcatgctgtgatttcatcgctttctcggtatgttgcttcatgcgccggtgcttccgtttaatcgttgaacgcttcttagtgtgtttaggcataactcacaatccttccggtacgcgctctttaatgtacgtgtcaaactgtcgttcaatttcatgactctttctggctaactgatccactgttttaatgtgttcactgccagtccggattaaatacccacgaagccagtgcaatgcgtcctcgacgtttttacagtgtgctaggggtacttctaccagccgattaataccagacttttcatcgtagctagttaccggatgcccatggctgtctaatgacatcctgttaaccttaacttcgtatttgtcactagtcagatgatactggtcaattttcatatcaatcatgtttattcgtcctccgtaatgtagtatttgttttcgtcaatcgcgcgaatacgtctatccagccaactgttctctgttgtaattgatttggtgtatgtcttcatggtgatgtactcctactcaaattcgattgctggtatgttcaggtgctcaatcaagccaaggcgttccaaccgctcatagttgagacgctcgcagtataaatctgcttcgtactgagacctgaattccttgattacggtttcaccattgcggcccacaatcttgaatttaatttttttatcaatcctatccagttggctcatttcttcaaaatgtttaggcatcttcgtcctccgtaatgtagtatttgttttcgtcaatcgcacgaatacgcctatccagccaaacgttattgtgctttagctcccgagacgtcctagttttaacctgcttgccttccatgactaatttaatggcattatactgggtacgcgtaatttccatgtaatcgcccgatacggccttaattctgagcatcttatgcaggttagctagtttgctctcaggcacgttaaccatgctgccatatctcgcttctagcttatgaatgacttccagctctttaagccaatttttgcttgccataggctaacttcctttcaagctcctgttcgtaatgatcatgtatctcattcgtacaattagggcacggtccaaacgtgaagccataactcccaagtggttgctgaacaactttactaccatgacataattcacaactcatacacttctgaccccttccatattgtcaaacagcaattgacagctagtatccttggtatataagcgatcgattgttttgccatcatacatactttctaattgcttacgtgtgttgttagtcgtaatgatggttatatgtttgacttcgttatgatcaaaatcgcaacgcgcattcgccacctgatacatcagcgtctgcaaatctttgtgtaccggcttgtagaaccctttttcagttggcttaccgccttcagtaccaaaatcgtctaaaactagaatatcaacgttttgcatgtcttttagaatgtatagtaaacgttgacgtacatccggtgcttcatacttttcattaaccagccgtagcaactcagctgttgagacaaacatcgctgtctgccctacgctcattagctgatacataattgctagcgctaatgatgttttaccaacgccgggtccacctgcaagcgctacgttgaactggttagtctctaattgcctagctaacttaaatgcctgattgccaagctctctagctttagcttgattaggctgtttatcaacctgccaatcattaaagctaaatcgtagtggcacgcctccagaccagactgacatgcgatagtaataccgttttcggttagcaaccacaccagcgttcgctctatcaatcgtctaatgatccaattcttctttggttggcaacttagttgtatcaattcctctagccgccactactttctgaatcgtggcttgattgaataacttcgttacattttccattagccaaaccagtcctctcgtgtttgtggcgctactttgttgctttggttactttgctgatctctcttagcccaattacgaatggtagccaagtaatctttgtagtgtttaccactagattgaacatacccagagactcgctcaatacggtcttgccagtcagaagtaaactccgattttagtttctccaattgttcatccgtcagtaagacattctggtattgtccatatttgtgtcgtactggtttggctttttttggcttgggattatctggttctatatacttacctttactaaccttacctaacctatccttacctaacctaacctcggtatgacaattgcctaccaagtgtccgtcatttggttgactgttggttgacgtgtgactaccaaaaggcaatttgctataactagcgtcttcgtttagctctaattgtttaagctcactagtatatttcgtggggtgcttacgatctgatcggatgtaattatgaatatgccaatctttaatcacagtgacgccattctcaaacggaataaggtactgcttggctaacaaaattttcaaatcatcatcacttgaaccagtcatccgcataatggattttgtattgcccacaaacccgtcatcatcagcatgcatattcaaatgaaaatatagtagctgagctgacttaggcatatccataaacaaatcagaatccgtgatcgtattactaaacattctcctttgtgccatctcttaatcctcccttatttactagtaggcattctacccacccggtgtattagtcactgctgtgttttttagttcaagccaattcgttttagtgtttctaaatcacatttcaacactatattcaattaatcccagcttttttaaatgtttcatagcacgtgaaaagtcattaatgctaatgctgttttgacttagcaatttgtatgtgtcacattttccaagtgacagttcgccaattatctgaatagtcttcaaatcattttggcaaagcaaccatttttcatatagtgagtttatgtttttactaagatgaccaatgtctgtaaagtttacgctgattctgtatccatttttaatcattatttcagccccctattaaacatccatgaattcaagcaaaacgccattgccatattactttcgattagacacaattctggagttaattcttgtggatcgattaatgcaatccgtgtaataccatgaagaatacaatcctgttgttctttgtaaggtaatggattatccataactactgtcctcgctttcttagcacttgcaaacatttcgagttagcgttaatatatacgcacaccttgaattgttttctttctccctactcttgtaattcactccagtagggagtatttttgtcttttagcttgcaaacgagactgctttggaataaagtaaatgttggtactaatcatctcttccattagtccatcgttagccgctactagcgatggctttttttgcgctcgtttccactcgtggagtggtaaaattgatactttttgcatgatcattcctcctacttaattacttgaataccattagtaatgatttcaaattgctggccattctcttttactacagctacatctttttttgtacgcaacgtgaacggaattgacttgatttcaactactctgccaacaccggcttctcttatcagctgaccacaactatattcagccttgtaactcactcgatcacctacatgaactttcatggttattcctcctaatacattggtggcaatgtaaacgtccagttctcatcagaatttccatctggctcgcaaacattaatatcgtgttcttgcaattcgccaataaattcttctgaatagccaaagcatgggcgccgcttaatgattccatccgtatcgtaagtgatagcattaatcagctcacgttcatctgcacgaatcgcgttatacttacgtgctcttaacgcgtgctcaatgtcttctccatacatatcgtttcctcctaaattccaaaccagtttctaatctctcggcgcttgtaccatacggatgttagcgcccaggttaataccgctacttctaccatggcaattcctccttatgagttgaatcatcatctacccgcctaggctttaattactcaaattttgatgattcaataaccatttttcgactgctggggcgtaccactttccgtcttcttctggctttgggaacccttctttgtcgcgatagtgcttgtcgaatgtatcaactttgattccaaactcagagtagaaatctttacgtccaatcattttatgatcaacagcttgttgactacgcccatccgcgattccttgttcatatgcttgcgtgaaaagcttcgacaaagcacttattaaactgtccatcctggtcattcctttcggtgtataattttgttagtccaattaatcgaggtgacaaatatggaaagctctcattgcgaacatgaaatggcactatatgccgctcaagccatgaccatttcagatattgctgaagaaaaagataaggctaaatctcatcactatacgtacgatgctcgattaggaatcgaaatattcgaagataactataagcatgccctcgaacattattcgggacgctttcccgattaattaaccttttcttcttcctgtttggcttcaagatctgattggatagcgcctattagctgaaaggcctccttatacgacagatcattgctaaacaggattttttctatttctgatttggcctttgaaaacctatcagattttaaaaatgctcgcgtgtcccatttactcatatttgcttcacctcctatgctggcttagttgtatacttgacttattccaatttaatcgaggcgataaatcatgaatttaaaacaagccgctatatttgaatacagtttcaataagttactccatagcttaaataaagacggaagccaaaaatgtgtttggtatttcaatggtgaactctttactgcatctttttacaaatccaatccgtttaaagatggcaagacgttctttgcctataacgaaattttttcgaaacactttttcaataacgatcaatttaatgaccaaaaggtatctcaatttaacaacttaccgttatttttaaatgaccttaaagcctttgtctcttccaacctagttgacgaagacgatctggccgatagtctctttttgagaaacgtttcctttttccgaaaagaattaggtgatttagatttttatcttttcccagaagacacccaaatcgaaattgtttcgactatttcatccgaaacttcggatcaaaatgtttgatgtattccaatacactttgaagttcagcacttagttgctgagctttttttattgcagttttcagatcttcaccattttctaacactaatgtgattccaggttcttcttggtctgctgagaaagctttgtcatactttctaacgcccaacattttttcttcatctttcatgttccaatcctcctatgctggctgttcatttaagtaaaggtcgctcataccaagcatgtccgctgcttgtgttaaagcgtcgtagttcgtcgcttgaacttcactaactgtacttggctcccacttaccaccgttaacccgagatttaaggttagggttcaacatcgtatcgttatactcaagcaagaatttcagcgcttcacgtacattttcaaattccattgttttacctcctatgctggctccttgtcgaatcgaagtgacgtctgtcgaatgattgtcttagttgctgtagatggctcccagtcgttgatgaagtccattaccatctggtagtccttcttgcgtagcattgaccgagcactcacgttagcaatcttcttgattccactgccgatatctttgaacagctcgcctcgttgtttctgtgtgatatggccatagctatgtgcgacttccgacacgcgctggttaacacgccggttaagcgcactatattcaggattaggaataacttggttctccttgaggtctttcacatcgccctccacgctatccagtcgttgattagtttcctcattggcttgcagtgccaatctcgcaatctctcgtggggacgttggcagtgcaaactgtttcgggttgaagtagttttcttccagctcatcaaacatgtcccaagcttgatcagttccaagcatttttgaatgccggctagcaccacgctttgtccaaagatataaagaactaacatgttcattaaccaaaccgctttttgcgtattggtctttaaactgcttcaacaaatcgtttgcaaccaaatagaaatgctttccttcgatgaatttgtctttattccttttaaaattctcttggattcttcgcgatgttgttccatagaactcagctagctgttcagtggttaaaattagatctccgttaaatttaacttgttgtacttcttgcatgtgggtcattcctttctatgctggttgtttgtagtccattggcgtaaacaaaaacttgatttcatattcaggaaaaaatttttcttgaatttttaaagcttctgtaaatttgaacgaagacttaccatttattttgtcagccactgtctggtatctaacgttcaacagatcggcaatatctactaaagaaacgtttttttcttttctgacattgttaagattattcaacatattttccttcctttctaagtacgaaaattcgtatcttttaataaaaaaaataaatgtcctccttgaacatgacctaataatatacgaattttcgtatcaagtcaatacaaaaattcgtatttttctaaataattttatatacatacgatttttcgcatggtacaatagacacatattaagggagtgaattgatttgaacaaagaagaatatttaaaagatttaattgaaatcaaatacggcaacgttaaatctttttcggaacatgccggattgaaatacaccaccgttcgttcaattctggaacgtggggtgttaaacgctaaagtagaaaacgttataaaaatttgtgatgccttaggcataaagccagaagacattttagaagtagaagattccattattaatgataccaataaaaagatgattcaattaagctctgatcgtcagcaaaatgtttacaactacgctaacaatcagttgaaagaacaaaatggtaaagtcgttaacttgccactcgttggtaagtcagccgctaaccctactgaattgacttatggcgatgtagaaatcgaacatgatgacttcacccacgtaccgcacggggcagacacagccatccgtatacaaggcgattcgatggagccacttattcacgatggtcaaattatcttctaccatcagcaagaagaagttgagaatggtgaaattgctatcgttgaaattgatggagacggtgttacttgtaagcaaatttactacgactacacttccgatgaagtcatcttacgatcaattaacaaaaaatacgaaccacgtcatgttaaagatgaccaggtacgtattataggcagagttatattataggagcttattgctcctatacttatgcgttaaaaagaacacacgttctacatatttagcggtattatacttacataagaccagatacggatgtcgctaaaagctggggaatttggaggaatgtaatatgtcaaaatgcgtgatttgtaaaaataagattggcttttttgcaaagtattttaccgtcgatactggagaaaaagtatgtaaaaattgcctttcaagttctgaaccagaaatattaatcgaaaatctttcctctgcggcggacgtagcttttcatatggataattctgttggcgatgcttatttatcatctattggcgaaaagtctttgtcagattctcgtagagagaacgaggaagctaataagaagcgtctccaacaagaactagaccaaaaacgtcatctcgaagaacttgctaaaaagagaaaagaggatgccgataaagctgcacgacaagaaatatttcattttaaagtacgcggtaccacccactatgacctagcaaaaatggtctcttacgcacgtaaaaatgacttgtttgatccttacgatggatataccgatgcagacatcaaagaattctcaccttacgaagaagtgtatgaaacagaccttgtaggattgataagtgcgatagaatttagaacagaccccaataataaatatgataaaaatgcaatcaaggtcattgctacgcttgatgatggcgaatatatgttaggacatgttcctgccggaagcactaaagatataagtgaaataatgacgaagcaaaataatggaagcatcgcgctaaaaataaactacacactaactggtggtaaatataagattgctgaggaaaaagaagaagaattcaattttgacgaagattgggacgttgagaaggaaatacagcaagaggaaaacgaaacagatttcaccaaaaaccttagaattaagtctggaaagaaagagtatggtttcaatatccaattatttgataataacattcaatgacggaggtttcgtaaatgggactactaataatgatcgtcatctttctagcactatggaagatattaggaacactaggacacatctttttaccaatattggccgtgttatttatcctggcaacctggattccttcacaagcaatcgttatggtgatttgggtgccaatcgcgatattatattttatcggcttggccgggtataaacatgctaagtagaactagtataaatatattttaatcggggtaaaagctatggaattgtatgtaggaacgtacagcacacacgtgttcgactttaccattgcaattggcatcatttgcttcatagcgctagtcgtcatgttagtttactggacccgcaagcgaaagtagcaccctcgcccactaccagcctagcgggcaacatgcgagcgtagttcaacggtagaacggtactcctttgagttgctgactagatactaacagatacaggttcgactcctgccgctcgcattaaaataaagaaagaaggcaatactatgcatcaagatatttcaaggtacgaactaatagaagatattatcagtgacttaacagcctttgtaaaatatgacgccattctctacctatcaaaagatagctattccgaagcagaatacgaccgtatgcttaaaggaattaaagacgatttggtgacacgcttcaagcaaggaaaggaatagtaaaattttgccagtcaagccaattgaatcatttcagttggcatcttgcgagcgtagttcagcggtagaaccttattccaagtcttgaagcccattctttcttggagtactatgcaggtccgactcctgccgctcgcgttgtaacaaaaaagcacatcccctcccgccaagaagatggatgtgctaccaataaaaaccagtggattgctccgctctttttacatacataatattatcacaactaaggaggtgatgcctacaagtccttaaaattctacccgcctaggtgaaatttaaggaggaaattaaaatggcgagtattaaaaagaaaaatggcaaatgggctgttcgtgttagttactatgatgagtttggcaaacggcactttaaaaataagagtggcttttctcgtaaaaaagaggctgaacagtgggcgactaaattggaacaagctaagtttgaccaatccatagggaaaactgacacaacgacagtctttgcagattactacgagaaatggttagaaacctataaatttggcaaagtagcacgaattacagagcaagaatatcgatatactcttcgtcaaattgtggagctactacccaatattaaactatcgtcaatgaccaggttacgttatcaacaatttattaatgaatttgtgcacggtaatactaagcagcgtgcacagcgacaactggcagatgatcaaccatatcacagcaaatcatctgttgaaaaattgcatggccacattcatgctgcaattatcgatgctgtagccgataatttaataaagactgatttctgtttgcatgttgaattaggtggccacgctggtaaatctgcgcaactaaaataccttgacgcaaaagacatgcaaacgctagctatcgaagtcaataaaaacatcaagctaatttctactggaaaatcaatgatctatactggcctactaactggtatgcgagtagccgaagtttctgctctgacttggactgatatcgattggcaaaataagactatccgtgttaataagtcatgggattatgtttatggccaaaaatttaagaaaacaaaaactgaatctagtattcgtacaataactgtaactgacgatcttttaaatcatcttaaaacactgcatgctttacagatggcagctaaattggataacccagatcatctagttttcatgaacaagcgtggtcgtattccatcccctggagcgtgtgataacttgcttaaaaaatattccgattcattgggaattaaacggattagttttcacgggttgcggcacacccatgctagttacctgctctattgtggcgtgaagatggaatacatttccaaacggttgggccataagaacagttccatcactcgtaatgtctacgctcatatgattaaagaagaccaacaacaggaagacgaacggaccttaaaagcactctctcaggtcaattaatatggtgcacttttggtgcactcaccaaaaatgatgacgccaaaaggcttgatatcaatgatacggtagtacactcgaaagtctgtactctccttattaaaatagtagagaccagccagtaaaaacaagaatcccaacaagcattgatttgtcgggattcttgttttttatataattcaaatcaaacaagtcaatatcaacatggtttgctacctactatactgtttggaaatggtatggatactactattacaaaataggttttagacttgagctactcttgcctgctccaaaattttggcactcaatatcaacgctttcttgaaccacctagaggttttctatactattggtttagtaacatgttctaaagctgcttctttaattgttgaatgccaattcaaattcattcacatcaatgccttattaaacatcggcacttgaaataatcataatgatcaacaacatcaatcaagtaataccattccccactaatccacaaaaaatatccgtcagcccttgccaacggatacccaattacttctgttcacgtgcggcttgaccaaaaacaaagaacgaaccaagaatacccacgcatgatagtaaaaataaaatgccatagcacagtacatcccccactgtcactaaagtcttcggaaaaccggcagttgagacccatagaaaaatcacgcttaaccaaaaccaaaatgaacgataaaaccgaaccggtcgacgtatccgcatgacgctcccccctaactcgtgattccaatgaaataaccgattggaataacgcctattataggcagtgcgcaattaggtacaagctctgaatactcaaatccgacgtttaagttacaattcataaccgattacgtttgttaagtgccaatccgattaatatgccccctcgcaacctcaatcacgacgagccagtttacgagcgataatcataaatcggtcttcaaacgtcgtgacgcgaccattaatggccagtaaggattgtaactgatgtaatttgggaagcatccgtgccacgtcaaaattcggaaactcccatggaatcaccgtggtataatagacaattgcgccaatatccgtaaaactcagtgccgcgtaggcttgctcagcccgcagaatttcaaatcccgcagcctgcatttgagccattaccgtcaacaactgattgtcaggatacgccggttcgtaatgctcatcaaagaatcgtgacaacgcataattattggtcgcaccaacttgctgaatcacaagtcggccccccagctttaaaacttccgcaattcgcttcactggcatcgcaccatgactattcgttacaatatcaaatgtcgaatttggtacggccgtcaactgttcggcggcatctggatataatgttatcccctttttaaccaccgtttgcttcaacaactcaatatttggttgccacccctcagtcaccgcagtcagcgctggctgatggttaaaacgccccatcaattcaccaccgcccgtatcaatatccaaccaccgatcatcggcacttagatgctcacgaactagggcagcgtaatcccacggtaagtccgcagtctgccaccggccagccagatgactaaagtcccagccgtgcatggattgctgcgcttcttcaaaccaactgctttctaaagctgtcatattttgcctccttcgtttcctataaaccagaccacccatcaaagtctccgctggcctatttcaatacgaattatgctatgattacaatatctttaaaaggaggttcagtcaatgacacaattactggtcacaaccactgaaaatattccggggcacccctatgaagttatcggtgaagtctttgggctaaccactcaatctaagaatctggtccgtaacattggggcgggcttaaagggcctagttggcggcgaaatcaaggattacaccaagatgctcgaagaatcgcgcgatgtcgcggtcaatcggttgcgcgataatgcaagtgccatgggtgcggatgccgttgtgatgatgcggttcgacaccggctccattagtcaggatatgcaatcggttgccgcatatggtaccgcagttcgttttatcaccgaagacttgaccactgacaatgcttaactgattcgagactaacgaaaccgcctgccggtaatctgggcaagcggtttttagcatggtggcagctgtttgtataacacaattataattttcgtcaccggcgaatgaacagacaaccaccacaagctaacagtaatcccatggccgtcaaataagccgcttctgggctcacgatattatccaacaagaccaatccaacactgccgattggaatcgaaatcgtcgccaatgaatttatgatgccgcctaaactcccaacgatactttgatcggccactttcaataaactcgccatcaatttaggatttgcttgccccatacaaaatcccccaatcatcatgattgtaaccactatccaatagttttgccaaaacaacagattaataaataaaccctcaaacgccacgacggtagttaacatgacaccacgaaacgtccacctctgaaagtaacctgtatgtaacaaattccctgcaaccgatccaaatacgtcagcagtattcatcacaagaattgcgactccgaatgaaagtggtaactgcgtcgcccggtgaatcaggtataaattcaatagtgcatcgacgcttgcacctaccgcattcaagaacaagacgctccccaatagcgccaagacgttcatgtgcacccccgcttccattgcttgtcgtagcagttgacgaaatgtcgacgtcacggtgacagttgcggaaggtaattttagcgtttcatacccgaacagtagcaccagaccggcaatcaagaacgtgattgcattcaaatatcccgcgagacgataatcgcccgttgcggccaatagactgacacccaacgcttggcctatcgtctgcattaacactccgataccttggttgatccctaaggcctcttcttgtaactcagacgcgactttagcttgtaataatggcattcggaggctgccgctcaacatccccaacacgtctgaacacaaattgatgacaataataatcaacagcaacccgacctgtttttcagtaataagttgcgctaacacgagatataatgccgcttgaacaaatttcaaacctgctaaccacccccgcttattggtttgcgagtctgccaatcgaccagtaagcataccaaaaataccaggaagcacagtagccaccgaaactagcgaaaccatcaaatttgcttgtgcaaacgttcgcgcgtacgttaatagaataatgttaaataggctggtaccaattgtctcaaaaagatcagctactgttaacgtgacaaacgctcgattacggcctagatttttcataacgccacttccaatttaatattatttattgcttaaataaatttaaatgataaagcaactttaatcgtttgatttctatttgtcaaatggttaagctagtattgaggtgaaaaacatgtccaaaaacacactggctcagtttgcaaagttaatggccgatcccaaggtggccgctatcttaaaggccaccaaatctaaaactggtttaacaactaagcaaatttcggcccaaactaaaattcccaacaatcagttgtactacaccatcaacaaaatgcaggatgccgacttattaaccatcgttaatcaagttcaggttaaaaatctaactgaaaactactattccagtgcccacctctcccatgagacgccacacgatcttgatggtctcgatactgatctgactgacatctccggtacgtggactcaagcccatgtccaacaagttttacaatggatcatgctattgaaccacgactttaccgaagcctaccaggaagagatgacccgcaagcaacctgacaagtcagccatttttttcagtaacgcgatcctaaacctttcagcggtaggcgagcaccagttgcgcttagatttgatcaaattgcttggcgatgctgaaaagaatgatcctgatcctcagtcaacggacaagcgtcaggttaaactactcattgaaaagtggcaataattagaatatgcaattgttagtctttttggcttggctaccaaagaatcactgactatccaagctaactaacgaccaaaacaagggttagcaaaaaagctccgaatgactaataaatcgtcattcggagcttttaatattggctttaaaattgcatcaagctcaacatatcataatctttaatcttatcgcggccgtgcaactctttgagttcgaccaagaaagccgtcccaaccacgttaccgcctaattcttcaaccatttgaatcgttgctgagatggtcccaccagttgctaataaatcatcagtaactagcacattttgtcccggcttaattgcatctttatgcaaataaagtgcagactgcccgtattccaaatcataagtcgctttgaccgtttcgcgtggtaacttacccttcttacgagcaggtgcaaaaccaacgcctaattcataggccactggacaacccacgataaagccgcgcgcttcaggcccgacaatcatatcaacatgtttatcacgcgcaaattgcacaatctgatcagtcgcttcacggtaagcttccccgtcagccatcagtggtgaaatatcgcgaaaaatgattccaggttcgggatagtccggaatactagccacatacttttttaaatctaatgccatttgttcttaacagctccttcaattcttaaccgcagcctggttcttcacccatacttggagcgctgcagatttactatataaaagcgtttcttcagcaacgatttgttgttcgcgcagctgataactaggggcgtgatgtaaatccgcttttgccggattcgaaacgccattcatgacaccatcatttattttaacaaatccgacctcaaaaaacacctgaatcatgaaaataagcaaatttcgttcaatatgcagatgcttggccactaatgttaattgatgatgaatatcaacatcatggtgcgctgcggtaaactggaaaagtttcgcaaactgcgcgcgatttggcattcccgttaaataaaccgattcttgccgatataagtagagcgtcagctgatcgagcgcaattgtgctgagtacctgggtcatatccgccagcgtgtcaggacaatcgacaatgaagaccgcttgattagccgtcacggcagtcagatccattttcgtatcccccacccatacggcttgcgcttgggaacctaaatactgttcaacttttttcaacagacgctggtggaaaaagaggtaaacccccggtgcttgaaacaaatgggccgaaagatgttgcgtccgggcgtcgatcacctgggtccccgtcactgcaatatccttaaccatgatttggggcttcgtctgaccgttccaagtattttcactcaactcacccactaacgtcacatcggtgggactcgcctgaatagccggcaaggcagtacccatcgaaaaaccgatagcatcaatcgtattggtgccatcacccagttgtaatttcaagtgttgctgatcactaccgatcgcgcgtgcttgcggaacagtcgttggaactaattcaaacaacggtgccgggttatccgttccaaagggggccaacgcttgaatatctgccagagttgccaaggttgcctcagctaatggtaacgtgccgtcaattggtaaactgacttgcgcattatctgctaattgctgactaaccgccgccgcttccatcgcctctttaagcgttgctaactggtcggccatgacagttagtccaaccgccatatgatgaccgccaaaagccaccaatgactcccgaactgggtcgattgcggcaaataaattatacgcttcgacgctccgaccactacctttgagccggccatcatcatcctcatttaacactagggttggtttgccagtcgtttcgaccacgtggctcgcgacgattcccaaaacaccctcgtgccaaccatgcccggtaataactaaggtttggcgggcctcattttccggcgtctgtgcttgctcgattgcactggcactgattgtcttgaccaagccttggcgtttttcattcaattgattgacctgcttggccagcgcggtcgcccgctcatcgtccaaagttgtcaataattctacaccgctctgcgccgactgcagacggccaagtgcgtttagccgaggggcaataccaaacccgatattggtctcggtcaatttatcgggaatcagtccggcttcttgaatcagtgctgccaagcctgggcgggtcgtctgctgtaagaccttcaggccgagcgttaccaaagtccgattttcaccagttaagctgaccaaatcagcaaccgttccaatagcagccagatctaatagttcctcgggtacttcctcaagtagcgccgtcgctactttaaacgccacaccggcaccagaaagaccaccaaatggataactgccctctggatgtcgtggatggacaatggcgtaagcgtgcggcaattcagtcggtaactcatgatgatcggtcactacgacatcgatgccctgttcctgcacttgattgatgaccgcatttcccgcgacaccgttgtccaccgtcacaaacagcttcgttccagccgcaatcagccggtcaaaagcggcctgattaggaccataaccatccttgaaacgatctggaatatagtaattcacgttagcgccaatttggtccaacgtttcatacataattgacgtacttgttaaaccatctgcatcataatcaccgtaaatggtaatttgatccccggcaataatcgcctcttggatgcggtcaacggctttttccatatcgtgcatggtcgttgggtccaacaatggttgttgatccgcgtgcaggaatggggcggcttcttccgccgtattaatgccccgcattattaataaccgggcaactaagggggtcacgctggccgcctcagctaacttatcaacatcggcttcatcaacggccgttgttaaacgtggcacccactttttctttgccgctaacatggcatccttcctttcaacaacttacttatctgctggcgtggttggttgttctgccaccgctcgtttttgtttacctttattattcaaacgcaacgttaattgcttattttcggcagtcaacttgtcaatcttagcctgggccgctgctaaagcttcactatgggctgtccgttccttagattcattgaccgtcgccatcagtactgcggtaatgacacctaagatcaacgtcaccacaatgaccaaaatcagtggccaatgaactgctgtaattccaaaattgattcgaactggttctacgtttaaaattgcaaaaataatcactactagtgcaatgactagtgcactcactaaccgccattgattcttcattaaattcatcccctatttaaaattaaaaaccgtccccgtcagccaatccccgagcttgggtgccagctgataacctaaattagctgcagacatcacccaaggccgattcagttcgcgccgttgatgcccgagtttgcttacaatcaattcagcaaacttaacggggttcaatgccagctggtcgacccggtctaaatagtgccccgtgggatccgcaattttgaaaaagtccgttttaatgggacccggattgaccgtcaatacgttgacatgagcatccttgagttctaagcgcaacgcattatcataagcaataatggccgccttactagccgcataaacggctgatttaggtgttgcgattttgccagccatcgaggcgatgttgacaatttcacctgcatgttgcttgaccatccgttgcgcagccagttggctaacatacatggttcccaatgtattgacgcgcaacattttcgccatcaccggcgcatccatggtgatcaccgtggtcatatcgccaaaaccggcagcgttaatgaccacatccaattgaccaaatagctcatcgatggtcgtaaagacgtgatcaacgtccgccacgtgacccacgtcacaagtaatcgccacggcctgcccttttgataacagacgacattgatcagcaacctgtgttagccgttctcgccgccgggcggctaagacgacattggctccctgactcgccacagctagggctagttgctcgcctagtccactagacgcgccagtaaccaaaacagttttacccactaagttcgtcatttacttgacctaacctttctcaggtaatggaatatcaattacatcaaagtcacgaacgactttcgagtgactaaagactttctgtgcttgtttttgtagttccttactcaacttacccgtgtaccgagccgagatatgggtcaacaatagctgcttaacaccggcctgttgggccacctgggctgcttgggtactcgttgaatggtaatagttatgtgccaacttaccttcatcttttccgaacgtgctctcatgaactaaagcatccgcatcctgtgccaagctgaccgcgtgcggtgtccgccgagtatcaccgagaatcgtcaccgtccgccccttttgtggcgcagcgatgtaatcttgaccattaattgtccgaccatcaggcaacgtcaccgttttgccggcttttaattgaccatagacgggaccactcggaatgttcagggctttgagtcgatcggcttgtaattcacccgggtggtccgcttcttctacccggtaaccaaaacaagcgatccgatgatccagaggttcgcagcttactttgaacgtcgtatcttcaaaaactgtctcagctttcgtgatttcatgaaacttcaatggatatgacaaatgggtgccagagacccgcaacgccgtttgaacgaagtcgcggacaccgactggcccataaatggtgagtggttcgtccccgccttgaaaagaacgcgagctcaataaccccggcaagccaaagatatggtcgccatgcagatgggtaataaatatttttgcaattttgcgtggttttaacgtcgtgcgtaaaatctggtgttgcgtcccttcgccgacatcgaacaaccagacttcatttcgctcatctaatagtcgtaatgctgtgctagtgacattccgaaatttgcccggtgagccggcaccggtacctaaaaattctaattgcatatttttgttcgtcctatctatacagtctgctaactattttaccgaatctagcggcaatacacaattgttagcactgcaaagtcatggccggtcaacaccgtgcgctcaccgaccgcaattctaaaaagcaagcgacgttgggcgactcctcacaattaacaggaagaacacgaacaacgctgctcattttattttaacatgtcaggctaaaattatcgcacttggtttcaagattccacgtgccaagactgcctgccaccggtgttatctataatcaaaaaatgcacttttccgggcaaactgactatgacgggttgtgaccgttttcattcaacccgtcatcgccggcaaatgaatcctcagtccatcttgcttaacccaattgattatcgtatacttgcttacaaatcgtctgaacaagaggtaaccgttatgcgactcatcgactttaacttatcaaccgctgatctacagcaaactttaccactgtattgggaactaacgactaatcaaatctggccaatccaaagtgttacgctcgtcgatcaccagctggttttagtagcttcaaaaagcgcgctcccgctgacactcgaccagttcaatgcgcggacgcgccaaatcgatggtcaaacgcagctctgtattcaaaccccaccgcgcccgcgccgattatttggctatcgcttaagccagcagcgcttactgtttggctgagcatctaatcgcacgtcagctcaaaaacagcgtcgttagttaaaattctaacggcgctgtttttggattgttcattattttatcactagtccacctatcagactgtcgtaacgacaatcatcaactaattatgtcgtcacaaaagtttagtccataaactggaaggagtagtccaagatttgaatcgtatcatcattcttggcaccagctgcacgtaaggcatcatcaacacccatcccacgtaattgtcgagcaaagcgcattaaactttcttcatgatctaaattggtcatcttaaagagccgttctagcttatcaccagacaagacgaacaagcccggttctggattatcaatgctaaagtctgcatccgcttcagtcgtgtaatcacggtgcttcaagtcgtcaacacccttgattgggaattgtggcgtcgtatccaataaatcagccgtcttggctaacaaggcttttagtccctgttgtgtaatcgacgataccggatagacggctggcgtgtttggcaacgtatcatccgtcgctaacttcgccttaaagtcttccagattagcttcggcatccggcatatccatcttagtcgccaccacgatttggggccgcttcaagaggtcaggatcataactcgtcagctcgtgattaattttgtgataatcctcaaacggatcgttttcttctacaccactcatatcaatcagatgtaaaataacgcgcgtccgttcaatatgccgcaagaattgaatccctaagccgaccccgttagccgcaccttcaatcaaaccaggtaaatcagccatgacaaagtcacgaccgtcatccaaacgaaccatcccgagattaggcactaaagttgtgaagtgataggccgcaatcttgggcttagcactcgtgaccactgaaagcagtgtcgacttgccaactgaaggaaaaccaaccagaccaacatcggccaagactttcaattccattcgaatcgttaattcatcgccgggctcaccattttcagcaatttcaggagcagggttcttagcgctagcaaaatgaatatttccccgaccgccccggccacccttggcaaccactaaccgctgatctttattgacgatatcgccaattaactcaccagtttcagcatccgtcaccgttgtcccaagtggtactttgataattgtgtccttcgcggaacgacctgtcatctgcttaatcattccattgccaccagctgcggctttgaacttccgcgtataacgaaaatccatcagtgtccgtaatccttcgtcagcctgcaatacgacgcttccgccgcgaccaccatcaccgccagcgggaccaccattgggaacaaacttttcacggcggaaagcaaccatgccgttaccaccgttaccggcctttacatctacttttacttgatcaacaaacatgttcttttctcccgtttcttctatattattatctacgaaatccgatcgtgcgaaattagatacctgacctagtatacaaatcttcggccacttcgtcaaaagttccacgcctaattagacagatcatctttatttggatgctaatgacgatttgatgacaggttttggattattttgacggtttttgaaggtttttgttgcattttgacgtttaaacaggtatattattatgcggagggatttgaaagtgcttacagaagaacgtcaacagtacattttaaatacgatccgtttcaagggcattattaaaatcaaggacatctgttctgaaactcgttgttccgagtccacggcgcgccgtgacctccaacagctagaagaacagggcgagttactccgcgtgcacggtggtgcgaagtatatgaactcactccaagaggaacccgcgatgaatgataaggtttcccgtaacgttaacgccaaggaccatatcgcgcagcaagccgttgcgaacattcaagttgatgacgtcatttatttggatgctgggacttcaaccctagccatgattcaccatttaaatccgagctacaacttacgtgtcgtgactaatggtgttgtccatgcttccgctttggcagacatgggcatccaaacctacctgcttggtggcaatttgaaaggcaccaccaaagccgtgattggtcccgaagccgttaaatcgttagaggaataccgattcaacaaagtttttcttggtatcaacggtgtccacccaaaattcgggctcacaacgcccgaccccgatgaagcggtcgtcaaaaaaaccgcaattctacaaagtgaagaaagctttatcttagctgacaacactaagttcgaccacgtttcgtttgcgcgcgtcggtgatttatccagtgcaaccatcatcactgaccaactcacgccaagcgttgccgaacagtatcaaccattaactacgattcaggaggttcaatcatgatttataccattactgtcaatccatcaattgactacgtggtgcaactaccccaaatgaccctcggtagtgttaaccggttagcacacacggcgaaactccctggcggtaaaggcatcaatgtatcgcagattctgaacgacctagaccaacccaacaaggccctcggctttatcggtgggtttaccggcacgtttatcagtgatgctttaaaagccaagggcctagattgtcacttcacaccgattgccgatgacacccggatcaacgtgaagattcacgctgaagaagagaccgaattaaacggtgctggcccggacatcaccgccaaagaaacagaagccttctacaccgaattggccaatttaacgccgaatgacgtggtcgtcatgtctggtagtttagcgcctagtttaccagatagcttctactacgatattattcagaaggtcgaagctgctggtgctaactttgtcatcgacacgaccggtgaagctttgaagaaaactttacccagccaccccctcgttgtgaagcctaataaccacgaacttgctgattactaccacacgacgtttaatagccaggctgatatcattgcagcgggccaacggatgctagctgaaggtgcacaacacgtgctgatttcaatggccggcgatggtggcctcctaatcaccaaggatgcggtctactttagtcccgcaccaaagggccaggtaatcaactcagttggtgccggtgattcaatgattggtggctttgtcggcacgttcgccaaaacacacgatgctgttgaaagcttccgctacggcttagcttgtggctccgcaaccgccttctcagaagacattgcgacccgcgccaagatcgatgaaattttgccactcattaacattgaaaaactcgctcactaaagaaaggactgttaactaaacatggatatccgcgatttattactaaaagatgtcatgatcatggacatgcacgccacgaccaaggacgaagcgattgatgagttagttcataaatatgccgaacaaggtatcatcaatgatgaggccctctacaagcaagacatcatcaaacgggaagccgaatcaactaccgggattggcgacgggattgctatgccccatgccaaagataaggctgttaaccgggcaaccgtgatgtttgctaagagtaaggccggcgttgacttcaacgcgttagatggtcaacccgttcatcttttcttcatgattgctgctcctgaaggtgccaacaacacccatttagccgccctcgccgccctctcaagcttattgattgatcctgaattggtcgctaaacttaagaatgcacagtcacctgaagaagttcaacaactcttcggtgatgcccaggctgctaaggaagaaaaggaagccaaagatgcagctgccaaggccgaaaaagaagccgcagctgccagcaccaccactgacgaaaaacgtccctatttagttggggttaccgcctgtccaaacggaatcgcccatacttacatggccgaagcagccttgatcaaagccggtgaagcggccggtgttgacatcaaaatcgaaacgaatggttctgaaggtgttaagcacttattgactgccgatgaaatcgctcgtgccgacggtgttgtgatcgccgctgacaaaaaggtcaagatggcccgttttgatggtaagcacctggttaaccgtcccgttactgacgggatcaacaaggccgatcaattagttcaagaagccttgagcggtaaagctcctgtctatcacgatgctgatggtggtgctgcagatgacgatgaaggtggcagcgctaatggtagtgtttggggtgaagtttacaaagacctcatgaacggaatttcccacatgttgccattcgttgtcggtggtgggatcttaatggccctctccttcattattgagcaattcgttggtagtaagagcttagcctttaccttcttcaaccaagctggtaacatggctttcgccttcatggtacctgttttagccggttacatcgccgaatcaattggtgatcgtcctgctttgatgcccgggttcgttggtgggttcatggccacggtatacactggcgcttacggtggtgtttacacggcctccattaccgccaatgctaagagtcccgctggtttcttaggtggtttagccgctggtttcttagccggttatattactgtttggatgaagaagtggaccaagaacatgccacaatccttagacgggatgaagccaatgctgatcttcccaattctgggcttattgattattgctgcgctaatgttcttcgttgttaacccaatcttctcagttatcaacgcctggattacccacttcctaaactcaatgggtactggtaatgccgttctcctcgggcttgtcctcggtggtatgatgtcgatcgatatgggtggtcctttcaacaaggccgcttacgtcttcgcaactggtgcctttaccgcaactggacatgggaacttaatggccgctgttatggctggtgggatggttccaccattggcaactgcgattgccactgccttctggccaaagaaatttacggatgacgaacgtaaagctggtatctctaactggttacttggtatttccttcattactgaaggtgccattccattcgccacagctgaccccttgcacgttatcggttcaagtgtgattggtgctgccatcgccggtggcttaactcaactttggggcgttgccgtccctgctcctcatggtggcctctgggtctcattactcgccacgaatatctggggctacatcggtgccacaattatcggtgccgttatcgctggggttatccttggtctctggaaaccagctaaagcttctaaataatgtgatatctaaaaagacgatcaaattgatcgtctttttttgttttcaaaattaacgaatcagccgtctaaccccgcaataaaacgggtataatgaaagtaatatactgattatgttaacgagaatcgagacgagtttgatgaaactacgaaaatctatctttggcatcagctgtgtattattcggcatgatgctgctttccggttgccaaaaacaaactaaaatgaccctgccccctgtcagtcacaagaccttaacagcgatggtgatcagtgatgaccatgtcattgcgcccaggctgcatgataatggtaaggctttcacgcagtacgcggctaacgatgccggtgcggatttaaaatacagcgcgacgatttttcgcgcttttattgctaaggcgttaatcaccaagcctgacgttgtgctcatcagtggcgatattactaacaacggtgaaaaagccagtcacgagtacgttgccaagcagcttcgccgactgactgctaagcacatccgcgtctacgtcgtccccggtaatcacgacttgaacaaccccatcgcccgtcgcttcaaaggaaagcatcaatatagcaccgaggcgactagcccgacccagttcaagaagatctatcatcaggccggctacggccaagccagtgaaactgacccaagctcattgggatatttggtaaaacctagtaaacacacttggtttttaatgctaaactccgccatttataaaagtaattatcaacaaggtaattcaacggtcggtggtggcctgaccgatgggaccttacaatggcttactaaagtcggtaagcaagcaaaacaagcccatgcgactctcattcccgtcctacatcacaatacaatggaccacacggtgattcatcaggactatacaatcggttatgccgaagatgtccgtaaggcctttaccactgcgggtatcaagttatcgctcagcggccatattcatgctcaaaatatcaagtctaccaaagtcaagaaccagtcactgactgatattgccagtggcgccctgatactgggatctcactattacggtacgcttaagatcaaccagagtaacgggacggccacgtaccacgcgaccccgttaaacgtgagtgcttacatcaagcaccaccgtggtaataaagcgatgcgcgcctatcaaaagtacgatcatgacgtgttatatgcggctggctataacgcagcactgagtcagttatatgaggaccgtgacgaaacgcaactatcaagcgctaaagttaatcagctagcccgcggcatggcggccgccaatatcgcgctctttcggggcaccccagtcaaaaatagcgccgctattcaagcttggcaacaaatgccccacaatacaagtttgcgcggcttcgtgttagccaccaagaaactacacggcaacgtgacgtggtctgggtccgtacaataaccactttataaactaaaggcgacagcgaattttcaggctgtcgtctttttgattagtcactacttatagctggtcagtcacaccggcaccaccctacttcgattcggctagattggttttcgcacacgtagcatttggttaacaatggtcattaaataatcacgcttgctaaatccgacgacggccgttatcaaaatcaatagataacggagtataacactgtgatagcctcctaaaaatagaaagccaaccgccaaaaaagtgagcgtaatcagccccagtatcttgcgatcatatggaagcgtgccaagtttttcgcgacagattcgattcataaaccaataatgaacaaccgcatacatcacatagcaaattaatgttgtatatcccgccacctcgtatcctaaaattggaatcaaccaataatttagcgccacattcaatactgcgccaataacactggcaatcatgattaaagatgtccgttcataatagaactcaaactttgcaaataaatcaaaagcaaaaatgaaaaagacgctcattgcgattggtggaacgatccaggtcgccttagcatacgctcgtggtgcgaatatcgaaacgatttcgggcgcaaatgcaatcaatagcaggttgacaaccgcaattaaaactaaggcaccgtaagcgacacccgcaatatcggccacccgtcgatccttgattttttgatatatccacggactcagcgtttgcgacaatgcaacgttaaataaaatcatgatttgtgaaagtgagtacgccaaactataaatgcccgcacttttcgtatttaccatgttcgcaatcataatccggtcagcactactcagaacgatttgtgaaagataatgtggggccaacgggatgttgaacattaatgcgtgacgccaaaaatagcgcgagaaaaacgttttgccacgatacatttgcacaaaaaacaagcccgtatagcctaccagttccactaatgctagccctaaaaatcgagccgtcactttatcattcgcatacacaacgagcaatacgcctactaacggtttggcgattgcaaccagcaaggtcaccatcaccaatgatttgtattgcaaggcaactcggcgctcaccagcctaaaaattaaaaactgacgaggtccataccattagaagcatcgccaacatctgcgtcgtcgttaaagaaaagacactattccaaaaatcacgaaagccaagataaactagtgtccatgctaataccaacacaaccgttaatccttgtaattcagccgaatatcgacgtcgatcatggctgaatttgatgagaccttgagtataaacgccgtagcacagatttagtgagacgatgatcgtgacgatagtcagccaggagtacagcacattaaattgaccatactcggaagtagacattattctggtaaaaatgggcgttgcgattattgaaatgctcttttcaaaaaaagcacagattaagaaccaaagtgaggccttaacttgctttggcaaatgccgatatttatttctaatactgactaacataaattcctttctcatagatctgaactgagcatcacatcccgtgcttactaataacaaatctcataagcaccgcacacgttcaatcacttggttgttgtcgataccggcgcccatttaccgaccaaatcgttcttaaacgtaaatagttgatcacatagtaacaattatctggggatgtcaccattgcgcggactaacgcagccagggcctgaccaagttttcgtttgcgcatactggccatcgccatcgtaaaatatttttgcccacgattaaacgtactttgggcacggacgtcatttattttgtctgttaacgccgacatcccgcggccgaaactgtctgctcccgtccgtttacgttccgcatacaattgttgaatatagcgcgataccagatacgttttccacgcgtcgctggtcatactattaccgcgtaaccgatagttcaacactcggcggttaattgacccgattttgaatccattagcaagcagccgcagccagagatcatagtcctcagccgttggtaataaacggtaaccaccgacttgttggacggccgttttccgcattaaaacggtgggatgaataattgtcgaaccatagggcaggattttttgaattagtggttcagcctcgggaatggccgatttttcaccgacaacctcatcctgctcatcaagataagcaatatttccagaaattaaatccaaatcgcgcgtttttagcgcctctaattccacttcgagccgattagtgacagaaatatcatccgcatccatccgcgcaatcaactcattacttgctagctcaatcgccttattgagactagcggccaggccgaggttttctggattgcacactagtttgatcatttccacacggcaatcgtaatccattaacaagtcttttaaatcactccgttctggattatcaagtacgatcacaaactccctcggcaaataggtttgcttcaaaatcgattcaaccgcttgctggacttgctcaggtcgttcattatatacactcataattacgctgattgccattttttctcctcaatcttcaattcagttgaaagtaaataccccaagaatattattgccgtcagtaccatgccgctgcgcgcaacctcacctttataatttgcgattagtagaactacgccaaaggctagaaagattttactatcacgaacaacctttccagactttttgtggcaagccgtcaacgaggctataatcgtaccgtacagtagcgccatgtaaatgatgccccccataaataagtcattaataaagccaatgtcggacgttccgaaccaaatattgctggcattgccaccatatacgcgaacgccataaccaaacacccagtctaaaagctgactcggaaacatcaagaacgagcccgtcagttgttcgtaattgccctgcttactaccttcaaagacgagtgcaaacgtatcttcgaagccactgacgatccaggtatacgtatcaggttggatggattgcaaaaacgctaaacccaatatgataaaggtcacactcaatatgataatcaacacaacttgaaacagccctcgaacactggacagcattcgtttgaccagcatcaaggcaaaaccaaaagccagcgtgatcaagccagttcggccgtttaatacgataataaagacacaaaatggcaggaaccaataatactttttgccaaggttcattcccatatatatcgcaactagtcccatcagactatggtagattggtgtaaaaaatgtgtagtcactgctgattccatacaaacgttcaccataaataaactgattctgaataataccggtggctgtttttgctaaaatcgcagcgcgaatacccgaacttgccagcatgaccaaagcaaacaagcattgaacaaccaccatccatagcatccaggtcaagaccgtttcacttgtcacgttaaaatacttacgaagaacttctagccataacactaaggcaaggacattcaaaataatcacaacattttgaaacacccggggatcagttcctgccagcttcgctctgaacgcaaagtaaatcactgatagcatcacaccaatcacaaaaatgtgcagccgattaatagcaatcgataagtcctttggcgacaatagcaagacgcaaccaccagtaatccccagtgtaacaatcaggggcacataactactgctccaaaagttgggttggtaaatcaggtaaaatccggcaatcaatagtcctagtcttaagaatggcccaccaatctgacgatttactgcagtcatcgttccattactcctttataaacttgctggatccgctgaatgaattgcctttgttcatagtcactaaaatcgaccgctgctattttagccttggtttcctgataaaatttcccatccgaaaagagacgtgtcagtactgccaataattcagcatcactcgcataaaccaggccatttacccttgcggccgtttgagagatgcccccaatgcgggggcaaacggaatcgcacccaataaggctgcctcgaccatggtcaatccaaacgcgtctgatttggacgtcgacagcacaacttttgcatgccgcatgtatttgtaagggttacttttaaaccctaaccaccgtatttgcggggtggctgcaatctgtttagcgatgtgtgcgctcaagctaccatcgccgacaatcccaatctttagttcagggattgcgtctaataatttatgcgcaattctcacaaatcttgcgggatctttaacatcttccaaccgtcccacgaataacaggtcaaatgcagtggttgtactggcagtagccagttggcaaatccgtgaactgtcgattccattgggaataatcgccgtattggttaaatgtttgtggaagcgatacgattctttagcccaatctgaaacatataagactcgtaagctcttgttgccaatatattgaaacgccaaacttttccagttcacactagtctgccatatcggggcttgatggatatgggtgataattggcacatggtgaaaaagcaggttgaccaaaaaactcgctttgaaatcgtgtgcgtgaataatatctggctggagtgccagaatagctcgccgaaatttaagaagctgtttcggcgaaaaactttgatacgcgattccggcagcttgcaagctttcttgtatcgatcctgattgtgagcagtaggtgaaatcataggatccactcaaacccctactgatattaatgaccacctgctcagcaccacctaatttggcggaaaacaagacatgaacaatttttgtcatcgacaatcgtcccttctaggccaagcaacgcaaatagtacgcctgcgtttgttcgagcatctcatgctcagtatagtgacgttgatacatttgataggaattagtcttgacctcggcgatctttttcgattgatagagtgtcagaattttttcagcaatctggcgcgcatcattggtgaccaaaaagccattatgatcaatcaattcctgaatgcccccaacattcgacgcaataatcggcagaccttgggctaaggcttccactaaactgattgggagtgcttcataatcagaaatcagcaccccaacgtccgattgagaataatatttttgtacattatccaccaccccataaaagttcactttaccatccagattcaactggtgcgttagcgttttacaggcttcaatcgaagggccgtcacccagaaaatgacacacgattggtagattttccggcaagtatgtcaatgcttgaatcaggatatcctgccgttttggtgtatcaaagcgtgccgccattgatagtacaaagacctcggaactggtcgccttgtttgcgcccgttaatgctgtcacgccattatggataacacgagcaggatgagcactagtaatcacaccactttggacacccaaatcataatcaaactgcgagacacagatgtaagccgttgtcaggcgacttaatgctttttcaatagttttccccatcaatagctgccgtttcttcccgacaccaggagtaaagccccagccatggaccgtaaaaatgactttcattggcaatctaatcgtggcgagcctcccaatcataccagccttcgaagaatgcaaatgaataatatctggctgccaattttttactaatttccttaacgtgtagattgctttcaaatcactcagcggtgcaatcggatgtaccaggctggcaactctgacaacttgcacgtcttgaaattctttcgcgacgcttgcactcaggcgtccttcaacgccgtatactaaggaaacggcattgccacgcatcacttgcgctttgatcaaactatatagatgcgcctgggccccaccccaagtcgcttgagtaatgatgtaaacaatcttcactaccgcgcaccatccccggaaataatcaccctaaccgttcccatcagcatcttgatatcaaaccaaatcgaaaagtgctcaatgtaatagttatcgtactgacacttggcacccggtgtaatatcatagccaccattgatctgcgcatagccggtaatgccaggaatgattcgtagccgtttcggaaaatcaggatagcgttcactgaattgttcggttagttctggccgttccgggcgaggtccgaccaaactcatatcgcccttcaaaacattccaaaattgtggtaactcatcgatccgagttttgcgcatccagcgtccaaccggcgtcacccgaggatcatttttttgtgcccagatcgcacccgtctgcgcctcagcgtcctgatacattgatcgcagcttaatcacgtcaaaggtcgtccccatccaaccgactcgcgcctgcttgtagaaaacgggaccgtcagaagtcaacttgataagtatggcaaacacaattacgatgggaacgctgagcagtgtgcccaataagccgactgctagatcgaaacaccgctttagatccatcttccagccggtgaccggaacaccaattttgctaataaattcacagtgttgttcgtcagccacgattgattcattaatctcaacttcgtgcatgctcacattccccttcccagtacttggttaatcctcttctcaacggccactctgattcataatttaagcgtgccaacttgccaatacttgcaactgaatgatcaacttcaccaccccgctgctcggcccgtttgatttcaagttgttgaccagcaatctcttgatacatctgaataatgccatttaaactagtttctaagccattggcaatattgatcacttcatgttgcacttgatgttctgtaatcaaccataatgccttgataacatcacttacatatacaaaatcacgggtctgcgttccatcaccgaataatgtaaatggtcgctgtgttttcaaacaatccgtcaaaatcgacaaaacccccgaatacggtgagcttggattctgacgcggtccataaacgttgaagaaccgcacacaaacggtcggcaaatcgtacaactcaccgtatgccaatacaaaacgttcagtcgcatacttatcaatagcatacggtgacacgggtgcgacgcgcgaatcctcgcgttttggtaattcaggtagattgccataaaccgccgccgaagaagtgaatagaaattgcttaataggcaagcgaatttggcgaatatgttcgagcaagttaaataccgcggtatgattgacagcatgcgtttctgccggccgctcaatcgaatccgccacacttgcaatcgctgccagaaaataaatatagtctggccgttcgtctgctaacaattgttgcatgaatttatcgtcacagacatccgcgacgtatatcgtaatctgttcccaatgcttgatattgctgatggcccccattgacagatcgtctaccaccacctcaaagccagattcaactaaatgatcaaccaagtgcgagccaatgaaccccgcacctcccgttaccaatgccttcataactatttacccctctcaaaaaagccaaaattttcgtcgttgatttggtcgcaagacttcccctaacactactggatccccgttcagtagcagtcttgcattcactgcaaaagatgcaggattggtactatctaaccgtgctaatgcctgataacctgcccgcatcataaatcctcgtcgtgccatcaaatgcgcatctgaagcaatcacttggaccagcccgcattcaactaattccagcgctgtacttttaaccgctcgcccaaattgcccaacgagactccccgctgttagctgtgccaaacagccctgctgcactaaatcatagagccgctctggttgtgccataatctgagcatttcgctctggatgggcaatcaccggagtcgtcccttgctgtaagagctcaaagattacttgcgccacgtaattaggtacctgctcgtgtggcaactctagtaacaaatagcgccgaccaacatcaattcctagcaagtgcggcagagctgtcgccaaatcatctcgcaaatggacctcctgaccggcaaaaacggtcagtggaatttgttgccgcttaagttcggcctggagctcggcaacggcacgctcgactaccaggccggtattctgataacgccgatctagatgatgtggcgttgccaagacgtaatgaatgccatcagccaccgcttgtcgcgccatttcgactgcctgagcaagctgctgggggccgtcatccaatcccggtaataagtgacagtgcaggtcaatatactcagttggtctcagtcccataatagccgtacccataaccgtgagttttaatgtccacgtcatttaaaatagtcccgagtaattgtgcgcgagcattcttcaaggcactcactgcctggcgcaccgcaactttttcgacaaagttttggcgaacgactaggacagtgccatccacttgaccagctaaaatccgagcgtcggtcacgggcagtatcggcggcgcatcaacaatcactaaatctaacttacgtgttgcgaccgttaaaaacttggtcattctatcgctggctaataactcagctggattgggtggtttaggtccactcggcatgacaaacaaatgatcaagtacgggataaatggcttcgttcacgtccgtcagttgcccgcttaaccatgaactcactccccgttggttactgatcgcaaacgtctgatgaatcgtcggccgccgcaaatcagcatcgacaagtaagacttgcaggcctttcttggcgtattccacggctaagttgctgccgaccgttgattttccctcgccctgaatcgctgacgtgatcattagtgttttcaacggtttaccgaccatcgcatagttaagatttgttcggatcgttttgacttgctcagttacgactgacatcggtgccgtcaaagttgttaactgtatgccggtatgcatattcgctactcttcgcctcaatttcataaccgttcccccctatgttaaactcgtttgactgccgctttaacaactgacgtcaccggctgtggtttaatcgccggttggtcgtgagtcgctgtgaccggctgctgatgattaatgattcctagacttgtcagcattaattcatctgctaggtattcgagtgtctgcacccgccgattggacaagattcggacacttgcatacaccaatcccaaaatcagccccccccccacgaaaccaattaggatattgatgatttttttaggcgctaccggctgatccggcgtctctgcgggtgcaacgatcgttacattattgaccctaataatatgctggacctgatctttaaacgttgcagcaatttggttcgcaatcattgcactagctttcgcatttttatcacgaacaacgattgaaaacacctgcgaattggccgtactggtcacgctgaccgtttgcttaagcgactcaagtgagcgtcgaatgtcagtttctgccattaaagtctgccgtgccggcttcaacacgactggttttgtaattaattccttataagtcgtaatcatctgcacatcggcttgctggcccgtcaaatccgcgcccgcactactgtgtttgcggttcactaatatttgaacattggcttgatactcgggctgaatgacccacaaagtcaccactgttgcaatcgtcccgcccaaaatcattaaactcaataataccttccaatactgacgaatgagtttaacaataaaatcaaaggttattacttgctccattccacacgctccaatatttcttgactgacttttattaaacgattgacattattgtagaaaaccagttgcaaacgacgcaatagttttcacgaattttcatgaaactcatataaatacaagcgaatattcgacaatctctaaatttaaattgacattatagacaataatgttatatttattgatagttactgatcaaaataatataaatcgtataattatttgactttattttagctcgtatttacccacaattatttcgattaaatcatcggttactccagcaaccaatgtgcttttcaactaatcacaaaatcgacatttttacaaatcaatgatgttttcaagcatcaaaaaagaccacctagttcgtgaaaactagatggtcttcttaacattaattacattagttagccagatgacaactatgtggcgcccttttgataatgcttcggtgttacaccaccaccggctaatgaaaatttgacagtttgtgcaacgtttttagcaattcccagggactgaatctcttccagtgaggcaccagcaattttactcatcgatccaaatttacgcaacaacttattacgcgtcttcggcccaaccccggggatctcgtccaagcgcgaactcaatgaatgtttggtatggacttgtcggtgaaacgtaatcgcaaagcggtgcacttcatcttgaatccgttgtaataaataaaatccttgactcttcggatctagatgcaaatgctgatcaccagcagaagcgagtaggtccgccgtcttatgatggtcatttttgaccattgccgcgactggcgttgcaatccctaattcgttctctaagacgtccttagcggcttccagctggatctcgccaccatccatcaaaatcaggtcgggcaatgctgcatgctccttcagtagccgtgtatagcgccgccgaatcacttcacgggtcgatgcagcttcatcagcatgatcgaccgtccgcaacttatatttccgatacaattttttattcggttgcccgtccgtgaagacgaccatggcagaaaccaagtcggccccctgaatatgagagtggtcaaaagcctcaattttatgaccagcaggaatgcctaaagcatccgtgatttcttgcatcgcccccgtcgtcttgcgctcatccaattccaacaaccggaacttctcttctaagacgattcgagcatttttttgtgccatgtccagcaaatcctttttctggccgcgttgaggggtccttaccggaattccgagaatgtcactcaggacctgcttatcaagaccgttggggactaaaacttcgcgtggtagaacgttatttttgcgattataaaattgcaagataaagctcgtcatttcttcaggtgcagttgacactactgggaacaagcgtttctcgcgcttcatcaaccgcgcttgccgaataaagaagacctgaatcgaaagccagcctttatcaagatagaaattaaacaggtcgcggggcgtattatcgtttgaaataattttctgcttttcaaccgtcatttcaatataattcagttgatcacgtaattcagcggctcgttcaaattctaggtcagcggccgcttgatccattcgtttagttaactgcttcttgaccgtttcaacgtgaccattcaaaaaggatttaatccgcttgatctgagcgtcatattctgccaccggcaccgttttaaagcaagctcccaagcattggcccatatgataatagagacacggccgcttctggaaaccatggcaacgccgcaacggatagaccttctgaataaaattgaccgtttcctgagccgcgtaaacattgggatatggcccaaagtagtagccaccatctttacgaacatcactgacgatcaggatctgggggtctcgttcattggtaatcttaatgtacggataaccggttcccttttttaatttaatattaaagtacggttgatgtttttgaattaacgtaatttctagcaggaaggcttccttatccgttgaggtcacaataaactcaaagtccgcaatctctgatactaaccgcgcggtcttaccagtatggctgcttttgaaatatgaacgcacccgatttttcaagttcttggccttacccacataaatgatctgactgtttaagttcttcatcagataacatcctggtaagtccggtaacaaggataacttatgttcaatatgcgcggatgccataacacaccttcccttcatttagattagcattattagtataccgcctgctagcatggggctcaaccaaacagcccggaaatatgatttttattatgaccgactattcatcactgtcgctactgatcacagtgtagcaaaaaaccggtaatcagcaactgagctgattaccggttatgtgttgtttacatcaaaattttagaaagaaaatcttgggcccgctctgtttgcgggttcgcaaagaattcctcaggcgtattattctcctgaatatagccatcagccatgaaccagattcgatccgctactgacttagcaaaacccatttcgtgagtgaccacaaccatggtcatcccatccttagcaagttcttgcatcacgtttaacacttccccaaccatttccgggtccaaggcagacgttggttcgtcaaacagcatcacttcagggttcatcgccaacgcacgagcaatcgccacccgttgagcctgaccacctgaaagactacttggaaaggcatccgcatgatcgtccaacccaacgcgttgcaataattcgtgcgcttgcttagtcgccgcggcatcatcgacatgcttgaccttcatcggcgccaatttaatgttttccaatacagtcatgttgggaaatagattaaacccttggaaaaccattcccattttttcacgtagcgcgttaacactcttcgtatccaaagttgtgagatcttgaccttcgaaagcgacttgaccacttgtgggcgtctcgagtaagtttaaacaacgtaagaaggtactcttcccaccaccagaaggaccaatcaccacgatcacctgaccgggttcaactttttctgtaatatcctttaaaacgtcattttcaccgaagctcttcgcaaggtctttaacttcaattactggtttagtcatgttgcattctcctttcgaagtagttcaagatccgtgaagcggtaaaggttaagatgaagtatagcaccataataacaacgatcggtgcaaccccccggtacgtatctgaacgaacaatgttactttgataaattaattcagtgaccccaataatcgaaacgatggaactatccttgatcaacgtaataaattcgttcccaagtgatggccaaatgttcttcaatgcttgtggcaagaccacgtaacgcatcgtttcaccgttggacattcctaaactccgagcagcttccgtctgcccaacatcgacggaattaatcccgccacgaatatattcagcaacgtacgcaccagagttcaaggaaatcgcaataatcccagaagtcagtgctggtaaattgacgaataacccaagtccgaagtacacaaacatcacttggaccatcattggcgtcccacgaataaattcaacatacgcagttgctaaccaccgaatggcagtcttaagtggatttcctttagccatccgtgctaatgccaataaaataccgatgataaaaccgaagaaaacggagcaaaccgtaatgattaacgtatattcgatcccggttgcaaaagccttccagtaatgtcccattgacgtattaacggtattggtcttcaaatacttgccggctgccggtaagtattgctttttaacgaggttctgtttcttaatccgatcaacggtcttattgactttgttaacaagactagttgaacctttccgaaatgcgatcgccgaactcgttgcactagagctcatgttgaagtcactaggaatagcaaccaaactcttattgtttgcaacataggcttctgcagaaggcttttccatagcaaccccatcaactttgtgactctgaagtgccaaaatcagatcagattgtgaagtcatccctttagccttggcagtcgtttggtttttgacggcattatattgagtcgttccagtttgggcacccaacgtgccattcttgaatgaattcttattcttgtacttgcccttatcagtcttattgatgacaatatcgtagccaccttgataataaacgtgggtaaaatcaacatttttccgccgtgaaggggttgggttcatcccagagataatcatatcaaccttgccagtttggagtgccactagcaatgagtcaaatgacatggatttgatcttcagcttcacgcccagatccttagcaacttgtttcccaatctgaacatccatcccaacgatcttactcttaccgttgaccgttgcttgaaactcatacggtggataatcaggcgacgtccccattactaagacgccctttttctgaatttgttctaatgaattatcgaccgcttgcgcatgttgcgtctgtccgagtgggacgacggtcatgatcagggccacaataatggctaaaaaccacccaaatctttttttcataggtattctcctcgttttgtaatttacaagaataaagtataaccgcatatgattatttatgcaagtatttttgagaatttctttattttatgcataaacaagtcgtttatacacgttttgacccattgattatgcataaaagacgaataactgacaaattgtcggaaatttgctatgataggcgttaatcgaaaggaatgattttatgagtttaaaagtacagcgtcaagataaccttgataagctattcgacaagtttgccattggtcctgacgataaggataaactcaccactaaagcggttcaggatactattgacgaacatgctaaacgcaaagaaaataaggcagctgataaaaaggacgcccataaatagcagtcaaaaaaaacgcaatggcagttagccatcgcgtttttatttgaataactatttagcaaattttagtcccgattgtttgcatcttttcgcgccgctctgcttccgtttctggtgaaacatcgcgccaatcaacaacagccaaagcaccgtcgagcatcccgctatcatccttgagcgctaaagcattatgccagcgagaaatgttgaggccgttccccaagtaggcttcatcagccggtgcaacgtgcatcacataaccagcattattttctaatggcgtggtatagtcgggatcagcggctttaagaataactaactgaaacttattaccaatggcacagctaccgcctaaactcgaatatttgttagaaccatcgtcagttgttaaaattacttgactccctgccggaatcttatctgcaaggtaggcttgagcatcgtctttgatattaatcttcatagttaagcatcctttccgtttcaaaaacatttaagttgtgcacaactcttttacagtctttaatttacgctatttcagctgcaaatgcaattaatttacctagaaaagtgaaaataaacagccgaactcaataatgacacaatctttgcaaatgatatgtggtcgtccgtcgcaataaaaaagagttgggctgccagccttacctgctgacagcccaactcttcaggttagaccactcttcaccgactatttaactggtttaccattcgggtacttatcgttgagtttaacaatattttgttgcgcaacttcttcgaacggaatatccgcccattcagcaacttgtgataagtaccataacacatcgcccatctgtttcgtcagctgatctttattcaaacgttcaccatgaaacgtatactttttgactaagtcaacgacttgaccagtctctgaagctaatcccagcgataagttcgtcagcacctgctcattaccatataatgtccgatttgctaacgactgatactcattaaattccaagttagttgcctcccacagtgtgcgcttcgatccattgccaaacagcatccttgccttctttggtcttagctgaaaaggcgataaaatcgtcttcagcttggaagttaagcgtctttttaattaaactttcctgtttgttccacttaccacgcggaattttatcactcttagttgccacgaccagtaatggcatctcatagtaacgcatccactcgtacattgcgacatcgtctttagttggcgcatgacgtgcatcgactagaataacgacacctcgcagtgtctctcggcttgttagatacgtctcaatcatttgtccccacttctcacgttccttcttagataccttagcataaccgtatcccggaacatcgacgaagtataattgatcttcaactttataaaagttcagtgtttgggtcttcccaggttgactagacgtccgcgcatagctattgcggttaatcaacacattaatcagggatgattttccgacgttagagcgccccgctaacccaatttctggaaacccagtagtcgggtactggctcggcgctaccgcgctcatgacaagttcaacgttatgcacttccatcgaattaactccttctgcaatcgtattgcattcattttaccataatttttgcagcgggttgtcatccgcgctcaaattcgatttaaacagcactcaggaccgcgaatgaaaactcatcgcggtcctgagtaatgtctattgatcttctgaacgaaacgttaggaagctttttgatcagctaaaaccagttctggttcagcgtgatcagcaaccgtctcgcgagtaataatcacctttttaacatcttcacgacttggaatatcatacataatgtcccgcatcgtgtcttcaataatcgagcgtagaccccgagcaccagtattacgtgctaaggcttcttgcgcgatggcacgtaaagcgtcatcgttaaagtctaattctgcaccgtctagagcaattaggcgttgatattgcttgacaagcgcattctttggttccgttaagatccggaccaaatcatcttccgttaaacgttctagcgcagtcaagattggaaggcgcccaataaattcaggaattaaaccgaattgtaagaggtcttctggcacaacttgttgcatgagactcttggaatcgtctagaacggcattcttaccatcggtgtccgtaccgaaaccaatcgttttatcgcctaggcgacgtttgacgatgtcttcgattccatcaaaggccccaccaacgatgaataaaatgttggtcgtgtcaatttgaataaactcttgttggggatgcttacgcccgccctgcggtggcacattggcaatcgtaccttccaaaatcttcaagagggcttgttgaaccccttcaccggaaacatcccgtgtaattgagacattttcactcttcttggcgatcttatcgatttcatcaatataaatgatccctttttcggcacgttcaacgtcgtaatccgcattttgcagtaatttcagcaaaatattttcaacgtcttcaccaacatagccggcttcggttaacgtcgtggcatccgcaatagcaaatggcacatccaaaattcgcgctaaactctgagctaagaaagtcttaccagaaccagttggtcccactaagctaatattactcttttgtaattcaggaccatcttcggtctcttcatcattatcagccatggccttaacccgcttgtagtggttataaaccgcaactgatagggtccgcttagcttcattttggccgatcacgtattggtctaactcgtctacaatttcctttggcgttgggatatctgttaattcatgggtttgttcttcgctaaactcttcatcgataatttctttacataaatcgatacattcattacagatataaacgccggggccagccacgatctttttaacttgatcttgtgatttaccacaaaatgagcagttcacagggccgtttgtctcggtattttcaaacattcattctcacctcatcgatgtatttacatggattaatcataacagaaaaactgagctaaaaccagcttaggcactgtcttctacgtccactactataacatggacgaacctaaacccgaaattatctgttcaatcatccggctaaccactttgaaaaccgaatgattctcgcagtaaatcacaggcgtcagccaaatagctattaaattaatcttacgattagctgacgctatgtaaaagggtctcggaagaattattcttccaagaccctcgacttgtatctaattgaattaattagttcttgtcgctgtcgtcttttttgtcttctgctttggcattttgcttagcagaatccgcaatcaagtcaacggcttggcgaatcgcaatgtcatgtgacaacatgtcatccgttaaagcaccacgaacagcactttcttccatgttgtattgactagctaaatccttaacttcggccgcaatttcatcctgagatggcttgatgttttcagcttcaacaaccgcttctaagaccaagttagtcttaacccggcgttcagcatcagcagcaaattgcttgtgcaagtcgtcttcagtagtaccagtcaacttgtagtaagtctttggatcgataccttgttgttgcatattagccaagtattgatccatttgacgatgaatatcgtcttctttcatggcatcaggaattgcttgaatttcagcattgtcaaccgcttggtttaaagcttcgtcttcaattgcatcatgcgcagcggattccttttgttccttaagttcgtccttgatcttagcttttaattcttcaagtgtgtcaacatcttcgtcaacatccttggcaaattcgtcatctaattcagggagttccttagtcttgacttcatgaactgtcactttgaaagtggcttctttgtcttgtaagtcttcagcttggtaatccttagggaacgttaccttaacttcagtttcgtcgccagccttgacaccaactaattggtcttcaaaaccagggatgaatgagttagaacctaattcaagtgagtagttttctgattcgccaccttcaaatggttcgccatcaacgaatcctttgaaatcaataaccaccgtatcgcccttagcggctggttggtcttccttcagaactaattcagcttgtttttcacgccgtgattctaattcggcatcaacatccttagcataaacgcgagtattttgacgcgttacactaagttccttgtattgaccaagcttaacttctggtttaaccgttacaacggcctttaatacccaaggcttacctttttccatgctatcaacatcgatttgaggttgatcaactggttcgatttcagtttccttgattgcttcttcatatgcctctgggagcacgatgtttaaagcatcttgataaagtgcttcttcaccatacatttgattgaagatttgacgtggaaccttacccttacggaaaccaggaacatttaagttctttttagtccgttggaaggccttgtcgataccttcactaattttatcagcaccaatttcgaatgttaattcgccttggttgccttctttcttttcccactttgcagccattgtattccctccgaaacattataatttctacaattctagtcaattgcatacttgttaagtttaacctatcgacaccgtaaagtaaaccaaattggctaaaaaagcgcgtaagctcgcgatttattgttcgtttttcttaaaaaaagcgacttggaagaagacttccaagtcgcttagatcaatcaatgaaaatcagttagagattagtcatcaatttctgaaacaacaccggcaccgacagtatgaccaccttcacgaaccgtgaacttggtacccttttcgatggcagctggttgaatcaattcaacagtgaacgttacgttgtcaccaggcataaccatttcaacgccgtctggcaattcaataacaccagtgatatcagtggtgtggaagtagaattgtggacgatagtttgagaagaatggcgtatgacggccaccttcttctttgctcaagatataaacttcacccttgaacttcttgtgagtttggatcgaacctggcttagccaaaacttggccacgaacaacttgttcacggttaacaccacgtaataacgcaccaacgttatccccggcttcacctaagtcaagtgtcttacgaaacatttcaagacccgtaacagttgacttaagaacatcttcgtgtaaaccaacgatttcaacttcgtcgccgaccttaacagtcccacgatcgatacgaccagaagcaacagtcccacgaccagtgattgagaagacgtcttcaacaggcatcaagaaaggcttttcagtatcacgaactggagttgggatgtattcatcaacaacatccattaagtgcatgataaccttttcttgttctgggtcgccttcaagtgctttaagcgctgaaccacggataacaggaatatcgtcaccagggaaatcgtattctgaaagtaattcacgtacttccatttcaaccaagtcaactaattcgtcatcgtcaacaagatcagtcttgtttaagaagacaacgatatagtcaacaccaacttggcgagccaagaggatgtgttcacgcgtttgtggcataggaccatcagttgcggcaacaactaagatcgcaccgtccatttgagcggcaccagtaatcatgttcttaacgtagtcagcatgtcctggggcatcgatatgagcgtagtgacgcttttcagtttcgtattcaacgtgggcagtgttgatagtaataccacgttcacgttcttccggagcagcatcgatagaagcaaagtcttgttctttagccaagcccttagatgctaataccttagtgattgcagcggtcaaagtagtcttcccatggtcaacgtggccaatagtaccaatgtttacatggggttttgttctttcataatgttcttttgccattaatgaaacctcctgtgattttcgcaagaataacgtcgaggccaaaatggtctcaacaattctttagttagtattatactacatcctagtgaaaaggccaaatcgcgcacccatcactgagaatccttaaatattatatatagcctaatctgatttgtaaacagatattatttaaaaaattgaatttttgttagtaaattcttattacgcacgcttatgattgtaaatcaaggctaaattgctgaattttttgctgaattttcatcattttttcagtttggtcatcagacggcgttatcgtctgcccagtttgcaaactaatcaaaagatcgatccaagccgtggaatctgtaataacctgtgcagcgcatggatataaatacattaattgcaattgtaaaagttctcgtaagctttcatataaaaagacatcttgattaccaagtcgcactttcaaagcatggtaaacggccttgctcgtctcgtcctgaccgagtgcgactaactttgctggacacagtgtcaacatcttctcatccagtagccactgcatcttgaccgtctctgatacttgcaattggtacagtgtatataacacttctactcgtgttaagggatgcaaaaacggatctactaatagaaacttggctgccgtcagatagcgctcatatggcaggtgacgggctgcttgcaaacctgccacctgtttctggacgggctggtcagataaatgataaaaatgacgcattgttgtggtcaatgtcgatcctagcgttcgctcagccgtactctccgccgcttttaaagttgtgtttgcagccgtagtccacgcactcgttgggcgtgccttgatcataatgtgggcagaaatgaagtcatgattagcaaccaatgcattcagatacagatctgcggccgcatcggttgctaaatactgcgcttcaaactcactggcataattagctgctgccacatattgttgatcagcaaccaacgcttggaccagttcgtaattaactggtgccgtttgctgtgcctgatacacttgctcccacaaactagccgccttggaccaatcctgagctcgactggcttgttcggcggccaattgtgtttcagctattgtcattgaaccttcctcctcttcattgtaaccaaaaaagtcggaagtagcttccgacttttttaatactaagctttagattcagtctcgactggtttggctggtttagccttctttgtacgccgatgatgctgattaacttccataataaccggtaaaataactgggtgccgcttggtctggtcccataaataatggttcaacttctcacggacagcctgttttaaatggccccaatcaaactctttattatcgagattttcttgcaccgtcgttttgactaactcagcgctctcttgcatcaagtctttactagtcttgacatagacgaagccccgtgaagtaatcttaggagtcgcaataatcttcttctttttgcgatcaatcgtgaccactgccacgaaaataccgtcttcagacaaaatcttgcggtcacgtaacacaatgtttccaatgtcaccgaccccgatgccatcgatcatcgtatcgccgacttcgattgaaccggccaagtgcatggtatcaccgtcataacgtaactggtcacccttggctgcgatcaggacatggtcgtccggaattccaacttcacgtgcaaagtccgcatgagcatccaacagacgatactccccttgaatcggaatgaaatattggggcttcatcatgttgatcatcatttgcaagtcacgtttagcggcatggccggaggaattcatttcatcagcaatcgccttaacgtccgcatcagcacgataaatcatatcacgggtcttggcaaccacggtttccatcgaatgtgacggtgtggtagtaataaataccagatcacccttttcgatattgaccttgctctcctgcttattagccatccgttgtaaggccttaataggttcgcccattcggcccgtttgtaaaatcacgatttgttcaggtttaagtttatcaatggctttaagtggtacgacaacgtcttcaggcatgtgtaacttgcctaaatcgattgcggtcttcacgatactctcaacgtcaccaggcattaaagcgactttccgattagactttgcagcggcatctaaaacttgctgaatacgcaagatattggatgcaactgaagcgacaatgatccgtcctggatgatatttaaacgtttctaaaacataggccgcaatttcacgttcactgaccggctgttcataattttctgcattagctgaatcactaagtaacgccaagacgccttttgatccaatctccgccaaccgcgcaaaatcagtctgatagtcgcctgcggccgtcggatcaaacttaaagtcaccggtataaacgacctcaccggcactggtttgcaacacgattcccattgaatctggaatcgaatgggtcgtgcggaaaaacgaaaccgtgaccgtgccaaaatcaatttctgtcttctcattaatgatgtggaagtcattaaagtttttagctttagggtccttttgcaattgaatttttgccaactcaatggttagctctgaaccaaacacgggaacgttgaactcattcaaaaagtacggtaacgcaccaatggcatcagcgtggccgtgggtcaaaaagacaccgacgattcgatcagcattttctcgcaaataactgaagtccggaatcacgatatcaattcctaataactcattttctgggtactttaacccacaatctaaaatataaatatcaccatcgacttcgacagcatacatgtttttgccgttctcacggaccccaccaaatggggtaatttgaatttcactactcaattatttcaccttgattcttctaaatgtttaatgttttaaaaagctgagccgtttgttcagtactcaatggtaagattggtaaccgtggttcacccaccggctgacccaaatgatttaaggccgctttaactggcgatggcgatggtgcactaaacaaggcactcatcttgggtgttaagtcccgttgatacttagcggccgtggcaatctcaccctggtcgatggcactaaacatcgccgtcatttcgtcaccatagatatgacttgccactgagataaccccagcaccaccaatttccttggcagccaaactctgagaatcttcaccagtataaacaagaaaatcagccggtgcattttcgacaatcgcgccaaactcttccatcgtcgcacactgcttaatcccaataatattgggattttgtgctaatgttaagatcgtggccacggtcatcttcacaataacccggcccggaatattataaataataactggtaagccaccttgatcagcaaccgctgtaaagtgggcaatcataccagcttgatcaggcttgttgtagtagggaaccaccactaaagctgcatcaatccccttaatctgactaaccttcttagtaaatgcgatggtagcagcggtactgtttgagccggtcccggccacgattggtacccgaccatcgacaatctcagctgctttctttagtaaggttaatttttcatcttcggttagcgttggtgcttcaccagttgtcccacccaccagaataccttgggtgccgtgtgccaataaatgttcaatcaaacttgctaaccgcttttcgtccaattgttggtgatcatcgaaaggggtcaccattgcggtcatcaaatcaacgtttgcaaagttcatgatctaaaaactcctctattaaaatttacaagtaccagcgtacctgttccgattaagtaactctccccagtttaccacattttaaagtaaagcaatagttagaccattcaatgcaatctaatgtggtcgttgctgactaaaatacgcgacccacagcatcaatgccatcagctgtaatccagccgtaacaataaagattgactgatacccccaccaattggcaacaatcacggctaacccggggccgaccacgttaccacaagcttgcgcggactgatttaaactaaacacacgcccaaacgctgcgtgtgggacatgctcgactgtcatcacttgaagcgcgggcaatagtgccgcatccgcaattcccagtattagccgtagcccgaccagccacgcgacctgatgtaccaaactagtcaacaataagtcaacaatcgctaaaatcaaaaaagtaactaagcaacggccagcgcccagccgatccagaatgcgcccaacacgaccagccattagaatcgtggcaagtcccggcgcagccgccacaatccccgtcatcaagataatcgtctgcgccgttgcttggggcgctaactgtccgaccagcaagcttaacagtggtgttatcgcattggtcgtcgcctgaacaactagtaacgatgtcagcaaggcacaaataaagcgaccacccaattgatgtaagattggtcgcaatggtggtaacgtggcgcgactaactgccgtcaccttctcttgaacaccccaccaggtcatgacaaagacaagcgccatcaaactactggtagccacgaacgccccccgatagccaacggtattagccagaaagcttcccaaaagtggccccatcaatgtgccactgatgctaccagtgaccagtttacttaaccactggccacgttgttccgcaggtacggtaatcgaaatcagtgcgttagcattattgatgtaacctgaaaacgctccctgtgcggctcgtaaaatcaagaggacgatcacgttaggtgctagtcccacaccgagaatcgttaaggtcatcatgccagatgcgcgtagacacatcagcttacgccccttttgatccgccaatcggccccacaatggtgcgactaaagctttgcaggcgtatgtcacggcaaacgccgctgcccctagaaaattcaactgggtcgttgaataatcgcctaatgtctgaatatacagcacaataaacggtaacgtcattgcgttacctaaatcagtgattaaactgccaaaccataagacccgaaagttacgagtcaacgttgccattgcttccatgaaatcccctcattcacttttgaataaacataagtatagcgaacggttgtttgggtttaataaagtttatgtatcgtttctgtaattttttacacaaaaaaagaaccacccgcaggcagttctcgtaatctcaatattaacgacgaagaccaagactttggattaagtcacggtaacggttaacgtcttctttacgaaggtaagctaacaagttacgacggtgaccaattttcttcatcaacccacgttgtgaatgaaaatccttcttgtgaactcgtaaatgttcgtttaattcgttgatgtcttccgttaaaactgcaacttggacttcaacagaaccagtatcgccttcgtgacgagcatacttgttaataagctccgtcttcttttcgcgtgaaattgccatgtgtttcaaccacctttccaataattgccctaaactgagtaaatcgttggtggtgcacgaaaaactaagtaaagggttgctgaacacttgatatagtctagcaaactaaggagtaaaaagcaagtttcaatacatatcaagataaattactttacacataacggttgcattcaagccggggcttatgtataatagcatttgttgaaaaaatgatggaggtgaatctgatgccaattatcaaatccgctattgaacgcgtgaaaacaaacaataaagcaaacgtccgtaacaccgcccaaatgagtgcgatgcggactgctgttaaaaaatttgaagctgctaaaactgctggtgccgacaacgtcgacgatttatacttagcagcaactagcgccgttgacaaggctgcttctaaaggtcttatcaagcgcaacaaagctgcccgtgacaagtcacggatggctgcacgttacgctaaataagctaattttacgcccgagcattgcgacggcgtttttttatcgcctttaatgactcaaaagatggtcgaccgaattctgagaattccggtcgaccatcttttttgggggctccatatctaagcactattacttttgccttcgtgaatagtcgttctcgcttgtccaacaagccaatgcctaacgggacagccgcgttccgaccgctgcctgtcgctcattaacaaattgaaccataaataactcaaagagcaactccgggtcgcgttgtgtcgttttcatttgtacttctgtttggagcagtcctaagtacgccgcccgtaacgcagcttgatcaaaatggcggaccgtttgcatggctagtttgacccgatatgggtgcactttaagcgtgctagctaggctgccctgactatagcctgcacgcgccataattttgacctgtagcaacaatcggaattgtcctaataagattgcattgatctttagtggggcttcctgagctgccaccagttcatggtaaagttcgaccgctgactgcgtctgataacgaagtacatcgttgaccaaatcaaaaacattttgcgtcagtgatttagtcaccaaagcctgaactgccgctaaatcaattcgttgggattgggctgcgtaaatcatcaacttcggtaattgtcccataatcagtcccaactgcccgtcagttcgattaaccagttcctgtagtgcgtccgcaccaatgcgaatctgtttctcatctaacgccgcttgcacatagcgttgcgtttcagcctccgagacttggttgacttcaaccgtcgtcgcctgtttttttaacgttttaacgagctttttacgcgcatctaatttctcatagggtgccataaacaccagaatcgtacttggttcaggttgttcaaaatagtgctgtagtgaggccagatcatggtcaaccttggtcttcttattttcacccgtcaaaaagtacgggtgattaataaagactaatcgccgttcaccaaaaaacggtgccgacattgcatcatctaaagccacagctactggcgtcgtttccatatcataactgccgacgttcatcgtttgttcttcactgggaatttgctgcgtaaaagcctgtttgagctgatcggccaaatagtcgaccgttcccaagataacatagatcgatgccaagtcaccgttgcgaatcgattttaacgcctgttgtgcgttgatggcgatcaccttcctttaaaaatgtttgccaacgtccctggcgatgattaacgaaacgataggttatcatcccctgcaaagccgttgaataagtgacaatatgctgttcagctagagttattagtgtttcttgattcggatgcccatagcgattgtgccgacccaccgataaaataccgtggtgcacacctaattggcgcaaagctaacggatccgaggctgttttactgccatgatgccctagctttaaaacgtccacgcgtaattgtggatatcgggcaacgattgcacgctcccccgctcggtcaagatcacccgtaaacatgaaacgttgctgaccaaaaacccccgttagcaccaacgaatcttcattttaagcccgtcccggtttaaacggatgcaccgcaaccaatccatctgcaaacgtatggccggccaatgcttcaaccactttaggccgctttctggcgggcactagcagcttttgaaacttggctaggcgcgccattccggcaggtaccaccacttgattgaccggcatcaagcgtaatagttcacccaaatcaccaatatggtcaacatccttgtgtgataaataaactgtatccaagtgagtgatccctagccggtgcaaataattgaccgtaatcgtttccgcacgcgatcgcggttgtacctgctctgcctgccaacgtggccgggaaaagtgtagttgccccccagtatcgatcaaactcacttggcggttaaatggttggcgaatcaagatcgaatcgccctgaccgacatcgataaattgaacggcaccgtgaagtggaaaacgtagactaagactaaaacaagcatatgccagtaacagtccccagtaataccgacgccgcggtgtccgtaacaaccacaaactcaatagactgagcgtccatgcccacagtgtactcggttgaccgataatgagtaggcctggccaatggctgacccactcaagcccattctgaaaattaaccaacacccattcacacacgctggtgacattggtagaaccaaagccaatgctcgcccccacgaccgtcaccggtaataatacccaactaaaaataggcgcaaccaccaaattgactgctaaggaccacagatgccactgcgccgtagctacaagcaaaaccggtaaactgataacctgaatccaaattgctaatcgccacggcggcaaaccaggcattaagatcagcagcaaggctagtccataactgagctgaccacctaattggctcaataccaaaggattatgggcaatccccattatcagggcaaggctccaaccacccaacgccccacttgactgatgtgttagcaactgccaaataattggtaaagccgcggttacaactgcccgccgcaagctatcggcaccgccgcccaagacaaggtatgctggcaagagccctaataaccaaatatcgattgcttgctgacttagatgcagtcgtaacaagacccattgcaagaatttaactaataaaataacatgcatacccgacaaactgaacaaatgcaatagtcccagctgttgaacggcccccattgtcgtctgaaaatctgtggggcgtatcccaaccagtagactcgtcgcataacgactaagcgttggtggcaatctttgacaggctagaaagaattgctgacgccattggtgtaatcgatcaagtagcaccagccaaccacgctgcggcgcaatttctattcgttgaaccgctgtgaccgtcacttggcgggcgatgccttgactgcgataatacctaggcgcattaaactgccccgggttggtaggaggtgcgatggcggcgacttccccctgaacgtgccagatcgtccggtgagtaaactgggtcagatactgtttttcagtggcacttttcagctgtcctctaacaagtactttgcccattggactagtggcaatcagctgatactgaccaccgcgcaccgtaatcgcatcgggttggacagccaaatggcttgtgaccacctgactgggctgctgaacaatggaggcgaaacggtggttttgccagttcagccagattgccaaagataaaacacagccaatcgtcaccatcaaacactgtcgatctcgtaatcggatgactcgcaataaccaaattaataataatccggctgccagccattgttggtcaactaaccaactactaagtaagccgcacgcaatggcggcaaaaaatagtgcgcgcaattagtcacgatctaacaagatttgatcaagattcagcttatccaaatctgattggtcgaactgaacttgttgtaaagccacgtgttttcgttcaattaaggacatggcatacgcatcgttatgataattacgtaaataatgaattttttgaattccagcttgtaataacattttcgtgcattgtaaacatggaaagtcagtgacatagatttcagcaccatccgtagctgcaccgaattttgcacactgcaaaatcgcattcatttccgcgtgaatagtgcgaacacagtgcccatcaacaaggtaacacccctcatcgatacaatgaacatcgccggatactgaaccattgtaaccacccgcaataatgcgtttgtcgcgaacaatcgtggcaccaaccgaaagccgctcacacgtgcttcgactcgccaataagaccgcctgcatcataaaatactgatcccatggaattcgttgatctttcatcattttatgcctcactttcaatgacagtagtataccaaaatgtgcgctttgaaactagacggtgagctggtctttgtatttggccacagtcttttctccaaagccgctgacgtttttcaaatcatcaattgttttaaaattaccatgttgctggcgataatcaatgattttttcagccttcttctgcccgattccgctcaacgtttgcagcgcggccacatcagccgtgttgagattgaccttatccgttgccgcatgattactagttggtgttccgccagtaggccccgttgactggacgactggtggcgcaacagccggggcctgttcgcccttagctggcacgtagatcacttgctgatcagtcactttggcagccaagttgatctgctgagcatctgcctgtggctgcatgccttgtgccagttggatgacatccgcgacccgcatactagcagtaacctgatacaaccctggtttattaaccgcacccttaatatcgacatacccgggtgaactagcacctgtcggtcgggctgggctcggtgtagcgttcgacggttgggtactcgttgcgggctggtcagcattggcagacgttcgactcgcgcctcccattgatgtggaattgaacgaatgcgccaacaagttatccgtaccggcgggttgaggctgcttaagttgactcagtgcccatcccgttatcaaaataatgatcacggcagtaacaccaccaacaatccgccagtgcattttgagcagcttaatccaatctatcatttgttttcaccccttcagcgaatagttacgcaaaaggagcggctgcccatgaaaaaagtttgggttttaccccaaactttgctaacttgcatttcaattttactattggtgtgtctgcaaataatgaacggcctgtttaaatgaggtcactggaacaactttcatattaggcgcgtactttttcgcggtcgctttagcaagttgatagttagtttgacccttttcttcaaccgccaaaagcgctttggttggtttcacatacggtgcaaagaaaattgtcgcccctgcccgcttagcagcaatcactttcttgtcgataccaccaatttcaccaacttgtccattttgatcgatggtgccggtccccgcaatcttccgtccgtgtcgcaaattctgattagtcaattgctgatagatttgcaagctaaacatcaatccggccgagggacccccgatttgtccgggatcaaccttaaccggaatagtcgtcgtcactttaatattatcagttaggccgataccaatcccggcgcggtgcgtgctcagcttgattaggggcgcacttgcttgcttcaaatggccctttcgccgatacgtgatcgtcactcgatgtccgacgccctgcttaccaatataatgctgatacgcactggctgtattaaaatggtggccatcgactttcgtaatcgtatcgccaacttttaactggtttctaaattttgaattagactgaaccgttaaaacgtagataccctgataaaccttgcggtattgctgatgcgcagccgaatacgccgtcgcgatagcttcgttgattgcacttcgcatataaaacttctgaacccgattataagtcgcgtcatcctgaccgccagtcatatcctgagcactgaccacgtcatagtgcggattcaattgtgcgtaaagccacaacagcggcgtcgctcgagcttctgcgaccgaggtcaacataaacttaccccggtgatgatccggatgccgcttgacggtcacaaaagtcttcaaattatttgcacttccgggtccttcaatatagtacggtaaaggaattagaaatagtgcaagtaccaccagtatcacgaccagcaagccccagtaacgttttaacaactcccggcccttagtcatgctgatcagttcctaaccgctgatggagtttttgtgccaccgcggtcgggacgtacttggaaacgtccgctcccatcttggcaacttccttaattaagctggaagaaaagtaagcgtacgggggccgtgcaatcaagcaaatcgtttcgatcgtctcgtctaatgacttgttcatccaagcgatatcacgttcatacccgaaatcctgttcattccgcaaacctcgtaccaaaactgtcgcatggacactcgccataaagtcaacggtcaaaccagttgcggcctgaacttcaacgttgggtaaacccgtcagctcatcactgatcatcgcgactttttccgtcatcgtaaataacggttgcttactcgtattgaccatgacggccacaatcaaccggtcaactaatcgactggcacgttgaatcatatccaagtggccccgtgtgattgggtcgaaactccctggaaaaactgctgtcaccataacttacccgacctccattactttttggtaaatggtaatgaccgtaataccgtaatcttgttgtctgatcaattcaaatccgggtaagaccgttggcaagttcgcattcgtatccgtctcacaaatgacccggcaacccggattcagcaatcctagtgcatcacaatgctgaatatccttcacaatctgttgcttggcatagggtgggtctaaaaacacccaatcaaagtgttcatcttgggatgctaatcggtccaaaatacgctcagcatcgcctttgataacttcaaatcgttcgggggcctttgtaacggcaatgttatccttgatcgtcttgatggcttgatactgccgatcaatcaagacggcccgagccactccgcgtgatacagcttcgatactcaagccaccgctcccagcaaataagtctagggactgcccaccatcgaaataggggccaataatattaaaaacagcttctttaaccttgtccgtcgtcggccgagtttgcatgcctggcacggctttgagccgccgaccaccaaagtctcctgctacaattcgcatttcatcttcaccaacttaatcctcatcatcgtcatcaggcgcaccagtcgtggttggcttaaaaaagccttgatccacacgttcgccaaagttcattgcaacgtccgggcggtatgacggttcaaccctgcggacaaaatttaattttttgattttcgtggtcgcggccggaatttgactttcatccatgtacaagaccacataatgctctttacgcgattggtattgaattaatccaaaacgtttcaattgacgcacctgcttcatcgaatgcatataaacgatgagcgaccggcgcggtttaactgtaaaatccatcgaacctcacctcttctactagcgttgctgtttaaatgttaggctagattcagcatttcgtcaactaagttcttaactacgcagtggtttttattggcgaagcgctgaagctaaaaaacactagtaacctaagccactagtgtttttgcttgaaatatccttattgtggtgcaatctcgagcagtaagtcatccgtctgaatgacgtcacccgcattaacataaatatgttcgatgaccccatcttccggtgcctgaatggttgtctccatcttcattgcttccgtcacaagtaatggctcacctttcttaaccgtttggcccttcttaactaacagtttcagaactgaaccactcatcgttgcgccaacttcatcttcattagttggttccgccttgcgcgtgctggttgccgattggtgaatggcattgtccttgaccataatctcttgattttgaccattgatactaaagtaaagtgtccggacaccatcgacatcgggatcactaatctgattaagcttgacgatcatcgtcttacctttggctaactcaatattgaccgtctcaccgaaccgcatgccttggaaaaaggtcggtgtgtctaacagtgatacgtgcccgtagcgcttatggctagcgtcgtaatccatgaatactttcgggtacaggatgtagctgagcacttcctgatggctcgcttcatgaccaagcttagccgatagctctgctttgaccgcagcaaagtcagctggtttggctaaactaccgggccgcacagtcaacgctggctggcctttcaagacaatctgctggagcttctttggaaagcctccgactggttgaccaagattgccagcaaagaagttgatgaccgatgccgggaaatcgagcttggtaccctgattataaacatcgtccggtgtcaagtgattttccatcatgaacagggccatgtcaccaacaactttagagctgggcgtaactttgataatatcaccaaacatatcattgaccgtcgcatacatcgtcttaacttcttcccaacgatccccgagaccaacagccttagcttgttgctgcaagttagaatattgtccacccggcatctgcgtctgataaatatctgtctgtggtccggtcataccgttcgagaagtcttggtagtatggccgtacgccttgccaataccgattgatggcttcaacgttgttaatatcaacatcaggttgacgatcattgtgggctaatgcgtaatacaacgaactcattgatggttggctggtcgtgcctgatagcgcactcgcagcaacatcgaccacgtcaacaccagcttccactgctcgggcataggtaaagattccattaccagtcgtatcatgcgtatgcagatgaactggcacggacagcgcgtctttcaacgtcgatactaattcataggcggcctctggctttaacacacccgccatatccttgatggcaataatatcggcaccagttgattgtagatccaaggccagctgacggtaataatcaagattgtatttttgccgatcagggtccataatgtcgcccgtataacaaatcgtggcttccgcaatcttcccggtttccttgacggcctgaatactcttttccatttgaggaatccaattcaaactgtcaaaaatgcggaaaacatcaatgccactcttagctgcttctaagataaattcgcgaatcacattatctggatagttctggtaacccaccgcattggaaccacggaacaacatttggaagagtgtccggggcattgcctgccgaagttctttcagccgattccagggattttcatttagaaaacgataggccacatcgaacgtcgcaccaccccacatctcataggagaataactgtggcaacgctttttgtgaagccgcggcaacggctaacatatccttcgtccgcatccgcgttgcaaataaactctgatgcgcatcccgcatggtcgtatctgttaataacacttgcttctgggctaacaaccactgttgtaatccctggacaccttgttgatccaacacgtcttttgccgtgacgatgtcgggtgcgatcggttgaaaatcatccttaaactcaacgtccggatagtacttcttcgaatgttgggcaacgtcagcgaaaccattgaccgtcacatttccaatatacttcaacatcttatcttcacgttgcgtatcgtcagggaatttgaagagcgttggggtctgatcaataaaccgggtccccgcttcacctgcttggaacgttgggttgtcaatcacattcagcataaacggaatgttcgtcttcacgccgcgaatatcgaattcaactaggacgcgtcgcattttatgaacggccgctctgaagttccgcgccgcaacacaagcctttacaagcagtgaatcaaaataaggcgttacgattgcgccggaataggtattaccagcatccaaacgaaccccattaccacctggtgaccggtacgtctcgatgcgaccagtatctggcataaaatcatttgcgggatcttccgtcgtaattcgacactgaattgccgcacccttatatgtcaatgcgtcttgatgtggtaaccgtaaatcctcgaataggtcaccacccatcgcaattttgagctgagcatggacaatatcaatttcggtaatcatttctgtcaccgtatgttcaacttgaacccgcggattaacttccatgaagtagaattggtccccttcaaccaagaattcaaccgttgcggcgtttaaatagtgtacactcttcatcaagtcgactgcggcgttacagatcttttgacgcaactcgattggcagggccacggccggtgcaaattcaatcaccttttgattacggcgctgaacagaacagtcacgttcaaataaatgcatgacattgccgtgagcatccgctaaaatctggacttcaatgtgtttgggattcgcgatgaatttttccaagtaaatctcgtcatcgccaaaggattgcatggcctctgaacgggcacggtcaaaagcttcttgtaattcagaagcttcgtgaacgatgcgcattccccgaccgccaccacccatggcagctttgatcataattggataaccgtattgctgagtaaattgtaacgcctcgttcaggctagtaaccgggtgcaaggtactcggaatcgtctgcacgccggcatcgcgagccacacgtttggccgtaatcttatcaccaaacatctcgaggtgctctggcttaggaccaacgaaggtcatgccttcttcagcaatccgccgagcaaaagtagcattttcagataaaaagccgtaacctgggtgaatcgcatccacatgattttctttagcaatgcgaataatatcttcaatatccaggtaagccgcaatcggcgccttaccctcacctactaagtacgcttcatcagctttaaaacggtgaactgaaaactcatcttctttggcgtaaatcgcaacagtctgaaggcctaattcgtggcaagcacgaatgacccgggtcgcaatttcaccacggttagcaattaatactttcttcaccaaaatccctcatttccaaataaaatcgtcttagcctgcctgtcgaactgtattaaggcgcgccattttttcaagtgcactaatgtttaataccaatcctagtgaaagcgtcaataccatcatgctagaaccaccataactcatgaatgggaaggtcaccccagtaatcggaatcagaccaacgatcccacccacattaataaatgcttgaatggtcatgtaggctgcgacaccgtaacagaccaacgcgttgaacgtattagtcgcacgaaccccgatatagatcgtgcgcatcacgatgacaagtagtaagcccattacgattaaaatgccaattagtccgagttcttcggcagtgattgacataataaaatcagtgttcggttcgggtaaataaccacgtttttgcaaactattcccaatcccaacgcctgtcaaaccaccgtttgagatggcatagtaagagttgactaactgcgtccccgctcctgaagccgttttaaacggattcaggaaaccgagaaaccgccgtaactgataagaatttgcaaaagcactttggggcatgcgactcactaaaggcactaaaatccattcaaaggcagcgaccgccccagcaaagacaccaacacctacaaagtatgaaatgccactcgcaaacaaaataaccgccgcgatggctaaattaatcgtggccccaccaaggtcgggttgcacaaaaatcagtaaaatcatcgcgaacaacatcacaaactgagcacccaattcacggattcgagccaccccaaaatgtgcctcccgttgagaaataattgatgccaagtaaatgatcaggtaaaacttgcaaaattcagctggttggatcgagactggtcccaaaatgatccagccagccgccccattaattgattgaccaaccaatcggaggagaaccagaacaaataacatcgcaaaccctaacataccaagtaacttggtttgcttaaaatagtcgatcttcaaattcatacaaaccaaggtgatcactaagcctaagacgacccagatcagttgtttaactaaataaccggtgggtgtcgaaccgttttgtgcggctacgtatgaactcgatgaatagaccatgacaacgccgatcccgctgagaatcaaatacgggataaacagcacatagtccatatagtgtaactttttccacatgagcttaaatcccaccctaattaatatctcaattcgggttatcccccacaataacgcgaactgtttgcttgcaacaattatagcataagtcgattttaacacagcattttcacatattaatttgttgttttttaattaagtttggattactgatttacaaactagtgcgtttagcctcattagtaaccggctggccaacgcctccaaatcagtgtatttcccttaataaacgtacctagacgatttgaacaacccgcgccgttccggcacttgacgtcggaatgaatttatcgcgcattgccacccataacgcgataagcgcccccgcaagagccaacaatcgacaacgtgaacgataaaatagccgtggtaagccccatttaggacccaccacagctattttggattgctaaccgctcgttaacgatcaatttcgtgtcacgcactgggaacgattgcacgctcactcggcctcatctgccgcaatcgcggctcgcaacttacgctgataccaatccctaacacgctggatattcgcaactgcccgttcaaatgagaatgcgcccagtaatagcaggcacggtaagtactgaattaagtaccgactccgaccaccttcgaacaagaggaggaagataaacccaccaatcatcgccaaccggagcaattgaatcaattgccagcgcgggccaaaacccaacgcgataattacgagtagtactaaccaccacagttgcgccacaaaccgaaaatctgcaatatggcgaccgtataaataaataaagttttttaaccaattactaaagccctggttgcttggtttttgattttcgcgaaagaaattgccttccttcaaccagccaaaggtcccgtcagcagtattattgcgttgcttttttaccaagaattcaaggtaaccccacggtcccagtttcttgagctgacgcttcagcatcttgattgagtaagccgttttttgtgccttggtgggcaaaacggccatctgtatcgcctgcttttcactatacccgccggagccgtaaacgcccatggccataaaatgaatcgccggaatcgaccttgatttatcgattttgatatacgtctggttctggatggcctgattcgtataatgataagtgaggccggcactttcgagcatcaagattgccatggcgaccgtcacaaaaatcatcgtcgtttgtgaaccctgccgcgaccgcaaacgtgctaaaaagctgatgatggcaatggcgattaccggaataatggatgagggtttcatgaagtacgttaatgtcacgctcacgccaaacccaacggcggcggccacacgcagtaacggcggtcgcttcgtttgactcatcacaaaatagcacagcatgcaaaacgaaaccagcggcagtccccaagcatccgtatacggcataataatacttggaaaaaccgctaaccaaccagcgtgcagatacatagcgattcctaacgccgagcgtcgtaccacaaatacgctcattaaattgaaagctgctgaaagatcgacaaaaaacagcgtcacgtaatcaaaaaattgccatgaagtttgaccagtcacttccgatagccagtgcataaaaagcatgattggcatgttgttttgattaagactgtaatacgccgtcacgcccacctcctggacgtgtttcgcactggtagccgcatagtggagcatcccagcgtcaaaaccactgacgggatggacaaatgtcacgaatacgagctgaccaataaaaacgagtgctaacaagacaccagccgtccagagctgatttgtgattaatagtcgatatagcacccgatgaacgcgcggatacgcatagttcataatcaacacggcgacaatcacaataatcaaccccgtcgtcaataaggtcgtactcgtcccaaacgtctcgttatcccctaaaataatattcggcgacattactgcaaataacaacattggtgcaaatagtaaccaccaaacgctcgtaatcatcttctgactaaattgataaaaataacatctcatcattaatctacttcgtttgaattcttgcacctgaactaaacaatcaagatattccgccaacttcgcgtgatatcttgtagtcagccaacacgtgccgcttcaactcattttcctttccggcgtcgatagtgattgtgaattgtacgcctatcatcacgtaagacggccaacaatcgttgccattcttcggtgaacccccgcattttccaagttgcctgggtcgtcatcgcattgataacaccaatcaatcgaatccaagctgtcaaaaacatataaagtggcagcgttaatgttagccaccataaatgcttgtagaaatggcgttcttcaggatacggctttaataaaataccaacactaataaagttaataacccctaccatgacgtataaactatagatcaagagatatgagagccccacgaccacagttgaatagccaaaagcaatcaaaacaatcgtcgcaaaagtccaaatcattcgtggaaacgtaaacgtgtgatcaatcataattcgccgcaccaaaaattctttgaaaaagcccttgatgctagctgtttgtgacatataatgttgtgcaacttccagttcaccacgttgccagcgctggcgttgcgtatataactcagaaaagcctgaaattggcgctacataaaaaatagcatctgcacaaataacgacctttttgcctaaacgtgtccgaatctgaaacgtcatgtccgtgtcctcaccgattgtatcggtgtcatacaagaaagtttccattaacacttcccgtcgaaatgccgagaaagctcctgacatggtaaacaactggtcgcggaacgactcgatggtacggccagaaagaaaagcctgtgcatattcgtaatactcatttttagccaacagccgatgccaccaaccatgaacttgcttaaccaagtttctttgtgggagcactgccccggtcatggccgcaatctgctcatcgttctcgaaccgtagtaccatatttttaatcgcgttgggttccaataaaccatcactatcaatattaatgacataactaccaatactctcgtaaatggccgcgttaagcgcgcgagctttccccttgtcagtattgacataccgtaaaaataaattaggaaacgcattttgggcgcgagcatacgccccaaaactatcatcggtactctgattattcgccaaaataatttgcatgctttttttatcatacgtttgatgatcgatggaacgaatgcagtcaaataacgtatcttcagaattataaaccggtacaatgatggttacccacggccacttagcaggcgctttaagccggggcatgtggcgatgtagtcgcattaacttaatagtcgacataattgccggaataatttccaccacgatcggcactaaggcccaggtaatccaaaaccccattctagtcagcgctaagtttatccagtacatcacaggattcgctccctccaatcaataaactgctgataaagtcctcgagctaactgtgaataggtaaaaacattgtaatataagacaatgaccagaacatagaacagtaaccgcccaatcactgaatgagccagaaagaatgtttgaccaccgccaaagtgaacaatcacaatcactacggacaggcgtaatacattaatcaagtaaatatacaacaatccaaaaacaccataaaacaccttttcacggcgctggtaagccgggtaaaaggctactagcgaaataaatgcgcacgtctcaatgattcccgagcattcataatcaatcgacatgattaccggattaccactattaataatgtagaccaggcccattttgaacataatactgcaccaaccggtaatatcactaaacagcgctaccccatgaatcacagcgtgggtaaaaaaccacacccaatacggacgactaattgccgtcaagataaaaaagagcccggcgcttcccacaatgaagtagaaggcagatagccgagcccgtttgagcactgacagtccgtataaccatatcacaatccctagtaggatctttacattcatcgtacatcagtcctattaattagcttaccgacgcgcctaagccgccggtggttataaattgattgtcagtaaattaaatatcattagttcaatagttatcgattcaattcacatcgtacaagttaatctatctttaatcatgattaaaacatgccaattttagattcctgttcatcagccggtgcgcgtcctatgccgacctccggggctgggtgccaattgctggaacgcagccgacgtcgatttgagctaacgcataacccgcgtcatctcaaatacgagtcttattctaagctggaagaaagacacttccgactaagaataatttggctactgagcattgtcacccagcccctccggtcgggaagccgctcgaatgcctaatgaacgaccatcgaactcggtacaatttgttgttcgctattttgatactggaattttaaacaaagcgttaggtgtattaagcactccgtcaagagattaaatctcactacaacaatttaggattagtgagctatctcaatatcattttcagtctgacagttgattgacaaaattatggtttatgaaaaacaatgacgaattcaccaaaagttgggtacgcacatgtccgccattcgaacactgtcccgactggaaggcgtttcggccaatgctcagcggtgaaattccacttagcaagcgtccttggcttggttagtggaagaccagtatttaagacgtgggttgcggcttaaatctgtgtccaccgcgttccagcaattggcagaaatgcctggaagtcggcttaggacgaaccagcaaaacaagtttacaccaactcgtatctatttccagcgggtttaagctggctgcttctgaatttaaaggaacggcacgttttaatcgtggttaatgctaaataataacgagcacaacatgttatcaatcatcagttcttagtggtcggtaaatccgttgcagttaatcgacgccgcttgcggaatttaaagtatccccaagcaacgattacgacaccgacaccggaaattacgtacggaccagttgagcccccggccacggtcattttttgattaccaatattcggattggacatcgtaatcgtttggccggtcatcgttgaaatatcgaacttgctcaagtccactcggaattcagcaatcgaatgtgaaccggcttgagaaacatacccgttgccgaccgtcccgtactgatggccctcattgtacttaccacccgtaaatgagacagctttgaccgccccgtcactttgcgagctaggcatctcattggaccacacgtaatacttctgaccaccaatgtcgaaattataatccccgtaaccgggaacctgtccatacttcatcttgacataaacgtagacgtactttccgtcactaaccattgccatataaccgttataaccctcggtcaaagtcacgttcttccaatcattaaagttaccatcgattttaatgttgagattatcattgtcattggctgcattattgtccgtcgtcgaggacgccttggaagagaccgtgcttttatcagtaattaccccagctgagctagttgctgaggaactggctgcactactggtgctagtcgtagaacttgaactagttgtagaattcgcatttgtacttgaactggtactactacttgagctagttgaagtcgccgtaattgttccaacagtgctagtcgtagagtcactaccgatattcggattgaccatcgaaatctgcttaccactcgcactgtcagttaatcctaacttggttaagtcaatctgaaattcggcataattatgcgaaccgtcgttggtcacatatcccgtcccgacagttccatactgagtaccatcgtaccatcgttccatttaccaccagttaatgtgaaggacttgaccgttcccgagctaacactacctgaaatattcttagaccaaatataatacgtcttaccatcaatagtgaaattatagtcgccatatcctggcacagcaccatttttcatcttgacgtaaacattgacatactggccagcactcgtgagtgccgtgtaaccattatagccctccgttaacgtcgcatctttccagtcgttcatcttgccatcaatggtgatgttggcgctagcatgcgctgcggtcgtcatttcaggattgatcattgttgcccccgttacccccaaaacgagcatgcctaagatcatcaacttattaatttttttcacgatgatcacacctcccaagttcaataccattttaacgggtaacgaagaccatcagactctttttaccctataagctaatactatactctggataacaatttatcaatcattatttccatactaaatgaacccaataaccattaatggggcaactatttgagttggtgattaaacgactcctcttcaaaccgctttggacgatacagccttaggcatgccagtaccaaaaaagcacgccctattaaggacgtgcttccaagcaaccaacttacttgttcattttacgctttttagcttctttttcacgggagttcgtgttcaaaatgcgtttccgcaagcgaacatgatctggcgtaatttcacagaattcatcactattcaagaattcaagcgattcttccaatgtcaaatgcgttggcgtcttgattgtcgccgtcaaatccttgttagaagaacgcacgttggtcatgttcttacccttagtaatgttaactgaaatgtcattttcgcggctgttttggcccacgatcataccttcatatacttcggtacctggatcaacaaaaatcgttccccggtcttcgattcccattgtggcgtatgtcgtagtcttaccctggttgattgaaaccaaagcaccgttacgacggcctgggttccagttaggaataactgggaggtattcagagaaagtatggttcatgattccgtaaccacgcgtcaatgaaaggaattcagttgaataaccgatcaagcctcgtgaaggtgctaagaaagtcaaccgggtttggttattaccagtactttccatgttcttcatttcagccttacgctttgataaggtatcaataattgaaccagtatattcgtctggcgtatcgatttgaacagattcaaatggttcgcaacgcttaccatcaatttcgcgatagataacttctggacgagatgcttgtagttcataaccttcacgccgtaacgtttcgattaagattgacaaatgcaattccccacgaccagaaacgacccatgaaccaggttcgtcagtatcatcgactcgaagtgaaacatcggtttcaagttcagccttcaaccgcatttcaagttgacgggcagttacgaacttaccttccttacccgcaaatggtgaggagttcgtaccgaaagtcatttgtaaagttggttcgtcaatccgtaagattggcaaagcttccggattagctgaatcagcgaccgtttcaccaacgttgatatcttccatcccagaaacagcaactaagtcaccggcgtgggcttcattgatttccaaacgttgaagaccaaagaacccaaacaacttagttacgcggaaattcttcttactaccatcgagtttcatgacagaaacactgtcaccaaccttgatcgtaccacggaagacccgaccgataccaacccgaccaacataatcgttgtagtctaataaggccacttggaattgtaaaggttcgtcagagttgtcaattggtgatgggatcgtcttgatgatcgtatcgaagattggttgcatcgtatgttcctgcttagcaggatctgattcataactagaagtcccatttaaagctgaaacatagaccactgggaagtctaattgtgattcgtcagcacctaattcgatgaagaggtctaacacttcgtcaacgacctcttcaggacgtgcaccggggcggtcgattttgttaataacaacgattggtgttaggtgttgttccaaagcttttttcaaaacaaaccgagtttgaggcatcgttccttcaaacgcatcaacaacgagtaataccccgtcaaccatgcgcatgattcgttcaacttcaccaccgaagtcagcatgtcctggtgtatctagaatgttaatttgtttgtcgccgtaacgtacggccgtgtttttcgaaaggatcgtgataccgcgttccttttcaatggcattagtgtccatcgcccgatcgtcaatctggacatgttcgtcaagggtatccgattgtttaagcatttcgttaaccaacgtcgttttaccgtggtcaacgtgggcaataatggcaatgttgcggatatcatctctaaatttcaaaattgatcttcctttcatccttcaaaattctgactatcttcgacagcagaaatcttacatatattaatacaatccgccgttactatcaagtcatagcttcaacttgaaaccttcataacgacgttttcagcggctttcatccattgacataaaaaaactgtgacatatgggtcacagtcccactacttactagacgattgccaaaattgagcgttgtgcgcgctttgtcgctatcagtacagcacccgatgataacatattaaccgggttgccgtcaactctagacacaaccaagccaaggctttccgcgagaacgcgaccagccgcaaaatcccatggtcgcaagtatgacaggtagccgaccagttcgcccgctaagacctggctaatttgaataccagcactacccataatccgtggtcccagtgatttggcaataatcgtctgcatattgaagtggtcttgaattagtaacggcgcactcgcaccaaacagccccgcactcagatcaacatccgcgggtgcagccagcaattcaccgttaagcgtgacgccgacttcaggaccaccagcatataatttattcgccatgacatcaaagatatatcccagtgttggtttaccgtcaacatacaagcccaccatcatcgcaaaatgattacgctgatgcacaaaattcatggtaccgtcgattgggtcaacgatccagacgtgaccattcatatcagtaacttggtcgccggttccttcctcagctaaaatcttcgcaactggatccaaggctcgaatctgacgcaccaaaaaatcttcattgctatgatccacgttagtgaccaaatcacgccgactcgtcttctccgcaaccgtcaagtgggtgcccatcttcgccaacacttgcgctctcgcagtttgcatcacgacttgcattttctgatttaactgtttcaccacattcgtttgcacgttaagtcacctagtctcggtattgaaatcgctgcttgttagtttcctgagctgcgcgcattgtttgataaatccgataacctgaagcagcctcataatcacgagccagtcgtttttcttccgacttagccggaacgaccgtcttaaaatcacgataggctgccaacaggtctgctgtagcgattgttccttcattagcggcctcgatggcttgataaaaggtcgtaaccttaatgatctcggccgtggtccacgtctcatccagtggatattggtaattatcattgtgtttaggcatcttcatccaactcccccgccgtgacccggtcaagttcctcttgaacctggctcgcaatctcagcgtattctttctgctcttcatcagatagcaccatatccgccattcgtttgattccgttagcactaatcagtaccggtgatgataatccaaccagctggtcgtcatcgactggtgtttggatatttgtgacggtaccgataaacggtgtctgggcgtaaaacgcattgagcacttgtactaatgctaacacactcaaggtctgattagtaacaatcgtggggtcgtcgatctgctccgtcgctgcactcatttcgtccatcccaaaactaatatcctggttagccaaataagtcatcacgggcgccggcccaatatatgaacgactccatgagatcaggtgtgtcgccgcagttcccactacgaatgcgcggacatccgccgggccgacacttaattgctgacgtagtagttgctccaataaacgactctgcggcaaagtacccaatccgaccactttagaatgatcaatgccactgaaacgcgcagctaagacacttaaaaccgcatcattgctaccagccaaaataatttttccgttaaaaccagcgcccatcgcatcattcacaaacgcgcgaaatagcggcaaagtcgcctttaaatcaccactggcatcacggtcgcttgccaatggcactaaatttccaataatcaagctatctgcttgcgaataatccggcttagcttgcgccactagtgtaaactgacgacaagttaaactcgctgttaccagtgcttggtagcgcggcgcttcttcagcacccgttgcgaccactaatttcactggcaaatctttggcaattgcgactaatattaattgttgtacgaactcgaataatccccgaataattactgtattaatcatttcaatccctccaaccttcgataataattgtacctgagctgtcaatgaattcaagtaaatgttaataaaaagcttactcttttgtaacatttttgcgtaaccaattggtccacttccccccgaagcaaacacattttgatatgttattaatatagaccactacatgctaaaaagttagcaatttgaataacaacatccgcatcaggttcaaaggcgtcacttacggatcagctgagtaatgattaacaagactgaccttcattgcgcctgacagcgcgttaagttacgtttttacgtgactatcttgactggtacttcggtaatccatactggctgcaacatcctatgtaaaataaaagtttgagactcacgcctcaaacttttattaagccatcatccgctttagatgtgcgttgggtaacccatcgcttcatccgccgcttcttgaactacttcacctagggtcgggtgtggatgaatcgtcaaagcaaggtcttcgacattcatcccaccattgaccgcaacgcttaattcagaaatcaaatcactggcacctggtccggcaatttgggcgccgacaatggtgccttcgtccttcgtactgacaagacggaagaagccgtccatggcgttcaacgagattgcacgaccattaccagcaaatgggaacttcgacgtcttcacttgcaagccggcttcttcagcttcagccttcgtcatgccaactgttgccaattctggatcagtaaagcaaactgccggaattgaaacgtagtcgttcgccgtcttcttgccactgattgcaccagcagcaactttggcttcagcaaaagctttgtgtgccagcgcagcaccggcgacaatatctccgattgcgaaaatatcctcagcggccgtccgcccctgttcatcaacttcgatcaagccgcgcttcgttaacttgacgtcagtgtattccaagcccatgtcgtcagtattaggccgccgaccaaccgtgaccataacatagtcagcatgaatctcagtttctttcccgtcgacagcgtaggtaaccgtaacgccactatcatcttgttcggagtttttagccatcgcattagtaatgacatcaacccccttcttcttaaagctgttcaagacaagcttgaccatatctttttcgaagttaggtaagatttgcggtgtcccttcaagaatcgtcacgtgagcaccgaggttggcataggcaccagccaactcagaaccaatgtacccaccaccgataaccactaattctttaggcacttcgggcaaattcaagccacccgtcgagtcaacgacccgaccactgaacttgaagcccggaatttcaactggccgtgaaccagttgcgatgatcaaatgtttgaatttataagtctgaccagtatggtcaccattcatcacccgtaaggtatgattatcatgcatataggcttccccacggaccacttccaccttatgcttcttgagcagcatttcaacgccaccagtcaaccgatcaacaacttgatggtctttccagtcctgggtcactttaaaatccaacaccggatcctgaatatttttaataccaaagatcttactgtccttggcttcttgtagccgatgaccagcactgatcaaagcttttgatggaatacaaccaacgttaaggcagacaccaccgatatattccttttccaccacggtgactttttggccgagttccgcggcccgaatcgcagcgacgtaacccccagggcccgcgccgatgatcattgtatcgcgttcttcagcaaaatctcctacaaccattctgacctcatccttccatcaaaagtaattctggatcatgtaacaattgcttcaataagttcattgcccgttgtgctgttgcaccatcaatcagacggtgatcaaaactcaaggacaacttctgcatcttaccaacaacgatttcaccatcgtcattgacgtaaggttccttaccgatacgcccaacacctaaaatggcaacttccggttggttgataactggggtaaaccagccgccaccaattgagccaatattactaatagtaatagacccaccactcatttcactggcctttaacttgccatcgtaagctttttgcgtattgtcagtaatttctttggcaattgcaaacaagcccttaccttcagcgtgcttaatatttggcactaacaatccacggtcagtatcggtagctaccccaatattgaagtagtgtttgtaaacaatttccttgtttgcatcatcgatcgacgcgttcaattctgggaattgttgtaaaaccgcaaccaaagctttcacgaagtatggtaagaaggtaagatggatgtcgcgatccaaagcaacttgcttgtacttcttccggtgtgccatcaacgcactcacttcaacttcatcaaataaagtaacatgtggcgcggtgtgtttactgttcaccatagccttagagattgccttccgaattggcgtcatcttttcacgcgtctctaattcaggtgtgtcagaaacatatggtttaactggtgttggtgctggtgcttcacttgcagccggagccgttgtcgctggcgtagctgccggtttagcacccgttgccgctggcgcacccgtgtaattgtcaatatcttgctttgtgatctgaccatgggcaccagttggcgtaactaacgtgatgtcaatgtccttatcacgtgcgtactggcgcactgatggcattgccaagacccgtttattaggattgcccgcagccggggttccagtcggttgtgctgatgttgcagcgggagtttcagctgcttcacttgccggggcttccgtcttagtagccgctggtgtttcagccttagccgctggcgcagcgtcgccagaaccatcgtcaatcgtgacgatcacatcaccaattttagccgtttcaccttctggaactaaaatatcaataactttaccacttactggcgatggtaattcttccaccgatttatcattttgaatttcaactagagaatcgtcttctttgacttcatcaccaggttttacgagccatgatgcaatttcgccttcttcaagaccttcaccaagctctggtaatttaaactcgtaagccattggataacttcctttcatgacagtctcaggtgactgtttttcgatgccgcgtcttgattaatagttcaagatttcgcgggtttttgcctcaatttcatcttcagctggtaaccaatcgtcttctgctaatccgaatgggtagaccgtatctggtgcgtacacccggccaactggggcactgagataaagcgcacctttttcagcaatcagtgaagcaacgttcgcagcaatcccagcctgtcgttgtgcttcttgaatcgcaacggcccgaccagtcttttgaacagacttgagaattgtttcttcatctaaaggtgacaaggtccgtaagtcaacaacttcaacggagatttcttctttttcgagcttttccgcaaccttcagtgactggttaacttgtgcactgtaagcaatcaaggaaatatcagtaccttcacgaaccacgtttgctttatctaacggaacggtataagcttcatccggaatatccgccttcattgaccggtataacttcaagttttcaaggaagaaaactggatcgttattccgaatagaagaaattaatagccccttggcatcgtaaggattagatggcgtcacgacccgcaaaccaggaatttgagctaaatagccttctaatgagtccgcgtgcatttctggtgtatgcgttccaccaccatatggtgatcgaatggtaatcggcatatgccgagtgccacctgtccggaaacgttcccgtgacatttgaccagcaattgaatccaaagtttcaaaaatgaatccaaggaattgaatttcagggattggccggaaaccttccaatgccagcccaattgataaaccgccaataccggattctgctaaaggagtgtcaaaaacacgatcttcaccaaattcggcttgcaggccatcagttgcccggaagaccccaccgtttttaccaacatcttcaccaaaaactaaggtcttttcgtctgacccgagttctaatcgaagtgcatcggtgatcgcttgaatatacgttttctttgacatgttacttcgactcctttgcttggaattccgtaatttgttgttgaatgttttgtggttgttcctcaaaaacattccccaagaattcggtcattttttgctttggtgcttcatctgcttgtttaacagcagccttgatatcttctttaacttgttcaacgtattcgttttcttgatcttctgaccaaacaccttgatcagtcaagtacttacggtaacgaatcaatggatcattatcgaaccaaggttgttcttcgtccttagtccggtaacgcttaggatcatccccagcattcgtatgcgggccaaaccggtatgtcagcgtttcaatcatgacaggaccgttgccagcagcagcgtattcccgggcggcctttgttacttcataaacagctaggaagtccatcccatcgacctgaacacttggaataccggcagcaactgctttttgagccaacgtcttcgcagctgtttgcttgcgccgtggtactgaaatggcataaccattgttttgaacaatgaagacggccggtgcttcgaaggctccggcaaagttcataccttcatagaagtcaccttgcgaagtcccaccatcaccagtataagtgtaggcaactttgtcttcggtaccgttctttttaatccctaaagccacaccggcagcttgtacgtattgagcgccgataataatctgtggtggcattgcatggaagtcttctggatattcgttacccaagacatgaccacgagaccacaggaacgctttgtaaacaggtagtccgtgttgaatcaattgtggaatatcacgataagcaggcattaaaacgtcggttttcttcatcgcggcgttactccccatctcactggcttcttggccctcagtcggcgcatagaatcctaagcgtccttgccgtgtcaaagcgttagaacgttgatgtaacgtccgttcccataacattaatttaaagaattcaacgagttgttcgtttgaatatttagagacaatttctggtttaattactttagcttgaccatccaatacttgcacgggctcaaagtctttcccaagtgcatcgcggatcgcaccaaaatcaacaattggtttttcgttgtccataaatgacacatccctttcatgaacgtacaaacgttgtgcatcgcaccgcgttcgtaatcgttttcataattacaagtctaatttaccattgcgtttcatcttttgcaagcccttccaaagagcgaaaagccggctttttctgtccaaatgattgtgaactatttaatttgtgcttaattctgttttcatctttttcataacgggcgctactttttggcgtaggcttatgataaactagatattaagtgtaaactgcgcgatcttaattttggaggtaattggaattgattaaaatgcgcgacattatccgcgaaggtaatcacacgttacgcgcggaagcaaagcaagttaaatttccgttgagtgaagctgatcagaagttggccaatgacatgatggaatacttagaaaacagccaggatcccgaattggctaaaaaatacggactgcgtgccggtgttggtttagctgcaccgcaagtcgacgtttcggaacagatggctgctgtccttgttccgagtgaaaatgaagatgatgaaccggtctttaaagacgtcattatcaatcccgtgatcatcagtcactccgtccaacccggcgccttaactgaaggtgaaggttgtttatccgtcgaccgtgatattgctggctacgttattcgacacgatcggattacgttacgctactataatatggctggtgaagagaaaaagattcgtctcaagaattatccggccattgtttgtcaacatgaaattgatcatcttcatggtattttattctacgaccatatcaatggcgacaatccatttgccgctgatgatgatttagttctaatttcttaaagtcatttaaaaaagcagtcctgaaatgttcaggactgcttttttggtgcactcgaattcaaccgacgcaaatcttccaaatactctaaagtggcctcattcatcaaataggcaatatctaagtggagctgtccgctgcgcagccacgcatcagtcactcgtaacgctggtccagcttcccgaaaagcaaccacctgattgtgaattgcgtacgcttgcaattcgttattgaataatcgccgaacttctggcaaatcggccgtgaccatgcctggtgcatctagcacgtactcaaaggccatcacaccacgcccccagacgtctgcgacgggcaccgaatgaatcgcccccgcaacctcttgaatcgtcatcgcatttgcgagcactttgaatgctgctaccatcgcactatcaaccgttcgttggccagcccgccgaatcttcaacgccgcacgcttcagcacttgccgtcgcagcaattcataaacgacgattgccattagtaccccaccaatgattgttaaccaactctgcatgctcaaccctcaattctttttttgtataatgattcacaattttaggaatttttcattttattacttatgtttagcatagcatgtttcatcaaaaaaaattcttttaaccgctctatttttgaagaaagttaacattgtatacacccatctcaaattatgctaaaatgtaagataattgttgtgtttacacaacctggtgtacggatcaaacttttatttttgctatctatttagattacttagtatctaaataaatcttgtttatattaaggagttttacgcatgatttacaaagtatattaccaagaaaccaaagaacggaacccacaacgggaaacgacccaatctttgtatctcgaagctgagaccgaagtagcggcacggaccttagtggaagataatacagatcacaacatcgaatttatcgaaccgttagaaggtaacttcttggattacgaacaaaaaaatccagagtatcacctaacggagttcaataaatgaaacggttaaacgtcaaaaataacgaaaccgctgtttttgcagtcggcggtttgggagaaattgggaaaaatacctatggtatccaatttcaagatgagattattctgattgatgccggaattaaattccctgaagatgaacttctcggaattgattacgttattccagactattcttatctagttgcaaatcagcaaaaaataaaagctttagtgattacgcacggtcatgaagatcatatcggtgggattccattcctattaaaacagatcaacgtgccaatctatgccggccccctagccttagccttgattaagggtaagttagaggaacacgggttattaaaaacaactgaattacacgagatcaatgaagatacggtgctcaagttccgtaagacgcgtgtctcgttcttcagaacgacccattcaattcctgatacactgggaatcgccgttcaaacaccacctggcacgattgtagaaaccggagactataagttcgatctgacaccaattactaaccagccgccgaaccttcaaaagatggcgcatctcggtgaacgtggtgtcttggcgctaatgtcagacagtactaacgccgaacggccaatctggacgaaatctgaacggtgggtggcgcaatcaattcgccacatttttgaacaagttgaaggtcgaatcatctttgctacctttgcttctaacatctcgcggattcaagaggcagcgcaagtcgcccttgaacatcatcgtaaaatcgcggtatttgggcgtagtatggaagcagctatcgtcaacggacgtgaattaggctatttaaacattcctgacgaagccatcgttgatgctaacgatttacgctccctccccgccaataaagtcatgattctatgtactggttcccagggtgaaccaatggcggcgctctcgcgaattgccaacggtactcatcgccagatttctattgaacctggcgacaccgtgatcttttcaagttcaccgattcctggtaatacgttaagtgttaaccacgtaatcaacgaactcgaagaagccggtgcgaatgtcattcatggtaaagtcaataacattcatacatctggtcatggtggtcaggaagaacagaaactgatgctacggctgatgaaaccaaagttctttatgccgattcacggtgaatatcgaatgttgaagattcacaccgaactggccgaacaatgtggtgtgccactagaccatagttttatccttgaaaatggtgatgtgcttgcctttacgaaggattctgcccgggttgccggtcactttggtgctggcgatgtctatattgatggttctggaatcggcgatattggtaacgttgtgttacgcgaccgccaagtgctttcggaagaaggtttggttgttgtcgttgctaccatcaatttgaacaaaaaagagatccaagctggtccagatattctgtcacgtggttttgtctacatgcgcgagtctggcgatctaattaacgaagcccggcggcatgtcttccgtacgatccggcgcaaaatgaagtcggataaagcaaccgaagcgactatccgcaatgcgattattgacgacctgcagagtttcttatttgataagactgaacggcacccaatgattctgccaatgttgattatgaactaactacttgccggaacgatctcgttccggttttttatggtgtaagactgatatgaggtgtaattttgattgctgaatactacattattattaatgaactggcaggatctggtcacggtaaggtcgtttgggaaaccgtcaagccgattctagaacaacgacagattcgatttgaatatcgaatttctgaatatgccggccacacaattcggctcgcaaatgagtacgttaaaaccattcaacgacgaccaaacgtgaccccggtcattctggtcattggtggtgatggcacactgaacgaggccttgaatggtattatgcaggtcccacaagctgaaccgatcccgctcgcctacattcctggaggttcgggcaacgactttgctcgcggtctgggtatggcgactgatccagcaattgcacttgcacaagtactcaacaatatgcggccccgttcgttaaatgttggttatttccatgaaaccttgaaaaacgaacaccggtatttcgtcaacaacgttggtttaggatttgacgctcaaatcgttgatgacacaaaccgtagcaaaaagaagggccgtctgggtcgttgggcttatctcagtaacatgctggccgcatattcccaacaggaaggcttcccgctaaccgtacacgttaaccggaagcgagactattataagcgggctttcctttgtacagtctcgaacattccatactttggtggcggagttgaaattctgcctcaggctaatctgcacgatgatcagctcgaattaatcgttgtcgaagagcctcactggtggattatcctctggttgttcgtcttactgctactgggtggccgtcatctcaagtcgcgtttcgttcaccattatcgcaacgctaacttgcacttgttggttaactctgttgaaattggtcagatggatggtcaaattattgggaatcgtaactacgacctctacttgtccacccatccctacccattctggatcgacactagtatccatgaccaccactaactctactgctaaaacaatacaaattaacgataaaaagtcgttgcgaagatgctcgcaacgacttttttataggacccagattggcaattcatactacttgagcaccgtccacttaccggccagcaatgctaatgaccacttaattgactccccacccactcggctaataaaaaagactgctgaccatctcaatatggtcacacagtcagtcttgattaatcttagtcctcagaagcgttgattgcttccagaagcatgtcaagttgttcacatttacgagataagtgactcacccgttctttcaaatgcggataaatggtcacaacccgtgagcgatcctgttgccgaacggctagcgtccttaaatgatcgagttcggtattagcctcttgatattcttctagaatctcaaaacgattactcactgatagcacttccttatcacaatagatggtccaatttttcgaattgaaaaacgacaaacataatataccacaattattggtaagtttaaatcataaaattcaaaaaaatttaaataaaaatccccctaacacttaacaatatcgtgttagggggattagcaattaaaatcggcttacttaaccgtacctgcaaaacttggcatgaagtatgaactgattgtctgaacttgaacgttttggccttcagttggagccgcaacgtattgattatttccaatatagatggcatcgtgataagtgctaccacgactaccccagaataaaatatctccaggttgagcatccgcaacggaatgcgtcgtcacataagattcctgtgcaaccgtactatgtggcaaggtaatcccagctgcatgttggtaaacataggaaactaaaccagaacaatccattcccgaaagactcgcaccaccccaaacataagggatgttggcactagccaacttcagcgcaaggccggttacagaaccagtagctaaatcactcgttgaactagtagtggtactgctactattagtcgttgcggtactacttgcggtattgcttgcactgctagtggctgctgaagaactactctgactggtcgtgcttgaactagtcgctgccgagctactctggctggctgtactcgtagttgatgctgcactagcagctgtacttgatgcttgactagctgtgctagtagcagtcgtactgctagtactagttgcactcgcagttgaagcggtactttgactagtcgttgttgaactagcagctgatgaggacacgctactcgttactgaggcgctcgctgcaacactcttcgactgactggtagcagtcgaagaactagcactacttgctgatacggctgcactcgttgcgactgctttgaccggtgcatttgaggtcgtagccgttgatgaagcaatagagccggtcgatgatgatatcgttgacgtgctagtactgcttgctgagttcgcactgacagcatcctgacttgctgcactggtgctacttacaacgcttgcactcacacttgaaaccgaactcgcacttgtacttgaggtggaactcgcactaacagccgtcgtggccttggcagtcgtactcgtagttgacgctgcactagtagctgacacggttgttttttgactcgtcttagcggtcgtcttggtcgttgctcctggcacttgaatgttctgacccaccacaattaaatcgccagaaagaccatttaacgtctggagagcgtgaacagaagtgttgtacttatcagcaagcgcccaaagagtgtcacccgctttaacggtatatgtacccttagtagcggctttcttagttgctgacttagtcgtggcggtcttagttgcggatccaccaatttgtaagttttgaccaacataaattaaatcgatattaccatcagatgctttaatctggttaagtttttcaatactctgcacggaaacaccgtgttgttgagcgaggccccaaactgtatcgtttgcttttacagtgattgaggcagcattggcagcttggcctgtagcaagcaataaaccaacggcaccaaccgtactggctaggaccttgcccgttgtatgtgcttgtgacatttaattcactccttagtttttgaactcaaattaacagtaacaaaatcgtcttgtgactgaagattaagaaattcttaacctgcttttacaaatcataattttattgtagcacaatttaccaaagtacaaactagaatcgctcgtttttttacaaaacagtccggttattttaaaaaacgtttgccaatgccaaagcggcgtatttggctgttatagcaacgtttatgcatataaacggaatgttatcttttgattacttcaagtaattagttgcactgtttggacgagttacgctattcagtaaacgaacaaaaaagcacattaacctttttgtaggttaatgtgcttaaagttgcgagctagatgcgaggatcaaacaaccgatcaactggttgctgttcatgtactaatttgattgcatcacccaataatggaccaaccgaaagttgcaccaacttatcaaattgtttatccgctgggatctgaatcgtatccgtcacgatgactttctcgaacttggaagcctgtaatttagccactgcatcctgtgaaaagattgcgtgagtcgcacagccgtatacggtcgctgctcccgcttgtgctaaagcatctgccgagacatcgaaccgagttcccgtatcaatcatatcatcgatcacaatggcgacgcgccctttcacatcaccaataatactacttggcactaggtcatcatcatctgggtgtcgattatcaataatcgcaattggggcccccaatagttctgccatcttacgtgcccgcgaaacaccggcatgatctggtgacacgacgacgagattatcggtaatgccgcgatctttaaaataacttgccaagagtggggccgcaaataaatgatcaaccggaatatcaaagaatccttgaatctgtgcggcgtgcagatcgaccgtcaagactcgactggcccggtccttttccaataacgttgcaattaattttgcagtaatgggctcacgtgaacgcgctttgcgatcttgacgtgagtacccgtaataaggaataaccacgttaatttgactggcactagcacgtcttaaggcatcgatcatgatcaataattctaatattgtatcattgaccggttccgaaatagattgaatgacgaaaacttccgccccacgaatactttcttcgatgttgatctgaatttcaccatcactaaaccgctttacggaacttttgccgagtggaattccgacccgctgcgcaattttttcggctaacggtaggttcgaattcagggcaaacagtttcagtttggcataagattgatctgttgacataacgacctccataaaagttgtttgatgattttgctactttgattatagcagtaaccacggctaaaaaccgcacacaagcaaattttcttgcataatgagcgtcgccgacaatgtgtcgttcattgtaatttcagttgcaataaccaattaattatcaattagctacttgcggcatgaaattagctggcgtgataccattcatgccaatcatcggatcgattcggccagcgctgactagcgctggggtcaaaattgttggtccagcagactgggaactcggttcctgagttttttcagtggccgactcctcgtcagaagcaactttcttaaccgccgtcgctttttcgccggctggcattgcctctgcttggtcagtagtcgcaatagtggccgtttcatcggatacggtatccccgccaaagacttgttgtaaccgtttcgtcagtgtggtttggcgattaaccgattcattggtaacgctccgctcaaatgattgactatcacctaacaggatcagcatttgttcagcacgtgtcacggcagtatacagtagattgcgttgtagcatccgtgcaaattgtggtaccagtggcagaatcaccattttaaactggctcccttgagacttgtggatcgacatactgtacgctaatgtcaatcgattccattcattgcgttgataagtcacttcattttgatcaaaggcaatcgtgatctggtctttcttcgattcattgtgagaatcatttgccagatcgataccgacgattttaccaatgtcgccattaaaaacattatcctcgggtgaattaacgaggtgcaggaccttatcaccgacccgaaaatcttgaccgttatacgttagatgcttctgatgggcactcttcaacggattaaagattttctgaaccgtggtattcagctgatcgatcccggcagtgccgcgatacatcggagccagaatttggacctcctcagcactgaagcccttcgccttggcacgtgccacaacttgttcaacaatgtgattgacttgataagcgttgcaggcaataaatgagcgatccggttggttgacggcaaaatcggccggtaaatgaccatctttgatggcgtgggccaacggaataatactggaatcattgccctgccggtagattgtcgttaactcaatttggggcagttcactaaactgcaataaatcatgaaacacttgcccggctcctaccgatggcagttgatccttatcgccaacaagaatgacttgcatgtgacttggaatcgccgtcagtaactgctgaaacagtaccgtgtcaaccatcgacatttcgtcaataatcaggaggcccccatctaattccttactaggctcctcgggaccatcttcacgccccgtcaacccaagcaaccgatgaatagtactagctgggagcccagtcgtttcagccatccgcttggctgcccgtccagtcggtgccgccagcaggattggaaaaggcttatccttatactgattgatatctagtgcaacgtcgtgtaattccgcatagagcgcgactaagccacggataatggtcgttttaccagtccccggtcccccagttagtagaaaaacaggcgccgtaatcgccgcttttagtgcttcggtttgtgattcatcataagtaatgttgctagctcgaccgacatgctcgatagcatgatccacggcacgttcagacaatttttcatcattatcggcggctaacaaccgttgtaaatgttccgcaacgcgccactcggcttcatagaggccgcgcaagtagatacgattctcgtcacccacgattttattttccttcgccaagacgaccaactgatcagccagcttcgaaggatcaatttgaacattgcgagcattctcaagtagttgcaacgtttgattcagcaacggttgagccgtggtatacgtatcaccgttttccacgcacagctcattaatctcagtcaatagggccgcctttaaccggtcatccgcttggggatcaattttaagttgggccgcaatttgatccgcttttttgaacccgacgcctttgatatcctcaaccaaacagtacgggttctcttgaatcttagccaaagtgtcaccttgatagcgtgcatagatggccgcagctaaccgactcccaaaaccgtacgcattaagtccaatgatagtttgctccaaaccgttattgaccgtgagcgtgtcgatcaaagtcgtctgaacgctggcccgaagtccgattggttttaaaaccttcggatcagctaaaatttgatcaatggcatcttcgcccaaagtatcgacgattcgctcagcagtccgcttacccaacccaggaaaatcactaccagatagataggcaatcaagcctgcgcgtgtcgtgggcgtttcattttgataattatccgcttgaaactgaaccccgtatttgggatgcgtgaccgttttaccggtaaaacgatacgttgtctcctcctgaatatccgcaaaatttccagtaacaacgatctcatcttccgaccaatcaatgttctgttcagttactttgactaataagactttataaaaactatcggcactgctaaaaaaaacggcagcgactttaccgacgataaagtgtgtgaccggttcccgaccaatatcgtcggaaaataaatgtgcttgttcgtccgtcacggaaatcctcctaaattagtgattttgattatctgcttgtgcggctaacattttttcaatatccgttagctgttgctgatgacttttaaaatattgactgtccaatttctgcgcgcgttcaaaccaggtggcatacggtttccccagtaccattgcggtcagtccaaggttaaaagcagctcgcccagattgcgaatcaatcttatatgcgcgttgatagtaatccgatgcttgctgattattgcctaatgcaagtaatatgtctgctactaacaaattagcgtcaagttgttgtggacgtgcctcttgagccgtaatggcccagactagggcatgttggtaatcgtgttgggccattaaagcttgtgcactcattaaataagcatcctgttttagttgatcatccgtaatttgttgataatatggtaacgctttgtcataagtttgagcttgataatagacatttcccaacgcataacgcaggtagtcggctgcgggttgttggtggtcaaactttcccaacgccttcattgctaacgcctctgcctgttcaaaatcttgaccagccgttaataataccactagttcataataagcatggtagtcctcgggctgtgcatcaatcttgccaatgagttgatggactagtgcttgctgtttagctttgctaggacgtgatgtttttgccatccgaaccacttccttctatattaaatcgtatcagttgcatcgggccgccgtgataggtatgaggtgtcattccaatctaatagcttaaaatgttgaccacggtcacgcgtctctaaaattgttgttgacgtattcgacaagccaccccgttgccgtaacgtcgccagtgtcgctcccagtaatgagttgaccaaggcattcaaggccgcaccatgactaacgatcaaaacattgtcatcgcgacgtggatttgcttgaacaatttgcttaatagcgggagtcatccgcttcagcagttgttgaaagctctccccctgaatcgctgtcgggtcatactgatccggatgatttcgaaacgcgtcgaattcggccggatacgtagcttcaacatccgtgaaggccattccttccatcttaccgagattgaactcccgtaaacgactcagtaccgttatgggtaactctgattgtgtcaaatcattacgtagtgtcatcgctgtatcacgcgcccgttttaacggactgacatagatatgactaaaccgaatatcctggagcgccgctgccaattcatgaatttcttgataactagtcggtaataatggtgaatctccctgagagccttgatagcgcccctcaagattccactctgttttcccatggcgaacaaataatagttttgtcaattgcttacttccttactctagtgtcttgatttgatcttattttcgagcaatggcccctccaaactgaataacggttgcgatgattcagcagtatcattgcaactcatcgtcaatcgccgttaggccaaccctgttaatacttcaaatgacgtggcggatggtcgtgatacttcgtcacgctcgcaacacgtcttacgttctatattatgacagttttcagactgattttcaaaatctgttcacgaattttaacgatcatcacgctattatttgataaacacgatcagttgaccgggcatggtatcttttagccactaagtatgcaactgctacaccatactgccaatggctgttattcaccgtactactcagccgtaagagtaaatcgtcgtttttccaatctacttaataaaaatataattatgtaaactaaatcagccgaaccaagttcaactccagcattaccctgctttaacaaaaaagtggtaagtagctttgaaacactacttaccaccactaattattatgcagcgggcacaatcgccaaggtccaagtaataatgctttgatactcaccaggcgttgccaatggtgttgctggtaactgtaatgaactaggtgccacatcaaaagtttgactctgatgaccagtttgccggtaaacgctggttgtcgaaccatccgttggtatcgtttgattgagcactcccgtcgagtctttgagcattaaccgagccgtcttgattgttgtatttccagcagtaaagggactcagactcgccattaactgccagtcagccccaacagtccggtcatcaaccacggccaaccgatagtcattattaccgtcataaccgtcattagcttttacggccgtcgggtctgtcgccaagtcagtaccttgtgcgagtcgctgcaggtttaacgttccaaaattaaaattaggaacggcactcaatgataaccgcccaccactcttaactgttagcaaagcggcgttggtcgtcaccgtctgtggcttgccattgaccggatagcttagactcgcatagtaggccgttccatcatcatccgcattggtcggtaccttgaccgtataactcgtatccgtgacattgagggctgtagccttaccattcttgacacgataccaattgctaacagtcaccccctcgggcaatgctggtaatgtaaatgttgccggcgtcccttctacgaccgtcacatcttgtaacgctccaaccaaaattttgacgctatcactcagaccattagaggttccggtaatcgtgacagttccgtgatcatccgcttttccggaattatccgtggcggcatccgctgcggtcacattcccatattcatcaactgccgcaagtgacgggtcactactcttccaagtaattgaatccgttgcttcctctggcgtcagtgctgcatgtaccatggtcgtttgtgcattattgagccacgcgtcatcactcgtcactttgatgccagtcgttaccacccgggctggcgtgaccgtcactttcgcgattttggaccaataatcaggaaacgccccaacaccagagaaatcatactggacttgaaaataaagatgcgttgttttggtcacttgcggcgcattgaaagtataggttcgactattagtgccaatcttctgataggtttgcccctcatccgtcgattcccaccaaacgtacttgcgaccactcaacagacttgtcgccgcctcaagcgcactgcgctgggcccgaaccgacagcgttactgagttgccaccaatcacatttgaatcgattggctgttgtgaaaaaccgcccgatagattcaagcctaagacggaactcggtggactgcttggcgattggggcgccgttttggctgctaaggcactcgtgacgatacctaaaccaaccagcatacttatcaccattaggccacaagccttgatcaactttctcatcgttcctcactccttacgcgaacgccgctggccaaaccagtacgccgccattagaagtgctaagagaatgactagtgccactgcaccccacagccaccagttgacctgacgcggtccaaccagatgatgattatgttgttgcgtccgttctgcagtcaaggtaaagtcacgggtgaaatcccagacacgctggccgctcgttagatgcaattttagtcggtacttccctgcggctaagttttgcgtgcccaacgcgacttgatagttaaaccagctattcggtgccattgatcctgatttaagttgctgcgtggcaacggtttttcccgtcgtgcgttgaataacgcgtgcttgaattttgagttgtccaaaaagtgtcggcgtcagattacggagtttggcaaagagtactggttgcccattggtgggcgtcactttgacttcatcgaggactaacttaactggaatcgtcacttgcggctgacaccaaagcgccaccgctgtaacctctgcatagcgattcttcaacataaaaccttgactcgtcgttggccgggccgcattggcggttggattggtgacaaagaggccacctaacacctccccttggaacccagacttgggaatcgtggtcttaaaagccaccgttttcgcttgatgagccgctaacttaactacgacgccacttgacgtcatgtcagtaaacgtcgtcgtggcagatgggtcatgccgcttagacggcacgtacgcgacgctgcctgcatctgaggtcgttgcgttgaccggtgttacctgcaacgtaattgctgatttaccaggattgctgacggagactctgaacgttgacgtcgttcccggcgtgaccttcatattaaagtaacccgcctgcttatctagttgatccttgggcagtaggggtgtcagaataaaacccgatgcgggtgtgttagatgccgcttgaccaggtaatgaccctaaaagcccgcctagtagcaatgccaacactaataaccaccactgaccgatttgtttccatcgcattctaaacacccccacttcacttaatcattgaataacgacgcgcgatgatcagctgaacctatgaagctgcttttggtgttgctgcagctgctgctggtgcattttgaagcgtccagtaaagcgttgctgtgtaagttccagcagaaatattggactgcttaccgacttgcaatgaactgctcgtggcagtcgtcgctgtatttgaaccttcaccactatctgcagcagcattccataacgtttgtgggctcgcgacccatccgtttgtcacttcgctctgattcaaactcaatgcggtcggcgcggcagtattagcattgtcagcgttacccttggtcatattcaaattcaatgtggccgagtcaactttagccgctcccgaactaaacggtcccatcccaactgtcaacgtccagccagcatgatttccccgaaagtcgctaacgtttaaattgccactaccattgccatcatagccactgcctcccgacgtattgctacttgttgcatttaacgttgtggcagcagatgcaatattcttaacgttggtcgaacttaacgcgatatttggcacagcatccaacgttaattcaccgggcataaccgtgaattgtgcattcgataacgcttccgcattacccgtgctatccgcaacataaccagacgaaactgtcgtcaaattgttgcttgctgttccgggtccggccgctaacgccgctaggggcattagcgcaagtgatagtaaagttgcgccaccactcaacccggtcattaatttaaaagttcgcatgttgcttcctccttctcaatcgactgcttttccagtcgcctgctaccatattagtttactaatcactttatgattccgctttcaccgtcctcttcccctgacgccaaccatagtttatcatgtataccaatcgaaactgtgggttatgttttgattcattaactttccatattaattaaacgcctggtgataaccggccacaacgtggatacccagtcacccttgtaaccaaaaaaacatcaaggcccgttgtccttgatgtttttacatcattaattcatttatttttttaacgcttcatctaacgcaataacgcccttaactggaccaaccacagtaatcacatcatggagggccatcatatccgtcggcttgggcgagacatcaatgtgtttctcgtgtttgattgcaattaccgtcagaccaaaacgttgccggatctttaaatcgatcagattctgattaacaaagttcggatccgtaatctcgattgcggccaacgtatactcatcacttaagtcaataaagtttaaaatatggttggaaaggatgcggtgggcaatgccctgacccatatcacgttccggaaatacgacttggtcagcgccgacccgttcaaggacccgcccctggtcgctagtttcggccttggcgatgacctttttcgccccctgctccttgctcaacatcgtcgtcagaatactggcttccatattattgccaatcccaataatcacataatcaaacgtatcgacgttcaaatcacgcaacacctgctcgtcacgggtatcagcaatcattgtctgtgtcgccacgtccattagctcgttaactggttcttcgttaatatcaacggccaaaacatcctgatgagctgcggcaagagcccgaacaacactctcaccaaaccgtcctagaccaaatacagcaaaactttttcgcatgttgcccacctaaccaatcaaaatattttctgccggataacggatcaagttcaccctagcttgacgtctggaaagcgcgtagagtgacgtgaagatccccacccggccaataaacattagcatcatgattacaatcttcccaatcaaagtcagattgggcgtcaatcccaaactgagtccgacggttccaaatgctgataacacttcaaacaaaacgtattccaacccgaagcccttcggaattttttcagtctgcgttaagatcagtgttgccactgtcagcacaatactagccaagaaaatcagcattagcgcccgattgatattctcctgactaaaacgacgatgactaaactcaacatcacggcgaccacgtagctgggcaatactttggaacatcaaaacgccaaacgttgtcgtcttgatcccacccgcagtcgatccaggcgtcccaccaacgaacatcagaatcataatgaccaataaactccccgcttgcaatccttgagtaggcattgtgattaaacccgctgtccggggggtaacacttaaaaacagcgtattgatcgttcggttgacccacgacattccggttggcaacagttccaagtcacgttcagtgatcaacaacaagacaaaaccgatgacaaataaactgaaagttgtgagtaaggtcagtttggaatttaaagtcagtcgcttacgcgtatggtacagcagcacgtcacgccaaactaaaaatccaaggccacccgcaataattaggatcatcgtgaccgtcaagacgtatggatcattacgaaagccttgcagactatcgccaaacacatcaaaaccggcattacaaaatgacataaccgcatggtatagtgacacatacaatccgtgacgccaaccaaatcgaggtacaaaatcaattgcgagcaacccaagaccgcctagctgaaagagcagtgacaaacccacgacatacttcataacgcttttagtatcactcaatcgttccaaattcagggaggccttgaccatcaactgcgtagagagaccgatctgacgacgcataatattaaagaggagtaccgcaaaggtcatgtagcccagcgcaccgacctccgaaagtaccagaatcaccaattgaccaaacgttgtccagtgcgcagcagtattgacgacggtcagcccagtaatacatgtcgctgatgccgacgtaaacaacacatcgatcaacgacgtgtgcacgtttgctggcgtcgcccatgggaggctcagtaagactgtcccaatcagaattaagataataaaaccggctaccattttcttagatagcgtatcaaaaaatttaaaatgtgctaattgtctcataatcattccatcccacaacagcttatcgattataaccaatcagtccgattgatcatactccatttagcttaatcaacctagtcaagaaaagcaagtccgacctaagctttgacgtacgccggccacggccgacccaatacatacaaaaaaaaccgctaatcaagctcagcttgatcagcggtaaaccaattacgaactaaacatactgtaagacgcgctcatcattataagcagcgtcaatcataccggaacctaagcattcctcaccgttgtagaagacaacggcctgtccaggagtaatcgcccgaactggatcatcaaaagtcacggtaacttccgtgtggtcatcattaaaatgcaccgtcacaccagaatctttttgccggtaacggaactttgccgtcacgtggaagtcattacctaagtcttcatcagtcacaaagtgtaaatcggacgcctttaagtgggtcgcgtacaggtgcggattatggtagcccttgccaacatacagaatattcttcttcaaatctttgccgaccacgaaccatggctcgttatcctcgccatcaccaccgataccaagtccgcggcgctggccgatcgtgtaatacatcagcccggcgtgctcacccttcacctgaccatcgaaagtcatcatcttaccgggcgttgctggtaagtaatggcctaggaattccttgaagttcttttcgccaatgaagcagatcccaacggagtccttcttcttagctgttgccaagcccgcgtttaaagcaagcttacgaacgtcaggcttcaccatttcgccaagtgggaacatcaccttttgtaaggtcttcgaatccagctgacttaagaaataagtttggtccttgttgctgtcaacaccacgcaaaaggtgcatcgtgccatcttcatcatgttgtaaccgcgcgtaatgaccagtggcaatgtaatccgcccctaaatccatcgcgtaatctaaaaacgccttaaacttaatttctttgttgcagataacatcggggttcggtgtgcggcccttcttgtattcgtctaagaagtacgtgaagacccggtcccaatattccttctcgaagttaatcgagtaataaggaatcccaattttatctgccactttggcaacatctttataatcttcggtcgcggtacagacaccattttcgtccgtatcgtcccaattcttcataaacacgcccaccacgtcataaccttgctgcttcaagagcaacgccactacggatgaatcaacaccaccactcatgccgacaacgacacgcgtgttactgtgatcagtcatacttttcaccatcatttccaaaagattctggagaatccacgatttgaaggtcgtacaagtccagtaagttccattataacaaagaaaacgccggctgcaagccaggcgttccctgattagtccgtcgtgaggacatcccgttcaataaagttagctaaaatataccgtaattgttcaacagcttccggatgggcgtcatttttgaaaatatttgcccgttggacaccattgcccgttaccgtcgtcatcttaaacccagtcaaatccgcattgactgtcatcttcagcttgaaagccgcttgatagggtgaagtgggatccaaggaacgttcaaaactaaacgcgcccgagcgacctttcacaaaacccaaatccatcaacgtgtatttcttgaccgttggactcagcgtatacgtcttagtatccccatctagtttaaccgttgttgtgtatgccatcgtcacgccccctgctttttaataagcgctgcgtcgtcttcgtcagcaccgttacaaactgatccagatcagccttagtagtatagcgaccaaagctcaaccgaatcgactcgctgatccggggagagtcttcaccatacattgcaattaaaacgtgtgatggttctaggctccccgccgtacatgcggagcccccagaaactgcgacaccacctaagtccaggttagtttgcattgtataggtcgatacccctttgatccataagttcaaaacgtgttgcaagttatgctcaccgagggacccgttgacttcaaaatcaactccgttagccgttaactggtcaacgatgtattgcttgaactcacgatacttagcctgccggtgggctttctcagcggtcgtcagttcttgcacggccgtggcaaagcccgcgattgccgggatattttcagtaccggcacggcgcttatcttcctgttcgccacccttgacaaagctaggaaagttaatgccattgcgtctgtacaagaagcccaagaatttaggcccattgattttatgtgctgaggtggacaacatgtcaatatgatcccgttgcacatcaatatccaacaacccgtaggcctgcactgcatccgtatggaaccatgcctggtgatcctttaacaattcaccaatttcatggattggcatctgtgaaccaacttcattattcccggtcatgattgagacgagaatcgtatcaggacgtagtgccgccttcaaatcatccagactaatttgtccctgttcattcacgggtaaataagtaatctcaaacccatgttctgccaaaaaagcagtcgatttaagaatcgcttgatgttcgattgccgtcgtaataatatgcttgcctaaatgttggcgcgtccacgcggtctgcatcaccgccgtattatcactttctgtaccaccactggtaaagataatgtcatcgtcagctgcgttaatgctttgggcaatcacgtgccgactatcgtctaaaacttcacgggcggcccgaccgaatgcgtgggtgcttgaggcattaccaaacgtattcgtcatttgatccgtcatcgtctgaataacggacgctgccattggggtcgttgccgcattgtctaggtacacttgcttcattacatcatacttccttctaaataattcttagttattagcatcgctgcgatacatctgactaattttgcgccgcaaataatgcaagtaacatcgctgcggactgcttacccgcttccaggataaattcgtcaaaactaacaccggcattttcatcaccgacatcggacatcgcgcgaatcaccacatatggcgtctggaactggtgacaagcttgaccaattgcggcgccctccatttcactagatagtgcttctggaaagtgtgctaaaatcttatcggtagccgccttacctgcgataaattggtcaccggaaacaatcagtccagtcttggcattcaaaccggttgccttggccgctgccatgatttgctttacccaattggcatccgtttcgtagtatagtggctgttgtggtaattgaccatattcgtagtcaaaggccgtcgcatcaacatcgtgataagcagttgccttagctacgacaacgtcaccgacatgcaaaccagcgccaatcccacctgcagaaccagagttgatgacaacgtccacatcaaagttagtaatcattaaagccgtagtcataccagcttgcactttaccaatgcctgattgcactaagacaacttcctgctgatcaattgtcccatcatagaacgtaatatccttaatattaacgatcttttcgtcttgcaaagcgtcccgtaacgttttaagttcttcttccatcgcacaaataattccaaatttcatgtgagcctagcgcctactttctatggtgttaaaaataaaattaaaaagacaataataatcccaacgactagtccagcaatcgcccaattcaatttgcgggctagccgtttcgtcttggcttcttcaacagcccggttgttctcagcagcatacgcttgtcgggatgcactgggttcagccgttggtgattcttgctcctgagtatcgtgaccagttggctggctacgttgttgtcgatattgctgtctggtgagtcgatcatcatctgccactatgcttcaactcctaactcagggtgactttgccagtaccaaatcgccattacggttttggcatcctgaatctgaccagtctgaacttgactgacagccgtcgcgaggtccagcttgatgagcctaatttgttcgtcagggtcttgtgggaatgccgttgcaaccgcactcagaccggtagcaacgtacaacttcattagttcgtccgtaaacccgggtgacgtgtagaattgggcgactgcttctaagtgctgagctgtcaatcgggtttcctcatttaattcgcggacggccgcctggtccatggtctcaccggattcgaccttaccagctggaatctcgacggtcagcccaccggttgcagcgcgccactgttgttcaacaatcattttatgttgcgcggtaatcatcagcatcgcgacggccggctgatgtcgcacaatttcacgtgttgccgtcgtttgatctggtaaagtgacttcttgtcgttcgacctgtaccaacccgccttgataaaccaactgacgactctgaacccgttcctcaaatgtcattgatcaagaacccctttcagtgtctgctctctcaataaggataccgattttttagctcgattgcaattttcaactgggcgatttcggtaattttaacgaacccgcaaaaaatgggctaacgagcgaccaatttggctccttaacccatttttccaattcttaaaatcaagcggaccaattgacactaatcgccattaggcctttgcaaggttagcgacgaaatcttcataagcaacctgctcaccagtttccgttgcggtagctgggctgtagtcgccctgaagcgcatcttctaatggcaaagtcacgatccggacgaacgtcgcgttaccgatcaattccatccagtattcttcatcggcaccttggtgaacaacggttttgaccatcccaccaggattggtgacgtggatttcttgattaaaatcggtactttcttggtgtaataacacgtacatcaatgaggaagccgacatcgcagtcccacaagcattggtaaaaccaaccccgcgttcaaacgtgcgtacaaaaattgaatttggtcctaagacttccacaaaactaacgttgacgccatcagggaaaatttggtttttaccatcattcatccattcaccgatacgtcctaattcggggccaaccaacgtatcatggtcaacgaacgcaatcaaatgcggattaggcaccgccacagctgagaatttcaagtcagcagacagcgctggaatcttttcattaataattgtcgtcgcatcgttattcgcatgcatgccaagtgtctgcgcgtcgaaagttacgggtgaaatttcaacactgtaagctgggacgtgggccgcaaaatcagcaacggcctgcacctttaagtccgcatacatcgtctgaacccggaagtcttcctgactattttgcgtgcccaaataacgagcaacggtccgtagcccattaccgcacatgctagcttccgtcccgtccgcattaatgacccgcatccgaccaagtacttgtggatgttctgatttatcaacaaccaacacgccatcagcgccatcgtacaaacctgcgccgtcacgtttacaaatgttaattgccaattgcttcaaatccgcatccgataacggtgcttgaaattgtgtttgatccaataaataaaaatcgttaccagaaccgtgtaccttgatcattttcacagccatcaacatcctatctatataaaatcgaccttaatttaaactacttcattatcatactgactttttcatgaaaattcaattgcaaaggaccatttctcataataaccattcaaagtcctgcgcagcaactgtaaattcttaatagctcttaaatcttgcatccgaaaaacgcaatcagttttttacagctgtatctcaatcatcccggtgttcggatttactgactacttgataatccccacacgccagcacaaaaaagtgccactaatcagtcccgttcgactgattagtggcacttttcataagttatcaagactcacgctaaatctaattcagattaagcttccaaaccagttgttactgattcagggtagttttcacgaacgattgcggcgcaccgtgcacataacatcggataagcctcgtcactgccaacatcggtcttaaccattcggcaacgatcacaaacgtcaccgtcagcatggccaaccttgatggctaacgtgtcaccaaatgtttctgcgtctgcaggcgcgtcacttaacgcgtgtagatctaatgctgaaaccatcaacatctgccgaacattggtgctcaaatgatctaagaaggcttgcgtatcatcatcaacatacaaatccaagtgtgcttccaaggatttaccaatcaacttagcatcccgggcttcttccaacgcctttaagacgttactccgaagatccatgaaccgcgtccattgagccatcaactcgtcgctgttcgcataattttgaacagctgacatctcagctaattgcgcaaattcttctggttccttcaagaatggccaaatttcttcagtcgtgtgtggcagcattggtgtgaagagcttcgtcaaggcaaccaaaacatcgtagaagaccgtttgcatcgaccgccgtgaatggctatcctcggcatcaatgtacataatatccttggcaatatcgagatagaagtttgataaatcaaccgtcaagaagttgatcaacttcttgtagatatccaagaaatcataatgatcgtaatgatccttcgtctcagctacgaattcgttcaaccgtgtttccatgtactggtccacacttgctaaatcttcataagccacgcggttggtcttcggatcaaagtctgcggtgttgcctaacatgaagcgtaccgtattccggaacttcttgtaggaatcggctacttgcttaaagctttccattgagacccgaacgtcggaactggtatccactgaagcgacccacatccgaacgatttcagcacccatctgcttaataacatcagctggcgcaatcgtgttgcccagtgacttactcatcttacgaccttgattatccaacgtgaaaccttgtgacaagacttgcttgtatggggcatgtccagaaacagccacactcgtaatcaagcttgagttgaaccaaccacgatattggtcagaaccttcaaggtataagtcggctggatagtcgaggtatgagcgctctgccaggacaccttggtgtgatgaaccagagtcgaaccaaacatccataatatcggtttccttagtaaaggtaccgtttggtgaatgttcattggtataaccatctggcaataggtcctttgcgtcgcgttcgaaccaaacattcgaaccatacttgccaaataaatcagctacgtggttaatcgtcacttcgtccatgatggcagtgccatcttcagcatagaagattggaagaggtacaccccaaactcgttgccgtgaaatgacccagtcaccacgatcacgaatcatgttgtaaagacgctttttaccccactctgggaagaattcaacgtcatccatcgacttaaggatttcatcacgcatatcaccaacggaagcaaaccactgtggcgttgcccggaagataatcggcttcttagtccgccagtcaaatggatagctgtgttcgtatggcatatatttcagtaataacccagcggccttcaacttgtccagtgcgatcttgttagcgtcatcgtagaagacccccgcaaaatcatcaccagcttcagccgttaagaaccctttgtcatctacgggagcaaagattggcaggtcgtattgcttaccgatccggtagtcatcttccccataaccaggcgcagtatgcactagcccagtcccagaatcaagtgtgacaaaatcacctaacatcgttactagatgccgactattgtcaaaaggatgttcgcacaaaatgttttcgagttccgcacccttgaccgttttaagcacttgaacatcttcccaaccaaatcgttcggcattttcgtccaacaattcagccgcgagcacaaacttacgattttcaccagccggttgcacaacgacgtaatcaaaacttgcatcgattgtgattccttctgaagctggaatcgtccaaggagttgttgtccaaacaaccatataggtatcatcatctaagacacccttaccatcaatgacatgttcaccgtagaaggcggatggcgatgtcacatcatgatattccacttcagcttctgccaaagccgattcagaagaccatgaccagaagacaggcttttggccccggtagatcaagtgacgtttagcaaacgcaccaaagacccgcacttgagccgcttcaaattctggctttaacgttaagtatgggttgtcccattcaccagcaacgcctaagcgcttaaactcatcacgttgacaatcaacttgttccaacgcgtatttccgacaaagttctcggaattcattgtccgtcatcttcttgcggtcataaccggcttgctttaacttctgttcgattggtagcccatgggtatcccaaccaggaacgtaaggtgcccgaaacccattcatcgacttatagcgaacgatgaaatccttcgtgatcttatttaaggcgtgccccatatggatatcaccattcgcgtatggtgggccatcgtgtaagataaagcttggcttaccttcattcaatttttgccgttgttcgtagactttattttcagcccacacattttgccgttcaacttctttgaccggtaagtttccacgcattttaaacttggtcttaccgaggtttaacgtttctttaacgcgcatattctcactccttaaaatttttatcaaacaatcgccattggatttttagacacaaaaaaacttcgtccacccagggacgaagttatcgtggtaccacccaattttagaattgtttaaattctctcttagcatggttaacgtccatggaccggccacccttactcaattcaggatagcattcggagatgatctgcaactaactaagggacgactgcctttccattgccggcagctctctgggcgtattagttaattgtttgctgttctcctcaatacattcaattcgcttcaattgtgcctgacgatcgcctaattaattattagtgctgtcatcatcagggaaaataaccaccgtctgttgttggacttgatcgccaccgtccgcaacgggggtctcaccactcgttgcttccgtaatttcaacggttgcttctgagtttacgctcgcatcccccgagttgtcaaggttatcttcctttaaaacgtgttgaatttcagcataatcagccgtattcgtttcgctaagtagttgatcccaatccttgctcttaaccacttctaactgcgattctaacatcacttgcaagcgttgccggaagacccgcgtttgtttcttcaaatcatcagtttcaacggataatcgtttggccttttgagaagcttcgtcgatcatttggtttgacttgtcggttgcttcactcacaatgtcagacgcttgtttctgagcttcgcgggtgataatgtcggcttccttcttagagttcgtcttcactttatcagcagcttcttgagccaccaagatagattgattcaaggaatctttcaattcattgaaatacttcaacttaccttcactcgagtccaaccgttcttggaggtctttattttgcttcaaggtaatttgataatctttgataatttgttctagaaaatcattaacctcatcaatattgtaaccacgcagtttcgttgaaaactctttgttatgaatgtcatcaggacttaacaccattagaattcctccaatatctatttactatgaataatatttaatgttattcgcagccgcgcttttttggtctcaccgctaatttcggcaagtcggacacgaccgtaatggttcacactcagcatatctaacaatgctaactcgtaatcagctttcggtaagtcagcccaattcagccgaaccttagcaccttcgatcaattccttggcgtgatgccgcgacaagttgaacgccgccttaatgatactatccgcacgtaatgaactaaccgtcgtagtaactgcctcccagtcgtcttccggtgtgatcaccgccgacaatggtaccgctgttaagtggactttcgtcttaccaaaacggtcgatttgctcctcgaaatagctggccatctcggtttcgcacacaaactgccatgtcgttccgtcagtcacgatgtcaccaaagacatcacgctcgacgccggcattggcaagcgtacccagaatttgaccatgctttaaggtggcaaacttcacgggataaacaatgttaaacagtgtgatttgaaaatcggccacttcaggttcgtaatacaccgggtaaaataagatccgttgtaactcagcaccttcaaagccaccggatgcccgcatccgcacgtcgtctaactggttgaccagcgtttgcgcaatgtagatttgtcgcgggttcaaaaacgcagttaagattggtcggtactgatcagctacttgccgtagccaaccagtgacctgttcaataaatggggcttcactatcgcgaaaatgttgttttaagttatcattcacgatactatcctcgttattttaatttagtatatcaataaagttatcagataaaataggccactttcagctaattggagcactaacagcgcaatgatcggcgaaaaatccagtccggcaattgcgggaataaagcgccgaaaaatactgagaaatggttcacagatttgacctaagaattggcccacgcgagtattataagctcccgggaaccatgacatcaaaatgtaaaccacaatggctaattggtacagttgaaacaaccgactaataatcgtcactaacaggccactcactccttataatttgctcgtatcaaactgacttgtcgtacttccggaaacctcgtaattttcaggaatacagaggaaaatttcatcaccaatccgttcgatctcaccattgatggcaaaaaccgtcccggtcaaaaaatccacaatccggcgtgccatttcatcatcgacgtgatcaaaattaatgattacagcttgatttttcaataactgcgtcgcaatttctttcacgtccgaataaattttcggttcgaatagggcaattttgctattcaccgacttgcccccttgcattggaactacctttggcgtgctccgagtattggttgcagattcagtgggagccgccgcttgggaagcttcggtgggttcctcatactgactgtcagaatcaccaacaccaaaaaagttactaatgaatccggccatgtgcttgcgctcccttcaccgttttacttacgccggcgcttgaagaatggtggtgtatctagcgaatcaccactgttatcatccttactatcgtcagcttgtgagttgtcattaaagacatcaaaatcagttttttcaacattgttaaactcttgaccattgttgactggtcgtgaattgttcggttcgcgccgaatatcccaattaccgaatgggtcgttagcttgggactcacttgattgggccgcttcactcgtcgctggctggtcagttggcgttgcgaacatgccgcctcgttgctgactagcttcactacgactaggctggctgtccatcttgagttcgcgttgcttctgatcgataccagtggcaatcacggtcacccggacttcatcaccaagactttcatcgatcgaagtcccaaagataatgttaacatcagtcgttgccgcttgggaaacaatgtcagaagcagcttgggcttcatacaaggacatgtcggggccacccgtgatgttcagcaagacttgttcggcaccatcgattgaaacttccaataatggtgaagaaatggcttgtttagtcgcgtccgccgtccggttttcaccactagcagagccaatacccatcagagcggaaccttggttttgcatgaccgtcttaacgtcggcaaagtccaagttaacgtaccctggtgacgtgattaagtcagagataccttgaaccccttgacgtaacacattatcagcttcttggaaggcttccatcattggagtcttcttatcaacgatttcaagcaaacggttgttagcaataatgatcaacgtatcaacgttgtctttcatctgagcaattccttcagcagcgttacgagcacgcttaggaccttcaaatgtaaatggacgggtgacaacacccactgtcagcgcgccggagtccttagcaattttagccacaactggtgccgcaccattaccagtaccgccacccataccggccgttacaaagaccatatctgagccttgtaacgcttctgtcaaggcctcttcactttcctgcgcagccttggaaccaacatcaggattagaacctgcgcctaatccccgcgtaagctttggtccaagttgaattttagtttcggcatttgaagtttgtaatgcctgcacatcagtgttggcaacgatgaattcgacgcctttaacatcttcagcaatcatccggttaacggcgttaccaccaccgccaccgacaccgatgactttaatattagcccctgagttctgggttgaatctaaagaaaattccatgttttttcctccgtcatttctatccgatattaatcaaagaagtggttgaagaagcctttgacccgttcaacagttcccttatgatctggatcagcctgttcctgtggtgcttgtggcgcagactgtttcttagttgcttttttaggttgtgctgcgggttggctaggtgctggtgttgtatcagcaaattccaacgccacactggcacgagtatcaccggtaagtgcactcttaacgagtaacgtaacttcactcaaggccgcttgatatttgatgaccgctaacgcctcatcaaacgacggatgcctcaagcccatttgattaggcgtaaagacgcgaactcgcgttccaaaacgttgcgccgccaaatcagtgataccgggtaatgctgccaccccaccagttaaaacaatgcccccggggagctcgagcgcccgaatctcatccaagtgctgcttgaccttatcaaagatctggtctagacgagcctcaatgatttctgctaagtattgctcacttatttgctccggtgtactttgcccaacaacatcaactgggaaaagttcatcatccgaggcctgctgagcatcggcatagccataatcacgctttaacttctcggcattctcgatcgatgtattcaaaacgaccgagatatctttggtaatatactggccgccttcttggtcaacgtaagtatacttcaattggtgatcatgtataactgccgcagtcgtttgaccaccgcccatgtcaataatgatcgaaccaaaatcttgttcaccgtcattcagcactaaggaacttaatgccaagggcgcgatcacaatctgttcaatttgcagtccagccttttccaaagccttccgcgtattgtgaatgattgttttcggaccagtgaacagggtgccgtgcatttcaagccggaccccaaccatgccacgtgggtccttgatgccatcaaaaccatcgacgacaaattcatcggggatgacatccagtacttcccgctctggcggtaaactctgaactaacgcagccgccgcaacgttttgaacatcttcattattaatttctttggactcatctgccacggcaatcataccacgacagcgttcaattttaaccaggttagcgggaactcccgcaatcaccttttttatttcgatacttgctttttcttcagcttggcgtactgctgatcgaatcgtttcggccgccttatcaatatcgacgatcacgccacgacttaaaccattagaacgtgcgcttcccacaccaataacgttcatttgccctttaacacgttcagcaacaatgacttttattgaggtggtccctatatcaagtccgacataaattcctgaattatccataatagaggaacctcctagtattttacataaatattcaaggattcgctgacatatccagttattccttagtttaccatatcctaagcgcttttaaaaaggtcacacttagcattctatcaattattctgattcttgaacggataggagtatgcgcccacctcaagattgatgacacccttggttttcatcttcgccacaattcccggataataagccatcttgctagcaaaagtgctaattgttgcgtacacttcattaccgtcattcatgtaaagatgaacccgttcgggattagccttgttcggcgcaaacttgatctcagaaatattgtgtttgaccgccgatggtaacttagcgtactgtgcaatcatcgttgctaagcggtgaccgcttttaaagttggcatagatcggtgaaccgccaccgggttgagaataggtcgctttcaaaatcagcccattttccaaaattcgtcgatagtgttgaccagtcgataagtaacccgcgatgcgaatttccttaactgtcacccgaacactgttcaatccaactagcttagtcgtgaccttgccaatttgcggctgggcgcgttctgcgcgcttagtagtccgttgatcatgaccaatcacggaccataaggcaactccagggttgatcttagtcgccgtcttgacctgcgtaacagacaattgatcgttaccatgtacggtcaccgtctgaacatggctcagtggtgaaatgaagtaaccagccacaccagcaccgatcaggaaacagcccatcaagatcacgacccgtttgaaaagtaatcggcggcgctgagatttgagtttcggtaatttatcgccaattcgcaggcgtttacctgaccaactatggtgactcttttgcgctgcgcgatgattctcagccgcgtctcgttgaaatcgttcccagggtgtcagctgctcggggtgctcacgctccttgggctttttatgaaaaatggccatcacacccaccctttcactctagtctctgtgctacttaatcaccgtttctaaaacgtgtagtaactggtcggccgcatcaggcatccccagttttttcgcattagccgccatcgtctcacgatgcgtggtactttggagaaggccatctaatgcagctaccaaactggttcccgtcaaatcagcttccttaatcagttcagccgcccccgcattcacgaggctttgtgcattcttggtctgatgatcattcgtaacgtatggactaggaactagaattgaaggaatccctaaagccgtaatttccgcaatactagttgcacctgctcgaccaagaataaccgcgacttctggtagaattgctggcatatttttgatgtatggttcgattttaacattcggagctagcgctgtcgctgacaagccattccgaatcttttcgtagtgtacctgaccggtgacgaacaaggtctgatagtcacgtttgttcagttcaggaattgccgcgaccgctgctgcgttaatgcgcgcagcaccccggctccccccaaaaatcaacgccgttggaatatcaggatccagatcaaactgcgccaaagcgccactttttttaatattagccacttgttgggctcgaggattcccagtcatcacaactttttgagcgggaaattgtgatcgcgcactctcaaatgaaatggcgattttatccacaaaccgacttaggaatttgttagtgacaccaacaactgaattctgttcatgaatgaccgttggaatgtgcatctggctcgccgcgaaaacgaccgcaccactcacgtagcccccggttccgaccacaatatctggtttaaacgccttaatgtacttacgcgccgtaaccacactctttaaaaacaaatagactgttttaacattttgtaatgacaatgaacgcttaaagccctggatcttgattgttttaaaatcgatcccccgttccggcacaatgcggctctctagtccacgatgggttcccacaaactgaacttgcgcttcgggatcatgtgcttttaaggcatcgatcagtgccagtgcgggatagatatgaccacctgtcccaccgccagaaatcattaatcgcattagttttcttccgcctttccagttaactgttcgattgctttaataaatcggtcgccccgcacttcgaagttcgggtactgatcccaactggcacaagccggcgataacatgatgatgtcaccagcctgactatgttgccaagcaattggcacagcagtctcacagttgtccgtaaactcaatatcttgaataccagccaaacacccagcgtccgccattttttcagcagtctcaccgaagacgattaacgtcttgacatgcgcctttaatgcgggagcaagcttttcaaacgtattaccacggtccaaaccaccagcaagtaaaatgaccggctgatcaaagcccttcaaggccatctcggtcgacaccaagttggttgctttggaatcgttgtaaaattgccggtcctgatacgtctcgacatattgagtccggtgtcgaacacccgtaaacgtcttcaagacttgaacgattcctgctgttggaacggcttgaagtttagcaacagcaatcgctgctaacgcattttcaacattatgatcaccaggaatccggatatcagcagcatccatgatgtactcatctttaaagtacagcttgccggcctcttcataggcgccatctttcgtattggcttgccgtgaaaatggcacgacggttgcttgtgattgcttactgagttgccgccattcttcactatcccaattaatgactagataatcattagccgtttggttcatggtgattcgcatctttgccttgacatagttctcacgtgagccatggtaatccaaatgcgtcgaataaatattcgtaatcaccgcaatatgtgggtgcaaagtttgaataccacacaacataaaactcgaaagctcagtcaccattgtgtcggccgccgtagccttttgtgcaattgctgaggccggcacgccaatattgcctgctacgtaagctttaccggcatttgtgcgttgattaagcatcatcgtgatcatcgtcgttgtcgtggttttaccgttcgtccccgtcacaccaatcaactctcccgctaggatttgcgatgcaagttcaacttcggtaataactggaatacccttttcctgagccccactcacaattggatttgagtatggaatacccgggttcttgacaacaactttaaaatcttcatctagtagtgacagcgggtgaccacccgtgataactttgattccatcactcaataattcctgtgcatccgggttctcatcaaatttctttttatcattaacggtcacaaacgcacctaatttgtggagcaaccgtgcggcattgaccccgctctttgctaatccaagaaccaaaaccttttggttacgatactgctcaaccgacttcataaaccaagatctccctataatgtttgtagatgatacctaaattaacttgttatgtggctgatgcaccaactcgtggtcatcagcaaattattcatggtgagccagtgaccaattccacgacataatctgcggcagacaacgcaaccatttaaagaacaatcgttgcgttgataggaatcagtactatttacttgtcacttacttggcgaccaccaatgaataaagtcataccgcaaagaccaattatgtacaactaactcggacaagaatgcccgagttagcaaactgtgactaaataatcgtggcaacactgattacggctgccactaaaccgatcgaccaaaaaacgatatcaatcttccactcgctccaacccttcatctcaaagtgatggtgaattggactcatcaggaagatccgttttcccgttaacttgaacgaggcgacttggaggataactgaagccgtttcaatgacaaaaatgatgccaatcaagaggagggatagttcatgatgcaataagatcgatactgcagctaaagcaccaccgagcgctaatgatcccatgtcacccataaagatcttggccggtttgtgattatacacgaagaaacctaatagtgaccccacgacggccaaacagaataacatcacattatactgattttgagcgtaagcaatcacggcatacgcaccaaaggcaatcgtggcctgaccagcgactaatccgtccaacccatccgttaagttgacggcatttgagaagcccactaaccagatgatggcgaagagcatgtaccaaattcccagcgaccagacccccaaacctggaatcctaagtgccattggcaaatgttcatgttgatagaccaacgttaaaattactgccccaatgacttgaccaagtaatttttgccaagcctttaaaccttcgttttgtttacgccaaagcttgatactatcatcccaaaaaccaagtgcaccgtataagaccaggataaacatcaaaatccaggtggttggttgtagctgatgttgccacccaccgacccataacgtggtgactaagattgcgataatgaacagtaggccccccatagttggcgtcccagattttttctcatgccacttaggaccttcctcacgaatcatctgtccttctttgcgggcgcggaaataccgaataagtgacggcattaacgcaaacacaataataaaaccactaattagggttgcaccccacactaataaactcacaacaattctccattctaagacttgataactacttcagtgtcacactaattgcctgcttagcttcgatcggattacccgcagtcacactttgcgtcttgacgtaacccgtcccgctagtcgtgagcttaacgcccgtcaacgtcgcaaaatcagccacttcacttgccgaccatccagataagttcggcatatacatctgcccgttggcaaccagaatgacgcgttgaccacttgaaacgacagtgccagaagaaatggattgcttgacgacccgactacccttaccaacaacgaccacgtcaagtccctgcttcttagcagctttcttggccgcgctagtcgacttactcgtcaaatctttcattttgatcgtcgtcgctttagtctcactcgctttttgttcttccaatgcccgtttcatcacggtatcaaaaatctctgccatgtcatctgacgcggaacttccgttaagtgtcggttgtttcatcgtaatgtacataatgtacttcggatttttagctggcgccatcccgacgaccgagtacagataggtgttgtcaccttgctcatacgtactcccgttgctgacctgggcagtcccagtcttagcagcaatgcgatacccgctgatcttatatgatgagccagtaccgtatgacttatataccacatcttgcatatgatccaacaccttgctggcagtcttcgaactgattggctggcttacaaccttcttcttacccgtataaaccgttttgttggtgttagggttagtgatcttggagataaagtacggctgtaacatcttaccatgattagcaatcgctgtgaatccacgaagcatctgcatagcggtcacctgaatcccctgaccaaaggccgtatccgcttgttcgattggatacgtaaattgaattgaaccactctgctcgttgtcaagaccactattagtactctcacgcaacccaaagcgtttaatgtacttcagccaagtcttggcccccattgcttgttctaggtgggccatcgccgtgttacttgaaagggcaaaccccttagcataggtaatattgccccacccgctcgtattccaatcaggaacggtattattaccgatcttatattcaccggttgggacggttacattagcattgtacttaccgctgtcgatcgccgctgccattgtaaagaccttcatcgtcgatcctggttcatacgtgtcttcaaccaacaaattacgccacattttagatagtccggtctttgtttgcgcattaaatgtcggtcgctgcgtcgtcgccagaatggcaccagtcttcgcgttcatcaacgttgctgtcattgacttaggtgagaccttagcgtttacttgtgaaactttagtttccagtaatgtctgtaacttactatcgatggtggtataaatattatccccatccttaaccttcttaccagtctcagtgctaccttgatatccgctcttcgtaatcgtcttgcgaccatcggttcccgataactgcttgttaaaagccaactcgatgcccatcgaccccgttaaccgcgtctgatcggtatccttctgactcttggaggtggtcagcccaaccaagtgggaagcaaacgtgccgtttgggtagagccgcgcttcagattcaataaagtgcagcccagccacattttgggcatcgatcttttccttagtcgtcagtgaaatattcttaccagccgtcccaaattcaatttggaacttacctgcgcctttttgcaaggtcgcgagggctttcttatagctgattggcaaatacttcgataagacacgcgccgccttcgcattatttttaacatacagtgccttgccactagcactttgctgatttttcgccataatggcgtagaccgtgtacgtgctagtatcttcagcgattgggtcaccgttggccgtataaatagtcccacgtttggccgtgatggtctggtcttccgtataaagtttcttggtggcctcgaccagattgaccccgttgacgtggcgcacaatcgcgatatatgaaaaacgaatgatcaaaacaccaaagacggcaatcgcgccaaaaaatagccattggccaaaaattctacgattttgttttggtgaccgtttcgaagtcattcgttgtttgttcttattcatttgtaaacattccttatgctaccgttgttcagcgataacccgtactgcttagcaattttatttaaacggctccgacttgaaagttcactgatttcttgtgcggccgacgtattttttgcctgcacttttgtgactttcgtttgcaccgtctgtaactgactttgtgcgttactcgttgcaatgttcgttgaaactaacataatggctaatccaaacaccaccaaactcaaaccaacacacaatactttttcaaataatgaaaaagcaactcgctgcgtcttgatggacggattcggggtcacaacggtttttgttttatgtaccggggtggttgcgccaggagtttgctgtggcaactcccgcgctaatccattttgggccattttaatcactcctttaattattcctgaatattatttattcgttatctttaaacgttcgatggctcgtaacttggcgctgcgagcacgacgattagcttcgatttccgcatcgctaggcacgaccggtttacgactgactaagcggtaatctggttgcatttcagctgggataactggtaaaccaggtggcagctccggcaaatcgctgtgctccttaaagatcgtcttgacgagacgatcttctaacgattggaatgtgatgacactgacacgaccatgaacattgattaaatcaatcgcttgttcgagcgaagtctccagtacgcccaattcgttattcaccgcaattcgaatagcctggaaaacccgtttagcgggatgaccacccgttcgccgcgctcttgctggaatggcattcttaataatttcgaccaattgccccgtcgtcacgatcggctgaaccgcccgttcacgctcaatcaaccgtgcgacttgtttagaaaacttctcctcaccatagcgatagaaaatacgaaccaagtccgcatagggccaagtattgacaactgtttgagcagttaatttctgactctgatccatccgcatatctaacggcgcatcatgttgatacgagaagccgcgggcagcatcatcaaattgtggcgacgaaacgccgagatcataaactaccccgtcaacgtggtcaaggccccgagcatctagttcagtcttcaagttggcaaagttacttttgatgaacgtgacctgaccacgttcaagataagtcgctaagttactttggttataatcgattgcggtttgatcctggtcaaagctatacaagtggccttccggacctaactgttgcaaaatttcacgagaatgaccaccgccacctaacgtacagtccacgtagatgccatccggccggacgtttaacgcggcgattgcttcatgcaaaagtaccgttgtgtgttcaaatgttgccacgcgtgcgcccccttcctaaattattattgttatttaaaaatcaatcaagttttctgcaagatcatcgaagttcgctgcggtctccgtctcaaactgttgccagtgttcggcaccccagatttcaaatcggtcagaaactccgacgatcacacattgcttttccaactttgcatattgtctcaaggttgcaggtatcatgacccgtccctgtttgtctaattcacattcagcagcagcagcatagaaaaaacggacaaacgctcgcgcatccttgcgagttagtggtaaatcatctaactgtgcttgaagcgttgcccaccgttcagcgggatagccaaaaatacaaccatccatcccacgagtaatgacaaacgaagtgcccaatagctcacgaaacttggcaggaatgattagtcgccctttcgcatctaaggcatgttcaaactctccgaaaaacatcttagacgccacggccaatcaacccctttcattaaacataattcaagtctaccacacccccccacttcctaccacatcgttttgttacttttccaaattgttaacaaaatatcaaaaaaagtcccacctaacgttagtttcgttaggtgggacttagtgggggacatttttacgatgttaaaaagaagtggctgccaagtgctaggatatagacgacgagtgtcaataattccgctccccgccaatagagcttaaaaaagcgccagtaaaggatttctccgcgttcaacagcttcaatcagtgttaaaccgatccccaaaatcattagggacaacacttcgtacggtgccagcgaactatccgttgcttgcagtgtcagaaagtgggtgaaaacaattaaaaatggcggccaaaaatccaacaatcttaatccatgtggccaaacgcggtgtgcaacccgtttagcacctaaaatgatcatcgagatggcggctaaaaataccagctgcccataccaagtggtccataaatctcgcatatgcgtacttgcctccccattagtgtcgggttaaattatagagattatcgttaaacttttcaatcatctgtgacagccctataataaacataaactattactggagggatgaccgttgttacaatactttaccactggtaaaaatggccttttgactacgccgaacgaccatcacgatcagccatactggatcaacgttgaacgcccgacctcaactgaaatcgaccaactggtcacacaatttgatcttcccaaagattacttaactgccatcctcgacgatgcggaggtttcacgagccgagcaattatcaaccacgcaatccagtcaaccaatcttaatcgtgatgcagtatcccaaactcacgacgagtaagctggggtaccttgaatttcaagtctatcccttcgccttgattttagtggatcaagtggtcatcaccgtcagtaattacccggctagttttattcaagactttgtgatggacccggcctcgtctaagctaagtctggataatcacgaagattttgtgctgactatcatgtggtacatcgagcacagttttgtgaccgcactcgaattgatcaaccaacggacaagcgccctggaaagccgtttgaaccaagctactcacaacgtggaactctttaccattatggcttaccaaaaatccttgattcgttttaaggccgcccttaatcagaacacacccacgcttgacgcggttgaaacttcgatcacccatttcaacgcacctaatcaccaatcactcaccgatgatattaagattgagacccagcaagcgagtgacatggctgaaacgaccaatcagattttgcagcaatatagtcaattagtgggttcagtaatttccaataatttgaatgatgtcatgaaatttctgacctcactcacgatggtgttgacgattccaacgattatcggtggaatctatggcatgaacgtcaaattacctggtgccggtctcgtccacgctttcacttggctgatgctaggaacgattattctttgcattattagtatcgaatatttacgaaaccatgactatttttaatttcaattgaaaaaaaactgattccacgttaaactatgaaagaattactcgtaaagtgtggtgcatacaaacataatgaagaaaaaatcaacttttcaaaaaattacgatggtcgttatctggttaatgatcatttctaccattgggtcattggtgcttaccgccttatctgggttaggtttactaaccttctaggttaaacaccttgcgaaccacgaatggttgcaatacttaccaagaaaaaagttacgcttgctcacaacaagcgtaactttttttattactggtggatcactcagccatggtcggcaagcctagccaccaacttctgagacaatgtgaattaaaaaaatcacgcatttgtctctgaaaaaggttccaaccgttagtcaaatctggctaacgattggaacctttactttaacgtcgattattcaatcgtatcggcagcgccaccatgtgaagtcatgccattcaaatgatgcccaccagtcttactggacgctaagcgtcattacccgacgcgggcgcttcgtcagccgatttttggcggtaaaccttacgtggcttactcccctccgaagggcccaccacgccgcgttcctccatttcgtcgacgatccgtgctgcccggttatacccgatacggaagcgtcgttggagcatcgagacactggcggactgttgatcagtcaccaattcaacggcttcggcataatactcatcctcaccgtcacgagggtccccactaccagcggcatccgtctcgtcatccttgaccagcatactatcgtcataatcagccgtctgttgggctttgataaagttgacaacttcttcaacatcatggtcagaaatataagcaccctgcacgcgcagtggcttattcatgcccattggctgatacagcatgtccccacgaccaagtagcttttcagcaccgttactatcaataattgtccgcgaatccgtcccacttgaaacggcaaatgccatccgtgacggtacattggctttaattaatccggtaataacatctaccgacggccgttgtgttgccaagatcatatgaataccggccgcccgggccatttgacccaagcgaataatggcatcctccacttcgctcgaagtgaccatcattaaatcggctaattcatcgacgaccaccacaatgtatggtaagacgggccgtgactgcccatcagccgcattttgttgacggatatattggttgtacccctgcatgttacgctgcttggaatccgcgaacaattcatagcgtcgctccatctcggcaacgaccttatgcaacgcccgggccgccttcttcggttccgtgactacgggcgtcaacagatgtggaatcccattgtaaacccctaattcaacctttttagggtcaatcagcataaacttaacttgacttggtttcgtgttcatcagtagccccgtgatcatcacgttaatggcaaccgacttcccactcccagttgaaccagcaatcagtaggtgcggcattttagacaagtcggcaacgactaaattaccagaaacatcacggccgagcggtacggccaacggtttggtcgggtgcgctggttgggcctcaacgatatcccgaaatgacactgttgaaatctgtttatttggcacttcgattccaatcaatgatttaccgggaatgggcgcttcgattcgaagatccttcgctgccagcgccaacgctaagtcgtccgctaaattgacgaccttgctgaccttgaccccaacagctggatgtaactcatacttcgttacggatggccctaagctgacattcttcacttcaacttgaacaccgaaactcgccaacgtggttgttagcttctgcgagttactctcaatcgttgcgtactcagcactctgatccgtttttggaatcttcgtcaatagtgttgactctggcaactggtagtccgcatcatccatcacttcagtcccttggagttcttgttcatgatcaaccgtagcagctgaagttggggattttatgggcgaggcttcacgatcactagccaccgtgatattcaagtcggcaggcgagctcgtaactgcactggctgctgagtccggcgccgaagtcccgctcgttgtctcagcaggggctgctgactgtggtacggttgacgttggctgcttctcagtacttgccgcttgattggcgcgcacttgttggtgaacccgccaacgggcaatttgaacccggagcacgtgcgtcagccattcataaccggatcgcagttgctggcccaattgcatcaaggcctgacgcaacgcttgcatcgtcttatggaacggcaaatcaaaggtaatgtagatactggcaaccatcaggatcagtgcgatcaaaattgtcccgacattagccaatagtggataagtgacactatagccagcagcgccgactaatccgccaccaagattactggccatgccccccttggcaaaatcatttttgatcagattccacgtcaacgaccaaaaatcggcatggtgattcaattgattaaacatcgggatctctaatagcaataagtaactgaagaaaaacaagttaccaccgacccaccaccgccaagtcagtcgtggccaccgaccaaaaatcatcaaatatcccatgacgaggagtgttagcccggcaaaaatctggtaggcattcccagcaatggctcggaaaaactctgcgaataccatgcccactaaccccaccttcaataaggcgagaatcgtgaccaatagtccaatcaggccaatgacattccccgtcatctgccgcttagccgcaaccgtcggcttcttcttgcgcgtcgaggtccggcgcttttttgttgttgcttgtctacgcgccacgcttcgttcatcctttctcaattaatactgtcttcattataacaaactcaagttcccccgtccccatcaaaaaacgcaccctaacgtttagcgctagtgcacgttctgttggttacttcaacttatcattttcatagtggtgcgaccgttcaaggtttgggaattgttgttgccgcaggacttcataaatcacaatcgcagccgaattcgataaattcaaggctcgaatatgtgaatcatcttggggaatccgaatggccttttcgggatatttgcgcataaatggttctggtaaccccgtcgtttccttaccaaataagaaatagtgatccttacccgtatcactataatcaacatccgtatagtcatgttcagcaaacttagacactaagtacaactgatttaaatcaggaatactagctaaaaaatcttgcaagtcagcatgataagtaatatcgacactatcccagtagtccaagccagcccgttttaagtgcttatcatcaattttgaagcccaacggttcaatcagatgcaaggccgtatccgttccggcacacgtcctggcaatattaccagtattcgctggcattaacggttcaaataacgcaatgtgatttgtcaaaataatcgtcctcattcatattagtctctacgccatgttcattcatagcaatcctattaatcataccatgtctatggttcaacagcgaactttgaaactaaaaaacgctttgttcgcattcttaaccaatctttcctatactaatcaccgtacgcgccggagggcggaacaggacgcacactggctgacgaacaccaatctaaacctgacacgttgtcatcatgattcatgccggattaacacgtacaaggcagcattcgaatcattttataactcgaggaggaattatctatgaaaattatgattattggcgcaaccggaatggctggctcagccatcaccaaactagcacttgaacggaaccacaccgtcgtggccatcggacgttctgaagaaaagctagccgctctaccggctaacccaaatttgcagaccaaagctaaagacgctttcgatctcacactatctgagctacaggcggttgacgtggtcattgacgcaatggcgactagtcctgataaggcttaccgacacgtggatctggcaactaagctgattgctcagctccgcgaacaacagcggccacgtctcctcttcatcttaggggccggtagtttaacaactggtgatgatcaacacctcttcgtgcacgacattgaaagtaatcccgccaatgctgccttcgtcgctattccgcaaaaccaactggccgaactgaccttcttacgaaccgtcaccaacgtcgattgggttggaatttccccggccgccaatttcacagcaggtcctgctaccccggcccagtacggccatgacacattactgacgaacactactggtgaatcagtgaccaatagtggcacgatggcggtagccgttttaaacgaactggaaacgcccaaacatcatcaagaacgctttacagtcgctaaccagtaaacgtcttgcctagcagcgctaaaatatcgagtggcagccaaaccacaagccgagcgctacttgagcaatttagttaactgtgacgcgctttaaataagaccaattaatcccgccagaatctgacgggatttttgtggcgtcgcaattgctggcagtatttaacagctaagtgctgccaccgccccatctctcctcattgcgacagtcgtagccaacattgtcactaaccagttggttgcattacaccgccagttaacgccctcaccgacctttaattaattcttcaccaaagcatgctaaactattgccatgattatttgaaagtggggataccatgaataaccgtttatcaggacggaatttactcttcatcggcaccatgttatttggactatttttcggtgctggtaacttgatttttccaatttttctgggccagcaagccggccaacacgttggtgcggccattatcggactattgatcaccgggattggacttccattactaggcgtgatcggcatggggctgacgcgcagtcagggcgtatttgacctggcaacaaacgttagccgatcatacgcgtatgtcttcaccgtactgctttactttaccctcgggccactttttgcaatgccacgattagcaactacggcctttcagattggactggcccccttcttaaccaccaaattacaacccgtggtgctattgggcttctccgttgcttttttcgtcgtcacttggttactggctcgtaatcccggtaagattatgacctatgttggtaagtggctgacacccatctttttgctattattaggtgccttaatgcttgtcgctatcattaagccactgggatcacttaacgtcgcggcgagtggcgcctatgtcagccatccagttctaactggttttactgaaggctacaacacgatggatgcgttagcctcgctagcttttggcatcgtcgtgattgatgtgattcgcgacctcggtgtccgtgatccggggcaaatcgcaactgataccattaaagcaggcctaatcagcatgagtttaatggcagtcatctatggtctgctggcgattatgggtaccatgagcttaggtcgcttttctccagctgccaatggggggattaccttagctcaaattgccgatgcctactttggccgattcggtaatgttttactagctctaattgtcatcatcgcttgcttaaaaactgccattggcctcacttctgctttcggtgatacgttgcatggcatgtttcctaagatttcctaccattggctgatcaccatcgcttgtctcattccagccattcttgctaacgttgggctaactgaaatgattacttattcaaccccagtgctgatgtttctctacccgctcgcaatcgtgttaatcatactggcagtactggcaccatggcttgggatgtcccgctggttatatggaatgacaactgtctggaccatgattccggccattcttgccggcattaacgctatgccatccgcctgggtacaagcatcctggttgcaagctttgcttcatctcaacgcgtggctaccgcttgccaatctagggttaggctggagtgtacccgcactgctaggttttggtttagggtggttgatcagccgtaaacaaccatctgcttctaaattgcattaatatagcgtcacatataaaatagcggaccttctgatagccatccacgacttttcagaaggtccgctttaaattacgagagccatgccaattgactggttgccattgaacctcaccggtgaatcatggcattattcaggactggtatgaatgcaatagcaacacatggtcacacctcaccgtcagcttttgaagacacaaaaaaacgtagtatttcggtgtgggcacggcgaaacgctacgttaatgaagtacaactcggtagtcaccaacgacatgtcgatgttaactaccaaacgatttctcaaaggttatcttaacaccggcgtttcaatcatgcaagcacccgcgctaacctttttgcatcgttaataaactcacatcaacggtaatcttagttaacctctgccgtttagcggttgcgagctgctcagcatccgcaccccagtgcagcggtgtcatgactaataagtcgttaaagtcaatgttatcaagcgcaacttggtattgaattcgttgccgcttagcagtgggatagtgctgggcaaacagatctaacacccgttgattatcatactgatactgtcgatcagtcggtttaaatagtaaatgacgcagttcaactaagtactcaggatttggcacgatcttcaataactgtccaccgggcgcaaggacccgttcaaactcttggtaagcggatggtgagaagacatccataatggccgtgaatgccccatcggtaaagggtaattgggccaaatcggccacacaataataagcagtcgtcgtcaattgggtcgctaagttaaccccatccttactaatgtcaaaaccaatccccacgtcttcagaattggcatgcattgtcaacaaatcagctaggggggtgccttcaccgctaccaatatctaagattcgttgcgccgtttttggcaatgccgcattaatggcttggacaatggggccgaaaaaaccagcttgcaaaactcggcgccgcgctgccagcatgttagcatcgtactcgctagcgacttgatgcgttagaaaatacaacgtccctttttttgaaaaatctacttgatgcccattaggacaacataagctgtggccgtcaattgtcacgtatgcttgattacaaactaagcatcgaaagcgatcgatatttgcctgaacaaactggatgccgcggtcaatttttttcacaggtgtcaccttaccttggttaattttatcattaggcgtcccatatccaagcgatgctttccagcttacctgaaactatggattcacgatgacaacatcgtgtaaaggacgtatgttcaatcataccatatcggggcggacaaaatagtagctgttacgatttaggtgtggtatcttattaactgttctaaaggctgacttaaattgtcaaaatgaatttgctaccgaatggcatgaatttaatgacataaaggagactcattcagatggcaaagaaatcaaaaattgcgaaagaaaaacgcatcgaagcaaccgtggctaagtatgccgaacgacgccaagcacttaaagctgctggcaactataccgaattggcaaaattaccacgtaatgcttcacccgtgcgtattcatcggcgcgactcacttgacggtcgaccacatgcttacctacgtaagttcggcatgtcgcgccttaactttcgtcgcttagcgcacgctggtcaaattccaggtgttaaaaaagcaagctggtaaagtgacaactggcgtgatattcactaatgattagtaacatcaccattcagttaaattaaaaaggttccacagaattgtcatcagacttctgtggaacctttttaatttggcgttattggtttaatcgcgtttcagcgccatctgagtagccaacaattaccttacttgttagtttgatcagttgatggggttgcttcagcctcatacaatcccgaagaccgtcgataccagtcaaacagatgtgtccacaaaactttcaagatcgcatagcctggaatcccgaaaataacccccatcaacccgaagattttaccagccgctaataggacgactaaaatcgtaatcggatgaatagctaagctactccctaagactaacggtgagataaagcggccttcaatcgtttgttcaatgacgaagacaatcagaacttggaccaacatccatggtgaggtgactaacgcaatgaccactgaaggcaccattgcgagaaaagaccctaaatatggaatcaaatttaagattccagccgcaattcccaacgtcagcgcaaatttcaagccaataatactgtaaccaaccgcaaacatcacggcaacaaagaacgccacggtcaattgaccacgaatataattactgacctgtgaattgatttctgtcaaaacttctaagaatcctgagcgcgctttggtaggtacaaacttagccatatacttcggtagttgatgaccatcgcgcaataggtaaaaaagaataaacggcattgttatcaacccaatgatgacggtcgttacggtactaaatacgcctgtaagtgaagtcaccgtcccggtcaaatacttcgaaaagcggccactcactagcttactgagatccgtgttccaactttcaagttggtcacggatactactgagttgcggatcattgagccagcgattaacttcagtactggcatttttccaataattgggccagtcattgataattgataaagtttgatcgcgaatcgttgggataatcgcaataatgcctaacgccaacagcgcgacaaccacaataaacaaaccaatgatcgtccaggttcgtcgtacgcgaaaacgcttttctagccagtcaacaagtggattaagcaagtagtacagcacaccggccaaaataatcggcaaacccacgatgctaaaaaattgccggaccggatctaatagccaatcgacttgcttgcccataaagaagatcgtcaatactaataaaataacgaccaaaatccgaatgagccgttgcgctgaccaccgttgtttctgtgaatcaggtttcaaacaatccctccttcctaagcctgatacgtaataacgctaccgaccttgattgttggtaactggtttggtgtcaaataaatgccgttttccattggtttggcaggtactggtttgaagtacaacgtcgcgtgcccaattgacgttaaattagcttccactagtccccctgcaaaggccaccgtataagtttgtcgatcgatcgtaatggtgctaccagcaactaacgacagactcgcgatgggctgctcaaatttctgaatcaccgcgatttgctgtaatggtgccgtggccgtttcatcgaataaaactaaaattggttccttggaatcgatagcattcgcaccaatcgattgtactgttgcagttattgtcatattgagacccccatcggttaattaattgctttaattgtagcatagtcctaatcacagacgccaatttgtcatcgcttacacgggccatatctatgctatacttgaattatctatcaaggaggtttgttatcatgcaagaacgcattttattcggaacatatacgaaaaaaacaagccaagggatttaccaaggaacccttgacaccactgccaaaaccttaaccaacgatggcttactggcagccactcaaaatcccacctatttggccctctcagctaaggattgcctatacagtgtcgataaggaagatgacgagggcggtatcgctgcttggcaaatcgacgggcaaactgctcacaaactaaacaccgttgtcgcacctggcaccccaccagcttacgttgctgtcgatgaggcccggcaactcgtctacagtgccaactatcataagggaacggccgaagtcatgaaaattgctgctgatggcgcgctgactttgaccgatactgttcaacatagtggccatggccctcgtcctgaacaagacggctcccatattcattacaccgacctcacgccagataatcgcttagccgtaatcgatttaggtagcgataaggtctatgtctataacgtcagcgacgccggtcagttaagtgaacaatccctgctcactatggaagctggctttggaccacgtcacctcgtgttcagtccagacggccaatacgccttcttagctggtgaattatcgagtcagattgcgagcttaaaatatgacgcccaaactggtgcctttacgcagcttggcattgtgaagaccattcctgccgactacacggcgcacaacggtgccgcagccatccgcttaagtcacgacggtcattttctctacgtctccaatcgtggctacaatacgttagctgtctttgcagtaaccgccgacggtcatttgaccctgattcagcaaatcagtacggaaggtgacttcccccgtgattttgatttagatccaactgaagcctttgtcgtggtcgttaatcaaaacactgataatgccactttgtatgcacgcgacttaacgagtggtaaactaagtctattacaaaaggacgttactgtgcctgaaggcgtttgcgtccgtttctagtaaaggatgaaactcatgttattaaaagaagtctgtgttgaaaattacactaacattcccgcagccattgcggccggtgccaatcggatcgaactcaacgataacctatccgttggcggtacaacggtcagtcgtggtgtaatgtctgaggcagccaagtataccagtgaacatcacgtgcccctagtgaccatgattcgcccccgtggtggcaatttcgtttataatgatacggaattaaaaatcatggaagcggacctgctacaggctcaatcattaggtgttgatggtgtcgcatttggtgctttgactgcggataatcagcttgacgaagaagccttagcgttattaattggtgcagccggtggcatgtcgatcaccttccacatggcttttgacgccatccctgaaaatcaacaagccgcggcaattgactggttagtagaccatgacgtcgatcgcattttgacacatggcggcccacttgatcagccgattactgactgtgtcccccacttgcaaacgacgatcaaacaggccgctggccgaattcagatcctacctggtggtggcattaccactgccaatgtcgccgacatcaccacaacactcggcgtcaaacaggcccatgggaccaagattattaattactaagaactgccaaaaaggcgcatctcattttttgagatgcgccttttgattggcgaagtaaactaaaaaattagaccattaatcacggttattcaatggtctaatattggcacaagcgcccgcactaagccaacttgccctgagccctcttccgcgaacaaattggtcattgtcaacgctgatcaattggctcgtgttcatcatcaatcatgctaattaggataaacataaaacagaccaaatcttaatggtcactttatgaattggcacgttgattatgaataattaaacggttaagatcagccggtaatggtgcaaaggtcgtgagggtctggctaatgaatggatcatcaaattccagttgcatgcagtgcagtgcttggcgctgaatccacgggtcacgaggaccgccataaagggcatcaccgatcaatggatgaccgctagctgcaaagtgcacccgaatctgatgcgttcggccggtatgcagccgtacccggacgactgtcatgttacgcagccgcttaaccacccagtactcggttaaagacggcttaccgtcgggacgggtcgttcgtttgataaatgaatcagcggcacgaccaatgggcgcatctagccacccgtggtcagtcgtcaattcaccactgacgacggctaagtacattttgcgcatcgcatgggccttcaattgatgatcaataatcgaatgggcaaaatggtgcttagcgaagagaacgataccgctcgtatcccgatccaaacgcgtggtgatatgcacaacctcattatcataatgggccgcttgataataaccttttacccgattcgctaaggtattgtcaggtaaggcatgcgccggtactgaggccactcctgctggtttattcacaatcaggtagtcacgatcctcatataagatatcgatcggcaacgtcgagacgcctaagtggtcattaccaatttcagcaggtgtgaccatcgtcacagtctcaccgcctgtcagcatatgaatcgctaataccggtcgttcatcaacgagaattgccccaccatgaaacttaacttttttcaacaaactacgtgtcacaccatgttgtgccaagagtgtcttaactttcatcgggttcgtctcatggttgatccaagtaaacctcattgctcgtccaacccgatgaaggatgtcccgacccgttgccagaagcgattatgacgatgctgagcaaatgcaattcgacgattagcaattgaataacgaatttgttcaattggccgcggctgcgtatccatttgatcagctgtaaagacaaagtgtgactgctgttgtggccgaatcgttattgtttcatacggcgctacgatgactggcgagcctaatgttcggaagactcggttgttgatcgacgcaatctcggccatttgtaaagcgtccaagcgcggatgaatgacagcaccaccaactgacttattataagccgtcgaaccagttggagtggagacgcataacccatcgccacgaaaacgttcaaatagttcatcttgaatataaacatcggtaaccatggtactcccaagcttcttaagcgttgactcgttcaacgccaaataatgatcagtcgcatccgtatccgcataagtaatatctacagctagcaagggataggtcacactctggccgttgtcttccagtaaaccgttgatcagttggtcgatttcataatctcgccagtccgtatagaagcctaaatggccagtatgcacgccaacaaagcgaacttggtcaaccatgtgactatagtggtgaaacgccgctaaaagcgtcccatcgcctcctaccgacaaaacaatgtctgggtgctcatcatcaatttcaaacccggcagccagcagtttagtatgtaactcacccgctactttcttggtcttggcactcgcatttgcaaaaatcgttactttcatgaattttgatcttcctttgtcgtgtcaggctcatcgttgcccggccccttcccatacgagaacaagctctgagcttcttgaatttcctcacgaatttctgacatttctttatccaaactaaaggcggcttccgcagcccgttgtaatcgttgactcaagttttcagggaaatccccttgatatttatagttaagcgaatgttcaatggtcgcccagaaattcatggcaagtgtccggacttggatttcggccaaaattttcttttcaccaccgaccatttggaccggatattcaatcacgatatgatacgaacggtaaccagatggcttttcattactaatgtaatcgcgttcttccagaattgtcatatccgtccgttttcgcaataaatcaacgacctgatagatatcctcaacgaattgacacataatccgcaaaccagcaatatcctgcatatcttgttctaggcgatcttcttgtactttacgtcgggtcatcttttccttaatgctatcaacgggtttgacccgccccgttacaaattcaatcggttcatgctgattcaaatcacgaaattgtttgcgcattccccgcaatttaactttaagctcatcaacggcttgctgataaggcagtaaaaaatgattccaatcttccatcggggcacctccgtttcaatccataccctaaaattttaccataaatcgtcggaataaaaagttaacgttctcgagattgaaccctaagttcactttttttccaaactgtaatcctagaaacaaaatactttacgaatttagcaaatcggtgcatgattacgggtgaaggtttaagctaagtaacgagtgattttctgcattaaaaaatttatgaaatgaaaaacttgcaaatacctcgtttgattggtattctgcactatgacgcgaatagagaaagtggaggaattataacgtgttagaagtgtatttatttgtaaatccgttggcaaaccaatgcgtacgtgatgagcaaaacgtgttacggttggcaaacgactcagacaagcaaatccaatttcaattcgtaccattactcaatattaatgtgattcaacgggctctaaagtgccaaggaatcaaggcatccgactggcatgctcaaaatcaacagtctcaaacattgtaccgagttattttggattataaagccgccctttttcaaggcaaaaaacgggggcgtaactttttaattgccttgcaatctgcaatgctcaaggctggtcaacactattcggaagagctcgtcaaaacggttgcaactaactgtcagattgacttagacatgttcatggaagatcgggacagtgacttggcgaaacaggcctttcatgctgatcagcggcttgcatctgaaatgaacattaccgaagcatcgtcggccgtcgtttttgattgcgaccaatatgattatggtgtcttgctagaacattttaattacacgactctttttgacttagtcaatggcaatctggatccttttcaagatgcaactcgggcaactaatgccagctgtgctagccttgccaacgcacaattacacgttttataattccagtaattgcaattattcaactggtcctaccagtcaaaagcacccgacgatcattttcgccgggtgcttttgactgtatttaccttttatagctgccagaataagccttctggactcggcagctaacaccctaactgataagcgggtcaggtctaaaataagcgtcgggaccgaacatcctgacgctcattgtgcttgcttttataactggttaatcttgggtgaccaactgttcaaattcatttaatcgttcttcaaatacctcgaaagctgcatcaagataatcaggcttggtcatatcaactccagctcggtgcatgacatcgattgggaaagcagatgaaccagctttcaagtaaccgagataatccgcaacagcatctgtctgttgcgtactaatacggtcagccaacgttgaggccgctgcaaaacccgtggcatactgataaacataataattgtaataaaaatgcgggatacgggaccattcgtcggcaatttgcggatcactgacgacggcgtcaccatagtagcgttggttcaactgcaaataatgttttgacaagcgatcggcagtcaaagcctgaccttcttgatcttgctcatgaagccactgttcaaactcagcaaattgcgtctgccggaaaacggtgcctttaaatccatctaagtagtaattcaagacatacgcccgcatttttggatcttgttcagtcgctaagaaatagttcgtcaacaagttttcattagtcgttgatgcaatttccgccacgaaaattgaatagtcaccatactgataaggctgatgatgtgtcgtgaagtaagagtgcatactgtgtcccatttcgtgcaccaacgtatataaattatcaatattatcctgccagttcaacagcatgtatggcgcggtatcatacattcctgacgaatacgccccgctacgtttgccttgattttccaccacatcaatccaccgtgaagcaaacgctgttttgacgtgtttgagataatcaggacccaaaattttgagcgcttgtaaagcagttgcttgagcctgctggtaggaatagttagtcgtcggcttgggtgccaatggcgtgtacatatcatacatatgcaactgatcaactccgagcagttgtttccgtaacgcaacataccggtgcaataagtccaaatgcttgtcaacggacgtgactaaagaatcgtaaaccgccgtcggaatctgattggcagcaagtgctgccgtccgcgcatctggataatgatgagcctgggcaacaaaattgtgtaccttgacttggctagctaaagtcgaagcaagtgttcgccggaactggccgtatactttatacagtgcttcaaacgcctctcgccgaacagccggatgaacggactcaagtaacaccccataaattccttgtgacaatttgacagggttgccgtcgtcatcctttaccgttggaaattgaaagtcagcgttattcagtacaccaaaagttttcgcagaagcaccaaaaatatcactagcgcctgcgagtaaagcttcttcgctttcagacagaacgtgtcccttttgcaaccggatcgtatccaacaaatgccgataatcacgtaaatcgacgttttcatcaaggtacgtatccaattggcccggcgttaattccaagattgctggttcgaaccaggcagtcgctgcggataccttggcagtcaaactactagcttgatcgtctaaagccgcattggtactattgccagtatcctggtcacttttcagacttgcgtataccgccactttctctaaccgacgatacagcgctaaaacagcctggatgccagccagcaccgtgtcggccgagcttgtaaacgtttctttaagcgcagtgacggtggggattgcagctttgacttgtgcaatatccgcctcatacgcggcctgatctgcataaatgggcgtcaaatcccacgtcagttcttcaggaacggccgaacgggtcggcaattgtttggttactaccatgcaaattcctccaattatttcaatatagcactagattaccacagattgcgcctatcgcggtagcatctgttccggaatcaatgtttgcgccatcgaagctggccggaattcacatgccactcagttttctgccagtttatcacttgctgctcgctaagcatcgtaatcatggtcgttatcagttgttgtattaacgtgcctcgtgcttgcaggcaggcacgccgggcaagtaatggccgtaattgggcccagatcaatgcctctaattgtggcccagtaagccgtccggactgttgccgcagtgcaaaaaagacgtgggcgtgccagaccagatatggtcccgataacagcggtagttgcggcacagtgggcatcgtccacgtcggtaactgggcaatcgttcccccgcgttgatagcaagccacttgtaacgcatcaaaaccacgttgatgtcgaagccgtgccaacattagctgttgataataatgccgtaaatgcgtgtccggcaaagttggggtgttaatttttggagccaattggcgaaaatgtaacaccgactggctgcgcgtatccagtcgaatcgtttgataggtcagcggttccgtatccaatgtcaagacgtgatgcaataaacgaacactagtactttgagtgtccaaaaaaagtagaaacaggccccaccgttgctggtactgcaaaaacttcaaagccttgctattgaggtgcaattgtcgctgataggggcgtcccaacaaccataacacttgatagccatgctgacgatagccctgcgtccgagctgcgagtcgctccactgacaagggtgaacactgaaattctaacgcgagtggttgcgctgtacctcgtcgaaccaagatatccgggcgctgatgtatctctggcaaaccagcctctaagcgcaccgtataaccactggcagcgaaccaggtcgctaattgttgtttaccacgaagatggtccgttgtttccccttcagagaaagcatcacaatccgtggcatggacgtgggcaaaatgtggcacgatcactgccccccgtttcaatcgcaccggctgcacacatcctggacagtaatattctatttggcgatcagccgtcgccgcattaacgagttgatgctgggcatccatcgcgatcaacatgatggtccctcctttcaacaactaattacgtcattaaagccaattctcacgtaaacccatcatcatttattgaccccgagcagcacccgtcttttggcaaagcgtccggcaggcagattgtttatccgtggatacaaaaaagccttaacattacgaataaacgttatgttgaggcaattaactgctatttaaaatagtgccggatggtttccaaagcagcattagacatgatcttttcaccatgttcaagtagtacgtcagctgaaatattagctaaatgggcatattccaaggctactgcgacatcatctttgatagtggccgttgatgattgatcgacaaagaaaaccagttctagataatattggtcgcgatacttgaataagttagacgcgagtccctctggccggaataattgtgccaatgaaacaagatcctcaaattgatcgaatttcaacacgtattccttagttggtgtatcaggatcatccaaatacggatcgagatcattagtgtccttagttggattatgtgcaataccttgtccatcttcaacctgattcgtatccgtctgcatcagtttacgcttcaaataatctgaaacatcatcttgtgagtcgctatcatccgattggtcgggtgactgagttgctttagcaatcgtatcttgtaaattatcactgtttttgctaataaataattctaaaccatttcggtttggtaatacttggaaagttacggcatcattgtcctgaaattgatgatcaacatcaacttcctccaagatgctatagaagaaactttcaatttgcttatgattccctagtaaatctagtacgcgaataccgcgttcattgagatcatcattttcaataacgacgcgaatcgtatcttcgttgatgcgttccatctccattacagatccacccctttctaagtgtcaagggccataatcactatcacaattctaacttatttcagtttattgtaaagtaatctatctgaaaatacaaaaattggccaattagttaagctaactagccaatgataatcacatatttgctaattgttgtgcccgtaataattctaatgtccgaattttgcgtggcaagaagcggcgaatctcgtcctcattgtaaccaacttgcagccgcttctcatcaagcataattggtcgacgtaacagactaggatcatgagtaatcatgtcaaacaattcattgagtgacaaatcattaatatcaacgttcagttgttgaaaggcctttgagcgagtggaaataatttcttccgtccctgattcagtcagttgtaggatctgcttgattttttcaattgaaagcggttcggtaaacagattgtgttcttgaaaatcaatgtcgtgtgtctgtaaccaagccttggctttgcgacatgaggtacaacttggtgcggtatataaaataaccatcctgggtcctccttggcatcgttaatcaattttataacataattcattatacgctactcacttttaattgtgaataggtttaacaaaattaattcatttaaaactaataatctaaaatacaattattcgatatatgtattttttctattgaataaaccgcttttatagtcattcttgttattaattaattcgtatacaatttaattatgacttatgatatcaataatctattaacggtaaactgacagaaaaagcttagcaaaatgatttgctaagccctatcatactagccaagattcaattgtaaaaacttttgagcaactgtcacttgaatgtcattaccggcggctgcttgtgcttcttgttggagttgtgtaaatgagacatcttgtggcaagtgtgtgagcaataattttttgacgcgggcatatttggcaattttaccagactgtgccgacgtcatatgccacattttaccagttttatctgcggcaaaattcgtatcagtcatcaataactgtgccccggctgcgaaagtcgctaattctggcaaataagccgtatcggcggaaaagacaagttcttgccccgtcgctcgctcgaccaacttaacggcataggctggaactggatgtttagtcggtaaaaagctcacatcaaacggcccaatctgattgacagcagccggatcataggcccgaccttctgtggcattcgcccaggtcaaggcaccaaagttaagtggatcagcggtgtgcccgtaaatcggcagcacgggcgtcttccgttcaccagcacgcaactgccagtaatattgtaagaccccaacgtccgccgtatgatcgtgatgataatgagttaggagcacactatcgagctgtaaggggtctaaaatctcttctaaggcgtttagcgccccagacccacaatcgagcaataaatggtaatcaccggctgtaatcaggtaagaactcgtacccacgccatcgtatggataaccaccatagtaaccaagaactgttagtttcattattgaccatcccttcatttctctgtccacttctattttaatatagcaccaagaaaaaatgaaaccaacaacttaacatattttcaattattttgaaaaacacgtataataatagatgtaataaataaggagtgatattgatgagtggaaagattgcagcaacatttgggacacgtaaaattctaaccatgatccaacaacaaaatgctgatcgtgacttgttattaatgcaggccaacgccactgaagatcgctatatgctactcgatttaaccggcgaaaaaaccgttttttcaagccccgtaacgtatgacgttttactttcaaaaggatcagctgactggcatggaatgacaagtttcatcttcattgatttaccggaagaagaacaaaaagtctttaaatctaagtttagtagtttccgacacgattataataagccagatgggctgaaacatttttggatcttacgtgagtccaaaaataattcagccttcgtgattgtcacaaattggcatagcgactccgaatatgctgtttggctgcgaagcgcttcattcaagccatttgccaagtacatcacctcagattacggctaccacgaaagtcgctattcatttgtacgttcattaaaatcataatcatccggtattggatatttcaagtcgctgcagtgattgaactgcaacgacttttttcatgaatattacttttactcaacactgctaaatctcatcagttgatatataagcctcgttcacaacatcacattgcagtcagaaccaacatatgtcccgatcagtgtgatcctaaagaatctgccgtcagctttagttgagcaatcgtgagcccaatcagccatctgttgaatgacacccaccctatttactgattacagtgcgcacctctttaggtgatctcgtcaaacagttaatattctgaaaacacaaaaaaacgtcattcatcaacgaatgacgtttgtgacggtccgtacgagactcgaactcgtgatctcctgcgtgacaggcaggcgtcctaaaccaactagaccaacggaccaattgcgggagcagggtttgaacctgcgaccttcgggttatgagcccgacgagctaccagactgctccatcccgcgataatataatgacccctacgggattcgaacccatgttactgccgtgaaagggcagtgtcttaaaccacttgaccaaggggtcatatttttaaatggtacaacggagaaggagggattcgaaccctcgcaccgcttgcgcgatctatacccttagcaggggcacctcttcagccacttgagtacttctccaaaatgggcctaaatggacttgaaccatcgacctcacgcttatcaggcgtgcgctctaaaccagctgagctataggcccaaaaaaagcgggtaacgagaatcggactcgcgacaacagcttggaaggctgtggttttaccactaaactatacccgcagaatacagatatggcgcgggacggaatcgaaccgccgacacatggagcttcaatccattgctctaccgactgagctaccgagccattgtagccatttagaactattaacttaacggtccgtacgagactcgaactcgtgatctcctgcgtgacaggcaggcgtcctaaaccaactagaccaacggaccaaattgcgggagcagggtttgaacctgcgaccttcgggttatgagcccgacgagctaccagactgctccatcccgcgataataaggaggatgagagattcgaactctcgcgtggtttgacccacctgacggttttcaagaccgttcccttcagccagacttgggtaatcctccatatgatgtaactaggaaatgtccactattaatagtagatggaccttgtagggctcgaacctacgaccggacggttatgagccgtctgctctaaccaactgagctaaaggtccaagctctaattcctatcgcggcagggggaatcgaaccctcgacctcccgggtatgaaccggacgctctagccagctgagctacaccgcgatgtgttaaataatcgtatatgactacttaatcgggaaaacaggattcgaacctgcgaccccctggtcccaaaccaggtgctctaccaagctgagctatttcccgttatatgcacccagtaggagtcgaacctacaaccttctgattcgtagtcagacactctatccaattgcgctatgggtgcttcataaaagtgccgaggaccgggatcgaaccggtacggttatcactaaccgcaggattttaagtcctgtgcgtctgccaattccgccaccccggcaacactttggaacaaagcggaagacgggattcgaacccgcgacccccaccatggcaaggtgatgttctaccactgaactacttccgcataactattcagttaatgccgactagaggattcgaacctccgaccccctgtttacaagacagatgctctgccagctgagctaagtcggcatgacgattaacacaactataacatcatatcatgctcagttacataaatcaacaataacttttgtgaaactatttaattatgagccgtgaacaatgagccgtgacagtctcgaactgtcgaccctctgattaaaagtcagatgctctaccaactgagctaacggctcatgatggaggatacagggctcgaacctgtgaccctctgcttgtaaggcagacgctctcccaactgagctaatcctccaatttcgcatggcaacgtcctaccctcgcagggagcgatcccccaactactctcggcgctaagaagcttaacttctgtgttcgacatgggaacaggtgtatccttctcgccatcatcaccacactatgtgaaactaaatattaaattgaataatatccatttaaccttgcggttaaatgagccgtgacagtctcgaactgtcgaccctctgattaaaagtcagatgctctaccaactgagctaacggctcatgatggaggatacagggctcgaacctgtgaccctctgcttgtaaggcagacgctctcccaactgagctaatcctccaatttcgcatggcaacgtcctaccctcgcagggagcgatcccccaactactctcggcgctaagaagcttaacttctgtgttcgacatgggaacaggtgtatcc

SEQ ID NO: 4 - DNA, 280336 bp, synthetic construct
  source 1..280336: mol_type = other DNA; note = Lactobacillus plantarum PDG8 - Contig 4
ggagccattccctgagtaactagaccaatgtaaaacaacttctctttaatcgtatagcgagaaccttttctgcccatagaaaaactcctccttaggtagacaagctttgattatttgcttgtctacccaaagaggagtatatcccgaagattcctgcgagcagtttttatgattgttaaaaatagtggctaataatgacgtcctatacttagtctaagcattgaccaatcgactacgccaactgtaacgtttcaaggtaagccttcccccatcgatccattgctttaacgattggaactagtgatactccaatgttcgttaactcataaactgaatgattagcgaccgtttgttgactcacaatctgatccgcaactaattcctttagttgcatcgctaacattcgactggtacagcccggcatgccttttaataaggacgaaaagcgctgcgaactccccattaatcgacagataataattgatttccatttacccgacaagatactcaaggttgtatccaatggacaaaattcttcatgtcgccgactgttctcaattggtgtaattgtacgcatctcgccacctccatcgaaaattgtatcataataatattcttggtataactgaactgtttaatattattaagtgaccaaacaatgattaccactacatcaaccacaccgctattaataaaacaggcagcgcccaaaatttggacgttgcctgttttaatcattacacatcacgcgactaatacgcgaatgtcaaccgctatgtcggtaggataacctgtgttaacgtgaaagcaaagtcaacatgccaaccatggctaatgaattattgataatgtgcaaggtgacactatagcgaatatcgttgaaccacacgtacgtaaaagtcagcacgacggcgatcggtaagtaggctagtagcgcagggctaaatgataacgtatgggcaagggcaaatactaaactcgcaaaaactaatgcaaccgtgaaactcacccaatttgtgacccgcggaaataaccaacgatacatcagcccacgaaaaatcagttcttcgacaatcggtgccagtactgccatcatgacaacattaatgactggactagtagtaaataccttatccaaaatcacttggttttcagggggttgtttcacgataagtcccgccaacacgttacctaactcaaccaggataaataggcccactatcgttaacaccggacgtgtcggtcgtgataaactggtcacgattggcgcttgacgacgataaatcgttaccagccaccaaatgagtaatccgagcaagactaaacttgccactccggcaattagtgttgccgtggccgagaacccgtgtcgaattgctggcatcatcgtaggaatcatagcgagttgatatagtgcgaatagaccaattagtttaacgatattgaggagccaggtgacaatagaacgattcgacttcaaaattttccaacctccttatgtgtttgcatcagcttttcagctcgttttgggattagtccgccaagctgactaaacatccactagtgtccttgtcataataccataatgaagaccatttgattgtgaacaatcacctcttcagagtgaaattatgattgcactatttgaccagtctatcttaagaaactacaatcatcggaaaacagtgatcgttttaagtctaaccacctatttttaattatttatctgtttggagaactctgccgatattccaaatcatactaattctcaaatcattatctccgtatatattaaagtgagaaaaatcgtatctaaatctagtagcatcctaggaataaaaccatcatctagataacacttgatactaatctattttgttccaacaacctgaatgcattataattaacaagcgattaatttatatcgataaatcatgttttatattaaatagtttatttaaataagctatttattaaattttttatttaaataagctatttattaaattttttatttaaaaatataaattttacgtttaaatattatacaatacgttcattgggagactataacatgccagcaaaaacacaaaacaacttcattcgaagactaattaaccttcgtgacagtcggaactggtcaaaaactgaggtggccaggaaattagggttgagcagtatgcagcgatatgccaactatgaatatggcacgaatgagccagatttgaacatgcttaaacagattgcagatctatatgatgtgacaaccgactacctgctgggtgaagatagcgcatctaaatggattgctagaaaagataccactgacttaaaagactttctcacagctcatgtggattcgatgacatacggaggcgaagcacttacggaagaagaacgccaacaagtacgagtagcaatggccgtcatcttctgggaatagggctaaacgcgactaacgccccttacgatgaagtatcttaatgttcgaaccaagttacttcgggcacgcttatggaaagcttatttatcggccagaatattggtcacctttgtttatttatacgaaaaataagcctatcaatacggggattaatggtttgggtaggcttcaacaacttatgtccaataaactgatcgacacgaaaagctgttaataaagggaggagcttcaacatgaagtcaaaaaatttagcacttactaacgggattgtagggctagtcggcggcattattttattattcgggggctggtttattgctggtggcattgttagcgatgctgccactggatcagtatctaatacatcaggtgcggccgctttcctaaacattttgaaaattgctattttagcattaggaattattgcattaatttattataaaggtgataagcgtgtcggtactgcatcaggcgttttactaattgtcggcggcgcaatcgcgcttattccattcttgggttggattggcggaattctcgcaattattggtggatctttatatttagcttcattaaagtattttagtcaaccacaagcatagtctaatctgcaatcagttagtaatatcagcccttaactgggcttttattcaggcccaaaaagaacgtacgttccaattgtgcaaaccatttataaaaggccgttacaattaacgaattctgacaagtcttttgcaattgcaaagcaaaccaaatttactcagtgctatgcacacatttctcaatactgacattcgaatgcccgttggctaacaaagttaccaacaatttgttaacacttcaaagttcatagcgactactatcaccgggtttatcgctactgctcttagaaacgcccgtggaacgttaactgatgaatatagaataactatccttaccggatggattcgatatgctatttaattctgatttgacatacttgcgataaatgccgataagtacacttgtcagccagcgtttaagctgaatcaatccttcaactatcataaattctgacaatgcttgaaaaaattttaaataaaatttttattgatatgatgtatgtataaaagcaagaaaaatgtatgcttactaaaacttgagagaagatgaaaacattttgaaaactcacttttttacagttcactctgtcgacagtaatacttacgatttaagtaatatcaaaatatattttagcttcaatggtataacagttgaatcaattagtcgtgataaaagcactgtaattgcagttcgtggtgaattgaatatagacccaatttattcacaagtagaaacttcaagactaatgagaccatggttacttgtcattcaagggataatttctctatttcttgaatgtcccatcactatttatgacattactgaatcaggatcctctttcgtggttaaaaatggtatcgacaatcccccaaaaactatttttcaaaccgaaatgaatgactattcaaaagatttagaaaaagtattatttaaaatcaatgattcaaagtataaaaacctttctatttctctactcgaccgatggcgcaaaaatctcaacctagagaatgaggatttagaaagcaatttatatcgtgatgaagctttacttggactctttcaaattttagaactattgagtaacagccgcgaagatgaattaaagaaaattgcggaaagcaaaataaagtcaagtttgaaagaatatgcttcacttatgctaacaaggaatgacgaacttgataactatgttaacgataaatataagattgtatcaacagctctaggcgcaaagagccctaactttagcacaaaaataaaatatttactatcaaaaaatggtatagattcagaaaatgatatgtatttcgttgaatcagtaattaaacttagaaatgcgattgcacacggcagatttttatttcagccaatattccggtggccgctgactccattttttaacatttctcaaaacgtatctgaatttgacgtgctacgttctctagtaaaaagattgattggaaacttttttgaaataagtacttggaactctgactatacagaagtttctaaagcactcttgaaacctcccattaagacaatacagaagtttatgaagaaacctgagaccttcaaacaggttacgtttgatactttagaatcctcaataggaaacgaaactggaatcacctgggcaaatatttacctcagctatattgaaaatcccaaaaaactcaatctagatgatcttgctaattcattaaagcgttatttctttaatttgaaaaaaactgaagataatattgacgatatttttgtcacttcagtgatttttatggaatgtagtaatgatgaagtagttgctgaatgttacagaaagatagaatggctattgaataacacgcattttcacgacagttccctaatcaatattatgcctgagctagattttcatcacattcaatatcctagatataaaaaattcattgaaatgagacggaacattgatggtgagttttaaaatcaagttagccactagtatttttacaaaataaaaacaccaagacgaaaacctctttcattggagttcctactgtacgagtatctgtcaagttgtcatttgaaataatataagttttgctctacttaaacggcctcattccagtattccgctggggtgaggtcgtttcttgctgatgaacggtctagctgattaaagtagttgctgccttcttcaaccaaggccactaattctttataggtagctggtttggcatgtcggtccatccaacgtaatttgaaatcgttccattggtgcgttatcatatggcgttcctggtcgtgacatgctacgagtacctcatgttgcgccaaaaattattgaatactcctgatatgtatgccgaacctcggtcagtatgcactacagggtggacgtcacccgcaaaattaaaggcccgttgaaaaacctgaacttccgcattcgtagtttcagtttcacttagtttatgggcaattagatgccgaccgcaaagacccagtagccactcaggcgtactttatactgaccattaacaccataaattaattcagttgaatcggccaaccagacctgatttggttggttaacgctaaaatgctgatttaaaacattatcttgtaagtattgctcctgttgtttgatccgtgaatgctttttctgacgaacctggcaacgaattccaagcttgatcataattcgcttaacttgctttaacgtcacctgttcggtaacggtcgggtcttttctgagattagatagctgccaatactttgatgatgttggttataccagtattgaacccgttcagttaagaagttatctcgaatttcccaagtcgttacgtcacgatggagccccttataatatgcctggcggctaactttgagtattgataataacttagtgaccgtaccgtgattattttgactaacttccttgattgcgtggtaagccagtcgacgttgtgaattcacccttgcgctaaagttcctgatatttttttatgaaagcctctaataactgctgatccttgctttgtgattctaattgtctaatccacagattggctttgtccaaatcggttaattctgattcgggtttacgatgtcctcggttatcgaccaaaacttcaaaacctttagcttggtcctttaaggcccaataacgggcttgctgataagaaacgttgaaatgttcggcggcctcactgtatgaatgattacctttattaatccattccaaaatcgttactcgctcattaaaagtcgttttacggctcattttaggacctgctttctagacggtgaagccgtcacagtttgtccctattatacttgattggccagtttcttagctgtgaagttgaacgtaatccatatttattagttaatccttgaattgttccctcgccattcaaatatgctcgaatgatcttctgcttgaaagtctgactgtagtgctgattcttagtggcctctgctagtccatcaataccgtcacgttgatagcataacatcccattatctaatggaataacaactcaattcatgttgcttgctaaatgcgctaatagaaaggccagagctctgaaaatcagtaattaaagccaatttttcggccggtgtatgtctagaccttggcatataaaaaatccctccatggttgtcagatgaattatattatttcatctgacaaccataaagggatcatagcactgcaacaggttctagatccacttacttattattaataatattctattcaaaatcttttgcgtcaccaatgattatattttttcgtcggcaacgacgtaatgttattggtccagcaatcggtgccaaaagacctgcaatcaaaatgccaccaatcagtgtgacaataatttttccaataacaacccagaagccaccaaagtaccacatgccatttaaaatgcgtcctatcaaactttcacgataccagtacaaactaaatggatagaaataagcacttattgccgtcagaacaatatgcaatacactcatcgttactcctaataagctaacagtaactccaattcctgattgcatacctggataaaagatggccagtagaatcataccataaatggtccacacaactggtattactagtaataagtgagctaactttcgcttccaataatcgggatgtaaataattatatgcgtctaatttatggctaagttttttcctagataccgtaggctttatctttactggcttgggcggccgaacatactgtttcttttctgtcattcttcactactcctctgttgtcactataacattgcagcatcaatatcctgctgcttaattgcagaaaggtcttctccttgctggccggcgacacgaacagcaaatttcctgattaacctttcattaagattacgaacccagcggccattactatgatcgtgagagacattaaaattatgcataactaagtccgtgtatgcagttttatccacaatataatttttagcctttaagtcattccagccaatttcaattaattcctggggtgtataatcttcaaacataaagtgattaggaatccggcttcgcagtccctcattcatttttaagaacttttccatacgatcggtatacccagcgaaaataacaacaacatccgcacgatgatcctctatgaattttaaaatctcatcgatggcttccgtccaaagtctttctcatccccgttagctagcgtatatgcctcatcaataaataggactccgccaagagcagactctagaactttacgagtttttatcgcagtttcgccaatataacgtcctacaatgtccgaacgtgaaacctcgacaaatttctgatcgttaatgattcctttgtcaaataaaatttcacctaaaatacgtgcaacggttgtttttcctgtccccggattacctaggaatagtgaatgtagtgtcatggcatcactacttatcccttgctccttacgctgcttattcatttgggctatagcaataaattcattaatctccgatttaactccactaatccctatcatttcattgagacgatccaacgcaggctttttaccaaaataactcacttgaccctgcttgtccgcggaaatgtaatgatttgtttgatccaccacaaacgtcccattgtttaaattatattggtagtaatctaatgctgtcttaccgatatctacattccgttcaagtttcaaatttggatttgagatttgtccaaaaataatatggcagacctgaatattagagcggcccgcaatatacaaatttactttgccgttgtcacgccctagaataaaaaagcgatttccagtgacttgtgttccatttttgattgcaaagctttcccgaatcagtgtttcgttaatattagccgtggtgtgatctaaactaactgaatccacttgaccacctttaagtgtcatttgactgtttaacaccaatagagccatgtcaaacttgggctgattaatagaacaatcttgacaggttaatttggaatcacatatatgaacgcatggatacacttctttagacagaatttttccacccgttaaagttgacgatattaattggatagtactttgttcatttccgttaagcacacaaccgtccgtgtattctagttgacttttatgacataaaaattgagcatgcttcaaatacacctttgcacaaatccatgaattacgaatagtcagctcagaattctcgacgtaaatacgatgctttccatctgaaattttgctagctccgactgttacattctttaattgtacatgtgaatttccactaatatacacaattggatagtttgttccagtcgttgatttgttaattaagtaaacatcttcagcaattacagttgaacccatacgcacagtaattgcattactcttatcagtatttttctgaatacaaatattttgcaacgttactgtagctccatccttcactacaataccatcgattgtattggtatagatatgttcattctctctattttcaacgtgaccctgaattgtaatacttttagtaataactatagattggttattttgaccgttgaacggatcaaatcccgcctcaatctcaatgacatctccatcactggacgcttcaattgcctgatcaaaatcccacgttgaccgccgaccaaacagatttttcttatcaggacccactagataattactcatgacccctcctcactccttttcactcactattctatactaactacactatcacctttgtatcgtgcactgcaatatcactagtcacaaatgtcaaaaaatgtcctactaaaaaatgtcctactaatgataaaaaataaaattatcactcagaatttaaccttgattgcactaacttctgaaaacaaaccattcataatcctattacaccatcgatattacgcctgcattaaatctgaattagtacgcttaaataaaagtttgttttttaataagcttcattcaattctttgtaaaaatcattaccactttcataacttagaaattattttctgggttctctttgattcactcttcaaaagtgctaacaaactctttgtgatttggttcatcaattatcaattagatttagtcttaaacttctgtaattgccataacagttcttccacactctatatgatatatctctacttacttacattatccgcaatgttttgtgaacaaacaagaatccaataaaaaaagaatcgtgcaaatccttaatcactcctaagtgactaaagacctccacgattcttagtgagactgttgataggaaatctttcagattcgccaccaattcatccattttataagctcacaaatactgttaaatcaatattacgatttcatttttatatgattttctattcccattcaattgtcgaaggtggcttactcgtaacatcgtacacgatgcggttaacgtgatcgacttcattgacgatccgcactgagatcttttgtaagacatcccatggaatacgtgcaaagtcggcggtcataccgtcgattgatgtcacggcccgaataccaacggtgtaatcgtaggtccggccgtcacccatgacaccgactgacttgatgcctggtaatacggtgaagtattgccagatttcacggtccaagccggcttttttgatttcatcacgtaagataaagtcactatcgcgcacaatttctaacttatcttccgtaatctcaccaataacccgaattccgagaccagggccggggaatggttgacgccaaacaaggtcagacggcatccctagcttttcaccgagttcccgtgcttcgtccttaaataacgtccgtagcggttcaatcaacttgaactgcatgtcttctggcaaaccaccaacattatgatgtgacttgattgtttgggccgttgaagtcccactttcaatcacatcggtgtagagggtcccctgtgcgaggaattccatcccgtttaacttcgtggcttcttcatcaaacacttggataaattcgttaccaataatcttacgtttccgttcaggatcactgacaccagccaacttgcttaagaagcggtccttagcatcaactttgatgatgttcaagccgaacttaccttctaggctcgccataacttgatcagcttcgcccttccgtaacaaaccatggtcaacgaaaatactggttaattgcgtgccaatggccttgtgcaataacacaccgacgacactggaatcaaccccaccggaaagtcccagtaagacctttttgtcgccaacttcagcgcggatcttttcaatctgcatatcaatgaaatcatccattgaccagttagcttcagcttggcaaacgtcaaatgcaaagtgccgtagaatatcattaccgtagtccgtattccgaacttcagcatggaattgaatcccatataacttccggtcaacatcttgaattgccgcaatcgggcagttcttagaagtggccaccacgtcaaaaccatcaggtgcctgagtaaccaagtcaccatgactcatccacactgactgctcagctggcgtgttcttaaatagggtcgccgagtcactcgtcacgtcaatgttcgccttgccgtattcacggttatcagctgattcgaccttcccgcccgcaagcgtgtaggtcatcagttgcatgccgtaacaaatccccaagattggtaagcccaacttgaaaatctccgggtcaacccgaaaggcgccatcatcgtaaacactgttggggccaccagaaaagataatacctttcgggtgacgggccttgatttcttcagcggtgatcgtgttcggaagtagttccgaataaacgccgaaatcacgaatgcgccgggtaatcaattgattatactgactaccgaaatccaataccaaaatggaatcgaaagacgcggtatccgtttttgccaagttgttcactcctttggattaattaatgctcaataggtctatcatactgatttctaaacgttcggtcaaccagtatgagaaatttcttaggtgctaatatttgcggaaatacacggcatcaatcacatgatgcgcaactttgtgcaaaattaaatccgcacgattacgggttggcaagatataatcattcaagtttttcaagttaacctcttcccaaacacgctcggccatcgccattgcgtccttcggatcaccgatcgcccaaggatagaaataattcgtcggatcctggaaagccgttttcatcagggccttgaagcgttctaagtaccaatcttcaattaaatcggcatccgcatccacatacactgagaagtccgtaaaatcactaatgtagatcgcctgattgcttggcaattgcaacacgttgattccttcaataatcaaaatatcaggatgcgtgatcacgtcaaaacggtttggcacaatatcataagtctgatgagagtataccggggccttcgctaacggctttccgctcttcacatcgttcaagaattggatcagccgcgtcatatcatagctttccggaaaccctttgcgttccatcaattgcatctttttgagctcggcattcgggtataagaaaccatccgtcgtaatcaattgcgtccgccggtctggatataaatatttaaatagaatctctaataaccgtgctgtggtggtcttgccaactgccacacttccagacactccaataataaagggtgattggcggttctgacggtgtaaaaaaacggactccgtttcccgccatgacaagtagtgttcatacttggcctgcaacaaatgcgcaaacggcatataaatatcacggacatcgtcgagactaatccggtcattaaacgcctcaatttcgtgcaaattggctgcggtcaatggtacttgatgctgattgttacgataaaattgcttccactgttcacgtgagaagcgataatagttcatctgatcttccatgatttctgtctgccaccattactaaattaatgggttgattataacatgaaacccttatcaaacgctgattaaaattcaaattaaccggattcctaattggtagccaataaccattaatagctcgatactagttaacgctgacctagtaccgagctatgctactgtatcttattcgattttcagttgtgccgcgacctcacgagcctgaccaaacaacgtcgtaataatttccttgactggccgaattgtcgtcatcatccctgccacttcaccggccataggcgtaccatgttccatatcgccatcttcaacggctttcgcaaatgaaccgtccgctaacgcgtgtaattccgctaccggcgcgttagtttgctccaatcgcaagtattgtgccaacatcgggttaactagcgcccgtaccggatcgcgctggctgcggccagtcacgattgtatccgtgtcactggcagccaatacccgttgcttataactagctggaactgggcactcctcagctgtcagaaagatcgtaccgcactgcacaccctgggcggccagcgcaaacatcgccgcaatcgagcggccatcaccgacaccgccagcaccaatcaccggaatatcaacagcgtccacgacttgaggtaataatgccatcgttgacgtttgaccgatatgtccgcctgattcttgaccttcagcaaccaccgcatccgcaccggccgccaccatcttatgggcatggtgaaccgaagcaatcactggaatcactttaataccggccgcgtgtagcggcggaatatatgaagtcgggttacccgcaccagtcgtcacgaccttgaccccctcatcaatgatgacttgggccagttctggacagttcttcatctgtaacattaaattgacaccaaacggcttatccgtcagcttgcgggtcgcttggatctctgctcgcaactgttcggcagataaccccgctgaacctaaaacaccgagtcccccagcttccgaaaccgccccgactaattcatgggtcgcaattcgcatcatggcaccagaaaaaatgggatattgaatacctaacatttcagtgattgacatcgtcgtttcctcctcaggtcactaacaaccgttctaactagttgttagtattttcacgatattatgtgcctagtcagtattaaggtcattgtctctcaccgactactgcacttgatgagttaattttaacgcttattccatcgttatgatagcgttttcttagttattccgacacaagtcccaactgttccactactgatcatcctgacgcaccttaagatttccttcacaagtaaaactaaaaaaagtaccactccaggtgaatggagcggtactcactgtcttaaactgacttaaacttttgcttcatttaatgtatacaaggcgtggttcacccgcgctagtaacggtgacaagctacccaccgcgactagcgttagctcgtgcatggcccgtgaacagattgtatataatagttgccgttcatcttcacgttggtaattttcctgattagcgttccacacgatgaccgcgtcaaactccaacccttttgctaagaaagacgggactacaatgacaccaggagccaagcgttgattttcagtttgaatcaacgtgacctgctcaccacgagctttcagggccttcgtgagcgcctcgcattctgctaaggatttcccgataattgccgtcgtatcacgttcagaatcgttcatcgctagctgatcaacgacttgatcaacccctgcttcaaagttaggcgtcacaacgacatttggcaagtcgccctgacgatcaaaagccgtgacggcttcaccattgactaaaatttccttggtgaaatcagtaatctgttgcgttgaccggtacgatttagtcaattgcacgacccgcgtcttttcagggtcaaataatgtggccaattcattgatcagcgaatggctgttttccttggtaaaaatcgcctggttcaagtcaccgagcattgtgaagcgggcttgagggaagctaaacttcaggaacgctagctgaaaggcgttgtaatcttgaatctcatccaagaagacaaaccggatgtcacgctgcccgtgctttccggtcattaagtcatgcaggtacatgtaagctgagaccgttgttaacgagatatgacgttccttaatctcggctagtttccgttcaaccgtagcatcccagtcagcagctgagataccgtgatcagccaacttgatgatcttcggtacttcgcgtaagaaatgcgcgtactgcatgttgatgctcaagaaacggttacgcacgatttgcgtccgggcttttcctaagcgttgcatcacaattttacgtgctaagaatttaaactctttatcgccattcttaaattcccgcggctgattgccatataattgattgatctcttcgcgtgataagtcttgaaccgcttcttcgacccacttggaacgcatctccgattcaaccttgcgattcaaaatcttgattaattcttccttagttgctgataaccggttcgctaagtggtagttttcgttgaaagagtagtaaatcgatttaatcttttcccgggaaataatcacttcatcgttcaacgtaatgttacggaaacgcatgtccgcttgttccaaatgtcggccatacgttgtaaccgcgttgaaaaatgcgaggctaccttccaacttcgtaatctttgccatctgcggtgtattttcagtttcaaaccgctgctgtaaagtttcaacttgcatgtgtggtaaccggtacgatgcgtattggaaataagtcatctgaaccatgttttgttcacccagttcgggcaatacttggttaatataatcattaaagagttgatttggtgagaacaagatgacttgtccggccgtcaaattaccccggtaacgatacaacaagtatgcgacccgttgtaaaacggacgaggtcttcccggaaccggccgccccctgcacaaacaggaggtcagaactcgtatcccgaataatggtattttgttccttttgaatcgtcgtcacgatactcttcatcttcacatcggacttttcatccaacacttctagtaacatcgagtcaccaacggcttcatcagtatcgtagactgtcacgatctggccattctcaaccatcaactgccgcttcaacttcacattaacggtctgttcaccatccggagtctggtacgtcacgtgccctaacccaccgtcataataaatactggaaataggcgctcgccagtcgtagatcaaaaagtgattcggcgtgtcagaaaatgaactgagtccgatataaatcgtctcaggcttaggctcaccagtctcatgaaaatcgatccgcgcaaaataagcattcttttccaacttttttaacgtcgataattgcttagtcgcgtgcttccaactattctgccgctcatccatcatctgttgttgctgccgcacggataatccggtctccatcatgccttcgtaactatccgtttttatattgatgttattcagcaagtcacgtttaatatcggcctgatctttttccgagcgcgtaatggtttggctttgttgctcttcagccaccttaattttcgcaaccacatgatctaagtgttcctgttctgcagctttaattgacttagccattgaacgccctccattcctaaatatcgaacaataattttatcactatcggcggcccgactcaattaataacccatggcagccgccagtttttgattttttatgtaaatttgtttgaacattggtctatcaaagttacgattgtgttaaactggaagaaatgtaatcggttacatctgtttttcaacccgcagacgcttataataaatgcaacttaaattggaggtggcgccgttggtcaatttaatagccattttaacccatttagaacaaagtatcgtcccactattaactacgcttggtagttggtcttacatcttattattcgccgttatctttcttgaaacgggcatggttgttttcccatttcttcccggcgaatcattgatctttctcaccagcacgatggctgcaactcacagcgacgccctcagtattcagattctggtgccagtattctttgtggctgctgtaattggcgacactgtcaatttcgaaattggccgccatctgattcgcttaccgtggttgcaatgccacctcccccaatccaagcaacaacgcgcacaacaattttttgctaagtatggcgcgaaagctgtcatgtttggccgctttgttccactcgtgcggacctttgtcccgctgagtgccggggccgctaaaatgccgcaaccgaccttcgctatctggaacttagttggcgttggtatctgggtcagtgtcggctgttcactcggttacttctttggctcgatcagcttcgtacaaaaccacctctcgctttgttttctaggaattatggccgccgcgctcattccagccacagtggttgcgctgattaagacctggcgacaacggacaacactcaatctcaaataagcgccacacacaacacggttgatctgcaatcgtgtttttttattgcttctcgctttgaaaggcatgtctttccttttcaaaaccactcaaaaagtgtatcctttcaatgacttattcgagtggagggattctatgcaaccaattcaattaactgcctatcaatctgactggcaaaagcaagcaaccgagtatcaaaccttgttacgccagcaattacaggcgaatctattaaaaagtagtcacgtgggtagtacggccatgccccaattattagcgcgtccaacaattgacttggcgttgcttgttaaagatcaggcggctgccgtagctacgttacacgcacgaccggtcgctggaacgacgcatacttacgcgacgcaattagctgctaacgacatccacgtgatcattacaactgatgaacagcattatcagcaattgctcactttccgggattatctcaatgcgcaccggacagacggccgcaagtatactgccattcgcgaaaaaggtgtgcgcaatggacaagccgatctcgcagcctacctacaaatgaaagcagcattcatggcaagcatcaatgacaaggcccaagactggttagccactaaggatcagcatgaacaccacgaccggaccgtccgtgcagaactcgtcaacatgtgccttatcaccaatccagcgaccggcgatgtcctggttgaaaataagattgacgcacagtggtcggggttaacttttcctggcggccatgttgatcgcggtgaatcacaagtaaccgcgatgaagcgtgaagtattagaagaaaccggcttgcacgtcgatcaattaaaattagttggcaccgtaacgtgggtcgaaaatgcggacggcgacgtgtcgcttggtaccttatacaccactagtcactatcacggtgatttgctagccggctcatacgagggggccattagttggcaaccattgagccaactgacgcctgacaaattagcccctggtgtcgaccaaatcctgaaagttttcaccgatgcacatgctagcgaagctttctggggctttgatgatgatcagctccgtgtgtactaaaacgaatcgaagtatttattcatggatcaagtttccttagtcattattttattagccgcattattaattccgcttatcatggctaaattcaaaatcaacagtttgccaacggccgtcatggaaatcattgtcggtatcgtaattggccccagcgtgtttaactttgtgaacacctctgaccttatctcacaactctcaacgattggcgtcatcgtcctgctgttcttaagtggacttgaaattgactttagcctatttaagaagcggcgcacggcgttaacacctttagaacaaaaaaacgcggtcaacacaccgaaatattcgccagttcgactttcggtgtacgcctacagcacaattattgttctatcgctgttactcgccgctgcttttaaagtcagcggcctcttcagtgatttctggcttgccgcgattttatttggcacgatttcacttggtattgtaattgcagctttaaaagaacaggaattgcttagtaaggctttcggacaaacgattctgctcatctcggtctttggtgaacttgtaccgatgatgggactgacgctctatgcatccgtctacggcagtaactcacaaagtctctggttactattactcattttagccgttgccgcactattactcttacggttcaaaccattcttccgcttctatcaaaatattaacaaatcgacgacacaactagatattcggttagccttcttcttgattgtaacgatggtcacggtggccgaatccgtcggtgctgaaaatatcctgggcgcttttgtggccggaatcgtcttgaaactcttgaaccctagtgaaacgacccgcgaacgcttggatgctattggttacggcttcttcatcccgattttcttcattacgactggcgtcgatttgaacttacggaccttattaacaagtggcaaaaccttactattaattccactatttttcttagcatacatggttgccaagattggcggctactgggtcctaaagttacggttcaagcaagccaatgctttagccggtaccgcgctgactgcaacgacaatgacaatggtattagccgttcttcgagttgccaagtcaatgaagacaattactagtgaccagtccggcgctttcttactcgcagcgctactcacttgtgtcatctcacccctgatttttaacaagttttattcagctgaaaaagaagacctggtcaaaacagcggtccactttatcggcgctaacttaagcaccgtacccgttgcacaacagctacgaaaaggctggtacgacgtgtcaatgtacacgaatcatcctgagaattatcaaacctaccacgcgcaagtgccagtgaccttaatggaaaacttcacagcccaggacttacaggatcacggcgtctttgacacggatattttggtactcggccatattgatgccgaacgtaactacgagcttgctaaagccgccaaagcatacggtgtacggcggatcatcgttcggtttgaagaccgcaatgtgctcaacgaacatgaagatgaactccgagagctaggcgtcgaagtctacaatacaccagaggccaacattactttactgcgcgccttaattgaatcaccgtcaaccttgctattgctcaatgatactgaaaacagcatctacgaagtccgggtcctcaaccatctctatactgatgttcaaattaagaacttacagtttgctcaggatattaccattagtcaagtcatccgtaatcggaaactgatcgcgcccaatggaaatacgacgattatgtacggtgaccgcttaatctttaccgggaataagcaaacggccgctcagattcgacaagccttagcaactgctaattaatcgcagtgcattttatggtaaactaaacacattatggcttagttttgaacaccaagtagaggagtaaataatggcaactttttccgtttacatgattcgtcatggtcaaacttactttaacaagtaccgccgaatgcagggctggtgtgattcccccctcacagctgtcggcgaacaggacgctcgcaatgcaggtaaaatgctcaacggtattgatttcgatgccgtttacgccagtgacatgacgcgggcaatgcgcaccgcagaattaattcttcctgccagtggcaataccgatttgacggttcaaccaatggctgccttccgtgaagccttttatggctattttgaaggtgatgatacgtcgcagacctggttcatggttggtgcgccccatcaagcacctagtttgtccgcaattattgaacaatacggcatcgaaaaagccaaagatttctgtaaagaagctgacccgttccatcgcgccgaaaataacgccgaattctggcaacgggtcaatggcggtctcgatacgttacgtgctcaccatcacgacggggacaaagttttggtcgtcagccacggcaatacgatttacagtattgctgctcgttttgccgcactgacctcaccagcacggccccaaaatgggagcgtcacgaaattcacaattagcgacaacgatgtgacgttagactactttggccgcaaagaccatctcgactaaataaggagaaacacatggctcaattttcaatttactttgttcgacacggacagacttttttcaacttatataatcgcatgcaaggctggtctgactcgccgttaactgaatacggacaagccaccgcaaccaaggtcggtcaagcactagcgaacacggcttttgactactactacagcagtgattctaagcgggcaatcgacaccgctcagctcattcgacaagcggcgggtgccaccgcccagccctttaaaacactgatgaactttcgtgaagttttctatggttatttcgaaggtgacgattcaagtcggacctggtcactagttggccgccaatacggggtcaccagcatgcacgaacttcttgaacacgtgcctatcgatcagactcgcgacctgatgcgtgaaatcgacccttggcatgaagctgaagacaactcgatgtactgggaacggatcaaccagggctttgactacttgaaagctcaccacgatcaccatcaaaaagtcctcgtggttacccacggcacgacaatccgcagtatggtcgcacattttgctcctgaaatcgacatcacgaacggccccaaaaacgggagcgtcactcgcatcgacatcaatggcgatcaaattcgcgtcgtcgattatgcgcaagacttagctgacgtgaaagtcaatcaacacttataattttgctcatcaaacaaaacgctcgcaaccactgactggtcgcgagtgtttttatattggctctgaaataactgttgttggtaattaactaaatacgtgattactggcgacagatatctttatttgtattttaatcatgggctattgaacaattcgaattgaaaaaggtgctcgccattgtttgactaagcacccgtagcactattcgcaacatcaattgacagagaaccaactcggctatcttatcaatgatgtccttaaactttgctggttaaagacgtgtttgaagaattcaggtatgctaccccaattcaaactattttttcaaaaaagcaagcacgttcttcttagacggtttcatgcttcctgctaagaacgcaattacgactgccacaacagcaaacaaaagttcccagactgaccaattaaaaactaccgttaaagctaacataatagcagctgcaattatcaagacgccatctctggggcctaaattcagatacggatacatcatcatcagacgtcacttctttcactatttgttgtactcaaccaagactatacacagaattactgacgaaattaagaaacccctccgagaggtagtgcgttgaccgggtgtaacaagaaaattttgtaaagtcttggcaacagtgcgtctatctcaggtcggaagaagtctaagaataacccaaatattcatttaacttctaaagttattataacaccgctttcatgcttgtggtcattcttttataaaaatattgaaaagctgttggggcttcactgatgaatcacaaacccactaacacccccccaatcctaactcgtgactttgataccaataatgccaatgaccagcattgcaatgaagattcacgtgatgggtgcaattgtatctttgaagaaaaccaggccaacaattatcgcaccgaccgcaccgataccggtccaaattggatatgcaatactcaacggtaagtgtttggttgctaatgctaagaagccaaaactcaagaccatgccaactactgtggccgcagcatagccaaagtgactgaacccattacttaatttcatcatcgtagcccataccacttcaaataatccagcaataattaaataaatccacgtcattatcaattcctcctcaaaataaaaaggacaacgtccacccaacttccacaatgacctaaggaagttgggttaacgttgtccggtgacaattcatcttaatatttcagtccactatagcaaacctcatcggcatggtcaagcttactcaccgcaaagcatccactttgtcagtggggtcaacggtgtcggcaaagcatctaaagcaaagaaagccgcagtactcgtctcatcggtggcttgaatcaattcaccacccgttgtattggcgcgatataacgtggtgacactgtcaataatgtccccgttaggatactgatagtgcatcttgggcccactatagacatcgatcagcgttaactcacccaccgtcagcccagtctcttctttcaattcccgtcgcgccgtttgctggaccgtctctcccggttcagtcgatccagctggcaagccccaacagtggttatcggttcgataaatcaagacaattttgccaatcgaattttgggccattaaagccgcaccggccactactagcggttggtgaccaactcgccgccgcaaatcaagcacgtaacccatttttgattcctccctaatacccgaagtcgtaatattttgattagacatgttatacttaatgcaatcataacacgttaggagtgagtgtatgtctgaaaccaacgctcaaaaagtacaagaagtcatcattgccggcatgtctaaaacggtcgccaattacgactacgccatgtccgagctagaagcgctcgttgcagccaataatatgcacgcggccctgcgaattgaccaaggattggaaaaacccaacccggccaccttcttcggcaaaggtaaagttgtcgaaatcaaagaagtcgcagccgccaacgatttgcacattatggtcatcaacgcggatctgacccctagtcaggtgcgtaacttagaggaacaaacggacattcagatcatcgaccgtactggtctgatcttagaaatttttggtaaccgtgcgcggagcaaggaagccaaattgcaagttaagattgcccaattacaataccaacttccccgattacgaacgagtatctccaatcgccttgaccaacaggctggggccgctgctggtggtggcgggggctttaccaaccgtggtgctggtgaaacgcaactggaattaaatcgccggacaattcaagaccggatcagtcacgcgaagcacgaacttaaggaactcaataaagacgaagtagtgcgacgttcacaacgcgataaagctgggctccccaacgtcgctttagtcggttataccaacgctggtaaatcaacgactatgaatggtttagtgaaactgttcggtaagggtgaagataagcaagtcttcgaaaaagacatgcttttcgcaacgttagatacaagtattcgtcagttaaccttccctgacaataagcagttactgctcagtgatacagtcgggtttgtcagcgacttgccgcataacttgatcaacgccttccgttcaacgctagccgaagctgccaatgctgacttactcattcaagtcatcgactacgccgatccccattacaaggaaatgatggcgaccactgaaaagacgctcaaagaaatcggtgtgcacgatgttcctatgatttatgccttcaataaagctgatttaaccgaagccgactacccgaaccagcaagatgatcaactcatctatacggcgcgtgatgaggcctcactacaagctttgaccagtatgatcaaagccaaagtctttaagaattacgtgacaacaacgttattaatcccgttcaatgatggtgaagtagtggcttacttgaatgaccacgccaacattctcaaaacggattacttagctgatggcacccaattaacagtcgaactcaacactgtcgatgcccaacgttatgaaaaatacgtggtgacacctgcttaaacgactcattcaaaaagatggctctaggattaaccgcctagaaccatcttttttgatttaacaatcaacccactctgttaatcgccaaaccactagtgccaatagtgaacatcattcagtcaccattaacgcgtgcaattgcgccaatagttcggactgcgaccgtcctcgccattgacgttgaaaagcataactagtccccttcagcatggcaattaacatatcagcttgaaactcacatgccggtttcgaaagcgttggcttcaaatcacgaaccagttgcgttaataggtcacataattgttgataaagttcgctctgataaaattgacggcgaccaggttcaccggcctcgacattcattaataacgccatgttgtgctcacgaatcgctaaatattccccaataacatgatcaaaacgtgccgctgcacctaccgaggtcgtggtcaagtagacttgattggttttaataaaagttgcgactcggtccgttaccaatgccaaacatagtgtacttttatgggcatagtgacgatacaacgttccgggaccgataccagcggccgtcgcaatatctttcatactaacggtttcgattgaacgcgcggcaaagagttgtcgcgcagcagtcaaaattttctgttggttaatttgtgcatcctttcgcattcgacacaccctcctatttacttaagttcaccatacacttttacgcatcacttgacaaacggagtgtactccgtttaaggtataattatacaatttaagggggaattcactacgtttgtctttttatccggattactaatcggcatcttcgttagtctgattggtggcggaggtgctgccctatacctaggtgtcttaaccagtcaagtaggccttgcaaccgcggtagccgtaccaacctccctaatcgtcgccttaccagccttattctttggttttctaacacagttgaaaatcaaaaatgtcaatttcaagattggcaatcaaatgatcattgcggccgttcccggtatcatcgtcgggacattcagcgcacaatttattccccaacaactgtataactggattgtcgggacaatttttttgattatgggtgcgatggtactaatcaagtatgttcaccattctaaacaaactacagccggtcaccaaccttggcaagctgccttctttggccttttaagtggattgatggtcggcattggcggcttaagcggtggtgcgaccacggctgccgggttagcaattcttgggctaacggccgttgaagccgctggtactgccacctatgtgttaactgttatgtccacaatcagtttaatcggccatctctttactagtacttttgcttggcaatcaggattggtcctcatgattggcgcaattatcggcgcaatcattacaccactcgtgattcgccatttaaatttagataaggtcaaccgcgtattaacgccatttcttggtcttattattatttattttggcatcaaaatgtttatataaaggcagataaaaagtcacttcaggcagtcgtaaacttgaagtgactttttgatatcccctactgaaaaaattcataatcatgtgtataccaagaacaaccttctccagcatgttggtggctaagctaactgccgacgactgactaggtaaacaacgataatcaatggcagcgtcaccatcatcacgggataaaaccacgccattggtaattgactgctaatcagcccgccaatgatggggccaagtgacatcccgagatcaacaccaatataaaacgtactattggctagcccatgatcagctttcggcacgagcatcaatgctttagcttggcaaattgaaaacatcaaaccgtatccggcggccagtcctgctgcacccagcagtagcatcgcccaattgttcatgtcagttaagccaatcaatcctaatagattaaaaattaagcataaccagatgaaccgtttaaatggcacccggtcgaaccaatcgcggagaataattcgcaatactaataaaatacccgcgtacaccgggaaaaatacccccgctgccacatgaaaatgccgtgcagcgacgtagctgacaatataggtttgggtggcaaaatatggtaatgaaaataaaagcaaaatcaaggccacggggattactcgtggttgtacgatgcgaatatggtgcttagtcgtagccgtttgaggcgtcacaattggttcaccatgatcaccgacgaattgaatcatgatgatgagcagtaaactacagcccgctgctaaccaaaaaacactctggtaactgtaatgttgatacaagaagacactgattgccggcccgcacgccattccaagcgcattcgctagcccataaatgcccattccagagccaattcgatcgggtggcaataaactagccatccaggttgccatgcaaactgaacacaaggtatatcccaacccattcaaaattcgcaataacatgattaacgtcacgttggttgtcaaactataacctaaactagctagtagcaacaaacagccccccacgaaggtcaaacggtacttagagacccggtcggttaaattcccagcaagtggccggagcactagcgatgtcaaattcgttaacccggcaatcgtaccggcaagcacactactagcgccaataccgtgcgcaaatcctgcaatcacgggattgattaacattggactcattaaaaagaagaaactagccattaacactaactttacatccggcgtatataaacgcgtcttcatcaattctcatcactttctaaattctgattaacttgccgtaacaaatctaaaaatacctgttgttgttcggcatccaaatgggcaaacatttgcgcactcgtctgccagccatgttgacggagctgctcgcgtttagcacgcccactcggggtcactaccacttgcttggcacgcgcatccgttggactgaccactaattgtacatatccgcgcgtctgcaagcgttgcacgatcatcctggccgtctgatgggtaatttcctgatacgtcttaaacgcggttaccgtgcgacctggctgatccgtaaaaaaggtcagtgcatccgcttgctgagtcgttaaccccaccgtccgcaaatgttggttgcgacgccgcttgatttgacgagctaaaatcagaacttgccgcgccaccatttcatcatgattcatcttaatcacctgccctttcatttatacagccagctgtataaattgtcaaccagcgaccgttattttttctagcagcctgacgatcattttaaacaacgacaaaaaagtggctaggcttggttagcctaaccactcataccgttgactataacacatttttccggcgttgcgcggcacgccataacgaaaaggccgtccaacagctcactaagacgatcaaccaactcagggctgttaaggacagtgacttaactaaggtcgctgccaccaccacgccaataataccgcctaaaataatgccgaataagccgcgataatcgacgcggtcatggcgaataaaattcactgccgaaatcggcatcaacaatgcgcacgacagcatcataattgggaaggcggcaatcggggtcaatcccagaaaatacaccattaccatacacggtgcgtacagtccgactccggctgacatcagtaaccctaggataaagttgccaccaatgccgaccaataatttccaaccggatagccccgtcgcctgattagcaactcccagcaaactgatccaacctaataacttcgctgccatcagtaaagcagtgatgactaacgcaccggccatgattaactgaatccaccgctgattaagcttcgtcatgacttcactacccagtaatgcgccgagcgttgctgctaaaactaaactaatcagtgtcactggctcgaccgcaactgctgtaacaaagaaaaacgcctcaaacgcggtcggaatcgcatgcatcgtgttcaaagttccaggtagcttacgttcatcctttaaataatggctcgcttgaaaaattgccgtggacacgacgaaacttccgataccaagtgtgtcaagaaaatccgtcacggccccgataaccatgccgaaaccaaaactgtggtcaaaaaatggcgctgcttgccgtctggcaccggctaacagcaacccaaataagccgatgctgagcagcatcaacaacaccacaattgcaattaccatcaatctaaccccactctcttacctactcgtagcattatactgtatttttaggaaggaaccaaaaattattaccatgacgtcactgcaagtggtacccacaatcatcagtttgcatactgaacgtgaccaccagaccataagatcccaccggcactagggcaactaggcccacagattgtcagaatgtgctataatccaatcaatcgattgtgcacaatcattattagaacgtctccgcacttaatactcatcgcatgaaaggcggtaattatcatgaagacaaccacaattcgcccccttgaagaccacgtctgtttttcaacctacacaacagtccatgccattcaacacctctaccaaccaactttgacagcacaccgactcacttatccacaatacttggttctagtcgcactctatgcgacaccgccgcacgctgtcacggtcaaaacgttgagcacccagctaaatttaagtacgggaacgctgacgcccgtgctacagcggatgacccaagctggtttaattacacgtcatcggaatccccaagatgaacggagcatcttgctcactctgacacctcagggaaccgcaacacgaattgctttaaatgatttgccggatttattgactgctaagggtggtctcaatcaatccgagtgggcacaactaactcaattaatgactaagttaatgactaacctgacccgttaaataaccctgctaatattaggaagataaataaattaatttaaagccaccacgccgcccaatcctattttgtcgaaactcgaatcaccaaccgaataacactgattattttgagtcttgtcgaactttattattaaaatatcgttattagttcggattttaggcgaaaaaccggccacaaccaacgatatttgattgtcatcaccattaatctctggtatgctaagtgcaatcatttagaatttggttgtttcaagggaggatttcaggttaatgcaggaaacaaagcaagcaacgaccctgaaccgttcactcggtttttggtcagcactttcactcgtcgttggtacggttattgggtcaggaatcttcttcaagcaatcatcagtccttgatagtgcgggctcaccgagcgctgcgttactcgcctggttactaggtggactgattacgttgaccgcgggcttaacaatcgccgaggtcggtgcccaaatgccgcatacgggcgggctctatgtctacatggaacaaatctatggtaaattgtggggctttctctctggttggatgcaaatcgccgtctacggtcccgctatcatcgcttcaattagcgcttaccttggtatattactagttggtttcttcaacctgcaggcgggttggcaggcgccactctcgattggcgtcatcgtcctgattggaatcctcaacatgttcgaaaaccgttggggcgccgcatttcaaattgcgaccacgttgggcaaattattaccgattgcggctattattatttttggactcttctatggtaatcagaatgcgctgggacagtctttacatacaattacccaatcaacgggtagtttcggggttgccgtcctcgcaacactttttgcctatgatggctggatcttagtcgctaacttgggtggcgaaatcaagaacccgcagaagttattaccacaagccattattttagggatttcaatggtcttgattgcgtataccttagtcagctatgggattctccacttcgtacccgcggcaacgatccacaaactcgggcaacaaacgacgctgtactttgcccaagcggcgtttggcacaattggcgggcgcctactgaacattgggattatcatctcgatggtgggctgtttaaacggcaagattatgaccttcccccgcatcgtgtacgccatggctgctcagaatcagctgccattcgctaaacaactcagttacttgcacaaaaaatcacacgagccgatcgccgcaaccattgccattctcgtttatgctagtattatgatcctgttctttaatccagatcgcttatcggacctctgtatcttcacggtctactgcttctacgtggcaaccttcgttggtgtctttattttaagaaaacgacgcccagcttctgagcgaccattctcgacacccggatttccgatcacaccgctgattgcgattctgggcgcactgttcgtgattatcagtgaaattggctcagacttatctggtgtactgatttccttggttatcgtggccgttgggttcccaatctattattggaagcagcagcaaaatcaaaatgcttaatttaaattcttgataacttgtaaaagagcgttgttactgaagatattttcagtagcaacgctctttttatgctttgcaacgcgcattgaataagtaatttaatctgcttaccgattaccttaacgcttagtaattaaacctcactatatttgattaatttgatctgctgtcgttctaaccattcctgcatttgaggatctgttaaaattgcgacttcttgcgtccggggaactgtcaggcttgaatgttgtaataagtagtcatccaaatagccaggatgacaaaccatcatagcatagccgtcattatattgggctagtgccgcacgtttcaacgtttcataagggttatagtttttgcccatactttccataaaaacatgtaatacctttcccttaaatagcacactcggactatctgggcctgctgcaaagcgtaaaatatttaagtgatgacgttcacccacaatttccaatcccttaacaaagttatcactaactaccgcatgaccctcaaaataatcaggctggcgaccaactaacgctacaaatttttgatattgcgcttcgatttccaaaacaacttcattaagatcgacaaaatcatgaatagccgccatagccgcccgataatccgaggaatgacgaaaggtaccatctggattagtgatgctcggaatcaattttggatttgttaatggccggccagcagatataacagtatgcaaacctaagcaaacccctgcatctttaatcatggctaatcctgacatcgtcgttggcatattgaccataacacccacattattaattaacccgttgtgaactgttcgtgcaatcccaacattaactgcatcggaataacctaaatcatcagctcgaacgattacttttctttccattagcttttaagcctccactagtttaaattctttagtcccctgtttgtttgtattggcttcaacaccaatcgcataagttgcaatagcagctgctacaaacgcaatcacgccactaaccacaccgttaatcacattagatgtttgcccgccaacatacgcagttaaagataaaaagtttgcaacaggtaccatgacataagctgtaactgttgtcaggccagcatataagccaccgcaaaatccgccaatcatcatgccaataaatggtcgcttataacgaattgctagtccatataatcccggttcagtcacacccccgataatactagcgattaaataaccccaagcaagggtcttttgatcttggtccttaattcgtaaggccgcacctaaacacatgcccgcgaccgacatactagcagcaactgcgccaagtgtgacaaagttttcatggcccgattgcgcaaaaatcatcatcatcgtcgtaagcattaagagatgcatcccggtcataaccaagatttcccataaggcaccaaccactccaaccgcgatcatcgttggcaagccacctaatttcccaaaagctaatattcctgtacaaatgtaattgccgataaagtttcccgctgggcctaaaatacataacgaaatcggcaacatgattgcaatcgtcaacgttgggataacaatcgtactaattgactctggtacataacgcttaaagaaccgttcaatatacgacattacccaaaccgacaaaataattggaatgaccgtacttgaataattaactaatggcattgcgataccgaagatattaaatgcctttccagcagtcacaattttaattaaattaggatcaatcaaaattgcacctaaaaacattgaaataatccgtgacgtattaaattgcttagcagctgtatatcctaagatgattggaaaaaagtagaatccagcatcaccaaccaacgtaaataactgatacaacgatgttttagtaccaagaatattgaacatacttggtcctaaaatggccgcaaacattttaaacattgatgcagcaatcaacatcggaatcaatggtgttaaacatccagccaatttatttagaatcatatttcccgcagacttaaacgttaacttttctttaggtcgattatctaaatcttcattaattggaattggcgcgtttctagttaaattccccaccgtaagtaacgcatcataaactttgctaactgcttgtccaataatgatttgatactggccaccagcgcgattgacaccaatcacacctggaatattctgtacctcaccatcattaggaatactttcatccttcaaattaaaacgtaatcgggtcatacaatgtgtcaccgaagaaatattcgcactaccaccaactgcttccagtacaccattcgccactttttcatactgtttatccttatttttcatgtcgcatacacctccattaattaacggttacgcttgagtatttattttattaacgattcttttaacatatatcattaggtagaaaagttcatcatcattactattagtatcaagttgactatcaacgcagtctgcaattcgctttgctaccaagtaaatttcaggctcatcatgcctcatcgtattgaataatttagaattatcattttcagaaatttgctcatgtttcttcatccgtttaatgtaataccgtaaatgcatgacaaaccggttgtatgtgaattcggtttgattgattctaagctcatattcttgttcaataatttttgtgatgatttttatcatttcatcgtcgctatttacacttgaattggtcgctaaatcattagtctgagaattgacaaaatgcatggcaattgctgtgacctcggaaactggtaattgaatatttagccgtcgattaattaacctgacggcgcaatacccaacatccgtttcttgtgggtataattgctccacatcatatgaaaatggtaactgggcgcttttataatgggttagtcgcgttattgcaaagttaatatgatcagctaagctaaaaatcatatttggattcaaaattcttggaattagtgcctgcgctcgctcaacaattgctgcactcaaatcaaagatttcagtaggtatttcttttagtaattgataatattgatagtttaatttataaaatgtcatcgtcactttagtcatatcagtaagctcatacgggactttttgaaatcctaatcccttaccaaaggcgaccaattcttcaccatgttgatcaagacaaacgaccacgttgttattaattttcttcaccacccgcattttaattcgcactcctttacatagtttatgcttgctttaaaactggtgttccggctgctaattgttgatgaaacttactgccaagtggcacttcgcccgtataaccttctgtaaagacgactatggtggtcatatctaatcccgcgatcgccatcgtttggcgatcaagcgtcactaatagggcccctgctttaacttcttgatttaatttaacgtgtgccgtaaagcctctaccatttaagccaactgtatctaggccaatgtgaaccaatacagacacgcccctagtctcatccatgatgccaatagcgtgtttactttcaggtaatgcaacgattttcccactaatcggtgccacaacttgattagtgtcctcactcggcctaatagcaaatccatcacccatcattttctttgcaaacacttcatccataacggccgtgatcggtatacaaataccttcaattggtgtaaccacctcgaagacatcaactttctttcttttaattccaaacatcactgaacctccttcaatacaaaaaaactccttgaggcacccacttcacccgtatatttcaacaagtaaaaggtaatgcctcaaagagtatgagttacaatccttaatttcagttttatagaaaacgttttcaataactatattatcacgccttctattttttgcaagacatttaaatattttttataaaaaaggccaaacaaagcattattgcttgtttggtcttttcattaagaaatttcagccatcatcccaccagtttaattacgctaacttcttatccaacacacgtgacagaattgacaaggcgtaacaaataatgaagtacatgactgcgatcattaagaacatcggtaaaatatacgctgagttctgaccataaataatttgcgcatggtttaataattcaggtaaaacaataatggttgccagcgacgtatccttaatcagtgagataaattgactcacaatcgttgggatcgtcttcttgattgcttgtggaaagacaatgtgccataacgcttgtacatagctcatcccgttagcccgggcgccttccatctgaccgtaatcaaccgccaaaatccctgaacgaatgatttcggctaacatggccgattcaaaaatcgtcatagcgaggatggctgcgaaaatgatcccaggcttgaatcccaagtgtggcaagccaaagtaagtaaagaagataattaagatcaatggcaagtttcgaataatgtcaacaacaaacccaaccactgccgataaatatttaatcttgacgtaccgaagcacccctaggactgaaccgataataaaactggcaatgatggaaacgacggacacttccaccgttacccagagtccttcgagcaagaaccggatatttatccacgaatacgcttgaataaagttttgcatgaatcgtcgcccccttctagtttgctaattttttctctaagtgccgcatgtaataactcagtggcaacgtaatgattaagtaaaagacccctacgaccacgtagctattgatcgtatcaagcgatagtgacgcaattgaatttgcttggtacatcaagtcgaacccagccacgaaagctaggacagaagagttcttcaccagattaataaactggttgcccaacggtggaatgatgattttaaatgcctgtggtaagacaattttactcattgcctgccagtacgtcatcccattagcacgggcgccttccatttgtccaggatcaacagattgaattccggcccgaaccgtttccgcaatgaatgacgaggtatagattgttagcccaattgtccccgcggtaaaaccatcaatcttggcaacatacattggaatgatcacgtagaagaacatcgcaataactaacaatggaatgttccggaaaatttcaatataaactcgaccaatgatgcgcatcgtacgacttggcaaaacttcaaagatagcaaacattgttccgatgatcgtactgaataccaaagcaatcacactggataacaacgtatatccgagtccttgaatcagctctgaccaatagtgcgttagaatgtatcccattagcgtgacgcctccttatagtcgaagccggccacgttaccaaaccacttcttcaagatgcggttgtacgtcccgtccgcttcaatttctttgagcgctttattcagagccttttttaacggttcctgacccttattaacagcgatcccgtatggttctttcgtgaaggtacccccaaccacttcgtaccctgggttttgcgacgccatcccgtaaagaatcccattatcagtagtcaacgcgaccccctgaccagatttcaacgccgtcattgcctgagcatagtcggataattccaacaccttagccttaggcgctgctttcttaatgttctcaacggagtttgcaccggtcacaccaaggaccttggtgcccgacttattcaaatccttaactgatttaatggcactgccctttttaaccaacagtgattgccccgcatcaaagtatgaattcgtaaaatcaacctgtttttcacgttccggcgtgatagtcatcgtggcgataatggcatcaatgttcccattcttcaacaatggaatccgcgtttgactcgttacttggacaaacttggcggtagcattcttaccgagcacccgctttgttaatgccgtcgcaatgtcggcgtcaaaccccttgatttgattatctttaacgtccatcaacccaaataatttcgtatcagctttaacaccccacgtaatcgtcttactagctttatcattggtcaaaacatcctgttttgctaatgattgccgtgaaccgcaagcagttaagaccaccactagcatggcaagcatgccgagtgcgccaattagtcgtttcagcttcttcattcgtggtcctcccctacaaattagtgtgtaataattttactcaagaattgacgggcccgttcattagacggctgaccatcaaagaacttttctttagcatcatcttctaagatttccccatcagccatgaaaataacccgatcggccacttcacgagcaaagcccatttcgtgggtcacaactaacatggtcatactggagtcttcggcaacactcttcatcacgttcaacacatcatcgatcatttcgggatctagtgctgaggtgggttcatcaaacaagagacacttcggcttcatagctaaagaacgtgcaatcgcgattcgttgtgattgcccaccagataattggctcggtaagctattggccttgtcagccagaccgacactatctaataagtccatcgctaattttttattctcatcttccggccgtttcaagactaaccggggagcaatcatgatattttcaagcaccgtcttgttagcgtacaaattaaagtgttggaacaccatcccaacgtttttgcgaattttattcatatccgttttgcggtcggctaaatcaaacccattgactaacaattgacctgactggacacgttccaaaccgttaacggttcgaatcaaggtactcttacctgagccagatggtccgatcaaaacaactttttcaccttcattaatcgttaaattaatatttttgagggcgtgaaaatcaccataatacttttcgacgtcgtgaaattcgatcattgacattgcagtcaccttcgctttctctatcagcctgttgactgacggtctagaattattgcattaataattagagttaagaaatccttattcttcgttaatgctatttaaatagtttaatacataattagtaattttgtcaaaaagtagctaaatattgttcgatatccataaaatagtgagaaacagctacactgttttcagttaaaatagctgaataacagctccaatattgaacattattcgtgaaaagccaataataattcgcttttctttttggaactgccacggccgaataatttttagacaatgatttcaataaaatttatattattctaacaactaaacttaacccgcttttaatcataccactactgaaagccaccgaagcgtccggcgcataattttcacaattagtggttttaactaactgaactttaaaaattgttaacgcttccgcaatcatttctttaataatcactgctaacctagaactattaagaaattaatcatctgcattgtaacgggagacgataatatgttacttgaccaagcagctaacatgactaacattatagcggcccagattatcaaagtcttttatccctttgtgattgccaagactgagacgggggcctacttaaaattgaatttatccaccaatgaacaacgcgatccactcttctgggatgagctccgtagcattctgcaagctaaactgtgggtgccaatcggtaagcactatcaccagttattagataatggctggttagccgaatctactagctagttagtcacgaccagtcagccgactcaagagacaaataagccctccaagcaatatgcttggaaggcttatttcattgccagtacacctgaagcccagtcgcggacgcaccaccaaattagtcccgctataagctagttatcgaacagcgagtcgccgaacaagttaaccggtggggcactttgaccagccaccgtctcctacagccatactggtagtagcggctgacgccatcattaaaaggcgtgggccgtcgtttcaccatttagaattgctaagacgtcatccaggctaatatcgaccatgtttttgaccgctaaattcgtatagaaacccacgtgtggcgtgataatgacgttgggcatctgcattaattgtgccacgttggtatcttgaagcacctcaccctgatgattttggttaaataacgcattttcaccctcaaccgtatcgagtgcacaaccggcgatttcaccggcctttagcgctgccacaagatcatcggtgacaatcactggtccgcgtgaggcgttgataaggtaggcatccgtcttcattaacttcaaggctgccgcatcgatcaaccccgcagaggtctcattcaaatccacgtgtaaatcaacgacatccgcctgccgcaataggtcttccttagtgtcaacgtaggttaaaacgtcttcgagttcaggatggcgtaccacgtcataggcaatcaccttggcacctaacccgtggaaaagtcgagcggccgtgccaccaatacgacccgcaccaataataccaacggttaatgatcgaatttctcgtgcttgcagtcccgcccactgaaaattctgttggctgattcgttgatcaaacatttccaagttgcgaatcaagcgcatggtttgtgccaccgacatctcagcaactgaattaggcgaataggctgggacgttcgtgaccacaagaccagccgccttggctgccggaatatcgattgtatccacaccagccgtacgactcgttagttgttttaacccggccgcagctaatgattggtataagctagcatcaccaccaattggactgcgttgctgaatgaccaagccgtcataacccttgaccaggtcggcagtttctggatggaattccagatcattcgtatctacttgaatttgatgagccgcagcccacgcttgaatcgcatcctgttcatcatcgcgaacactatacattaaaattttcatctttaagccccctgcttcttgctggcaacgtacgtcctgagccgcgtgaccgccgtcttaagatcggccattgaagcggcataactaattcgaacatagccttcaccacccgggccgaatgagctacctggaatcagagcgacacgtgcttcatgggctagttcacggcaaaaagccatactattttgtggcaacccggctggaatcttactgaagagatagaaggccccttctggcttagctgattggaacccaaggtcattaagtgcatcatacaaataatcgcgccgttcttggtactcacgtttcattacttgggcatcatctaacccatttttcaatgcttccgtcgcagctgcttgagcattggtcgtcgttgaagtcactgtgaattggtgaatcttacccagttgtgctgtgatagctttcggcgcacacatgatgccgattcgccagcccgtcatcgcgtgcgactttgagacgccgttaagcaaaatagtttgtgttggtaagtaatttgcaatcgattcatgaggctcaccatacgtcaattcgctataaatttcatcagacaaaacaaaaattggttgatcagctaacactgcggccagggctttcagatcatcatgccggtaagtcacaccggttggatttgaaggaaagttaaggaccaccgctttcgtcttggggtgggctgctaacgtcgtttgtaactggtcaggcgataacacgaagccattgtccgaggtatccatgaagactggtgttgccccagataatttaacgattgcgatgtacagtggaaaaattggggttggaatcaggacctcatccccaggattaaggattgaagtcaacgctgtataaatgcccccggtcgcaccagctgtgataatcacttcgctagcaggatcataatggacatcatacttagcggccaagaattcagcggcagccgtccgcaaggccaacgttccgttcgagggtgcatagtggctttcatccgcttcaatgctttcgattgcagcttgtttcacgtgctcaggtgtattaaaatccggttcaccgagggtcaaacgcacgatacccggaatatttgcgatttcagcgttgaacgccaaaatatcagacggctgaatcgccgcaatttcatgattcatatggttaacaagtgtttctgaattaattgacataaagattcctcccaagtttggctgatcttgttggtggaagcggactggactagggtcaaaaaagcgcaccccttgaaattccaaagggtgcgccaccacgcagaaacaaacttattagccacccttggaattttcaaacatccatgggcgccgtcaaatcacaaaatactcttggcaaccgcatcgatgcaaacatcggattcgtgtttgcacctctgcagccggcacaaacactagcgaaaataccaaaagtaaaagctagttctagattttaatgaatttaacggtaatgacatatcattagctcctcatcaattgttaatctaactataatggttgtcctaaccactgtcaaggacgaatttgctatactggagttaaatctactttggaaggaacgattatatgacttaccaagcattaatgtttgatattgacggcacgctgactaatagccaaccagcttacacgacggttatgcgtgaggtacttgctacttatggcaaaccatttagtcctgcccaagcgcagaagacttttcccatggccgctgaacaagcaatgactgaattggggattgcagccagtgagtttgaccactttcaggcccaatacgaagatgtcatggccagccattatgatcagattgaactttatccaggcattaccagcctctttgaacagttgccgtctgaactaagacttggaatcgtgacttcccaacgacgaaacgaattagaaagtgggatgcgctcgtatccattcatgatgcggatggctgtcacaatcagtgcggacgatacgcctaagcgcaaaccagatcccctccccctactcacagccctcgaaaaagtcaacgttgcgccacaaaacgcactcttcatcggggattccgtcagtgacgaacaaactgcccaggccgctaacgttgattttggactggcagtctggggaatggaccctaacgccgaccatcaaaaagtggcccaccgcttccaaaaaccattagacattttagcgctttttaaatagccataccgacaaaacaaccgtttcgagccactgctcaaaacggttgttttgtgtttagattcaatttggctaccgaaacgtgcttccaaaggcagtttgctccgcttaacaataaaacggtgatgctcacaaactaaccgcccttggaagcactcttaatcttctcttccctcatacgcaacctgcgcggttacctggtaatcgcccggttgctcgatagctgacgttcggcccgcaatcttgctcataccccctgtgattaccgtggaggccaaatacaacttataatcctcatgcgcatcatgaacatcggtcaagccgaccttagtaatatgcccaaccggggattggtccatctgattaattccggcgtaaataactagccggtgattctccaactttaactgtgagaaaggaatttgaatgccttgcccaatcgcataaacgggttcacccgttgcctgcgcctgctgaatgatggcatcatcagttaagccaccgtaatctaatcggacaatgttcgccgcttgtagttgatcaacaatttgatgcacattctcctgttcagcacgtgaagtcttcaccgtggcgggcaacaattcctgcccatcaaaaataccgttcgcaggaatgtatggttgttgctgactttgttgtgcttgtttttcagctgctaacgcttctttaggcttaccacccaacaatttttcaatacgtggtgataagtcatacttcgcagttttattagtaaaataataaatgacgtttaacgtaatgaaataaatcagcgccaagaaaacgagcatatataagatgccccgtaaccacgcgccattctgcatcaagcgaattgccacataaccgaggtataaattacccgcaattccaatgccgatatagatttggttcttaatcttcacattgacattaacgtaacccaaggcgtggttgatcatatctaaaatactaaacattcgttattcgcccccgtcgctagtagtggtatccgttgtcgactgtgacgttgtcgttgtcgagcttgacgcggtcgtacttgatgactcagcagcagagctttcatcatcgtcactcgtatcagtcgttgaactattgttatcagtcgtactactattagtggcactagaactcgtatcatcagctgaacttgatgaactactggtcttattagcactgctgctgtccgtatcattctcgtcagtactactactggaactactattctgttcatcattagatgtatctgaactggatttgtctttggatttattctcatcgctactatcatcagccgctttctttttcagacttgcggaactagctgatgaacttttgaccacactgctagtggccttggcgccattgacagtatgggttgtcttattaacgaccacgttagttgcccccagtgcaaggacaattgaaacaattgcaaatggtgaaataaatggtggtgttcgataagccatcgatgtcattcccttctgaggctttgccgttattctttctaatctataattaaaccatgctcgtgttcggaatgcactaattctatcacaaattaagaaactctttactcaaacaaggccaacaaaaaagccgactccccgtcagctattaattgcctgctttttcgtgcaattggcacatagaccgtaaatctcgatgcggtgacccgtaatcgtacaacccggtaattgtgcttcatactcgtctaacggacacgcttgcagttccgtcaccttaccacagtttgaacaaacaaaatggtgatggtgttgatgcttgaaatcacattgatatttaaccagggtttgattagcctgggccttcaattccaataatcctaacgtttcaaactctttaatattgcgataaatggtattgtgactcattcctgcaaataaggtccgcatgtgctcatcaacggccgaaattgccacatagtggtcctgataggtcaccagataatctaataatgcctgccgttgcttcgtaattttaaactgattgcgacgtaaaattgcgacggcttgttcaattggtgtttccataatgttgctgcctcctactgaccaggacttcactaaatcataatcattactatttagtttagcatactcaagtgtaaaagtgaattacgttgaccgtccatacgtcagcgctaatctttcgtcacaacatcatgctgacaatattcagtgaccagctcatctagttggcgccgcgtcgcctgccaatcatcattcacgataacatgtgcatgccccactaatcctactggcaaagcctggtcccgcaaatactcatcactagcaactcgcttttttatccggctaggaagatctcctcgcttggtcaaacgctgaattagcgcctcttgatcagcaacctcgagataaatcaccaccgcttgttcgcccaactcccgcgcataggtaatagcccccgccgtatctaagacgatactaatcagtggtgaccgttcccaggctgccgctagtccttctcgtgaagaaccgtattgattaccactataggtcacgtgttctaaataatgtttcgtggcaaaactcgtcggagtttcaaaataatagtcgcgcccactgacctcaccttcccggggagcccgagtcgtatgagtaatcacctgaggaatttggtattgtgaccgcaagtaatgactgacagtggtcttaccactccccgttggtcccgtgattacaaagatccgtttcgttgtcaaagttgataaacctccattttttaattcatgtaaagcttttcatttgcgttagctcggtaaaccgagtatagtaacgtacctataaggttcaaatagatgattcacgcatctcgtagcaaaccaacaattttcagaagggagttttgtcatatgcaatttcaaaaaacaaatagctggttcagcattgtcttagatacgcaacgccaaatgtttgtcgcaactgacaaacttcatccagaattgttcgctgaaggcgtaacaatcgaagatgcagttgcaaacttacaaacccaggcctaagccaatctaaaaatattgtttaaaaattactggtaccgtttatgcgacggcaccagtaatttttttacagtcagtattattgtagatgctgctcaatgtaggtgttagcctgatctaacatttgctttaaattatcgtaagtcaatcgttcacgggcagcagcataatcaaaccagccaattgcactgatttcagcttgctgccgcgtcactacgacaccacttgggacttcactgacaaacagtgtgacttgcttcaaattaccattcggtaagtcatattcggtatacgccttaaaattggtatcgagtgtcgcttcaatttgagtttcctcacggatttcacgtcgcgccgcctcagctaacgtttcattgccttcaacgtgccccttcggaaagccccaaaaatcactggtcgcactctgtaataataaataagcgggatgaccatctttttgttgatagacgaccgcaccactagctacttctgtactcatgaagtcgcaccttcctaattatgaattatgctctagtataacatgttccatcatcaattgagggctaaaattgcctggagcaagtcccccagtgcgaccccttgccggtcatccgttcgattttgtgcaatcgtttctgctaccgccatattcaaccactgattagcgcgcgccagcgttggtgctaacgcgtaaccccggcccaacagtcccgcgattacagcagctaaagtatcaccggtaccattataatgccccggcaaacgtcgcgcaccacagtattgcacgtgcccagcttcatccaaccaggcacagccaatctgatcagcacgttggacatccgtaatgactgcgtgggcaccagttttcaactgtgcttgcagtgctggcaaaataacttctaaatctggcgtcacttgatagggcgctcccgttagcaatgcggcctccgtcgtgtttggcaaaatcacatccgcctgttgaataagctgacacattgccgcgacatagtcctgatcaaagccctgatagagttgaccgagatcgccgagtactgggtcaacaactaatagcgacagcgtttgttgttctaagtaagtagttatttgttggcacagtgcgaccgaaccaacgtagccgatcagggcttgatcaaaatgcagttgtgcacgggtccaatgcgcaaagacctgcggcagccacgtcgataagtcgacaacggctggtgtcccgtacccgctagtatgtgtcgataataagctggtcggcagtgctgccacgtcatactgcatcgccgttaatacgggcaacgctgaactaagtgagattccaccgactgcggataaatcttccgccactaacattgttgacaatcttgctaccccctcttatctcgtgtaatgcttattctatcagaactccgactgactgtaacctcttcgcttcaaaagaaaggttaaatcaaccactcaaatgggcattgattactcatcactgcaaaccgcaacggtattgtcatcattaagcttgattagtgccgactcaaaaagttgagcagcggattgccagtcccgttgttcaactcattaaaatttatcatccatcctcatcagactaagcacacattacgtcgaagcccttcgacacttaaccgacttcagttccttcaaatattatccacaatattagctagcctacaatttgctagtgaatcctaacgtgggcatccgacagtttcagttatcagatgacgttaaatattgctgttccatagcgtgccgggcccgaaccgcatcttcaaaatgcgcaaaatgtttgtttaatatgtacgttcctttgtagtagaagtgcgcaacccaggaacctgactgtttgtcatagctcacgcccacgaccccactcgtgttacgcttcgacttcttgattgaacttacatctgtatggtgatcacgaatcttcaaattacgcgggtcccccatatgcgaaactgcttgcggattattaaaaatattttgccgactctgttccacggctagacagccacaactacgcgtcttgccgtgccgcaaaacgtaggaatccaccacgcacgtccggccacactgacactgacaaaaccagagcgcattaccattcttggcccggcccgctcggtgaacagctattaagcgtccgaagtgctgaccggtaatatcaatcgccgctcccatcctaatcccaccattctaaaattaaatttctattgataacaatattataagctttggcgaatccaattaacagtttaatgtattatccgtgtgtattctttgactaccgttcgttataacaaagtatcaacttataaataacaatagtaacagctacccaaccgcatattcagacccgtttctcttcagcttagcaccgttaccgccggcttaagtgatgactagtaattcggccatcacaacgctttttaaatccccaccatgactggttacgcgttatcgtcatcaaatctattgtcagcacgaacattgcctcgacagtcgcaatgtcaccagcttctatgatgattaaccagctatcttgctccgtatcccattgagttattaataataaaaggctgattctaattgacttttaataatcaaccacggtatcatattgacatgacgatttgtcgataatgacaactaactgttacaaataaccaaaaaggtggtccatgttatggggattttccagcgcattttccaaaaagaagatttggagcgctatttacaaaaagatagtcattttgaacgaaccctctccgcagtcgatctgattgcacttgggattggtgccgtcattgggaccgggattttcatcctacccggaacggttgccgcaacaaaagcgggacccgggattattttatctttcgttttggctgccattgtgtgtgccgtcgccgcaatgtgttacgccgagtttgcttcggtgctcccaatcgccggttccgcgtattcatacggaaacattgtctatggcgaaatgattggttggatcattggttgggctctggtactcgaatacgtcctagccgttgcgaccgttgccgttgggtgggccgcgtactttaattcattcattgctggttttggcctcaagttaccgaaagccatcaccggttcgtttgaccccgcccacgggacctatatcaacgtggtcgcaattctgattgtctgtctgattgcttggattatcgataccggcctaaaaacgtcgattcgattaaacaatattattgtggtcgtaaaattagcaatcattgtattgttcttattagtcggttcattttatgttaaaccaagtaactggacaccctttgccccatttggtgggacgggaattctcaagggcgccgcggtcgtcttcttcgcttacttagggtttgatgctgtgtcttcgtcggcagccgaagttaaaaatgccaagcgcaacatgccaattggaatcattgggaccctagtcatctgtaccatcttctacattctcgtttcaggagtgctgaccgggatggtttcgtacaaacagttgaacgttgacgatgcagtggcgttcgctttacaactcgtccatcaaaacttcgttgccggtattatctcgattggtgccctcgccggcatgttcacaatgatggttacgatgatctacagtagctcacggctattatattcaatcggccgtgacggcttactcccacgtttcttaggtaaaatcgataagcaccacgcccctaaaaacgccatgttgacggttacaatcgtgatttcaattcttgctggtctcattccgttagaccaattggcaaacttggttaatatcgggacattaattgccttcgccttcgtttcttttggaattttgctactacggcgtaatcccaagctcaacgcgatcaagggcttccgcgtgccactttacccggttctcccaattatttctggcttgctgtgcctgttcatgatgacccagctatccatggaaacttggctggcatccctagtctggttcctccttggtctcatcatttactttggctatggcattcggcatagtcgcatgaataaagctgatgagtaacaatctagatttgtactaactaaaagcgcccatctcaagtgatcaatcaacttgagatgggcgctttaactattgtcagccagctaacgatgacaacgattacattttaaggtatgataatgatacttaattaaggagcgtggtttaatcatgttaacacctaaaacgatccatgacgaccttcatgagcatcatacccaggtcgttcaactattcagtaagcatccctggctcattcccgccacaaccttattacacattattccagttgtcgtcggcatcaacggcttttggaaatcgcgagcactaagcaagcagctcaaaatcgaacgcgaaaaaacgaagcaacttgccctacaacaggtcgataaagttcagtcagcagttactagtcatcactgtcagcacccaagtttacgccaacttttcaagcaaattcgcagtcatcattaacaccaacgtggttcgaattggcagttttaatcgctgccaactcgaaccacgttttaatcaatcccctgacatttttacaaactacgattaatgattactgcggccatatcacaacggttaagccaattgaatcgtcacgttggctgatggcccaacgagcttggcaacgggacaacgcgtttccacaatcgcgagccaccgtgctgccgtttcagcatccacttccggaatcgtgacccgagcatctaggaaaaattggtacccaaaacggtcacgcgacatcttcaccgtagtcacgactttgctctgatgtgtctggccgtgctccttttcgattgcctccagcgtcgcgttaaggcatgtactgagcgccaatccgattaattgttccggattcgagcccggcaccgccttaagtggactagatacggccacctcaagaccattgggaatataggcgtgtccttcgatgccgtcttcattaactgcttgggtcgtatataaaattggaaaatcactcaatcttagttcctccattcgatagttcactttgcaattaacctaccacaacattataaacttgtcagtaagaagcattggttctcgactaattagcggtataatatttctaataatacttaatggggaatttacttatgaaaaataatcaatttgcaatcgtcccgactgattcggaaaccgcgattgccgaacttacaaaaattcattttattacgcctgatatggacgccctgacgactgttccagccgtctaccaggcattgctggctaaaagcttaccagaagttcacacggcaagcggcttgacccacaagtttaataacatcatggcaaccagccagcacactttatcagaatggctcgccgatgcaactatcgtaaacaatcaagtcttttataacgtgggacttcagctactgggttttctacctggtcaagattttgaattggccgatccattgctggcgatgcgcgatattcacttgccaatagtcggtgatagcgcctttgatcgtgaatccctctattatgcttggtacctattattaaatacacgtgggaataatggacaaaccttgattgaatcactcacgacccggggttactttgtaccattttaccaattacctaacgaccaaaagccactcttcttcaatggtaaggcccaagccgtctttgataccaacgcgctcattcgtgacgtcgtctacgttgaagcgcctttagatactgaccacgacggccaacgggacctgctcaaagttgaaatccttcggccaactgagaccgaaaccggcttaaaagttcccgttctctataccgctagtccttataatcagggcatcaacgaccaagctggtgatgctcaaatgcacaacgtagacgttcccctgactgcaaaggaaccggacgaaaatacctatgcggatgttgagttccagccaacaacggcgcaactaccagccgctcgaaccgcgaccacgacgaccgatacagcagaggagactttcagccgagaaaagtcctacacgctcaatgattactttctagcgcgcggttttgctgtcgtctatgcagctggaattggttcaatcgactcggatgggctagcccctaccggtgacgttgatgaaacgacctcaacagttgcaattattgaatggttgactggcaaacgccaagccttcaccaatcgtgatggcaatatcgctatcaaagcttggtggtgcaacggcgccgttgctatgactggccggtcttacctcggtaccctcgcaactgccgctgctacgacgggcgtggctggccttaagacgattatttccgaggccgccatctcaagctggtacgactattatcgagataatggcctggtcgtcgctcccgatacgttccaaggcgaagacaccgatgttctcgccgctgaggtcttctcacgaagcttaaaagccggtgacgctcaccaaatccaacccgcgtttgatcagaaactggcagaactgactgccgaccaagaccgagcaagcggtaactataaccgtttctgggatgaacgcaattatctcaagaacgttgacaaaattaaggcggacatcatcatggttcacgggctcaatgactggaacgttaagccccgcaacgtagctaatttatgggataaattacaggcagttcccgttactaaaaagctcattttgcaccagggacaacatatttatatcaataacttacaatcgctcgatttcaccgacatgatgaacttgtggctaagccataaattatatggtttagataatcatgcggagacactcttgcctaacgtcttggtacaagacaacacgcaagcccaaacttggcacggctatgacaattggtggcaagacacaaccgacgctttagattttaaggttcagtacaaagaattagttcctgctgaccatacagttgaccaacgcgccgctcattttactgataaattgcctgacaaattattcgaccactataagcatcatttggatagttggcagcgcgacctcttgcaagaggataagttaaatccgctctatgatcaccgcctcttgttcaagtcttggcagtcgcctgaggatcaattattagtgggtattccgcacgttgcgggctctgtcgccgttaataagaatttcggcatgttgagctttatgctgattgacttcggggccgcgcgccgtttgactgtcagcccacaaatgctagctgcaaaagcgcttgatctaggttaccactggcgcgaagatgatttgaaggacttcaagttagcgggtgagacgccgttcaagatgattactaaggggcatcttaacttgcagaaccgtcaccacccatggcacgcagaagcgattcagccaaatgtcttttatgacttttctgtggatctccaaccgctgttccaccacttactgaaggggcatcaactcggactagtcatttacgcaactgatatgaagatgacgattcgcggcaatcaagacctacagtactcacttaacttgaacgatattcgcttacacgtcccaatgaaaaaaataacggactaactaattatggcctaccagctaaccacacaaccgttaactggtgggccttttgtgtaccttcaacttaaatagccacttatcatgaccaggtcggacacccccacccgtccggaactagccaaaaaaagttccagcttaccatcaacgtaagctggaactcatctttaattgttattaacttcggcaatgcggttcgcaatcaaattcgttaactggcgattaccagtcgtacttggatgaacattgtcatctgcaaaccaaccactttgattctgcgcacgaccatgccaatcgataacatgcacgttcgcatgcttcttagcagtcttggcaatttgagcattgacctgattttgccaactctgtgttgggacgtgggccgttacccagaaaatctgacgatccttaccaatcagcttaacgacttgttcagcttgatcatccgtaattgtcccgttagtcccaatgttcaataggacgttatgggctaattgcccttgcgacttcagcgaattaatgattccaggaacttccgtcacttgacgaccaacgcgaccttgaaccaccgtacccgggataacatcttgaagatcggaagaaacatccagtaacaccgaatccccaatggctgtcagatccgtattggccatcgctagaacaacttgtggcttcaaatcgtattccttttccacctgcttctgcttcgagttcaacttcgcttcagcctgcttggtctgcatcttttcagtcgcaaccttcttgcttgaagcagccgctgcctgggcagctttttgccgtttgagcgccgccgcattcttcttatcagccgctttagagttagctgcaatcgtcttttgtaattcagtcttcttgttagcttccgctttacttggctgttgaacgaaaccaaccgccgtaataacgaataagaccgtggtcaaagcgacaatcgcagtggtcacgcggttaaacttcggtttgcggaggaaatctttgaagtcgaccaataaccgactgtaatcatagtgccgcattggattttcaataaaccgataactcaattccgtcacgatcaaaattaaggcaacttcaatcaaactattgaggagtaaatgatcaccaatgtttttaactttagtttcgtagaaaatcatcactgggaactggtagagatagatcccataactacgttgcccaacgtacttaaacaacggattcgtcaagacgcgattgagatgactagccgggtgggccaccgttgcaactaacactgttgataggactgtgaatagtaacataccgccacgataagtgaaatcagattgaccggacatctggaaaaacatccaaataattgcaattagcgaagcaccgcctaagatatccagtgtcactcgattaacattagcaatgtccgccgataattcccgtgatggccagataaacgcaaggccagaacctaacaagattgcaaacatccgcgtatcagttccgtagtacacccgattcgtattcgctggatcatacaacattgccatggttatcgctgaaatacccgcagcaatcatcataaaccagaagacccgtgaacgcttcttgaagatgaccatcaagataccaatcactaatggccagaataagtaatattgtccttcaattgagagcgaccacaaatgagtgaacggtgattcaccattgaaacggtcaaaataactttgaccgtgattgatttcaaaccaattatagacgtagactaaattcgttaatacggtagcccgaatgttcgtcaataatgaccgttgaaacagcgtaatgtaggctgttgtccctaacaacatcgtcacgaatgctggatatagccgccgcatccggtgtccgagaaaccgccatatccggacatgcccccgactcaaaatatcttgtaataaaatatccgtaatcaaataacctgaaacgacgaagaagatcggaactcccaagtaacctccttgtagtgaggccggcatcaagtgatagatgatgacacccagcaccgccaatgtccggataccatcaaatccggtgatataacgtcttggattcatccggtgtcgattcatccgactcattgttcggctcatatttacgctccgcaaattttcattcatattcctattaccccttgaattgtctctacaaatattaactaacccaccagtgcttcggtacctttactataatatgtaaatgaccgcattgaccagcattatttaaacttcattaattatttttattaaccactttattcattatgctgattaaacacatataaccccgaacttaattacaatataaataaatcaaacgtgagtctattaatccatccgttatcattcctatgttatcaacaatttaaggttgattcgacgtaccaaacagctcaattaatcaaattgaaattgattagcactacttgtgactaacttctactatacaacagtatgaaccagtaaaacattgaatcagaaatcattttaaaagattgacgcgattcgttcggtaacttgataaattgattttacaaacttgctagccatgataaccaccggacaagaggttcaccttagtaatctcaccagaactaaaatgacgactctgaccagtctctaatttgacgactaacgccccgtgtgcatcaatatccgtgacgactccacgatacttttgcgttccgctcttcaactcgacctgttgatcgatcaccatggagagtttccgataagcgtccatgaaagtcccactacgataagtcccatagctattgaaaaagcgccgcagtagctcacaaatcacttgattgcgcgtcacaccatttggattggcaacgactgcgcccgctttgtgcgctagtagcgctggaaaagctgtcgttgttaagttaatgccaattccaataatgactgctgaaatttgccccgtttcaagactagtgatgccttctgataagataccaaccaccttgtgatgattgactaacacatcattgacccactttaatgaaacgtcaaccgcaaacagctgttgcagcgtctgggcaacgactaccgcagtactcgttgtcaacaaaccagcgtctaacgccttctggtcactgagtggtaacccaatgctcatgtaaattccagtctgtgctggcgaataaaatgcccgccccgaccgaccgtaaccagcagtttgcgtatccgcaaccacgattttcggaagtgctaaaggcgtctgcatgactaaccgccgtaaataggcattcgttgaatcaaccgttggtagcacggtcaaatcaaacggtggtaacgctgtaagcgcgtattcaatcaccggcgcactcaatttattattggccacataccgataacctcgcccatgccggctctcaatagtatggcccgccgcttgcaatccttgcactaatttccaaatagccgttcgactgattgcaagtcgttgtgccaaccagtcacccgaacagtacgcgggcgccgcttggattaacaagcgtaaaactgcgacttgatttgccatatcaatctcacccatctctaattagttaacccattatttcatattggttaactaaccgcaattgaatttaaagaatgtaatattacatctttctgtgctgagcagtttacttattatcgctaaaaatgtaaccgcttgtcaaatcaattgtgtacaatcggtcacaatacgactgaaacttggtctatcagtcgtaccgaccagcataataactagtataaaccaaattcagactaaacggcccgttctaattattatttttatatcgtttcgaccgaagtcccctcccatactcagctactatgacgttaacgtactgattcagttaattagcgaacacgaccttaccaattatctacttaatgcaattctttatgattgcctagtctctttgaccctgcttagttaacagtggtaagataacaattaaaatatgaagaaattaggtgatcatttgaaacaaggaacgacaatcatcacgctggataatggctaccatttatggacgaatactcagggcaaaggcgacattcaattattatgtctacacggtggccctggtgacaatcacgaatactgggaaaactttggtgaggaactggcagatttaggcgtccaagtttcaatgtacgaccaattaggatcctggtattcggatcaacccgactactcagatcctgaaattgctaagaaatatctcacctacgactacttcttagatgaagttgaagaagtccgacaaaaactaggactcgataacttctacttgattggtcagtcttggggcggcgccctcacaatgatgtacgcgctcaagtatggtcaacacttaaaaggcgccattatttcaagtatggtcgataacattgaggaatacgttgtcaacgttaacaagtgtcgtgaagaagccctaccggctgacgctgttgcttatatgaagcaaaaggaagcggaaggcaactggaatgatccccagtatcagaagtacgtggacgttctgaacgctggctatgttgaccgcaaacaacccacttcaattcgccatttgatcaacaccactgccactcctgtatacaacgcctttcaaggtgataatgaattcgttatcactgggaagttaaaggaatgggatattcgcgatcagattcacaacattaaagtgccgaccctgttaactttcggtgaacacgaaacaatgccattagcttcggcccgccgcatggctcgtgatattcctaactcacgcttagtaacgacgccaaatggtggtcatcaccacatgatcgacaacgcccccgtctactttgaccatttgaaacaattcattcgtgacgtggaagatggcagctttaatcaaaaataaatcctaactgaacaactaataagccgccagtatcaggtcatacccgatactggcggctttttaataatattaggttaactgaatctttgcccagtggtctaactagcccttcaggctttaactatagctgatcaccctgtgctcgtagtaaggcgcctaatgatggctgttccttaatatcaatgtggttggctttggcataagcgtcaacttctgcttgaccatataattcaggatctagtggcatgtaagctgtgccaattggatcatcattcttgatgaccgcgttcacaacgattggccgcttgttgcccttcgcttggagcgccttgatttggtcaaagacggtttcgacctcttgattattttgaacagtaaaaccaatcccaccaaggccatctgcaactttggcccagtcggcatccgttagatcaacaccatacaagtgttgcttcgtatcaacttgctcacgatagatgaaaccaaaccgttgattactgaaaatcacgttaataacaggcaagccgtaacgtgcttccgtgataatatctggcgctaccatcgcaaagccaccatcgcctgagaaactccacgcttggctgtctggaacacttaaggcaccagccatcccagcaggtagtccaaatcccatggttgcgaagaggccagataaggcaaagcgttgctcctgatccattgggagcccccggacagcccattcggagacgttaccggtgtcgaccccgtaggtatcacgagggccgaccatactagcaactttgtgcatgaccgcttccggcgctagtccatcatggtcgtcagcagccaattgttggagccacttatcccaattacgtttattttgccggttagtcgttaaccacgctgtttcaggtaacgtttcgccagttgcaatcatcgcttgcaaataagcttgggcgtcactgatgacggcgtaatcgattgggaccatcttgccgatatcaaaactgttattgttgacctgaataatcttaatccccttaggccaaaaactagcaaatggaaattcagatccaaggaacaaaatcaaatcagcgtgttggagtgcttcgaaccccgatttggaacccaaccggccaaacgtaccaattgcattcgggtggttcgttggaataacccccgtcgctgggacggtgttcatgactgggatattaaattgttcactaaacttgaccaggtctgccttagcaccaagaagaccccgaccagcgtaaactaatggatgcttagctgcttttagcatctttaacgttgccgtaatggcctgaggatcgacccgttgttcaaacgtatctgaaacggtgttaggcgtcgataccggctgataatcgatttcttccgctgagagattttcaggaatgataacgactgccggtcccttttgccggtatgcttcacgaatcgcttggttaatgacatatggtaattgtccggccgtcgtgacagtgcggttatacaccgccacgtcactaaacattggagtctcatccatttcttggaagtaattcgtgttcatcgtcgcttgtggcacctgtccgacaagtgctaatacaggaacgtgatccatcttggcatcatacaaaccgttgaataagtgcgttgcaccaggacccgcagaaccaaatgaaacaccgattttgcctgtaaacttggcatctgccgaggctgctaaggcccccacttcttcatgccgtacttgaatataatcaatatcggccttttcaaggtacaaaccttcaacggtatgattgattgaaccgccgggaatcccgtagatgtggtccacaccccacgcctctaaaaccttaactaaagcttgtcctgcaatcatctttgtcatcactattcatcccttcgacttagaaccaatttgtctgcttggttcaattcatttaacaaacgtattataaatcgctttcaattataaatgcaattaatatgcttacttttcgtaagtgaaattacaagtacacaaaacggggcaccattcagcgccaattttgtgtttatccgattatttcatgtgaaactatctatggactagaaaaataggatcaagcacacacccgatactcagttttatcaaatatcgctaacgatctagcacgaacaacttaccgacgtgacgacaatcaaaaaccaccccatcaaacagatcagggtggtctacattaagctttactatattgtgattgttgatgctgggctgagacagaactgaccacttgcaaagcacgctgctgccactgaacatccacatctaataccgtggtttccggtggcaactggtatggcgaaataatttttaatgtcgtggtgactcgcagaatgactgcctgtcgataattagcgctaactaaccaacaacgataatcaccggccgctggtaactgctgttgccgatttgcaagttggatcgttctagtcaacggatcgaatgtcgcctgtgtcgcgtaagtgtaccccaataaatcattagcttgttcaatctgcccccgagcaatcagcccccggatccgagtagaactgactttaagctgctgattagccaagcgatccaccgtgaccgtttcaaagtacggggcgcccaattccgcgagttcgcgcatcccatttgcgccaccctgcccgaacgtatagtcaaaccccgccacaacgacttgcgcattcaacccgacaaggtaatccttaataaacgcagtcggtgtcaagccagcaaattggtggttaaaatccgtaatatatagtcggtccacctgtagcgccgccatatgttggcttttttgcgcgacggtattcagataccgaaaagtggtctgggacttaaacagttgtgacgcgtgtcgattgaacgtcatcacagcgagtggtaaatcacgctgcttcgcaattcgtttcgctgtttgaatcacgcgttggtggccctgatgcacaccatcaaagaaacctaaagctaataccagtggcggttgtggtgccagcatctttaatcgatgggcatctaaattgattacttgcatctgtgcgacctcccgaacgttcacgtagtgttctctacagcttggtatgttgtcaccgccacaatggcaagcgacacttaatactatgtaccaaaagagccgcgataatcgcgtcctctttcgttaattatctatccaaattagtttgtttgagcttgttttaagaagtagctgaacggcttcaacgcttgagcatcatacttcttgacaaattcagcaatcttgtctttatcttgccatgcgtcatcgagatacatatgttccgttgtaaatggcattgcatgcgttaacttcacatcaatgacaactggcttatccgtcttcttagcgtcttcaagggcttgcttgaattcagccttggtccgaacggtataaccaacggcaccatagccttcgccaaccttggcccaatcagtatctggcaaatcgacaccagagagtggttgatggctatcatcagtctgttcagcttcaataaagcctaaggtctcattactgaagacaatgttgatgatgtgcaagttatacttaacttgtgccaagatttcttctgacagcattgcgaaagcgccgtcaccactcaaactgtagacgtcccgatctgggtagttgactttagcagccagcgcggcaggaaccccaaagcccattgttgcataaatcccagaagttgcccatttctggttatcgtgcatccggatcaagcgttcaaagttaatattaacattgccgacatcgatggcccaaacagctttgtcactagcttcttggttcaagacatcaaagattggttcggggcgaactggtgattcagtgctatcgttgaagctggcttgccatttgtcccagttctttttatcagcaaccgcagcgtcataaaaggctgaatcatcgcgcgcttcaccagctgcattaatcgccgctaaggctttcttcgcatccgcctgaatagcaacgtttgtatggtggcgcttaccaaatttttcactatcaatatcgatttgaatgaccttagccttcttattaaataagaagatactaaatgggacattgttaccgacccagaggattagatccgtactaaagccaatctcggcacccggcttaggtgcgactcgtcccgtggaacctaagtaagcgggataatcgtcttcaatgatccccttcgctaatactgaagagacaagtggcatcttaaacttttcagaagcagcttttaattcttcagccgcgtccttagcgccaacgccaaagtaaatcattggtgacttagcagctttgattaatttaaccgcatcagcaactgattcagcggttggtgcaggatagttaacagtgtgcacgctagcgttcgtttcaaagttgtcttcaatttcagcccaaccaaagtccttagggatcgttaagacagctacaccattgtgggcatacgcttgacgaatggcttcatcagtcatcatcggtaaactctcagcagtcatcgcagtccgattccaaacagccacatcgtcaaaaatcggttcttcattcattgcttggaagaagtccatgttcatccgcttagtaggaacttgtgcaacgattgctaacattggaataccatcttccttagcatcgtacaatccgttcagtaagtggacagcaccagggccagcggaaccaaagcagacgccgatctttccagttagcttataatcagcggaagcggcaatcgcaccagcttcttcgtgacgtacttggatgtacttcaacgtttcccgttgattatagatggcgttcatcgttgaatcgaacgacccaccgggcaaaccataaatatgttttacgccccacttctgaattacttttaatacggcatctgaaccactaattttagccattagtaatgtcctcctctgatatattttaattatcaactttacgactttattgtaatcacgattttttaaaatgtaaacgcttttatcaatagattttatctatcattagaaattttgcgaaactttctatggtttacaagcgttaacgacgggctttggagcgtttttaatttttttaaaaaaaacgtatttttttgtatttttatattttgtattattttcgacaccggtataccaccttaaccaccgtactaattgtgtatttgtcttattaaatcgaattggtacgggtacatccccactcgtcacgcttgccccgcttagcaaatctcggccaattgactgctcacgagctagtttcgaaatagatcttgatgatgacgcttacatttcaatgtttatcctaactttctgattatttcgcctcccccttctatcacttgaatgactctagtatagtcacctccagagcaaaccaacttgacgctcatcaagttttagcctatttcacgtcaaaaaagactaccaacgtcatgtgcgtcagtagtccgtttagaattaagtcatttaaattatctgtaactagccaataacgtcgagctgaccacctttaactgtcagacatttaatatccacaagaagataatgaagatgaagaacagcacgtacattaatggatgaacttccttggcatgcttagttgcgaccatcgtaatgacgtatgcaatgaagcctaaggcaatcccatcagaaatactataagtcaacggcatcccgataacagttagaaatgcgggtacggcaatttcaaaccgttcccaactgatctgttttaaagattctgccatcaacacacccacaataatcagtgcaggtgcagtaacttgatccgtcacgacgtttaataacggtgagaaaaataatccaagaatgaatagcgcaccagtaacaaccgcactcatcccagagcgaccaccgaccgcaattccggccgaagattcaacataagctgaggttggtgaggttcccaacactgacccaactaacatcgaagttgaatcggccatcaacgctttaccaacccgcggcattttattatttttcatgaatccagcctgttctgccaatccaactagcgttccggccgtatcgaagaatgtcactaataagaacgtcaaaacaacaataatcaattgtaacgaattaatatcaccaatatgaccaagcgccacaccaaacgttggtttcaacgaaggtgctgccgaaacaattgtggatggcatcttaatcaagccagttgctagccctaaaatagaggttaaaaccatcccgataaaaatcccaccgggaactttgcgactcatcaaaatcaacgtgacgatcaatccaaaaatagttaaccaggtcgttccaactgtcaatgatcccagaccaacaaccgttgatttgttggcaacaattaagccaccaccatgaagaccaataaaagcaatgaagaacccgatccccgccgaaattgctaacttcatatcccgcggaatcgcatcaataatcatttcccggagcttaaaaatcgtaatcaagataaaaatcacggctgcaacgaacaccccagccagagcagtttgccatttaatgcccattccgataactacggaataagtaaagaacgcgttaacgcctaatcctggtgcaattgctatcgggtacttagcaactaaccccatcaataaacagcctaacgctgacgctaaggccgtcgcggtgaagacggcgcccttatccatccccgaagccccgaggacgctcggattaacaaataggatgtatgccatcgaaacaaacgtggtcaagccagccagcacttcggttcgcattgacgttttcaattctgaaaaattaaaatatgccgcaattttattcatgattccctccaaatattcgtctaaattataattgcacaattgtaaacgttcgtgttttagcgttcttttaacgtatttaatcgtatcattttgtttatttaaaagcaataaccgaacgctaaataattttgaatctgtttaattgcgattttcaattttaatgagcctgcggtagaatgaaattgataaagcgtgttcattgccttaaaaccgctcttggtcctcacgaccctcaggcaaataacgcgtcacgattctccatacaaaggtgtgatttaaatggctggttccaaaattacggcaatcttctttttaatcctctacactgtcctactctacttggtcttcacaatgcagaacatgttagccatgtacttaatggctattgggatgtttcttgaagcttgcgaaggggtttaccataacttcttcaagcattgagcgctacacgtatcacagtgaagcaagtacgcccatttgagtgcttactttctatgaaacgaccctactttagtacaagtgtttttattcaatgggtattcgtaacaaaacagacttcttaagaattgtgacaattcctaagaagtctgtttttgactagcgaccaaaatagttgctcatcaatactaatttagtagttagtcccatgtacatcctagtgtagaacggggtgtgactgtggctcaccgaggtccgtgacctgctggctaaaggtccccatcatcttgagcacttgatcaatctgtggtgcgcccaactggttgacccagtgatcaaagtgctgggtaatggcttggtcgacaatccgttcgacttgttgtccccgttctgttaaatgtaagtagagccgccgccgatcacgcggatctggcacctgaaaaacatagtgttgcattaacaatgatttgacttgccgtgaaatcgcgcttcgcgttacttgtcgctgaattgcaatatcattgagtgtcacttcatcagtcgtggcaatgcgccgcaatattaaaaattgttcaaatgacagtttattttgacttaaaagccaagccactaagtccatcataattttggttgtattttgatatgcttcaaaataatcattgagaagtttgcttaattcgtcactgttcatcgcgatcaccatcacttcattaacttttgaccaaatataacacgcctttaactgttttgcatgaaattacccgtaaattccaacgttaagcatcctccctaacaattttgtgcaacaaagtgtatgatgaaagtagttgaaacgcttacgtaaaaaggagacgagaccatgcccctgacacccttacaccaagttgaattgcgcttgatgcgtaccgtcatcgcaatctgtgaggctgaaaatatcgattactttttgatcggtggttctttactcggtgctattcgtcatcacggatttattccgtgggacgatgacatcgacattggaatgcgccgtcatgactaccagcgctttatcgccgtcgccaaccactatcttgatccaaacaagtttttcctacaaaccggtgcctcagatccggactatgcactcagttatatgaagctattagacgtaaatacttacattgaagaacgcaacaacgtcaataatgcgtttaaaggcgtgttcgttgacatctttccgtttgataagattccagatgacgaagccttacgtcgttcacagatgttacattacaaattagcagacgctgcgatcctgctcaaattgaattaccgctttgtcaaaacaccactgcgcaacttgattacgaaacacacacctcagcaattagctgaagtcaatcgctataagctggaacgtgaggaatacatgcgcctatacgagcagtcagactcccgaacttacaaaaatctggcgtctcaatacgattacgaaaaggaaattatgacctatcaggaattgaccgagctaacgaccgttccattcgaagatatccaagttaagattcccagtgcgtatgacaccattttgacccggatgtatggtgattacatgcagctgccaccagctgataaacgagttgaaaaacatctgaacaaactaattatcgataatcacgaaatcttataatatcaactagcgtggttcaggcatactcgttacggctgaaccacgcctttttggtatcttggatcaaacgtgccaagttaggttagcgttcgctaccgctgaaaccggggtaagcaccacatcaaccacctaactagtaagattcatacaaagttaatgatggccttaattacgcttaactttcgtataaaaactaaaagtaatcgctaactgtttcactactaaaatactaatttaactaaccccaacctgtgttaaacttaaattaaatacatgactttaaccttattgggggtcaggaaatcataaaaatgggggatcgccatggcagcaaaattatttggaattatgatgattaacgttcagagtattgaattgtcgattgtcaatttacgcacattacgccaagtagaacgagttcgttccgacgtttcacttggtgaggatatttatgatcagcatacgatcgattatgattcagtggaacaagccgcgcaggcactgagtggttttgttcagatcatgaatgattacggcgttaaggactaccatttatgggggtcgtggtccttgtcatccgctaacaatgccgactatattcaagaccaattacttgtccggactgggctcaagatcgactggttatctagtagtcaggaaacctacctgcgttcagtcgcagttgcggtacactttccacgattcaagcaaatgatcacgaagccgacctacttattaggaatcaactctggtagtgtcggtatttcgcactacgatcagagtaactttgtcttctcccgtagcctccgtttaggaccagttcgaatcgcggaagttcttgaagatttgcaatcgagcgtgcctaactatgttgaagttttggatgattatatttcgagtcaaatcgttgactttggtcgcctcttgcctgggcgaagagatcagcctagtaacgtcgtcatgctcggcgtcgcgccgtttgccaccctctttcgccaacaacaatcaaaagctggcgtggaggaactcagcaaagcagattttcaagctttatatgaggacgtgttgaacgcttctgaccagtatttaatggataaatacgaagttgatgaagaagacgtgcggctaatcgtgcccgaattactacttattaacgagttactacaactcactaatgctgagaaaatctggcttggcaacgtgaccgtgctggatgggttaattattcaagaagccattaagttgggctataagaaatataactttaatgatcaaatcgtaacagcagctaagaacattgcggacaggtacaacgttgaacctaagcatcgcgacttggtcaccaaattctcactgcacctgttcgaccagcttaaaccgctacaccacttaggcaaacgcgagcgcttactcttacaagtcgccgccatcgtgcacgacgttgggagctacattgacccgcaccaacattacttacattcggactatatcttgcaggccactgaactcatgggattaaccgataccgaaaaacgaatggtcgccctgatttcacgctaccatagcgcgcaaacaccatcaaaagacattcgccattttggacacttacaagtcgaacaacgcttattagtctccaaactatccgccatcttgagaattgcggacgctttggatgacggtcgcaaacaaaaaattgataaaatttccgtttcaattcgcaatccacgggtcatcattacttgctttgctcatgatgacctcttcttagaaaattgggtattcgcacaaaaagcggaattctttaaagaagtctttggtttaacaccagtgattaaactacggggggtacgttaaatgaattattataaagaaagttattatacaaaccgcgaactcagctggcttgattttaactatcgtgtccttgatgaagcacgtgataaggataaccccttgctagaacgtgtccgttttctcgggatcacacagagtaatcttgacgaattcttcacggtccgggtcgcatcattacgtaaattgatgtcagtcaattacactaaaccggatcccgcgggactgaccgctgctgatcaagtcagtgcaatcagtgataaagcccacgagatggtcaagcgtcaatacaatacattaaaccgctcgcttttgccattgctggaacagcacgcgattcatctcttgtcgatggctgatctaaacgaggaacaacacgcctttgttaagaactactttgacgatgagctgtacccggctttaacaccgatggcagacgactcttcacgcccattcccgttcattgggaataatacactcaacatcgccttacggatttataaaaatggggataagaaagaccgcaagtttgccaccgttcaagtgccggacgtctttcctcgcgtggtcgttttgccaggcacaccgaaccagtttattctgattgaggaaattatcaaagcctttgtcggctcactatttatcaactacacggtcaaggaaacgagctgttaccgcgtcatgcgggatttggacttagatgtcaccgaagaggatacctcggacttattaaaggaagttcaaaaacaattaaagatgcgtgaacgcggtaaggtcatgcgcttagaagtcgaaaagagtatgagcaagcatcaacgcacgcgactcgctaaagcccttgggattaacgaaagtgcgttatacgtcatcaacggtcccctcaacttgaccttcttatccaagctggtaaaagctgtgcagggccacgaagacttgaattatccaaaataccacgcctactatcccgcgaagtaccgcgaacgatccatctttgatcttatcaaggatcacgacattttaatgcaatatccgtacgatgatttcaaacccgttgtggactttatccatgaagctgcggaagatgaggacgtgttagccattaagatgacgctgtatcgcgtatcagctgattcaccgattatcaagtatctcgggcaggctgcccaaaacggcaaacaagtaaccgttctcgttgaagttaaggcccgttttgatgaagaaaataacgttcactgggcgaaaaaacttgaagaaatgggttgtcacgtgatctacggcctgatcgggcttaagacacactgtaagcttgccctcgttgttcggcgagaaaatgaaggtatcaagcgctacatgcacatgggaactgggaattataacgatgtcaccgcccatttctacacggacatggggctcttcaccgctgatacagacatgggaatcgatgcttccaacatctttaacatgttatctggctattctgaaccaccgtatttccacaaattgcacatctcaccagatggcatccgcgactttatcaacgaaaagctagacgatgagattgccattgccaaagctggtcagcccgcagttgtcaaaatgaagatgaactcattatccgatccgcagattattagcaaactctacgaagcttctcacgccggtgttaagatccaactgatcattcggggaatttgttgtttacgaacaggcatcaaaggcatctcggataacatcgaggtccactcgatcattggtcgccttctggagcacagtcgtatatactactttagcaacgacggtgaaccacaaatttacttatccagtgcggatatgatgacccgtaacctaaatcgccgggtcgaattattgttcccactgctccaacctgaaatcagtcaccgtgcgatgacaatttttgaaacgatgtgggctgacacggtcaaaacgcgcattttgcaaccagataatacgtacgcccgtgtggatgggcgcggcttagaggttttggactcccaggccgaattcattcgcgaagccgagcaagcagtcaaggctgatcacggcgatactacgcccactagcaacgcgcaccagttcattccaatgatgagtcccaagaatgagccggatgcttcagatcttgatagagaggatgattagcgatggaaaactttgcggtcattgacttaggttccaattcatgtcgaatgacaattacacagattcaggaagacggtagttatgcagtcactcaccgactcaaggaaatggtgcgtttatccgagaatgaaaacgccacggatacgccgacccttcaagccgaggccattgaccgcacgattgcagcgctaaagtcgtttgctgccgtctacaaagacttacctaacttaactatcaaggccgtggcgaccgccgcaacgcgaaaggccagcaaccaaaagaaatttctcaaacgcgttaaaaatgatgttggcctagatatcgaagtgattcctggaacaaccgaggcctattacgattacttaggggtagtcaatacgcttccaacgactaactgcgtcatggtcgatactggtggcggtagctgcgaactcgtccttatcgtaaacggccaagccaaggacctaatcagtctgccaatcggcgcggtcagtttatccgaaaagttcggcctcaacgaccaagttaccgctagtcaattatttaaaacgatgactttcgttgataaaatttttaatagcgtctggtggttgcgaaacggtctcaacttaccactcgtctgtttgggtggtagcaaccgaacgttagccaaaattaaccggcgcaaatgcaatatcctcaactttgaagatattcacggttatcggctacgtgacaacgccatctatgacacattcaatactgtcattagccaggatgcagctggtcgcgcggctattcctggattagcaaaggaccgggctgatattattgttggtgggatgattcctgccattagtctgatgcgctttttagattctgaccggatgattttctctcaaaatggactgcgtgaaggcatcctattcgagcacctgactgctttagctgaacaaagcgctaaagtcagcgaataaaaaaagcggactgacatttttatcagtagtatgctaggattaaatcattaataaattcatcaaggtcgtctttgatgcttgtatatctttacaacggaatctccgttggtcaagaaaagcgtcgtttcacatacgaaacgagctggccttgatcaatggaggttttattttgtctacaacaacacctgtcatcccaacccaaacgaaggttgcaatttttggcaccgccagtctggctttttgcggtattttagttgaaacatcaatgaacgttacctttccgaccttgatgcaccaattccacaccactctagcaacggttcaatgggtcaccactgcctatttactcgccgtagccgctaccatggttattacggcgtttattcaacaacgcttccgttggcggacaattattaacgttggcggggctggtttcgttcttggcggtttattatgtacagtcgcgccacagctctggttactactattcggtcgaatcattcaagccatcggaactggattggcattaccattagtatttgcgcaaatcatgacccaggttcctttcactgctcagggtcgttttacggggaccgctggaatgttgatcgcattggccccttcactcggaccaacatatggcggcttagtgacacaactattatcctggcgcttaattttcggcattaccctaccgtttggtctgattgcttggctgataacggccaaaactattcgccaaacgcaggcaccacggtcacgtccgttccccttatgccaattcgggctagtcgtcgcggcactcatcctgctgatttttagcgtcaataaccttagtacacatggcttaagcttagtattcgtctggttaccactgttattagcggtactcgccgtactgacttttacccgttcggcaacccgaaccacgcacccactaatcaacctggccgtcttccaacagggtaactttacccgagcgcttctcatttacttcttcattcaattcattcagattggactgacctttctgctccctaattttgcacaactcgctttgggtaaaaatgcgttagtgtcgggcttaatgttattagcaggaagcttatgttcagcaatactatcacctttggctggtaaattgatggaccgtcgcggcattcggcgaccattccaaattggtagtggctttttactgttggcaacactaagtctcgcagggttagcccagcatctctcggtcggcttgatcattggcttatttgttggcttatttgttggctttcaaattgggttcagttgcttatttaacaatgccctgacgtatggtttacaacaattgccgccccaactaatgggcgatggcaacgcgcttttcaacaccctacaacagtattctggttcgctcggtaccgccattatggccgtcttgattacattgggcacccgcatggcaccgagtgcttcgagtacgatgcaaaccaccctcggcacccagatcgcactctggttcagtctaattatcattatgattgtagctgctttagcgctgactacgaaaccaattgcgaatatggctgacgaccaacatcaatcacggtcatctaaccactgatttacttgggatttggttaagccgttaaaggcttcattaagcttcacgtcttctttacttctgaccactgagtttacggtaagatacagttaatccaaaccgaggagtggtgtgcatgcgttgggaaccgttcagaattattttaatagttgcaacactaagttgtttggtgattcttgcccacgttcgccagccacaagcccggacgcggcagctactcggcttaggttacttatttggccttagtgtgattttgtttaccccgctgtcattcgacggaactgccatctacgtgatgccagctggtgtcggccaagtgaacctatcacggttgtatcttcacgggctgggctttatcgaaaatatcattctgacgattcccttaggctggggaattaaacgccactttcatcactacccactattgggcctcggattaacgggcttgttagtgggtgccagcattgaaagtctgcaatatttcatgtcacaacattggctgatcaatcgcagtagcgatatcaacgacgtcattgccaacgcaacgggtatcctgattggcggactcgtggcagctaccttccaatttgtggcccagcaccgcaagacaagcgtcacggattactgatcacaactgtatcctgaagcttgcacccccttgctggcagcttaatgctcgactgcgccgtaaatcacagcatggcgctcaacttaaattcacaaacgcagtgacaaaaagacggttgttagaccaataatagtctaacaaccgtcttttgtggcgtcttctcaattttaatggttagttgtggacttgtcctcatgcgcggcacgttgcgcttgctgatcttgatgccagctagttggactccataattggccttccattgaaccccgtagactctcaatctcagcctgttggtcatcgatgaccttaatgatactctccacaacaacttgattatcagccgtcttcaaagcggcgagtgcctggatcgcccaggcagcctggtcttgttcactcattatgttaaaatctccgtttcctttaagcctttttacattgtacacaaaccaactgattataccaaggaatctgcttactcagcaaaggtaacgggcggtaatcggcaagtaaaataacgccctacaacgcgatacgctgttaagaagacacgcaacctaacgcgccctggtggctggctggtattgttctttcgacaaaaaaacgccccatcaagaatatcaacacaattcttgatgggccgctttcgtctcaaacgctaaatccgattaaccaactgcttgttgatcatcgtcataaagtttttgttgaatttcacgtaattcagacttacgtaccgaacgtggcaaaaatgcccgaatgtcctcttcgttataaccgatttgtaaccgccgaccatcataaatgattggccgcttgagtaattgtggtttttcaactaataggtccaatagctgattgaagcctaagtccgacaaatcaatgtgtaatgctttgaaagccttagaacgcgttgaaacgatgtcctcgaagccattttcagtgagccggaggatttgtttcaattcatcgcgatccagaggattagcaataatgtcgcgttcattaaatggaatgttattctcaactaaccatgctcgtgcactacgactagacttgctggacgttgaataatataagtttactgtcacgatgaattcctcctaagtttcagcaagtgactttacaccacttactttaatatagtaagtatacggttttagtcaagaatagtcaaggtttgtcagaacttttttagttaattatttctaaagttctgccagccaattacccatcaaatgccagcgctattctgtacttgtgccgacaaaagcggtacctcacgagataccgctacttaactaaacatgaccaactgcccgggctgggatcgaaccagcgacctcttgattaacagtcaattattctaccgctgaactaccgggcaatgattatgtctgtatttatacacgcttttatgataaaaaacaagtcctttttaaaaaaagtcacactaaattcacataattaatatgatatccgcctcaaacaacgtacaaacctaaccacgataccacggaaaagtcctgttttgaaaagcgttgtgccagtgtattagtgatttctaattcactcaatgttgtttttaactcatagtagtaatccccacgctgattatgcagtgccagttgccagttgcctaaatcatcccagcaagtcgtatcgggagcggcctgttgatgcttaaacaaacacgtgaaaagtcggcttccacgtctcgtgatcgtctcctgtgatacggatcaagcgacacacttcccggtgacaacgaatcgctgtccgaacaccaacgataatacctgccaccatcaccccagcaccaagtgccaacccaagtaataacaaccgggttaatagtggcgttgcttgtaattgcgagctaatcacaatcgtcgcactcatcatgagccagactaccaacacccagccattgagccagttcaaggcgacatcgcgagcatgtcgatacactgctaagcggtattgttgatcattgttgaccactcgttgtttaggggccacagttgaataaaccaccgtcatatcatcatgaaacgtataactagtaagtggttggaagaccgtcgtcatagcttgtaacgtcggctgtggcatgtattcggcaatcaactgacgtgcttgtgagacttctttaaactgataactcagaccgtgaatcgccgtcaattgatagccccgcgccgcctgccgattgagccaagcaacctcggcagcagagcctttaagaaaaaagcgtcgtttttgcatactaggaatcctccatttcacaccgatttgagtccccattatatgctgattggtctacatttcaaatattcattaatcttagttcaacaccgttactaaccgttgtacaaaagtaatattatcaaaacaagcatggtaaccctttcttcattccagcggattggtatgggtgtgatgattaattctagatacttcgtgggacgccagtttatatattaagtttttgatatttattcacaaatccactcatccatgctagcatcaaagatgatgttattgattacaatcttcggaggaacaagttatgtcagccaaatatatcatggccattgacgaggggaccacgagtacccgcaccattatttttaatcacgccggtcaaaaagttgccgacgcccaaaaggagtttccacaatactttccgcaaccggggtgggtcgaacacgacgctactgaaatctggaacgcagtttcctcaacgatcgctaacgtcttaattgacgctaatattaaacctaatcaaatcgaagccatcgggatcaccaatcaacgtgagactaccgttgtctgggacaagcaaaccggtctacccatttataacgccattgtttggcagtcccggcaaactgcaccgttagctgagcaactcatcgctgattgtatgggcgatctgattcaccggcacaccggcctagtgaccgacgcctacttctcagcaacgaaaattcgctggatcttagaccacgttgatggtgcccaaaagcgcgcggaacgcggcgaacttcttttcgggactattgatacttggctcgtctggaaattgactggtggcgagacccacgtcaccgactacaccaacgccagtcgcaccatgttattcaacattcacgacttacaatgggaccaaacgattctgaacctactgaacattcctgctgcgatgctcccagaagtacggtccaactctgagatctatggcacgactaaggactacttgctttatggtagccaaattccaatcagcgggatggccggcgaccaacaagccgcactatttggtcagatggcctttgaacctggcatggtcaaaaatacttatggaaccggtgcctttaccgtcatgaatctgggcgagcaaccgcaattatccgaccacaaccttttaacgaccatcgcttacgggcttgatggcaacatcaattacgcgcttgaaggctccatcttcgtagcgggttcggccctgcaatggttacgcgatggcatgcaactgatcgaatcagcaccagaatccgaaagtcttgctcaacagtcccataatcacaacgaagtttacgtagttcccgcctttaccggattgggcgcaccttactgggattccgagacccgtggagccgtctttggcttaacccgcgggaccacccgggctgattttgttaaagccacgctacagtcactggcctaccagtcccgcgacgtcattgatacgatgaaaaacgatgccaacatcaccatgcccacactcatggtcgacggcggggcagcccgcaacaactggctgatgcaatttcaagccgacatctcaaacgtcaagatcatccgggccgctgacctcgaaacgaccgcactcggtgctgcattcttagccggcctagccgtgggatactggcaagatttggacgaactcaaatcaatccaccaaaccggcaatgtcttccaaccccgaatggccgcgccccaacgtgcgaacctttaccaaggctggcaagccgccgtcaaagcagcccaactattcaagcacatcccaatcgacgcccaatcaagtaccaactaaactaaatttctaatcaaaaacgtcgcgactgaagtcagtcacgacgtttttagttcagcactattttccttgagtccatcactgccattctcatctatccgataatccgcactgtgtttgttgcttttcatgattaaaacgtgccaagtttttaagttcaaaagcaaccagcttagacccgctggaaaaagttcaggttagcgtaaacttgcttagttagtgtgtcctatgccgacttccaggcatttctgtcaattgccggaacgtggtgggaacagatttaagccgaagcccacgtcttaaatactggcctttcactaaccaagcacaagacgcttgctaagtgaaatttcaccactgggcattgtcagaaacgccttccagtcgggacagtgttcgaatggcagacggagatgtacccaacttttattggactcatcattgttcttcataaacagtaattttgtcgagcaactgtcaggcagaaaatgacattgtgatagcttactattttggaatcaccatagtagtaatcgaacgtttcaacaaagtggttagggtaaccctaacgtctcgtttaaagttcctgtatcaaaatagtcaacgaccaattgtgccgagttaagtggtcgttcatcagccattcgagcggcttcccgaaacgtgttcggtgccactaaagcctgtgcttgctacgccaacggactaatgccaaaaccgcattaatccgttggctaggcaatgctcggcttcaactcgtggccccgcacactcttgagactggaggggctgggtgacaatgctcagtagccaaattattcttagtcggaagtgatttccttccggcttagaataagactcgtatttgagatggcgcgagttgggcgttagctcaaatcgatgtcggcttacgttccagcaattgtcacccagccccggaggtcggaataggacgatcattgctgacgaacagaaatccacctaatcggcacgttttaatcatgattgatgacagattaatgaatatcgcgtggggtttatgataattgtagttcgtctacttttttgaaggcgtgactggctagaaatagcaggaatatgccggcataaaagagggcaaatagtaataagaatagccgtaaatcaaagcggtcagctaggaaagaaaacgctagcgaacccagcggtaaggtcacggaaaccagcgtataaaagcaggtcattaccttcccgagttggtctgaaccgaccgtcgcttgaatcatcggtgtctcaaatacttgcgtcagtccttgaaagacaaagctcagtaagtaaatgatggcaaacagccagaactggttgtacgacactactgtcaagatcatgaataacgcgcgcccaaagttgccgatgaggtaagactgccgaacggtcaacttttttaactgtcggtagactaccgtcatccctaataatattccaacggctgacatcgactccaaaataccgtagtagatcgagccaccgaaatgccgcccaaataaaacgacgtacgtattcaaaccgccaaagaagaaattcatgacgacgctcgcaaacgtcaataaacgcagcagcggatcagtgctgataattttgaaaccaaccaaaatctggttgagatacaaggacttttcccgcgtgtgttgctgacggggttcagcgagtttgatccgcctaaaagtggcaacggtaacgacaaacgtggctgcatccatgattaaaacaccgagcactgagcagaggctgatcaaaaatcctgacagcgcgttgaacacgtaatccgttcccttgtaggcaattgacatgtccgcttgtgcttgaactagctggtctggctcaacgagcagcggtactaatgtatcttgaatcggataagctagtgatccaaaaagggccgcgacgaataccagcccgacatagatacctggcaacttaatatgtaacgcaactaatccaattagcatgaccacgatcactaactgtgaaaattcaaccgcgactaataatcggcgtttagaatgtcggtcgatactgtcaccaaacagaaacaacaacacgcccggtaaaacaatagccacattcatgatgccgatccacaacgcactgttggtcaattggagaatgaaccagttcatggcaatcatgtagatgctgtcaccagcgttacccactgctcgccctaagacgagttttctgaagttggcattgatcacattatccgcccctttcaagccttgcaacaatgttactatcacacatcagaataaggatcgactcagctttcactcgaatctgcaacgcagcccgggcctgcttagtaaacatcgtctcagaattaattatattataattagtaaaaataacaatatttaatcttattttaatgttaagattcgtcctcccaggtaccaaaaaatctcccatgtcagctaatagcgacatgggagcgttacattaacggttatttttcgctcagccattctaattattagtgttatggtaacgattattggtctaattccggcaaaaagccctgctgcctagcgattgtcaaaaactctcgccgtttggccgctgagtgggtcgcttcctgcgtcatgtgcgctaagtgttccgtacgggcgtgactactccgatgttgataatactgattcaaaacgccatcaaaccggtccaactccgcctgataactcgcaggctcagcataggtatcttgaaacaacacagcgggcaaccctaatcgaggtttcttttcaggaacatccgctgggtgccctaactgcaacccaaagacgggtaacgtcaagtccggcaagtgcagtgcgtcaatcaccgcctgcgtgtcgttgttaattgatccaagtacaacgctaccaagacccatgctttcagcgaccatccccatcgccgctgtaatcagcgtggcatcttcaatactaccagcaaagcggtcaaattcactcagtgcccgacgcgtcgttgcgcccggtgctagcttgacgttgcggtgttggtccgcaaccacaactaataaacggccgttttcaccaaccgttggcatcgtcgtaatcgtggccaattgttgccgtagtgcaggctgagtgatctcaatcaaactgtatgcctgtaaatattggctagtcggcatttgttgtgccgttgtgatgatttgcgcgaattgcgcatcactaattggttcagtggtaaattgtcgccgcgttcgatggtcctgtaaggtttcaatcacactctttgtcacttaaaatcgctcctgttcttgttgtaattcccgtgaccagtccgttaattgtggcaacacgtccaggttcaagttaaacacaattcgttgacacacttgatcaagctgtacgctccgaaataagggataacgggtcctgccctgatcctggtgtatgataacacttaacgtaaccagctcatctaacgccgtttctaacagtgtcatcgcacgctgcggaaaatattctcgctgtagtgccggcgcgtccaatgagcagcctgccaacgcttcaacatctcgccgagtcaataacaaactttccggatgttcgccaattaatcgacttaaaatctgaacagtcaattgggtctcaaacgcgttacgaaaacgaaaacgggtctggaaatgactttgaataaattgtagcaatgccccattcttcatttaataacgagcctccttaaacatgcttattgataataacactgatactagcgtttgtaagttattttcccccaccacgcacccgcaattaaatcaccacaatcagtcaattacatgatccaaacaaaaaagctgagcttagagaattgacattctgaaagttcaacttttgagccaacgcctactaaaaaacaaccgccgtttgataaactcacactcctgcgctagactttggctaacagcttttagccaatatgattttctttcaaaatcagatcgacctcagcttgcatgtcaggtgtttttgtccattcttcccaatgatccatcgtttcatcgggaatcgtaaatgtttcattaatatattgctcatacttggcaacatgcgtggaatgcggaatgtttagttgtaatatccgcacttgcttaataaaaccacgttcagctgctaactcagcgcggccattcatcaacatgtttccgatctccatgtatgaggtcccatcattacgtgttatttcttgaattaagtctaatacttcatggtttttcaactgcaatccctcacttcacattttagtataagcggggttggcagtcgtgtcaaaactgaccagtaattgccaggtgatcaggcttggtatgcctaatcacctgtacttgatgaacactaaactaactcagtcagccccaaaatgctaccatcagccgagcactcctttttctgagtaaacatcaatcttcaaaaattacaagagagccttatcttcatctattccgccataaattcgctaatttcactcaaaaaaaccactatccaagcagatagtggtcggcataagagagaaagagaattgattagaaggtaattaaataccttacaaactaagaataagcgatattgtaagcgttgtcaacagttagccaaaataaatagataaattatttctatttactcattaatctttttctaacaccctcagccagccatgttcgccactaaattgccgtctttacttgcacaaagttaattaattcaccttatttaatagattggtaccattcacaattaccaagatttaaaataaacttctcaacctagataattttaattattatcaacaatcaattataattatttacactggttatttaaattgacctcactagcaactaaccctgtcactctcgcattaacacttgctgggttattattcgcattccctttaagaatgaaatatactaaaagtaggcggtaacatgtcaggcagctatgggtgtgagggcattatgaaaataatcgagcatcaggggaacgggattaattattatacattagtgaacaatcatcatatgagcgtcactattatggactggggcgccacagtcaccgcgatcaaaacccatgataaagatggtaattttgcaaatattgtcttgggatttgacgacggcgccgactacatcacctatcaatcttttttcggtgcaaccatcgctcgggttgcggggatcatcaaaaatgcccggtggcggcagtatgacttaactcaaaatgcgggcgaaaatcatctaaacggtggtaatatgcctcaaatttcatttgaaccatggtttttagaacgtaaactgcacactagtgatcaagttggactcgtcatgcaatatattaccttggacggtgagaacggctatcccgggacaatgacgatcacggctaatttcgtattagataacgacggtaaatttactattagctacactggtaaaagtgataaaacaaccttattcaaccccagcaaccatacctacttcaatctaagtggggatgcggaacgcctcattgaccaccatgttcttaaaatcaatgcagacgagtacgccgcgttaaacaaacacggtattccaactggtaagttgccatgggtcaccgacaccccatttgattttcgtgacccagtcgaggttgggccccagattgctaacatcaagggcgggctccatcacggcttcgtcttaaacgacaccccatatccacaagtagaattactagatcgcatcagtggacgcaaagtcacgatgcgaacgaacgctccggcagtcgtggtttccagtgcaactaattaccgtgatgatcgttatcgactcaatggcggtaaaccgatgcgttctcaacttggtctttccctgcaagcacaaaaattaccggatgctattcaccacaaggaatttggcagtatcattatcgaacctaatattcctgtaacctaccaaacggcctatcgtttttctaatatttacgacgtctaaccactcaagaatgattcaaattgatctcccagaatgcaaactactgggagcttttttgactcactaataatgcgttacaccataccattgactgaacgaaaatctcctaacccattttagtcgacggacatggcttcattaccatttacctactaggcgcatatgctattatgcacgttgcgcgagttaatctgtcatgactcaggacgagttaactatcaaaataagtgctattatgataataatacccacatgtggcttaacgactagtacatttagcggcggtttaataatgaccaccccatcaaatgtaattaataaggaggatcagattatgccagctactgacttacgtgttcagcgcacccagactgcgctgaaagaggcttttcggacgcttgctttaaagtatccgcgctatcgtgatattactgttaaggagctcacaagtgtcgctaatatcaaccgcaaaactttctatttacatttcgattccattgacgatttagcggaaacgttcgttcaagaaggtgctgataagattctagcactcattgacccgcaagatttcaagaaaaatattagccaacccggcttaatctttgatcgcttagtgacctattttcgccaatctgaagcttttcaccgagtcattttgttgaatgatgattacagttttttgtctcggaaaatccacgctgccgtggtagcagggcttacaacgacgattcaaacaaactatcatttatctgcaatcgatgctaaggtctgttcaagctttttgatccacaacaatttaacctttttccggctctattttaatggtgatttaggactatctttggctgaactaaagcagcgtttagtttcgctcaacacttatggcattcatcaattcttctaccctaatcaatcactttaataggacccaaaaagctgagctatcgaataacgatgttcattcgatagctcagctttttactgactagttataggcttttaattatttaacaactcttgttcaatggttgctaataccccatcatgttcattatccaggaccgtcaagtgttttgctgcggcttgaatgtccgccggtgcgttgcacatcgcataactgtgcgctgcatatcgcaataatgggacatcattcgccccatcaccgaaggccatcacattagctgcagttaacccaagtttagtcgccaagaattgaattgctggtaattttccgacccgctgatcaaccaaatctacgacgccatacccactatcatgcgcacgtaactcgccatcaaaataatcattagctcgtgccaccagatcagcagcctggtccggtgacgttgagatactgatttttttaacggtatcatcaacagtggccagatccgcaaccaagtgtaaatgatcataaaactgacgggccatcgctactaacttatcaggtgctcctaactcagtatacgacccatggctaccaactaagattacgtatgcgtctttgaatagtggctggtaacgatcaacagtcacaaactttcgttgctggtctgctgaaagactaccatcaaagatcaagcggtcctgggcataaatcgacgccccattttcagcaacaacgataagattatccgccataacatctttaaataactgtctaagatgggcatattggttaccggacgaaagtactagggaaacatttatcgcccgtaactgcgccaaaacccgtttaaaccgttctttgtcaaaacgctgatcttgatgcaataatgttccattcaagtcagttgcaattaaattgattgccacaagtagccaccccatcttttatcatttactaacaaaatcggcctcgtctcgtcatgtgattcagccgattaaacatcaacatggcactcagttacattgctacgaatactattgtagcataccattattgtcatgccataaatgtcgcgggtagttgcggtttggcaaaataatatccttgccctcgcgtaatgcctagatgattagccagttgaacatcagccgctgattcaatgccttcaaaggtaaatagcatttgctgttcctccgccttatcaaaccaaaatttgagcgtcgaaacaattgcatccgtagttggggtccccagcggtcgcatattttgtaacgcgaatttaaccgtattcacatatggcaacatcattttgatctgttggaataggttatcagaaccaacatcatcaaaagcaagtaatataccagctgcccggtacccaacacttaattgctgtaactcacttagctcaggtgtcgcaactagctcaacagttagttctcgtggtaacaaatgcgtctgcacatagtgactaattgcagcttgaaagtcaggattagcaaactgacgcgccgttaaattgatggaaacatgatggttatttaattcctgaatagcgcaatccagcaattgaatcaattctgttggcgctatttcaaaggtcgctggtattcgccaagtttgttgcctctcatcccactgtcgtaataataactcatacaagattgttcggttggttccaaggttattaattggctgtgcaaaatatttatatttcagcatgaccattcatccccaatagtctaattatttagttgtgttatcgcaaccgcttactttatcataccaaaagattgtcaactttcacaatagtcttatgaatattagtagttaaaaattatgcaaaagctttgtgggcaatcaaaaaacgccaccgtaatcgaacggtgacgtttcttggtgcccacacacttactttaaattattcaacggtcacactcttggcaaggttccgtggtttgtccacatctaagcccttgtttaagctcgtgtagtaggccaataactgaccaggaacaacactaagcaaagccgttaatcgttcatcaaccgttggcaagataaccgtgtcaccatctttagctaaactatcggtgacgatagtaactgtcttagctccccgtgcagcaacttcttgtaagttggagcgggtcaacccagcggtattcttttgcgtaataatcccaatcactggggtatccttttcaatcaaagcaatcgtaccgtgctttaattcaccagatgcgaaaccttcagcttgaacgtaagagatttccttgagtttcaaggccgtttctaatgagacggcgtaatccagtccccgaccaatataaaatgcgtttggcgtattcaataaggcactcttagcaatcttttcaaaagtagccttttcatcaactaagctttgcatcccattagcgactaacgccaactgctgtttcacgtcgaaagctgttgcagctggttggtcaacggccacacctaacgctttagccaagatggcttgtaaggcaatctgtgcggtataggctttggttgaagcaaccgcaatttctgggccggcatgcaataacaacgtgtacgttgcttcgcgtgataacgttgagtttggcacgttcgtgatggtcaagcttgggaaatgttgatcgttcacattcaataacacttcacgactatcagcagtttcaccagactgggtcaagaagatgaagaatggatgtgctgataataatggttggttgtatgcaaattctgacgaaacgtgcacttcagttggcacgttagccaacgattcaaataactttgcaccaaccagaccagcatgataactagtcccagcagccacaatgtatagtcgatcggctgctttaagagctgttaacaagtcatcattgatgattggatcacccgcatcattaagataaacttgggatagcttccgcatcacattcggttgttcatcgatttcttttaacatgtagaatggataagttcccttgtcagcttgagctgcgtcaatgtcgacatggaatggcttccgttcaactggttcaccggcctggttcgtgattttaatttcatcaggtttaacgaccacgatttcgccatcatgtaattccaagaaatctttcgtttggtctaacatcgctaaactatctgagcagaccacgttaaagccttcgccgaccccaattaataatggactcttattctttgcgacgtataaggtgtcaggatcttccttatccatcagtaagaatccatatgaagaatggccgagcagacctaacgtcttacggaaagcggccaacgtactcaagccttccttggtgacaaaccgatcgactaattgaacaatgacttccgtatctgtttgagacttaaaagtcacgtcacttaaataagtctgttttaagtcttcaaagttttcgattacaccattgtgaactaagtagaagcggccatccgcagaaacttgaggatgcgcattggcaacactcggttcaccgtgagtcgcccagcgagtatgcccaatcccggtcgaaccatgaacagcttcacctacttctttacgtaagtcatcgatccgacccttttccttaactaaatagtcatgaccatcttgatcattgacatagataccagctgaatcatagccccggtattccaacttttccaatccgttcaataagattgatactgcactatctttacccgttacaccaacaattccacacataaattaatcttcctttactgtttgaattgtttctagctgcgtggtcaatatatctgtcaccaacctcacagtcggtttttgtaattgacctgtagagtgcagtccctgacgtcacccgtcgattatcgataaacgtcatcctcgtcaactttagattctaaagtcctggcgctattccgctttaaccaattaacaattggtctagtctaacctccaattggtatatctcctagaaacaagttaactttaccgttacatctaataaaagtcaacaatatattatattggtatacgtgttagttagcgtgtataccaatctcaaacgctgataaatcaagggcatcacgaattttcgaattttttgtaacttttttgcggtcaaattggtttgggaggcactgggtcccctgacagtcgccagttaaccgcatttagcaataaccgttcgtttcatggcaacaaaaaaagtcgcgactctaggagtaacgacttttttgatgatcggtctgatcacttaattattcaacgccaacttcagctttgaccacatcgacgatccgatctacataagcgctaaccagttcgtcggtcttcgcttctgccatgacccgcaataaatcttgggttccagaaggccgtaccaagacgcgaccatcaccggccatttcatcttcaacgtccttgataactgccttgatcttatcattgttcaaagcggctttcttgtcttgaaccttaacattcactaacttttgtgggtaagtcgtcacctcggcggctaattcagaaagcttcttacccgtttccttcatgacgtgcaataactgaattccagtcaacatgccatcacccgtcgtattaaagtctaagaagaccacgtgaccagattgttcaccaccaaggttatagccgtccttcaacatctcttcgacaacgtagcggtcaccaacttgggtctgcttgctgtgcaaaccagctgcttctaaggccttgtataagcccaggttactcatgaccgttgtgacgaccgtatcttgcttcaacttgcctcgttcactgaggaattttccacagatgtacataatcttgtcaccgtcaataatgtttccaagttcatcgactgcgatacaacgatcaccgtccccatcaaaggctaaaccaacttgagcgcctttttcaacgacgaatttagataatgcttcgggatgtgttgaaccgacccctttgttgatgttcaagccatctggtgccgtagccatcgtatcaaattccacgttcaaatccgcaaagatccgggaaactaagttacttgtagaaccattggcaccatcgacagccaaatgaatgccacttaagtcatctggaatcgtttgttccaagaattgtgaatatttaagattaccctctggaaaatcagcaactgtccccagaccttctgctgctggccgtggtaaagtgtctttcggttgatccagtaattcttcgatttcttcttccttggcatcagacaacttgaagccgtcgccaccgaagaacttgatcccgttatcttcaactggattgtgagaagccgagatcatgacacccgcgtcagcatcttggatccgtactaagtaggccactcctggcgtcgtaattacaccgagacgtaaaacttcaattccggctgaaagcaagccggcaatcaaggcttcttccagcatttggcccgaaatccgggtatcgcgtgcaactaaaacgcgtggttgcgtactcttgttttccgcatgttccgtcaatacgtagccaccagcacgacctaaacgaaaagccatttcaggtgttaagcctgaatttgcaattccccgaacaccatcagtaccaaaatatttcattataatttacctcatttcaaaagtgtcatgattaatcatttttaactgtaatttttactttgaccgacgttgggctaactgacgagatcccatcctcatcgctagtcgaaacatcgaccgtcttagtcgtggttgaatcaacattcgtcacatcaacattgactggcaaagacttcaacttcgccaatgccgccttcgtgccagtaaccgtcactgacttcgtgtcagatgagaatgaataactggtgtccgccgcggtcttgccactggctttcaaatcgattggcacatctttcgtcgttgtcgcctgcgtaatgggaatatacaccgacgtggtcgaaggcgtcaagacaacgttcaaattttgaccgttggcatctaatgcttcaatgatagcctgctggttcacggatttctctaaattcttgttggtattaacgaccgcaacgactttcgcgactttgctaacttcgctgacggcgcccgtaactttgacagatgatgttccgagccgtgccgatccaacttcataaccatctgctacgttggctttattgaagtctgcgctgaccttataagtagccgttcgtcgtggctgaatattaacatgaatgtacttttgactaagtccataactcaattctttattcaagccatcgacttcgactttgacactgtgccgcccaactgccaacttagataaattagcataaactttaaaattctgcgtgttagctgtagttgttactaaagcagacggcccttcaatcgtaactttaatattttcgggataacccgttacaaagtacttcgtgctattcacgttcagctccaagggcgcgctaatggtcactttacggttagatgtcaatgtcgttttcgatgaactattcgtcaaaatactggcgttatgcgttgtctttaacgaattaacgtaggcgaagagcaccagcgcacacagcagtgctagtagccgcattgaccaattgctattcataaattttttcattttcggggacctcctccgaaaactcgtccaaaccaattttgaagcgcgttttgcttggttgaatcctcaggcgttaataggacttggcggaaataccgcaagtagttttcacgcgtcatcccccgcatcagctcattgtccttagtaatcgacacttcaccggtttcttccgaaatgacaatggtgagagcatccgttacttcactgattccgaccgcggcacggtgccgggttcctaactccttgggaatcagattactttcagataacggcaagtacgccgctgcaaccttgatttgattatcttgaatgataacggcgccatcatgtaacggcgtatttggaataaagatattaattaataattcgccggtgatatcagcatctaaggcaatcccggtctcgatataatcctcgagacccgtgcccagcttaattgacattaaagccccaatacgtcgtttggccatatattggatggctttatctagttcggcaatcatccgctcttcatcttcattctgacgcttaccacgtgcaaacatggaaccacgccctaaatgctctagccctcgccgaatttcgggctggaatataataaccattgcaatgactgcccagttaataatttggtccataatccacgaaaccgtgtccagaccaatcaaaacactcacagctttaataatcgcaatgacaacgatcccgcgaaacagttgtacggctttagtgcctctcagcaacacaatcagctcataaatgacaaaccataccgcaagaatgtcaaggagccggacaaagttttgtaaggtcaacaaaccgctccaattgaaagtcatagtcctcctcctcatgaaaatcatttactttcacattatagcacggcaacccggttctcgcggtgcgatttcagcagggtctgcgctttttagctagattttgaataaatattaagcttgatgttatttaatatagcttgattaatatttctgttaaaattaacactagaagggaagtgactgaatgactaggttacaacagtggtttgtgcgactcgcattctggggatttttcatcttcgcagcagtcgacttgcacggcgcgttccattttctattacttaattcaattttggcttatgtcccgatcgagctgagtttttggctgacaccccgacgtagcccgctattattttggctgattgcggtcatttggttgcttttctatccgaatgcaccgtacttaatgactgatttattccacctcagcctattgaagccgtatggcatcaacggtctcttgcgcttcgacttaccgatgtggcgggatttcgcttacttggttgggccaatgatggtgtctacaatcattggtacctggggcgttgaccgaattgcccagcaactgacccaacgtttacacttccagcgactccctgctagtcgtggtatcatctgtgccgcactcttcctatttgctagtgtcggtgtctacgttggccgattcctccgactgcactccatctacttactaattacgccacagtacattgtgaaacaattagttgaaatgtggtcactaaagatgctcgcttttgtcttgatgatgtggctacttcaactcctcatctacgcggcttggcgattcacgatgccaacggttccttatcaaacaccggataagtcctagcgtaatcaaaaacaccgtttgaactgatttgataatcggttcaaacggtgtttcttattattaactaaatattagctaattcttcgtcttaggatcactatattcggtatgccgcccccgcttatcatgcaacccactgaagccactgaaacccagttcggtagccttttgttccgcatcgttgatataacgcaacgtatcgcttgcccgtttttcaccatagacttggacccattgatgaaaacgttcctcggaagccgtggtgatttcctgttccactttatggccagcaggtgttaacgataagtacttgattcggcgatcatgcgtattcgtggtctgttcaatgtacttcaaatctaataacacgttgatttgacgtgcaatcgcactccgtgaaacccgctgctctttcgcaatcttgaccaacgtcagcggctcctcacttgttgcaatcatccgcataaccgtgtaggcctcaaacgttatcttatacggccgggtcggcactgaaacgaagtccccgacatattttaaaatatgcatataagtgtccacgaagcgttcatgaatttctgattctgtcataatgatgtttccccctgtaaggctgcccttattcgtccgcttaagtaatgattaatttgcaaacctaaccattcaccgtcaatactactctaacatcattataacctagaactactgatttacaatctaaaaagttaactaatcttcatcggcctcaatatcattgagcatcaataagttctccgagtaattaatgaactgccgtaactttgccgcggtgcgtaaactaatttgtccactctctaacaaatgctgtacacccgcacgttcggcaccaagactcttgatgcgtagtccatgcagctgttgttcataatcatcacgtgataacgtgtgatcatttttcgcattctcgatgcgattccggtaatgaacgatcaagtgatacagagcctggcgatcaaactgttgctcatcaacgttggcctgtttgagataccgcgacaacgctttaatagcagctttagaagcctcacgctgaatatccaacaacgccactcgtaattcttcgctatcgccaggtgctaaccatagtcgaatcccttgcattgcacgcgtcaacaacaaccgtaatgagcgcagtgtcggaagcccctgtcgatgtgtcgcctgtaagaaacgttgttcgcgccgatcgacacgccgcaagtagacctgtccagctaacttactagtttgtttattggcaatcatttctctaactgctgcccgttcaccattcagtgccactaagcgaagttccaattcatctgtcagcattggcgccaactcatccgcagtctgcgacgccacttctagacgccgaatctgaaactgctggtccaagatcaaatcataggccgcacgttggttagctggccgccgatgttcttcaatgttttgaatcgctaactgtaagatataaatgcgggcttgcttgtatgttaactgtggcaattgcccactgctatcatcaccgtcatccgttccctctgccaagaccgcgtcgtcttcatccggactggatccccgagtaacaaaggggagtgatttggccgccatcaatggcaaaatagccgccgcagcaactaaacttacaatgatgactccagccgcaatgaacagtacgagcgcacgttccggaaaggctttgcccgaggccaccacggttggaatcgtgaagaccccagccatcgtaatggccccccgcacacctgataaaccggacaatgctgcaattctgagactaggtttagccttcttgtgatgtcgtaaccagttgaacaacatgtaagcgtatgtccaagcaacccgaatcagtaacaaaatcccccagacgattaaaacgtcaaagaccgcatgaaacgtatttgtatgcgcgcctttaatggttgcttgcgttgctgccggcaattcaataccaagaatcaggaagacgatcccattcaataagtaaacaaccacgttccagacccgttccgtcactaatcgtaattccggcgcatcttcactttcatgtgaattttgcaagtgcgataataccccggccgcaacaacggcgacaacaccggacgcgtggaaccattcttcagcaatgaaataaattgcaaacggcgtgagaatctgtaacaccacgttgaacacgatatcgttgataccctctcgtcgtaacacgtcccgaatgagttgaatgatcgtgatcagcgccagcccaacggccaaaccgaccagactaatatagaagaaatccccaacagcttcaccgagtacaaacgtaccggtaaccgctgctgctaacgcatatttgaacccaattaacccactcgcatcattaatcaggctttcgccactgaccaagtgcaaaatttctttaggtaacttgaccccttccgagatcgactgcacggcaatcggatcagttggcgataaaatggccgccaacgcgattccaacagcgagcggaatcgttgggatcaatacgtgaatcaaaaagccaccgagaatggtggtaataaagacgaggacgattgcattcgcaaaaattgccccgcgtagttcccataattcctgttttggaaattctctgccatcgttgtacagcatgggcgcaataaagacgagcataaaccaatccgtttgcaattttacctgtacatttaataataaagccactcctagacccagcccgacttgaattaaactgaccgggattgcgactagatagtggctcaatacattcgacagcagcactaaacatgccagtaaaatcactaattcgataatcggcatctagtggttgccccctttgttaaattgacataactaaccttgaacgacgtcttcaccaatgattcggacttccgtctgaagatggacgccaaaccgttcaaatacaactttctggacgtagtgaatcatatccatataatcggtcgctgtagcgtgatcgacattgataataaaacccgcgtgtttcttagaaacttcagcaccaccgattcgatggccctgtaagccagcatcatgaatcagtttaccagtaaaatacccagttggtcgcttaaaaacactcccgcatgatggccattccaacggttgtttggctgctcgcaacgtattcaattcgtccatccgcgcttgaatcttggtctgattacctggcttgagaccaaacgtcaccgatacgacaatatcatcatagtcctggatcgtactgtgccgatagccaaaatctaattcgtcatgatccagggttttaagctgacccgctggcgtcaaaaccgtcaccgtttcaacaacttcactcatttcgccgccgtacgcaccagcattcatgaaaatcgcacccccgacactaccgggaatcccagctgcgaattcgagaccagtcaagctagcgccacaagcaaccttagtcgtcgcaataattgcggcaccagcttcagcaacaactttggtgccactcgcatgaatttgcttcatgcgggtgagaatgatcgttaatccacggataccaccatctttgacaatcaaattactggcattaccaatcacggttagtggtaaattttgctcattggcaaacgtaatcagagctttcgtctcgctgattgactttggaaacgcaacgtaatcggcgggaccgcctgttttagtattcgtataatgacttagtgattcattttttttaatttcgatggctggaaaagtggccaagacatctttggtcatggtgaaaagttcctttcgtgtttcgatttaattcacttacgttaataatcactttaaccgcatagcgtttttaatttaggccgacgtatcaagcaccgcagcattgaaacgctattgaaacgatataatcaggttgaaatttgtaagcctatcagttaattttagcactttttaatcacttaataaatgacggcacaccgcgtgactggtaattgcgccagttgggtcgactggattaggtccgtgcgttgttaccgccgtcagaaaagcacggatcagcggtgcaaatcctcgcttttccaatgtcggtgtccaatccggaaaagccgtcgtggtagttgttgccgtcgtcatcacggttttagtacttaaatcagtcacagacgcacgttgccccgtcgtttggactgtcacttgttccagattgaccccaccgtacatattcgtgataacttctaattgctcatgagccgtctgcaccgtcaaatagccttgcgccaacgcgccagttgccgtcgtcgtcaaccgaccactagtgtgttcaagtggttcatctaacaagaatagccccgtatcgaccatgtggatcatcaggtcgaaaaccgccgtttcaggatcttgactacccacttcgcgaactttttcagccactaacatccgtttgtcaggcaatgccttcaattgctgattaaaaggagcaaaacgccgattaaacccacaagtcaataacaggtgccgcgccgcagccaaatcatacaaactttggaccacctgaagatcagtcgcgactggcttatcgacataaacgtgaatcccagctaataacaactgcttgatgattgctgcatgcgtgtccgtgggagtatgcacaaatacggccgccggtttaactgccattaattcctcaagggtcgcatgggtgtgttgaaacccatacatcgtcgctagttgtgctcgtttttccggattacgcgtcgttagatgaaattcatactggtcttgcatcgccgccatgacgggtaaatacgccttttgagcaatgttacctaaaccaatgaccccaatttttaacatcgatattcctccaattttatcatcaatcttcttttagctactactgattgctccgtggcacactgatttaaatcattcagcgtccaattcatgccagtgattgttagctggaaaaacgtgccatcactgaaagccaaagatacccgctcggacgcgctgaaactaggccaaccaaagacaccagcatgctttgtcaccctatcgcacatctatccgccgtgtctggctttaatcacggcgcactgattcaattgtcattaaaataaccagtggctgccgtgttacaatatgagtaaattacttgaaaggtctgaaactcacgtgaaacttatctcttggaacgttaatggactgcgtgctgctgtcaaacacggctttgtcacaacttttaatgaactcgatgccgactttttctgtgtacaagaaacgaaattacaggcgggccaaattgaactggacttcccaggttattatcaatattggaactatgccgagcgcaagggttattcgggtacggcgatttttaccaaacacgagccgctcaatgtaacttatggtatcggtgtaccagaattcgatgacgaaggtcgcgtcatcacccttgaatatgcggactactacgtcttgacgtgttacactcctaattcaggcggtgaattaaaacgtctcgactatcggcaacagtgggaagatgcttttctcacatatattaacagtttgagtgccaacaagccgttgatcttttgtggtgatcttaacgtggcccacgaaaacatcgacttgaagaactggcgtagcaatcaccatagtgccggcttcactgacgaagaacggaccaagtttgaccgcctccttgcagcgggctataccgacacattccggcatttctatcctgaccaaaccgacatttactcatggtggagttatcgtgggcatgcacgtgacaacaattctggttggcgaattgactactttattacgtcacagcaattagacagtcagctcctaaacgcccgcattcataatgaaatttttggttctgatcactgtccagtggaactcgatattatccttccgaaccattaacttgaaaattaacgagattctttgtacgataatcctattctttagaaacggtggtggcaactttgaactttgtcgcaatggactttgaaacggcgaacgcgaaacgcgacagtgcttgttcactggcgctaacggttgtccgtaataaccaaatcagcgatgaattttacacactcatcaaaccagagagcgattttttctggcggaacgtccaaattcatgggattcatgaagcagatgtcgcagacgcgcccaagtttccagacgtttggcaacacattgcaccattcttccaacgcgaccgcctcgtaattgcgcacaacgcgccttttgatattggtgtgttacgcaatacgcttgcccactacggcatcagcgcgccggagtacctatccatggataccgtcaagaccagtcaacggttctatccagaattgcctaatcacaagctggatacagtctgtcaagcactggatatcgacctgcagcatcatcataatgcactagatgacagcctagcttgcgccaacattttactcaccgaagcgcaagcttttggaactgagcaactcaaccctttcgttcgcgttcagggttaaaattaaatttatgcaagtccagcaataagatgctggacttttttgtttacgcatcactaccgattatcaatactcgtagacagcttatcaattcccccaaccgactgggagatgagccaatcattcacaagccgtcgccggttaggcctggttcgtcaacgcttaaattccggcccatctactatcagaacctgtttgccgtcagttcagcgaatcccggatttcaaacccagattcccatatcaatagctggaacccgtttgccggttgggtcaacgacatcatagctcgttgccgtacaattttcgaacccaagatgctggtacagcttaacggcacgcacatttcgtaactggaccgtcaacacgaggcgttccaatgagctatagttacgagcccaatctaagacttcctcaatcaaagcagtccccagacccatgccccaaaattctttaagtaccgctacgccaacttcaccttgcgccgcactaaaatccgtactagcttgcacggtgctcacaccaatcaaccgtgaatctaatgtcgcaacgaaaataatgttggtcgttgtgccattgatacgctcaatttgcgcctgttcatccgtttcgctcaaatcctcaatgccctcatcaacagtgaaagtattactttcacgtccgagctgagcgagtagcgctaataattgtgctgcatccgcgacttcagcaggccgtacatcaacaacttcttctgccatggttgtcactccttcaattgatcaaccagtcgttgatagtgttcaccaatgggcttgaaggttattacccgctggtcatcggcatcagtgtcccggctaattgcaattcgcaagtaagtcgtcggtaagaggtcggcaataaactgtgaccattccacaacactaacgccatcaccatcaaagtattcatctaagcctaaatcttccgcaccgccatcttccaagcggtaaacatccatatgatagagcggtagtcgccactgacgatattcccggatgagcgtaaaagtcggactcttaacgttattaggaatgcccaggctttttgctaacccctttgtaaaagttgtcttaccagcacctaaatcaccatctagtaagattaaatcaccaggttgcactaattggccaagtttggccccgattgccatggttgcttccggcgacgttaccgtgattgattccatattcttccaactcctcatccaaattaactgttcttattatagaaaaaacgaaggaaacttcaaagtacaagctctgaagtttccctcgtttaacaaactaagtgaccgtttaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatgtgataaccctccaataaattaattaatgctcaagattgacgtgctctggtaactgccaattgattggctgttcgccgaaggatgttaacgcaatgttcgtttttgaaaatggtttggacccaaagaatccgcgataagctgaaagcggactcggatgaggtgcttgtagcacgacattcgtctgggtatcaatcagcttaatcttggaccgagccgccttaccccacaagataaagacaaccggcgtcgatcgttccgataaacgctgaatggcaacgtccgtaagtcgttcccagcccttaccagcgtgtgaaaaggccacaccattttgaacagtcagcacggagttcaataacaagactccctgcttggcccaactttccaagtaaccgtggttgacgggcgtacacccaacatcatcttgcaattctttatagatattgactagtgatgggggcactgccacgcccggtaacactgaaaaactcagtccgtgtgcctgaccagggccatgatacggatcctgacctaaaataacgaccttcgtgtcagcaaatggcgtccattcaaaggcctgaaaaatattatacatatctgggtgaatatttttcgttcggtattcatttttcaaaaattcgtgtaattggtggtaatacggctcctcaaactctggttttaagacgtcccaccagtccgtgtgaataaacgctttcatccttaacacctctcgttttattgtatcataaccaaaaccactaatgataataattctgtattcagacgtaaacatgttaaaatgtaattattaaaacaactaaggatgtgacaacatgatttcgattatcgcctctgatatggacggaacgttactcaacaatgaaatggtcgtttccgattttaacgctaatgccatccgtcaagcacaacagcaaggcgtgcactttatcgtctccaccggccgccgattttctgaagctcagccactactggccgctcaaggcatcacggcacccttgattacgttaaacggtgccgaagtatacgacgcttctggcaaaatgctcgacatggtgcccataaccaatagcgtggcccgcaccgtttttcacacgctaacctcacaaggttactattttgaagtcgtaggcaacgatggtatttactctaacagtaaagccaagcgaatcgaacaaattgcacatctcctaactaacctgaatccagatacaacgttcaaaattgcggtatcgctcgcgtcagcccgcttagaacttatggacatcaattacgtggacaactataacgagttattggatgatccgactaagcatgtcatgaagattatcgctttcagcgaagaagggcccgctaagctaaaaccccttagtgatgaaattctggcaaaacattcgtccctcaaaatcacatcttcatccgcatcaaatatcgaaatcaataatattaatgcgcaaaaagggattgcagtcgagcgctatgcgaatatgctgaataccccaatgagcgatgtcatggcgattggtgataataataatgacgtctccatgctcgaattagctggcgtaagttacgctatgggtaatgccagtcccgaagtcaaacagttagcccgctatatcactgatacaaatgtcaacgatggtgtcggcaaagcaatcttagaagtgcttgccaaacaatagtttccggaaaacggaggttgaagatgcgtaaattatatttcagccgcaatagcttcgcccaaggtgcccggattgttcgcgatgcgcacaaccaatctcactatctcttagttggtcggtgggggcggcgccaagacgcgctcagtttatacgcgatccaaggtaagctacttgccgaaattcgacaaacaaccctcggattgttgccaaaattcgatttatactataaccgtcaaaacgtcggttctattagtaaaacgctgggcttctggcatgaaatgctctatgttcgcaagcttcgctggattatcatgggaagcttgagtgccgaaaactaccgcgtttatcatggtactgaattaatcatgacgatgcgaccagttgtcaccactaacggtgaagcatttgaattagcaattactgatcaatccacagaaccactgtgtatttgcattgcggcgatcctggatcactggcaaaagccgaccaaccgcgcgcggacaccagttgcgaaaaagggactcaatgttagctttggtgaaagtaattatacattgacaccccgtaataaggtgccccaacactaaatagaactagccataaaacaacggccacccctgtttcgggatgaccgttgtttttagttaagttggcataactagtttgccagcttaacaccctatcaaagttgacgtgccgatcaagttgcccatatcacggtattcactagttaatcgtcctcagagcaacaccacttcatctgctatgcaagcacgttactacagaataggcgcgccaagaattaaaccaattcttagcgcgcctatttgacgggttattttattatgaccagccgatacttaaacgttgatcactttttgtaagaaatcttgtaaccggggactttgtgggtgttcgaatacatcctcaggcttccccgtttcttgaatcaacccatccgccataaagacgacccggtcggccacttccttggcaaagcccatttcgtgcgtgaccacaatcatcgtcataccatctgcggctaatttcttcataacatccaacacatccccgaccatttcgggatccagtgctgaagttggttcatcaaacaacatgattttcggatgcatggctagcgctcgagcgatggccacccgctgcttttgcccaccagacaaggacttaggcatggcatccgccttatcggacaagccgaccgtagcaagtaagtcacgcgccgttttctcagcttcctgttgactttcctttttgagttgagtcggtgctaaggtaatattttgtaacactgataggtgtggaaataagttaaagtgttggaacaccatcccaatattttcacggaccaaattaatgttagtccccttgtcagaaagatcgtaaccgctaatgacaacttgcccttgtgttggaacttccaagtcatttaagcagcgtaaaaacgtactcttaccagaaccagatggtccaatcatgcagactacttcgttatcttgaacttcaaggtttaaccctttcaagacttcgttatcgccgtagcttttatgcaaatctttgacaattactttcgccatgcttagttaatcctcctttgaacccagttagataaccatgttaataacgtaatgataatcagataaataatcgcaatcattaaccaaatcttaaagccttcgaagttccgggcaataatcaacgtcccagtttgggttaattcaacgatcccaataacggatagaattgacgtatccttcagcgtgataataaattggttaatgaacgacggaatcatgattcgaattccttggggcataataaccttgcgcatggccgtccagtatggcaacccaagtgaacgggccgcctccatttgaccatcgtcgaccgcggcaaagccccccttaacaaaggctccggtataggccccttcgttaagcatcaacgtaatcatcccagcaacgaacgcgggaatcttaaagccgtgcccaatcaggtctgggaacccaatgtaaataaagaaggccaacaccatcaatggcatcccacggaaaatataaataatcgtactggagatggccggaccaagtttacccggcataacgcctaagaccccaagaatcagtccgaggatcgtcgctaaaataattgaaataaccgttaattccaaggtcatccataaccctgagccaatcgtatccaagttttgggtgaacaagccaataaaggtccgactgcttgcgtcttcacccgttaaggatgcttcactagacttcaagtacttgttaatgatctttttgtaagtaccatccgctttaatcgctttgagacccgcgttaaatttctttaacagttccgcgtttttaccttttttaaccgcgaaaccatagtcgccggcctcgtgttgcttggaaacaatcttcaacgcgatgccattcttgattccgtatgacatcacgggatagtcttcaaaacaagcagccgagttgccgaccttaacatcgttatacatgttattagagtcattgaaatacttgattttgaagccgtacttgctctgaatcgacttcgcataggttgcaccagctgtccccgttttaagggccacggtcttacctttcaaatctttaaacgttttgaccttgctatctttagccacagccatgaccaccccggaagtatagtaagcgtctgaaaaatcaaacgtctgcttccgttcagccgtaatattcattccggcaattaccccatcaacttggttcgcactaagctgctgaacagcggcaccaaaactaagcgcttttaatttataattgaaattttcttttttggcaattgccttcaaaatatcgatatcaattcccttatacttaccacccttgacctgaaattcgaacggcgcaaaggttgtatccgtcgcaatcgtatacgtcttagcctgggcctgggtaccaatcgcaaaccagcttcccaacgctgctaacaacatgacaactgcaacttgccactttctcatcgacgagacctcctcaaatagtttaccggaacggtatgtcataaaatataacataattcatgtctcgcgaccaattcaattttttatacttttttaatttagctttaatgatgtcactatcatcagctgtttacttaataaaataaagtaaatagccatttctagcaaagattctgatgaaagtaccccctttttatgttttaaaattttgttcaagcattaatcactgcttaactgaatacttgacactagattcatcaacccgcgcaaccagccattaagtccaaacagcagcagttaacaaaacggaccaattcaaaatgaatctgtccgttgcaagaaatcgctatcaattttagctaatcgatgaacctaacacgccaatcgtacgcttaatcctcatgcgtatgccgccgacgtcctaatcccattaaccctaataatcccgttaatccgagtactaccgcgccttgttgtgctgagcggtcgcgctcgcccgtctgtggcagtgtgtcagcagtcgtgtcagttactcgtgtcacaggtgtcgctgctgctttggctgcgctagtatgctcattgttggccggtagagctggctcagcggtcgtcttgaccttagtctgtgcacgagtagccgcggccggttgttgctttgtcgtaatccgatcatcaacgccccagtcgacggtatgaccatccgaatcgttaggtcgctcactcggcttcggtgtttcactaggatcagcgatacctgcatgatcattgccgtcagggttagatgtttcgccgtgatcattgttgtcaggtacggtcgttccaccatgatcattgttatcagggtcggtcgtgttaatgtgatcatcgtcaggtaagacgacggtcaccacggccgttttagttaactgattaccggcaacatcaatatagtggtaagtcaatgtgtaccggccagtgcgttgcgtgttgaccgtaccatcgaccgcgatatcggctaatgtcagtgcttggccctgggcatcggttgcacgttcgaaattatcctgagcagcccaagtgtttccgacggtcaactgactatcacgcacttgtaactgggcctgactagccaatacatcgatactcgtcgtgacagtaatcagattacccgcacggtccatgtaacttagtgtcagtgggtaattgccggcccgccgtaagttcagggtaccatctacagtcacccgttggcgctgcgccgctgtcagcaacgtgccatccgctgccaaactcgttgaccagtcaacactatcattcagtgaccaggtcgtcttagggccggcaatcacggtaactggccgcgtactgattttagcctgcgtggcaacggttatcacttggatcaacgccgtttgttgttgtcccagcgagtccgtgtaaaccagttgcacagtttgtggctgaccaatatgggcaaccgttaagtctggcatcgccacgactgtaatagcggcattattgaccgcaatcggctggcccataccatcagtaatcgttccaataccctgatgataatcccacttggcagtcggacccgcgatgaccatttgtggctgagtcgttaatgctgcttggtcgactgtcaccgtcgtagtttttacgttgcccacctcatcagtatatgtcagggtgacttgttgttttccggcctgttgagcattgatggtcgtcatcgtaacattttgataattctgactagtctgaccccaggcgtccgttaaaccagtgactagatccgcaaccgttaattttccgacagctgcaggccaaatcacctggtcagcactagtcgtcatgtgcgcccgtgaggcgactgttgtgacctccgccgtggtggtttgggtcaatcctaattcatcagtgtaactgaacgtaacgacttgaggccgccccaccatgcctgtgctcaaatctgggcctgtcaacaccttaatattagcatcaccgacattaatcacttcgccggcagcattcgtcacggttttaaagttcgtctgataatcccaatgggcagtcggcccggcaaccggtcgagcggtttgggtcgttaaggcggcttgatcaaccgtcacttgggcagttgttgtcacctcgtttccgtaatcatcggtatacgttagagtcaccgtttgggcaccaggctggctagcattgactgcactcattttgacattagtcaaagacgacacttgagtgccatccgcgccggtaatcgtttgcaaaaagttggctggcgtcagttgccccgcatctttggcccatacaatctgtgccggacgtggcacgagtgccgcctgtgatgccgttaaggtcaaaatggctgacacagtatgcgtctgttgcagatcatccgtgtacatcaaggtgaccgtttgcggcttatcgatcattttagccgtcagttgcgggccggttatgaccgtaattttagcttgatcaggattcaactgatgcccttgcgaatccgtaacagttgccaattgttgccgataatcccaagtcatacttggtccccagatttgagtccggttctgactctccatcttggcctgatcaaccgttacttttacaacggtacttacttcgttaccagccgcatccgtataagttaatgagacgggttgaacacctggccgagtcgcgtctagcttagacatctgaacgatttgataatcagtcaccgcttgtccagaggcgtccgttaagctcgttacaaggtcattagccgttagcttcgccgcggcatccggttgcacgataactgccgccttggccgttaacgtagcttgtgagacctcagctgtcaccattgccgtgaccgactgggatttcccgagctcatccgtataaatcagtgtgatcagctgttgttgcccgactgaatcaacattcagatctggcctgttcaacactttaattgtccccggttggacggtaataagttgcccagctgcattcgtcaactgactaataccggcttcgtaactccacgttgccgtcgggccagcaattaccgtgcttggttttgtcactagctttgcctggtcgactgtcacattggcataagcgacggattgattacccgcaacatccgtgtaagtcaacgtcaaacgttgctgccccgctaacttggaatccagcgcactcatttcgacattgtcgtaatttgtaatcagatgaccttcagcatcgtataaacgatcaactaagtccgttgccgtcagttgtttagcttgatcaggccaaataatctggtcagcaacagccgtaatcttcgcctttgaaagcgtcgtcgttacaatcacgtcggtcgtgtgaactttacccagactgtcagtataggtcaatgtaaccgtttgtggcttgccagtttttgccggagttaaatcaggcgttgtggctgtaatgtcagcagtatcgacatcaattgtctttccgttggtatcgatgacttgagtgacgctgtcccggtaatcccaagtcgcggttggaccggcaattgggtgtgtcgcttgaccagtgattgtggcgaaatccacggtgactgtcgtcgaatcagtcgtttggttaccatacgcatccgtatacgtcagtgtcacggtttgcggcccgatagctttaggatcaaaaccactcatcgtcacatcatcaaaattatgaatttgaacgccatccacatcgtacagtgccgacactagcgacgacgcagttaccatgttcgcgttttccgctaaaattacttgcttggaaacggcagtaatggacgcttttgaagccgtggcttcgacattggcagtctttgtgtgtacttgtcctaaatcatcggtatattcaatcacgattggatacgtaccagccacacttaaatctggatgttaaacgaccgtaatcttagcattgcttaatgttagcgattgtcccttagaatcagtgacggctttgatgttatcagcatagttccaagtcgccttaggtcccgccacttgagtgtgattttgaagcgttagcgttgcgaaatccacggttacagtcgtcgaaacagtcgtttgattgccatacgcgtccgtatacgctaacgttactgtttgtggtccgatagctttagcattaaagccactcatcgtcacatcatcaaaattataaatttgaacgccatccgcatcgtacagtgtcgacactagtgacgacgcagttaccatgttcgctttttctgccaaaatcacctgcttagaaacggcagtaatggccgcttttgaagccgtcacttcaacatcggcagtctctgtgtgcgcttgccctaaatcatcagtatattcaagtacaattttataagttccagccacacttaaatctggacgttgcacgaccgtaatcttggcatcgcttaatgttagcgactggcccttagaatcagtgatggctttgatgttatcagcataattccaagtcgccttaggtcctgccacttgagtgtgattctgaagcgttagcgttgcggaatccacggtgactgtcgtcgaatcagttgtttggttaccatacgcatccgaatacgtcagtgtcacggtttgtggcccgatagctttagcatcaaaaccactcatcgtcacaccatcaaaattcgtgattttgtttcccgccgcatcaattaactcgctgaccaggtcggttgccgtcagctttttggcttcatcaggtatgatgatctggtcgctgacagccgtaatcttcgccttcgaagccaccgtgttgacaaccgcagtgactaagtgttctttgcccaactcatccgtataactgagtgtcaccgtttggtcatggccgaccatcgcaacacttaaatcaggttcagtaacgactttaatatcagcggttgcgagattatcaagcaacttttcatttgcatccttgacccattccaaaccagctagatagtcccatttagctttaggccccgcaattggattcgttagcttggtcttcaaatctgattggtcaaccgttactttggcataagctgtcactagattgccagcttcatccgtataagtaatagtaacggtctgcgcgccacccttgctcgtgtcaattgaactcattgtgacatctgttaggttggtactagtatcgacggggttcccgttggcagccgtgattgtcaccaaatcggcgacttttaattgagcaacctcactgggccaaatcgttaacggcgccttggttgtaacttgtgcctgagaagcaacgactgttacttgagttgggacgctgatgacattgcccaacgcatccgtatacgtgagtgtgacagtttgcgacccaatttgcgttaaatcaggttgctgatcaaccacaatgttaagtccatctaaactaaccgggttcccatcaaaatcagtgacactcgtgacatactggcggtagtcccaacttgagtttttgggtcctttaatgatagtactattacgcattgttaagtcggccttagttgcgaccatcgtcaccgtggtggttgtcgtgtggaccatgccagtagcatcatccgtatacgccagcgtaaccgtttgtgcgccagctttactcgtatccaagcctgtaaccgtagccgtcgcgagttcgtcagcacttagcttatcgccggccgcattgcgggagttgtccgtgtcgattaaatcattaatcgtatacgttggcttagcacccattttgatcgccaacggtttaccaactagtttgccttgatttaccgctaccgcaaccgtactagtttgctgccatactttgccatacgcatccgtatactgcaagtcaacttgataggtaccggcagtttgagtgtcgaccgtcgttacagcagtatcgccgttcacgctaattactttgacgactgtgtcagcggtcgcataaatatcagtcccattcacatcttttagtgttgcaacactatcggcaactcgccacgtcgtcttcggcccggcaattaatccggttacattcttggacgtgaaatcagcataggatgggctagtttcccagacccaagtgattgtatcggctggattatcgacgccattatacaaagccattaactcactcgacgtatacgtctgggtggcatcagcttgattgacccatttaccggtatagccagttccagttggaatgtctggcaatgaactaccgactaaatatgtttttgacccaaccgttaatgcgtttaggttcatgggcaacggattcccgctactatcttgattcaaaaacatatcatgatctgcaggttccttattcatatcagcttcagtgactgctgcaaagttagacatgtccaaactcgcaatgttgattgcctttaatccaggggttccctcaaacataaacttagtactagttaacgtactgcccgtctgccagcccgttatatcaagatcagtgagattggtatcatttaaaaacatcgatgacaacgctgtaacattcaacaagttccagccatgtaaatccgccgttgttaaactcttatctccattgaataacccatctatatccgtgaccatccgcacattccaagtacttagatcaatactggtcaaggccgtgttaaatgaaaacattctttttaagctcactggttgaaccgtattcaactgccactgacttaaatcataagattgaactcgcgagtcactggcgaacatagagtcaaaggacgtaccagaactgacattccaatgcgctaatcctgaaaagtcagcaatcttagttcccataaacatcattgaaaagtcagtgactttcgaagtatccagattttcaaggccatcaatactggccaaatttggattataccggaacatataactagtatcagtccccgcattaattggaccatcaatcactactttcgttaactcactgccaaaatcccccggtacgtcgctgacatcacccactccggtccaatcaccagcatgaatcgtcaacacaccatcatctgtgtactgccaggcacttgttcccagagtcccagttgagacaacagttgcgggtatggcggctcgcgctaatagtgcccgatttaactggactttatcgttagtcgtcgtaattgtattagttgtggcagttacagctatcggactagtttctgaatccacaactttttcagtttcattagaatctttcgagtctgagtcaccaatactggccattgtgctagtacttggcgatgcgacacttgaacgattagtttgtagtgattcatcagccaccaccgtgtccgtcacattagattgaatgccactctcagagcccgttccttgatcattttgataatcagaattttgtgttgtgactttctgtgaactcgatgcgacacttactgagctgtttgacgtttggtccaaactgtcgccagaaccagttttagcctgactgcttgctgatgccgaatcagaggtactgagattactggtttcgttttcattttctcctactgccgtaaccggttgttcagtctttgagtcagtagtggtgccactaaccgcctgttttttttgagcactagtatttgttgttgccgcattaatcgccgtcgcactagactgagtcgttgcccctgttgtactagtcgtagtagtccttaaaacctgtgagttggatgatgaggatgccccagcagtggtcgtagctgcggtggctgcggtcgtcgtttccgtatctgcccgacttatcagtggattcagagtaaaggtagccacggtaataccagcaaatacccagaaacgtccctttttatacattttataatgctgcttgctcgttataaatctattcatacatgtccccccaagaatccatgcaataaatcatatcaaaattaacttattatcaatttgagttatactaaatctgattaatatcagaataataacattctccaaagtttagtatcaattatatttattgaatcaattaataaatagcacgtttaactatcaatacaattatatgctaacataattaccagctaagtcgcaagtgcttgtacccgacctttcgcaaaatatttatagcctgataaccattttgctagtatctagaacatttataacagtgagcactacatcagtacatataaaatatatgcttgccgtcgtccgtccacggcacagaaccaccaacaacacatactaaaaaaggtcttccaagaatcgaattaattcttggaagacctttttatgacgctgccatactcgttgtatggtgcagcgatgcaacgctaacgtaatcgatgcctagtaatgtttcataacccggtcgatttgacgctgttgttcgcgtttcttgatatcttgccgtttgtcgtattcccgtttcccgtgagcgactccaattaagactttcgcaaatccatgcttgagatacatcttaagtggaataatcgtcacacccttagtcatcgttgctgcacctagcttactgatttctttcttgtgcaacaaaagtttccgggaccgcaacgggtcaacgttataacggttaccctctttaaacggactaatgtgaacgttttgcatccaggcttcaccgttgcgaacttgaacgaaaccatcctttaagttgacccgccgatcgcgaacggatttgatttccgtccccgtcagcgcaatgccagcttcataggtttcctcaacagcgtagtcatggcgtgctttccgattttgagcgagggcggtatctgggtgcttaccgtgttgtttggccattgccgcacatccccttacttaaaaattaacgccgacgatcagttgatgaccgccgattgttgttagtactatgattattattgttgctattatgattattattgttccggcgaccattgctattgccattacgatggttattgttgtggccaccacgatggtcgttattccggttattattgttcccatttcgccggtagttaccgttattgccaccacgccggttattaccacgatagttatcatgatgttcccgctttggcaataaatcagtctttggcgcttcttcaggattcaataacttaaagtcgacttctcgttgatccttatcgacccgcattagttgaactttgacgggctggccgattctaaatgtccgtttcgtcttacggccaaccaacgctaattgtttttcaacgtattcgtagtagtcgtcgtccatcgtactgatatgaactaagccttcaacggtattttctagttcaacaaacagaccgaatttcataacggaatcaacaacggcttcaaacgtctcaccaacgtgatcagccatatattcagccttcttcatcgaatcaacgtcgcgttcagtatcaatcccccgccgttcatgatcagaagtcgtttccgcaatatttggtaggttatcccgataacgtgcccgggcttcttcaccagtgccgttttcagcataatggcgaatcaaacgatgaaccatcatatctggataccgccgaattggtgacgtaaagtgagtataatacggtgccgccaacccaaagtgaccaagcgactggtcagcgtatcgggcctgcttcatgctccgcagcatcatgactgagaccatggcttcttcgggcttaccagcaaccttcttcaaaacgtcttgaagcatcttcggcttaacatccttagaactccccttgacactgacaccaaagttagtgacgaattcaaagaaactaagcatccggtcactatcaggcgtttcatgtacccggtagataaacggtaccttaagttgactatagttttttgcaaccgtttcgttggctgccaacatgaaactttcgatcattcgttcagctaagccacgtacccgtaattgaatgtcaattggatgaccggcttcgtcaacgataattttagcttcgttatcatcaaaatcgatcgcaccacgatgccgccgatgcttgtacaagatacggtgtaagtcgcccatcgtatcaaacatgtcgaccaagtccgcgtacttttcacgagtcttggggtcatgggcttcgagaatctgattaacagcgtcataagtcatccgggcgtgtgaccgaatcacactttggaaaatcttatggttaacgatttcccccgtttgatcaatctccatctcacaactcatggctaatcgttcaacatcaggatttaaggaacaaatcccgtttgatagccgccgtggcaacattggaatcacacggtcagttaagtaaactgacgtcccacgtttgaatgcttcccggtctaactcagagttctcggtgacataatggctaacatccgcaatgtgaacgcctagatggaagttcccatttggcaagcgccaagcaacaaccgcgtcatccaagtctttagattcggcgccatcaatcgttactaatggctggtccgtaatgtcgacccgaccaactttttcttcatcagtcacgtaatccggaatccggttggcttcatccgtcacttcttctggaaacactgacgggacgtcgtgttggtagaccacttgtaagacgtccatcccaggatcatcaacactcccaatgacctgcttggcaatcccaatcatccgcgttggatgctgagcgtcaggataagcagccacttcagcaatgatgacttccccctcagtggggtgtaagccctgatcagtgattaataactgatatttggataatttcttatccttaatttccacagaaccaataatcccgtcttcatccgtacttggtgtatacgcaccgacaatctgggtatagttccgtttaacgatgctgacaattttaccttcagggccgcggtcggaactgggacgggctggttgaatgatttcaaccgcaacatcgtcaccggtaatggcaaactgcgtgttgtccggattaatgtaaatatcaggcaaatcgggatcgtaacgaacgaaaccaaagcccttgtcattaccatgaaatgaaccttcaacagtcttcgtttcctggaccagcttgaaatgatcatgatcatcggtactaactaattttttacgttccatattcgcaagttcctttactagaaaagtaaacgccgttgcgcctgtaaaatgcaattcatccgttagttgttcaacactatacgtgcgatcgggatgagcttgcaaaaaagtcaggatttgttcttgtaagtttgcttctgacattatttacctcatttataaatagtttttaaatatgttaaaacatcttgttccaattggtgatgcgcactgttgacggtaatcacgtgtccagcatcagcataccaatgaaaatcaactggtacttgtggtaattgatcacgtaattgtcgcgccaccgtcgcatcaattaattcatcttgcccaccctgaccaatgaagaagggttgggtcacagcgctgaggtgactcgtaacctccgtcgtggtaaaggtattgactgcctgcagttgccgctgaaccagttctggcaacaccattaagatctgttcacgctcggcaattgagaattgactgtgcgccagttgatggtgactcagcgtgataaacatttcagcaacgtcactacgattaccagcaaatagtggtgaactaaacgtgccaccacctaacaactgaggatcacgctccaaggccgccgtcgcaaaaataccacctaatgataagccaaagatactaattttagtatagcctttttgccgcataaatgatattgcttgttgcgtatcttgccaccattgcgccggcgtctgtgcgagaatatctcgcggatcatcagtcgcgtgtccactgaattgggggccataaactgtataatcttcccgttctaatgctcgtgctaacatccgcacatcattggcacttcccgcataggcgtgcaataaaatgacggcatgttggccatgttcaaagaaaaacggttccggttgtttcagcatcattacaccaccttaaaaaaaagcctcctgaaatcacaggaggacggtcaattacttcgatgagtaccatgctagagctaacgccaggataaagaatgcgattcctaataccacggttaccttctgcatgaacgcttcaaaaccgcggggcttctgcttggcaaacaagtcatcagcaccaccggttaatgaagacatggcatcattagttttggatggttgcatcatcaccgcaatgataatcaaaacggaaacaaccagtattaacgttaacaataaattatacaagaaatgtgcctcctaaagcctccgctatgtctataacaatttaacatattttgccttatttttccagtatcctgaacaattcgttgctttgtttagtgctcagggcgtcgcgaccgttaaatgtgcgatttgatggcgcacccacgcacggttatcccggtcagtcaagataattaaggtatcaccagcccgcatcaaggtgtcgccatgcgggatcacttgacgctccccgcggcgaatagcgatcaataatgactctgctggccatttaaaatcacgaacttgatggccctctaacttagagccttcaaagatcggcaattctaaccgatcctggataccgctatgttccggtaaccgcggctgaattaacttctctagcaaagcctcataaatcggagcgccgcctaagagatccacgactaagtaggccgtcatcgaaacgactgctaatggcatcaagtgatgtagtgtcccgaccatttcagtaatcaataaaattgcggtaaacggtgctttaccaatgccggcaaagtatccagccattgcaaaaataataaagttcggaatcaagttcgtcggcatccaaccaacggcaaccatgaactgggcatagattgcacctaagatggcgcccagtgacaagattggcaagaagatgccacccggcaaaccagatccatatgaaatggtagaaaaggtaaaccgtaacacgaaaattcctaacaaggcgagtaacgctggcgttactgcggccaaattaatccaatcggaatcaccagtaaaaatggcaccaagccatccaaccaactgggcaaccgcaacttggcataccaatttggcatcgtcagcgtcacgttttgatatagataaccgaaaataccgagaaaaatcccgagcccaatcagattgccatattgactcaacggaaggttatggccgtacggaatgtgtaatactggtacaaggccaaaaaaattgagcgaaataaaattactggccatcgcactaactaatgcggtggtccaaatgattggtgaaaaattatgataaacctcttccagaacaaataacgtactggcaatcggtgcgttgaaggccgctgaaaggccagctgctgcaccaccggcaatcaaggagcgtcgatctgatcccgtctgtttgagtttcgacgcgacaccctgaccaatcgtagctcccaattgaatcgaggggccttcgcggccgagaaacagtccagaaccaatgcccagaataccaccgacaaacttgcgccagagcactgaccaccaactataatcaagctcgccagctaattgaccctcaacttgtggaatgccagaccctttaatattcggttcattcttaactaaccaacccacaaagaacgccacagccacagacaagcctatccatggaaagagcagtagccaatttgtatgaatttgtgcgtacacccattgaacgaacctcagtccctgctcgatgctgaaacgaaaaatactaaccacgatcccagcaatcacaccgacaattagtgcccggccaatcgagctgaaccgtgtaaagtcaaagtgttgttttgaaatgtgcggccgctgtgccaccatgagttccccctcttaatcatgataatcgttgtgcaatcacttgctggacggccgctaacgtcacgggcgctccaggatgtaatgcctgaatctgctgtggtccatctaggcgtaataacaaacctaataacagatccttttctaagtcgtcagtttgataagtttccttaaatccagccaataagtcagtatcatcattaaatgcttgcaaaaatagcgggactaattccgtttgttttgcagcttgatgggcggcactgaatcgctgtaaacctaattcaccactagtcacaattaaattctcgcccactagattgccatgaacaaattgattaggcgttacggtgtgtacttgtagccaggccgtacgctcggcaacaaagtcggggcccagtatatcccactcggttgattgggcagcggttggcccaaatgcaggaacttcagtattaagtcgcgtcaacatcgtcccaatctggcgccccagcgttgacttagcaaggggcttagccgttgcgcaaaattcagttagcgtcagaccttgtagtggctgataaatcacgtagtagaactggtacttatcaaaaatgaagcccgcatgcaatagacgcggagcacccaagctcaatcgagccatccgggtcagtccaaaacgttccgcctgataataggcccgagtttgggggataacctcactgggtggaaaaatcgcgatttgggtgggtccgaccgtaaagcgggcggccaacttatccgcaacgggttctggcgttttataaggctcattttcactggcataaattttttgaatcaccggttcaaaagcaccggcattcagttgcagtccttgccaatcagaccactcattaatttgttgctgaaagtcatccattctgctcgctccttactcaaaatacgcatgtttctattctaccacgactcgtccgtccctagaccctaaaatcaaacagatgttccttaaattatgtataataaaaacgccgtcccatcggaacgacgttttcattagaacttcaaattacttgctagtaatggtgttccgtgcagcttcgtctaagttgtagaaaccgtggatacctttatattctgaagtgctttcaagttggtcttcgatccgcattaattgattgtatttagcaatccgttcagtacggctcattgaaccagtcttgatttggccagcgttcattgcgacaactaagtcagcaatggtcgtgtcttcagtttcaccagaacggtgagaaacgatggcagtgtagccagcttctttagccatttcgatagcttcaacagtttcagttaaagtaccaatttggttaaccttgattaagattgagttagcaacgcccatcttgataccctttgcaaggtagtccgtgttcgtaacgaataagtcgtcaccaacgatttgaactttcttaccaagcttggcagttgccatttgccagtcttcccagttattttcatccaaaggatcttcgatagaaacgattgggtacttgtcaacaatgctgtcaagtaagtcaacgaattcttcggcagtaaatgattgaccattttcgccttcaccctttaagtcgtacttgccagtttcttcgttgtagaattctgaagcggcacagtcaaaggcaatggcaatatccttaccaggcttgtaaccggcacgttcgatagcttcaactaagatttcgaatggttcttcgttgttcttcaagtcaggcgcaaaaccaccttcgtcaccaacggcagttgagtaaccgcgctcgttcaagatcgctttcaagttgtggaaagtttctgaacccatccggatagcttctttaactgaagaagcgccaacaggcatgatcatgaattcttggaagtcaacgtcgttgttggcgtgggccccaccattgataacgttcatcattggtgttggtaaaacgtgagcgttgaatccgccaaggtagttgtataaaggcatttcaagttcgtcagcagcagcacgtgcagcggcaatggaaacacctaagatagcgttagcgcctaacttagctttgttaggagtaccatctaacttgatcatagcttggtcaatggcacgttggtcagttacatcgtaaccaacaatttccttagcaattaacttgttaacattgtcaacggctttagtaacacccttgcccatgaaacggctcttgtcaccgtcacgtaattcaacggcttcatgttcaccagttgaggcacctgaaggaacgataccgcggccaaatgcgccactttcagtataaagttcaacttcaacagttgggttaccacgtgagtctaagacttcgcgagcataaatatctgtaataatagacattaatttctctccttaaaattggcttgttatttgtttcacacttattgtagaagtttgtcaatcaacttgcaataactattattagttattttgataattaacaagttccaagaatgaatcaggttgtaatgaagcaccaccgactaaaccaccgtcgatatcatctttgcccattaattcgttaacgttggctggtttaacactaccaccgtattgaatccgaactttatcagcaacttcttgtgagtaaaggtcagcaacagtcttacgaacaaccgcacaaatttcttcagcttggtcactcgtagcagtcttaccagtaccgatggcccagattggttcgtaggcaataaccaatgaacttacttggtcagctgataagtctttcaaagcagccttgatttggcctgaaacccatgattctgcttcgccggcttcacgttgttctaatgattcgccacagcaaatgattggcttcatgccgttcttgaagatagcgtgtgcctttttgttaatgtcttcgtcagtttcgtggaaataaccgcgacgttctgaatgaccaataacaacgtaatcaacgcctaagtcagctaaggcagctggtgaagtttcaccagtaaatgccccagcatcttcaaaataagcattttcagcagcaatctttaaatcagaacccttggcagcttcaaccatttcctgtaagaaaagggctggggcagcaacgactgattcaacttttgatggatctggtaattgatccttaacagcattaacgaaagctaaagcttcgctagctgttttgttcattttccagttaccggcaataataggtgtacgcacgataaaccttcctttcggagaacagattatttttcagaaatagcagcaataccaggtaattccttaccttcaaggtattcaagtgaagcaccgccaccagtagaaatgtgggttaacttgtcgccaacgccaagttgcttaacagcggcagttgagtccccaccaccaacgatggtcgttgcgtctgataaggttcctaagaacttaccaatttcaagcgtacccttggcgtagttgctcatttcgaagacacccattggtccgttccaaacaacggtcttagcgtcgcgtaaaacatcttcgaattcttcgattgacttaggaccaatatctaaggccatgtagccatcaggaattgaaccttcaacaaccttgctaggaacatcgttatcaaacttttcagcaacgattgagtcgctaggtaagactaacttgtcgccagctttttcgatgattgacttagccaattcaatcttgtctttttcaacaagtgagttaccaatgcccatgcctttagcagcatagaacgtataagtcatcccaccaccgatgatgatcttgtcagctttgctgattaagtgatcgataacaccgatcttatcagaaaccttggcaccacctaagatagcaacgaatgggtgcttaggattgtcaaccgcgtcacctaagaacttgatttccttttccattaagaaaccagcggcaacttgatccatgtttgaagcaatcccaacgttagaagcatggctccggtgagcagtcccgaaagcatcgttgacgtagacatcaccaagtgaagcccagtacttgcctaattcaggatcgttaccagattcgcgcttaacttgttcgccgttaacaacgtcttcaaaacgagtgttttcaacaactaagacgtcaccgtcgttcatgttgttgatggcagtttcaagttgttcgccttcagtaacaggtacgaaggtaacaggcttgtttaataagtttgaaagacgttctgcaacaggacgtaagcttaagcccttcttgtcgtcttcgctcttaatccgacctaaatgtgagaataagatggctttgccatcatgttcaatcacgtatttgatcgttggtaaggcagcgacgatccggttgtcgtcaccaattttgccgtctttaattggaacattaaagtcgacacgaattaaaacttttttatctttaacatctaaatctgaaacgattaatttagccaatgttaaaatcctcctagaattcgtgactgctgaaattaaaaaaacggcaagaggagttttgcctccccccgccgtcaaaaccatatgcggttttaaagttcttaactatctaatcaaatattagagagtggcgaacttcaataaagtacgtaccatttggcaagtgaagccgtattcgttatcgtaccaagcaacagtcttaactaattggttgtcaccatcagaagtaacttctgtttgagtaggatcgaagattgaaccgaaagtagtaccgataacatcagatgaaacgatttcgtcatcgttgtaaccaaatgattcgttaccttcagtatgcttcttgattgcggcgttaacttcgtcagcagtaactttcttgtctaagatagcaactaattcagttaatgaaccatcaacaacaccaacacgttgtgcatggccttgtaatttaccgttcaattctgggataactaagccaagagccttagcagcaccagttgaatgaggaatagtgtttacaccggcagcacgggcagcacggaagttaccaccacgtacagggccgtcaagtaacatttgagttgaagtgtaagcatggatagtagtcatagtaccaaccttgataccgaattctttgttttcaaagaatgctaatggtgcaaggcagttagtagtacatgaaccagcagaaacgatacggtcatctgcagtcaagatgtcatcgttaacgttgtaaacgatggtcttcaagtctgagccagcaggagcagaaatcaagacacgctttgcaccagcgtccaagtgagcttgtgacttagcctttgaagtgtagaaaccagtacattcgagaacgaagtcaacaccgtcgttcttaacccaaggaatattttgtgcttgtggttcagcataaacacggtagttcttaccgttaacaacgattgaatcgtcggttgctgaaacgtcagcgttcaaagtaccatgagttgagtcatacttcaaaagatgagccaacaatgcaggtgaagttaaatcgttaatagcaacaacttcgatatcacttgacttttcaccaagttctaagatacgacggaatgctaaacgaccgatacgtccgaaaccattaataccaatttttacagacatactagaatttcctccttgtggaaataaaaatagttttattttaaaaagcaacttcactatagaagattacttttttaaaatcaagttagccgcaccctcatccgtgatcaaacacgtctgtttaggtgcaatgttcttcatatacgcggcaattgcggtggcttttgaagccccacccgcaatggcgagtataatctcccgatgggccagttctccgatttgcaatccaatccgcggaatccggtagaccacgttacccttcttatcaaagaagtaaccaaaggcttcaccaatcgcttcacgactgcgtaacaccttgatctgatcctcagacatattccggcgatgggccattgaaatggcttcaccgatactatgcacgaccacgttagcttgcccgataatcgccagcacctcttgaatacttggttctttgaggagtggttcatacgttcgttcactgacctgttctggtacaaacaacgagcggaacttaccgccagtatgttgtgccatttgtgacgcgatggtatttgcttgaatcgcaaccgattcaccaacaccaccacgcgccggaacaaataacaaatcacgtttatcacctaatttattagttaagtgacttgccacatgttccatggtatgcccacccataacagcaataatattacgcccttccggcaataattgctgtaatagctggttcacttcttcgcccatggtcccaataactttcaactgtcgatcggaatcaccagaaacgatgatgcaacgcttaatattaaagtattgcgccaactgtcgttctttctggcgaatgcccattagctcatccataaaatgacttaggcctactaacacgtcctgaccttgctgggtaacttgcatgcccgatttgtttgtcataatcaaatctagcttccgcaatgtatccgtttcggtccgtaacgtccgttcgctaacacctaacgtctgagctaatagccgacgtccaactggggccatccaattaatggttcttaatactaagtaacgacgactcagcatgtcaaccatatctggggcaattgcctcaatccattgaatatctgaatgcatggcatccaacctgctctctagtgggacgggtctggtccagctatgtcgaaaagcgacccaaagacttcaaaaaacaaagcacacaacgcaaattcactaagaaatcaatgttgcatacctctcttaccacaacatgaattataacaggttcataaggtggttgcaaatgaaaccccaattaaacttataaccgactggtccaaatggcgcgttaaattatcgttcggttctcaagtattgttttcgccttgatgacgacggaatattaagattttcgcgatatttcgccactgtccgccgagaaagttcgacattttccgcattaagaatctgaacaattttttggtctgaaagcggtttttctttattttcctgttcgatcaaggtcacaattcggtgttgaacactgtcggccgaaacgattttgccaccagtgggacgtttactgaccgctttggtaaagaaacgtttaagctcaaacataccgaagtccgtttgaatgtactttccattaatacttcgactgattgttgattcatgcacttttaactgttgggcaacatctcgtaacaatagtggccgtaaatccgtcgttttttccaagaagaagtctgcttgacgctcgataatggccgttcccactcgaaaaatggttgcctcgcgttgctgcaaactgttagcaatccagtcatactcacttttcttttctttcaaatattccgtaacttcctgatcatcatgctgccccatctgctgataataccgactgcggaatttaaccaccggttgagccatggatgcggttcgcaatgccagctggcctccctgattcgtcaccactaaatcgggaaagatgtacccggtcgtctcctgcccgattgccgcaccgggtacgggtgttagtgttcgcacataatcataaatacttgaaatgtccgcaagcgtcacctgatacttcttagccaacaagtcccattgtcgattaaccagctcgtcaaaactttcttctaagacaatataggctaagttcggtgcatggtcatcattttctgtctgcaacatcagcgcttcttgcaagctccgggccccaacacccggcggatcaagttgttgtaataaggtaattgcatccaacaactcaattggcgttgccttagtttcttgccgaacctgcctctcatcaatccgcaaataaccattcacgtcaacgtactcaattaaataaaggacaatctgacgcaaatgggtatcacgcatcgttaggtgaatctgatccaacaagtattcaaataacgaatgctgattagaggtcgacacacgctcaatgaaatccgccttagtggttacatttttggctgcgttcaaactggcgtgattattattccaatttgtatccacatcgatcaatgggttttctaatgctttttgcgttagaaaatctcttagttcttccacattaaactgcaacatctgaatggattgttgtagtcgctgggtcatcgctaacttctgtgattgccgctgttgctggcgaaatcctggtcccagtgccataaaaatacctccctgaataaatttttatgtaaaacccttgtgtttttatccattattcgctagaatataatatgttgtttaggcgcccgtggtgtaatggatagcacgtaagattccggttcttgagatgggggttcgattccctccgggcgcatcagtagctgagaaatgattctcagctttttttgtgcatttatttaagtgacaactactggactataccagtcacatctccatatagtaacttaatttaaaccaaacaacaagtaatatcctttcggggtcagtaatagtacctatacccgctcgtccaagtaaaaataatcaaaaagtaatcagttcaagtaaaccatataccagtgtagtcgtttagtagatttaataacagctaaacttacaccattcaaataataattactacaattgttattatattatagaatcgttttaatcatggtaaatttcattcatgcatccgatactgattaattcgttgcgagcaacttgagtccagcaacaaggtcaagtcgtttaatatgtcggctcacgtgcgaatttccaacttctattagactcatctttgtgggtcactatcagtaaattgattcacctactatcgcgataataaaattatgcgggtcgactacttttaaatcaccacattagtgctgaatatgcaagttcattactgcttaatcttgaatcattattataagagaacatcgttttcaagccaaggtagacgcaacacttaatccaaggcctactaactaaaatcgtcgaaaaaaaagagattgggttcacccaatctcaagccgtattatgatagaaacctaagtataccacgttaactgcataaacggaattctgtttttgaggtttttcttttgaccttcactgaccttagcggtaaactacatttatattagcaatcagctaatcaaataatgcaaccttaggaggctaacaaatcatgtatccagttcctacagttattgaacagtcatcacgtggcgaacgtgcttatgacatctattcacgactattaaaggaccgtatcattatgttatccggtcccattgaagataacatggcaaacgccattattgcccaactactcttcttggatgcccaagattcaggtaaggacatctatctctatatcaactcaccaggtggtgtcgttactgccggcttagcaatctacgatacgatgaacttcatcaaatctgatgttcaaaccatcgttatggggatggctgcttccatggccagcgtcttagcttcatctggtactaagggcaagcgttttgctttacctaactctgaaatcttgattcaccaaccatctggtggtgctcaaggtcaacaaacggaaattgaaattgttgcggaagaaatcttgaagactcgtaaaaagatcaaccagattttagctgacaactcgggacaatccgttgaaaagttgaaccatgatactgaacgtgataactacttaagcgcacaagaggctaaagactacggtttgatcgatgatattatggaaaacaacaaattaaaataagctaatatctttgactgggctaacttgacgttggcccagtttttttgctcgttttcttgtcattcgttttgcaatagcccatactgcacataagcagggattactacccggacaatattacttgtccttgaacttaaaagtaaaaaggagtctctataatgacaaaagtctttattgctggtcagcttccagcccaagctaatacgttacttttacaaagtcagttagtcattgatacttataccggcgataacctgatcagtcacgcggaactcatccgtcgagtcgctgatgccgactttttgattaccccactctcaactcaagtagatcaagatgtcttagaccacgccccacaccttaaactgattgctaattttggtgctggcactaataacatcgatatcgcggcagcagctaaacgccagattccagtcacgaacacgccgaacgtttcggcggtcgcaaccgctgaatcaacggtcggtttgattatcagcctagcgcatcgtatcgtggaaggcgatcacttaatgcgaactagcggctttaacggttgggcgccactgttctttctcggccacaacttacaaggcaagacactcggcatcttaggccttggccaaattggtcaagctgttgccaaacgattacacgcctttgacatgcccatcttatacagccaacaccaccgcctaccgattagccgtgaaacgcaacttggcgcaacctttgtctcccaggatgaacttttacagcgtgccgacatcgtcactttacatctgccgcttaccacacaaacaacgcatctaatcgataatgctgcttttagcaaaacgaagtccacggcgctcctcatcaacgccgcacgggggccaattgtcgacgagcaagcacttgtgacggcgctgcaacaacatcaaattgctggcgctgcactcgacgtctacgaacatgaaccgcaagtcacacctggtttggccacgatgaacaacgtcatcttgacacctcatcttggcaacgcaacggtcgaagctcgcgatggcatggctaccattgtcgcggagaatgtgattgcgatggcccaacatcagccaatcaagtacgtggttaacgacgtaacaccagcatagaccaatcagtgtagttgtcttgcgtgacaactcaagcactgtagaaccattcgtcgaaataaataagcggtccacttcgattcgtcaagacactctgacaagtcgaaatggaccgctattttgttttgatcaaggcacgtatggacctggcgctcctactaaggtaacagctaaacgaccagttaccatgagcgtccctcaatcagttaattatttggcaatataagcatacttataattccactgtgtcccagcagtattatgaataataccctttacctttggattttgtaaataagagtataccgtctgatacaatggcgtaattccttggtccttcatgatcgtcttctcagcgttgatcatatcttgccaacgagcactagtatcattggcatcctggttttgagccttgttaaccaacgcattgtacgtgctgctgttatattttccgtaattataaccactattattagtcataatttgcaaatgcgagattgggtcgttgaagtcagcaccccaaccactgagataaaggtcaaaatcaccactttgagcacgacttgaagctacctttgatggaatgttggataagttgaccgtcaaaccatcgagattcttttctaatgctgatttcaagtattgtgaaatcggcttattaggttcgtcattagaagctaataactgaatggacaatttcttaattcccgtttccttaaggccttgtttccataacttttgtgccagcgctttgttatatgacgttgaattcttaaccgttgattcatctgcaaaatccttatcagttttagcatctttaactaaatcctgaggaacaaacgtctttgagaccgttgatgcgtcaccaatcacattctttactaacgtcttgcgattgatcgacaatgaaattgcttgacgaatcttagcgttattgagcgcctttttgattgtcgcattactgtcttggaaattataaaccagaaacgcggtgatagaataagggtacgtggtatagtcagaactgctcttcatattcttaacttgttcactcgctaattgcgttagatcaagtttcttttcttggaacaagttcaatgttgtcgtagtactctcattgaccgtgtagttgatcttttgtaggtggacagctttcttatcccagtactgattattttttacaaactgccagctattattagttccagtccagccagtcaacttaaacggtccactgtagagcatgtactgagccttagtggcatatttgctaccccattttttgaccgctttctcactaattggtccaaacaacgggtaggtcattaacttcttaaaataagtaattggcttatcaagagtcacaataaaagtatgttcgccttgcgccttgacgcccaatgtacttggtgactttttcccagcgacaatttcatccgcattcttcacccctgagaagaggtaggcatactgtgacttagttgctggggtgacggtccgtttccaagaatagacaaagtcttgcgcggttatcttcgaaccatcgctccactttgcattgcgaatcgtaaaggtatacgtcttgccatcctttgaaaccttagttgacttagctaatcccggtgtaatgctaccattctttcctaaccggtataagctttcaaaaatattacccgtactgccatatcccgacatattggaaatatcgattgaatccaatgaactagggtacgacaagtttaaaacctgactacttgcatacttgccattaccagaagactggctattgtgcttcccacacgcagccagcaccgtcactaatactaggctcattaccactgctaacactgatcgcttcttcaaacttctcgcccctttacattcccattttgatgtgttgatctacttattcccatcggttgtaacaaaaaacgcctgttcagaatctcgtcagattccaagcaggcgtttcaaaattaacgatttgagctcaatcccgttatttttgatgcagagacgcttgtaattcaacgcaaatagccatgttgtttgattcacaacatgggcagcacatcatcatttgcattgttgatttttgcataattacgtctctccgatttcaataagatgtgttcagtataaatagttgcacttacttttgtcaagtgcttttcgagtatggcgaacgacaatcaatccatttcaacccaaaaaagccgctaacaccatctaaagtggttagcaagcttttcaacaaaactcatgcttaagccatccttatcgacaactaagcatctttttgtaattgttccgcaaattgattgattttacgcagccgatgattgattccagacttagaaataggcccgcccggaacaagggttcctagttccttgaggctaacttcacgatgttccaaccgggcaacagcgacttcttgtaattttggtggtaactgttgtaatcccaccgtagcatcgatcaataaaatattttcaatctgtttgctagaggcattggcaaccttatccatgttggcattctcacagttaaccaaccgattgaccgagttacgcatgtcccgcatgattcgaatatcttcaaacttaagcatggcattggtcgcaccaaccaacgacaagaaatcggcaattttttccgcttccttgatgtacgtaatgaaaccaccacgccgatcagtcgttcgtgaattcaagccatactgattcatcatctcggagatcatatgattatgttcctcatacagtgagtaaatttccaaatgataccgggaagtttcaggattattaaccgaaccgcccgctaaaaaggcgccacgcaaataagaacgcaccgcagcatcatccgttaacacttcagttggtgccacttcaacgatttgataatcctttaaaatacccaaatcagcgagtaccatgtccgtaccggtcttcaatcgtacgatgtacaaattattcttatttaatttcattttgcgccgaacaatcaattcactatcgacgtcataaaattgtttgagtagccggtaaatacgccgcgcgatggccggattttccgtctgaatattcaaaatgaagtgatgattagcaatgctgatcgccccattcattcgaatcaaagccattaattcagccttagcattctcgcgatggacagcgaggttagtcaattctttcttaacgtcactggcgtatgacatgccacgacccccttatctgaaaacgtcggaatgaccgactagattcattaattcagcgacaacttggtcgccatcatgaaaggccccattatcacggagtttcaagaagttcgatgagattacgcgacagttttgttcacgtaaccctcggaagtcatgactcacttgctttgaaacttcgttaaacttatgaaaatccatgtaatcttctggcactttttcggtgttaactaacaccgtattaataaagttctgccccaaatggcggtttaagacccgcacatgattagcatcggagaaattatccgtttcacctttttgagtcataatattacaaatataaaccacttctgcatcagactcacagacggcccgaccaatatttccaatcgttaggttcggtagaatgctggtaaacaaactaccgggccccaaaacaatctgatctgccgccataatcgcatcaataactggttgaactgcttgtggttccttaccattcttgtcagtgacccaaacgcgttccaatgacttatgggccgcggtaatttcggcttcacctactaactcagtaccgtcactaaacttaccatgtagcgtgagtgcctcgttggctgccgggtaaacatgaccatctacttgcatcatatttgataattcctgcaccgcgtcaaacaccccggatttcatttccgttagtgccgcaataattaaattaccaatcgcatgacctgcaaaaaattgatcatcaccctggaaacgatactgaaaaatatctttatacaaatccggccaactcgacaacgccaccattacattacgaatatcaccaggtggaaccacgttaacgtaattgcgaataatgccggatgacccaccatcatcagccaccgtcaccactgcggtaatatcgactgcctgcttacgcaagccgttcagaacaaccggcaaaccggttcctccaccaatcaccacaattttaggccgctgagtcttaaatgtgtattttctcatgagcgattaacagtttcctttcgtttctcaatatcacgatgactgatgtgcaccttgtagtgcttagccagcgcttcaccgatacgttgcgtcaaggcaacggaccggtgttgaccgcccgtacagccaatcgcaatcgtcaaactactcttgccctcggcttcatagccgggcataatgctttccagcatactcaagaactgctggtagaaagcttccgtagctggttgctgcataacgtaatccgccacaggtttatctagtcccgtcagcttctttaattcaggaatgtagtatggattaggcaagaagcgcacatccataacgatatctgcatcaatcgggagtccgtatttaaaaccgaatgatagcatttcaatatgaaaagtctcatcctgatccgtttcgaatttatcaaaaatcgattcgcgtaattcacgtggtgtcaacgtcgacgtatcaatgacgtatgaagcccgatctttcaatggcgccaataattctcgttctttgcgcacgccatccatgacgcgaccttccatggctaatggatgggaacgccgcgtctctttatagcgtgacactaattcttcgttggaagcatctaaaaacagaatccgggtcgacacaaagtccgtgttgtctaagttagccaacatatccataatttcgtcgtaaaaagcccgcgagcgtaaatcaatcactaacgctactttctttattttacccgactcctcaactaattctgagaacttcggtaataacgctggtggcatattgtcaatgcaaaaatagcccaggtcttcaaagctttgaaccgcaaccgtcttaccggcaccgctcatcccagaaataattactagttgtaatgattctgccatgctgtattggccccctctagtccatattgttggtagtataacacaccgggtgtgtcatttctactgacgtgccacttcgacccgccatttgattccaaacagtattacattaacgcgcaaaaaaaagaccccttaacaacaccctgacaccaccaatagtgagcgccaagtatcgctaacgagtcaatactgccaagctagttacgccgagcaaaagcaatcaagattgcgttgatgccaaaaactgcaaagtagaaactaaccagtacgttgaaactaatcacagcaaccattggattgattactaataagattcccaatgccaaactaataatatccaagattaaagatagaacaaaatacccggttccaaagacgcgtagatgtgagactacggtcagccgttcaatcgaatcgatcaagaaccaaaaggcaaagacgtaaccgagtaccagtaccccagtcggtgcgtggaataaaaataataaccccactaaaatatcaataatcgcaaacacaagggcaaaatttgcccgcaaccctgtttcacggcgtagttttgtgtacccaccgattgtggtgaccccgctaataattgcggcgatggcaaataaaaagactaaacttaaaagtgctgcttgtggttgcttgatgacaaagtaagcggcgatccagaaaacgatccccgtcatgaattcagtccaatcaaacccccagcgatgatcattaaacatacatcaacatctcccatatccgatattaattccatcttaccagttaatgtaagagtttccaatttttctgatagactttatgttagcttaatgctttttcaaaatgtcgatagcactaaaaacgacctctaaatgccgaggctccgccacttagaggtcatctttaaaaataatatcaatggtcaaattgataagcattaattaatcagtggtttcagattgataggctgacaattgcgtttgtgcccgttgcaattcttgtctaatctgatcaaaaccagtaccacctagcgaatgccgccgttccaccgcaacttttgcgttcaaatcatggtagacatcttcttggatcagcggtgagattgactgatattctttgagtggaatatcctgcaacggccgctgttttttcaagccatccaagacgagcttccccacaatagcatgggcctcccgaaatgggattcctttgtttgcaaggtaatcggctagttcggtcgcatttgagaaatcgttagtcgtggcatcagccatccgatcttcattaacggtcagcgttgccaacatgccggtgaagacgtggagactcgttaacacggtcgtgaccgtatcaaacgccccttctttgtcttcttgcagatccttattgtaagcgagcggaatccctttcatgacagttagcaatcccatcaagttgccgtaaacccggccggacttgccccgaatcaattcggccatgtcagggttcttcttttgcggcataatcgaactacccgttgaaaactgatcgctcaaactgatgtacttgaattcataactgctccagctgacaatttcttcacaaaaccgtgagagatgcatcatcaggatcgaagcattgctgagaaactcaagcacgaagtcccggtcagaaacggcatccaaactattatgatagacttcactgaatcctaatagtttcgcactatattcccggtcgattggaaaagtcgttccagcaagtgcagcggctcccaatggcgaaatatcggtatgcttcaggttaaactcgaagcgttccatgtcccgcttgaacatttggtaataagctaacaggtagtgcgcgtacgagatgggttgggcgtgttgcaaatgcgtgtaccccggcatgaccgtctccacgttctcactcgctttatcgaccaataccgtttccagttcatgtagccggtccaatattagtggtaattgatgcttcaagtacaagtggaaatccgtggcaacttggtcattccgcgaccgggccgtgtgcaactttccagcgactggcccaatctcttcggtcaataatgactcaatattcatatgaatgtcttcgttgaccgttgaaaattccaacttaccttgtttttgacgctcagccaaggtttccaaaccagcaacaatttgatcaacatcagcggcaggcaaaataccagttttcttcaacattttaacgtgtgccagtgaaccagcaatatcttctgcggcaagcaactggtcaaagctaattgatgccccaaagtcatcaacatacttagcacccgtttcggtaaaccggccaccccatagcttcttggtactcattaggcgtgtgccttatcagtcttagcttcggcctgagccttcgcttggacttgggcattaacttgcgtcggtaagccccatagcttaatgaaaccaactgccgcttgttggtcaaatgaatccgctgatgtataggttgccaagttcgtatcatatagtgagttgggtgacttccgcccctcagtaataacgttacccttgaagagttgtacccggactaccccattgacgacttgctgagtttgctttaagaaggcaaccatcgcttccatcaatggtgagaaccaaagaccgttgtagatcgtatccgcaagcttttgttcaatgattggcttgaagtgagctaactcacgctcaaacgtcaaatcttccaaatctttatgtgctttgagcaataccgttgcagctggtgcttcgtaaacttcccgtgacttgataccgaccaaccggttttcaatatggtcgatccgaccaattccatgttcaccagcaatctgatccaacttgatgattaaatcagctaggttaagtgattcaccatctaaagcaactggcaccccagcttcaaaagtgatttccaaagtcgttggcgtatccggcgtatcagctaaggccttcgtccggtcaaacgcatcggcaggcgcgccctgccatggatcttctagaatgccacattcattggcccggccccataagttttcgtcaatcgagtaaggactgtccaaattgattggtacgggaatattgtgttccttagcgtaatcgatctcttcttcccgtgaccagtgccaatcacgtacaggcgcttcgatcttgacatccggtgcaagagcgtggatagcaacctcaaaccgaacctgatcattacccttcccagtacaaccatgggcaattgcaacagcgtgctcttgcttggctaatgtgactaacttcttagcaattaaaggacgtgaaagtgctgagaccagcggatattcaccttcatacaaggtatgaccttgtaaagcaattaacgcatattcttcagcaaattcttgcttagcatcaatcatatatgatgaaacagcccctaattttagggccttttctttgattgcatccatgtccttgccttcaccaacatcaattccgcaggccacaacatcatagcccttatccttcaaccaactaattgcgaccgacgtatctaaaccaccagaataagcgagaataattttatcattttgtttgaccattgatttgtacctccgaaatttttatctttgcttttatcaatgacagtatcgtaccacccaatttaattttattcaataatattttaaatatattcatcatttgtgcaatattcactaaaatgtagaatttttatgcagacattcaccgaaatcagtatattttttgttatttttgaaacactaccttaatctaatcttagattgttttcccacgattcaggaccgctaagctcgcacaatgtcagtaaacagcaaaaagagcctagcttttcgttatgaaaagctaggctctttttaattggtggccggcaccaccattactttttatattttggtctattcaacgactttgcgtacaaatggatccgatgaaattccttgcgataaaatcaacttggcccattccttagctgagaataaagaatgatccttgtaattcccacagctatcgatggtcgtcccttgtacgtcttcccacttagctgggccagcaatgaattctaatgaggacttcaatgccttagcaacttcaacggtgtcatgttcaccccaggtaatcaaatgaaaaccagtccgacaaccaaatggtgagcagtcaatcacgccatccatacgatcacgtaataacccagccaacatatgttcaatcgtgtgtaagcccgccgtatcaatagcggtcttgttaggttgaactaaccgcaaatcaaaattagtgatggcatcacccttaggcccattttccaccgtaattttacgaacgtaaggtgctaaaaccttggtatgatctaatgtaaaactttctactttagccatgtacaaacaactcctctaaattaaaattacattacaaactcaagtgtagcacattgcccgttatttagcaggtgcagttgcttcacgtgctcgatcccgttctagaacgggcttcaagtattggccagtataactttcagccacttcagcgacctgttctggtgtcccagtagcaacgattgttccgccgccgtcaccgccttctgggcccaagtcaatcaaataatccgccgacttcacaacatccaaattatgctcgatgattaacacggtattacccgcatccaccaaccgatccaagacaccaatcaagcgccgaatatcttcactgtgcaacccagtcgttggttcgtccaagatgtagaaattcttccccgactgttgtttgtgcaattcggaagctaacttcatccgttgggcttctccacctgataaagtcgtggcgggttggcctaacttaacatagcccaaaccaacgtcgaccaaggtctgtagtttccgtcgaatctttggaattggttcaaagaacttaacagcttctgaagcggtcatttgaagaacatcggcaatatttttgcctttgtattcaacttccaacgtttcagaattgtattgcttaccatgacacacttcacaaggtacaaagacatcgggcaagaaattcatttcaatttttagaatcccgtcaccgtgacaagcctcacaacgaccacccttagtattaaaactaaagcggcccttcttgtaaccacgtaatttagcttcattcgtttgtgcaaataaatcacgaatattgtcaaagacaccagtatatgtggccggattactgcgtggtgttcggccgattggactttggtcaatattaactaaccgttcaatattcttaatacccctgacactcttatacttaccaggcttttcagaattacgattcaacttctgtgccaatacgcgtttcaaaacatcgttaaccaaggtcgacttaccagaaccggaaacccccgttaccacgacaaattcgcctagtggaaaatcaacgtcaatttgcttgaggttgttttcggccgcaccagtgatacgaatcttcttaccattacccggacgccgagtttcaggtagtgggataaaccgtttgcccgatagatattggccggtcagtgacttctgcgagcgagccacttgcttgggcgttccggccgccatgacctcaccaccgttttcaccggcacccgggccgatatccacgatatagtcagcggcccgcatcgtgtcttcatcatgttcgaccacgatcaacgtattccccagatcgcgcatcttcttaagtgaaccaatcaagcggtcgttatcccgctgatgcaatccaattgatggttcatccaagatatagagcacgccggacaagttcgacccgatctgtgttgctaaccggattcgctgggcttccccaccagacagcgtccgtgcagaacggctgagcgttaagtacgccagtcccacattttgcaagaatgataaccggtcgcggatttccttcaagattggtttagcaatcacgagactttgttctgataagctcaactcgttaaagaaatcgagttccttaccaatggctaagtcagagaccatcccgatatgttcgccaccaactttgacagacagggccttgcgatttaagcggaacccatgacaagtctgacaagtgagttccgtcatatactttcgcatcacatcgcgggtgaaatcactattcgtttcgtggtagcggcggtcaacattgttgataacgccctcaaacacagcgtcaacatcgcgaacaccaccaaagtcgttctggtagtggaaatggaacgtctttccgttagacccatacaaaaccgtttgttgatcagcttttgataagtcttcatacggcacatccatcggaatttctaactgttcacaagcttgcttcaacatttcaggataatactgtgaactgattggattccaaggcgctaacgcaccttcagccaacgtcagcgacttatcaggtacgacaaggtcctcatcgacttctagcttgattccgagaccttcacagtctggacaagctccctgaggcgcgttaaacgagaataaccgtggttcaagttctcccacagtaaacccacagataggacaagcataatgttctgagaacataatgggttcgccaccgatcacatccgcaatcgcatagcccccacttaatcgcaacgccgcttcaaaagaatcaaataaccgagaacggtcaccggacttcacaacgatccgatcaatgacgatttcaatcgtgtgttgttgattcttgttcagttcaaaagtttcactgatatcatgaatatcaccatcaacacggacccgcacgaaaccttcacgcttgatcttttcaaagatctttttgtgctcgccctttttctggcggacaattggtgataaaatctgcaacttcgttcgttccggtaatttctgaatccgatcaaccatctgttcaacggtttgactcgcaatcggtgtcccatcgttcgggcaaatcggttcaccgactcgggcccacagtaaccgtaagtaatcattgatttctgtaacggttccgaccgttgagcgcgggtttttggatgttgttttctgatcgatcgaaatagccggactaagcccatcaattgaatcaacgtctggtttttgcatctgtcctaagaattgacgcgcgtacgctgacaaactttccacgtagcgacgttgtccttccgcgtacaaggtatcgaacgctaacgaactcttacctgagccagacagccccgtaatcacgactaatttgtcgcgcgggatggtaacgtcgatatcttttaaattatgggctcgcgcaccgtgaatgacaatcttatcatttgccaaaaaaaggcctcctcaatctcaagccagcaacctgctagctaatttgtgctttcaattccatgaccgtatcacgcagcgttgcggcttgttcaaagtcgagcttcttagcggcggtcttcatctgttcttccaacttactaatcatatctaattgttgttcacgagtcatatcatcaaagtcggtttctaagaagtcatccttcttacccgcgtcttcagtggtcttcgtcgaagcaattagctctggaatggcctttttaatcgtatgtggcgtgatgtgatgatcttcattgtacttcatctgtactgctcgacgacgtgcagtctcatccatcgcggcctgcatcgaatcagtcgtggtgtcagcgtacataatcactgaaccgtgctcattacgagccgcccgaccaatcgtttggatcaacgaacgctcgttacgaaggaaaccttccttatccgcatccaaaatcgcaactagtgaaacttcgggaacgtcaattccttcccgcaacaagttgatcccgaccaacacatcgaacttgcccagacgcaggtcgcggatgatctgcgttcgttccaacgtcttaatatcactgtgcaagtaccgtaccttgatgcctaaatccttaaagtagtcggtcaaatcttccgccatcttcttagttaacgtggtgataaagacccgttcgttgacctcaatgcgcttattgatttcacccactaagtcatcgatctgacccataatcggtcgaacctcaatcgtaggatccaataaaccagttggtcgaataatttgctggacgacgtgcttggtccgatccatttcgtaagggcccggcgttgcggacatataaaccacttgattaatatgctgttcaacttcttcaagtttcaatggccggttgtccaacgcacttggcaaacggaagccataatcgactagcatttgtttacgtgctcggtccccattatacattccccgaacttggggcatcgtcacgtgtgactcatcgaccacgagcaaaaagtccttcgggaagaagtccagtaacgtatacggtggttcgccaggtttacggccatccataaaacgtgaatagttctcgataccactagtgtagcccatttctttgagcatttcgacatcataggtcgtccgctgcttgagtcgttgcgcctctaacaatttgccatcggctgtcaattctttcaggcggccgtccaactcatcttcaatgcccttgatggcgtgttccataatcgcatcattcgtcataaagtgggtcgctgggaagatcgcaacatgttcacgatcagccacaatttcaccggttaaggcgtcaatctcacggattcgatcaatctcatcgccaaagaattcaacgcgcaatgcgtggtcatcccgtgaagccggaaagatttctacgacatcaccatggacccgaaaacgcccccgctggaaatcaatatcgttacgatcaaattgaatatcaacaagtttacgcaacagatcattgcggtcgatctccatgccgactcgcagtgagactacgtgatcttggtactcgtgaggatcccctaaaccgaaaatactggagaccgatgccacgacgatcacatcgttgcgttccaataatgagctggtcgcagagtgccgtaacttatcgatttcatcgttgattgccgagtccttttcgatataggtatcactcgaaggcacgtacgcttccggctgataataatcgtaataactcacaaaatattcaacggcattgttcgggaaaaacttcttaaactccccgtataattgacccgctaacgtcttgttatgtgacaagattaacgttggcttattcacctttgcaatcacgttcgaaattgtaaaggtcttcccggtcccggtcgcccccaacaagatctgctctttttctcccgattcaatgccagcggttaattgctggatcgcttggggttgatcgcccgttggttggtaatctgaaactaagtcaaaatgattattatctacccgatcaatcaaacgtagtcctccttttaaacggtcacccgttcatatcatctattgataactaaatcttactgtcgcaccataaaaaataggcaagcccgcgcttccctatcacattcaaatcgcatttaattttagcacatcgaacatactttcgccattaatcggattgcggcccggccgttaaaatctgggtcgtcagcgcctgtaattgatcctgatgcgtgaacggttccgctaacatctctggtagcactgcttttaagaaatattgaacactagtcatctttttaaacgcgacaattgtttttaaactttcttgataaatatccctaaaaactggttccggattacccttttgaatttcaccaaacgactcatacaataggtcaattttatcggctaccgacaatatctggccttctagcgtttcatccttgccttctgatagacgccgtgaataagctgcctgaaactcagctggaatctcattttgcacaaaattttgtgataatttatgctcaacatccgccagcatcgtccgtagcgtcggcgttgcgtacttgacaggcgtcttaatatccccgataaaccgctcattatagtcgtgattcagcgccttctcatagagggctcgccaatcaacaatttgtccggcattttcttccacatcacctaaaaattgggcgacttcagcaaccttaaatgaatgcgccgcaactgaatgattctgatacttaaaaaaacccggggcccgttgaatcgtttctaaattacttaagctctgaaaatattgatgcattcccattgcagcccaccatccttcaatctaatttggcctaagtgtaacaaaagcgccccggggacgcaaacccggagcgctttcgctgattagcttaactgttatgcaatgttaaacttgctgatgtgaatgaacctggttcggtaatcgtaacataaacgccattaaataagagacaatcaagaatccggccaccactagatatggatagtgataattcatatctagtaacatccccgacatgattgggccaacgatattgccaacactcgttaaggacatgttaagcccattgattagcccctggttggcctcacttgctttcgttaatagggtcgtaatagcgggccgcaaaagatcgaatgccgaaaaaataacgagcgttgcaaccatgacagcaactttcgaatgagcctgcgtaatccagatagtgcagagcgccgcagctgcaaagcacacccgaatgacccgccgttcgccccaacgctggacaaaggtatcaaatagtgccacctgtaggaagagcgaaatcaaaccatttaaagtcaagaccaacgcaatgttgctcagactaaagtgaaagacttcattcacgtaaatactataaatgctctcaaacccctgtaagccaaaggaagacactaaaatcatcgtaaataatataataatcgggacggtccaaaatgcccgcgtcatcggatgattggtcgtcgttgtcgtggccgtaattgcttcgcgatcaggatcaatctgacgatccgcaggcaacagaatgacgagcacaatggcactgagtaatcccaatgcaccagcaacccagaacggcgtcttataactaataccagccaataccccaccgataccggggcctaaaatcaagccaccactaaaggccgccgataaccagccaattactttagctcgctgtcgtttggtcgtaatatcggatgctaacgccatcgccgtcggaacgaccatcgctgctgataagccaccaacaatccgggaaatattaaagacccacagctggttggttagcgcaaatagtacttccgagaccatatataagactagccctaccgttaatacgggcttgcgaccaactttgtctgaaacccggccaataatgggtgaggccacaaattgtgccaatgcgaatagcgcattcattattcccatatcggtagccgttaaatgcagttcatttttaataaacggcatgactggaataactaaactaatccctaaacaaactaaaaactcactaaaaactaaaattaaaattgcgcgtcgtgtttgtcgatccatgcgacctcacctcttcaatcaattgttaaatttacaccgctttccatcatatcagggacccggattgaaagctagcagaaagtttgacaccatttgcaacccttttagtcggtaaaatatcggccaatcagatacaataagcataactaaattctaaggaggacctactatggatcaagctttaactggtttcaccaatattcaacacttagactccgaaatcatcgttgacctgcgttatgccaccactaataactttactcatcaagtgatttacgactttaccacggccattgttcgcactggcacggcccacaaactcgccaaggcaagcgccctggttaaacaacaaggttatcgactcaaagtctgggatgcttatcggcccgtaagcgcccagcgccgtttatttgaagtgtatcctgatccagaatttgttgcccagcctaatcctaatttcagccaccaaaaaggcgtcaccttagatttgaccctggcccatcctgatggtagtgagttaacaatgccaactgccttcgatgacttcacggcagctgctcaccgtgacgctcctcgaaccgcacttcaagaaaaaaattatcagctgctggacaccgccatgaccgccgcgggctttgtcggctacgttaacgaatggtgggactaccgcgacaccgaaatggacgcttaccaacccctagccgctgatcccaacgactatgcttgaccaatcactttcaaataatataaaggtggccgccaaacagtcaggttatgaaacccactgtttggcagtcaccttatttggctcattatttttatggattcaccagcacttattattaaaacatgctagttagttggattgttgcccgtcagcatatgcgcgtcctcgtctgacttccaggaaaccactcgagtggcagatgaacggccgcttaacccaagctaatctgtcgctgaaccatctactccgttagacttggaacaaacgttaacgtagcacattcgttttgaataccatcccagcaattggcagcaatacctggagaacggtatcggacgcactcaccaaacaagtttacgctaatctgaacttattccagcgggtctaagctggctgttcttgattttaacaaccagcaccttctgaccataattagtgcaaaaacttaattattccgacgatagccatgttcctgatctactgcagcctgcgccactaaattcaagtaattaaacggttcatcaaagttgggtgagaatagcatatccatgaaggctaattcatcaatcgtattaccattatgaatcactacggacaacgtatttgctgattgtgaaacttcatgagcactcattagttgaccacccaaaaccttccgcgtttgttgatcataaaccaactcaatcatgactttcgccgtggtaggcataaagtccggccgataattgccttcataaaaagctgcttgggcatcgaagttagctgctttggccgccgttaaggtcagacctgcacaagccacggtctgatcaaaaatcaacatcccagtcgtcgcttgcgtaccaattgcacctaagcgtttatcaaagatattaattcctgccagtgcaccttgccgaattgcatgtgagactaatggcatataggcgtgttccttcgtaggattaaagctaatttccgtcacatcgccagccgcaaatatatccgggttggaggttcccatataacggtccgttacaatggccccctgcttagttcggttgacctgtcccgccaataactctgattgtggaatcacacccggacaaataacagccatatcaaatatttcttcactatcagcggttgcaactcgtagtcgattatcagccgtatcactaaaagccgtcacttgtgcattggttctaacttggatgcctttcgtcgttaacaagtcttcgatcttctcagaaatttgtggatcaagatactcattaattaagtgggggccccgttgaaacaacgtcacagtgtgtccggacttcacgtacccctcagcaagttccacccccgaatagccaccaccaacgattgcaatatggtgtgcatgtttagctgcttcgtagagttgctgggcctgttcgcatgttttgcaaagcatgaccttaggattctctacgcccggaatagccgggattgcagtgattgaacccgtcgccatgactaacttatcatagtgatccgtttgtaattcttttgtctgtaaattttgagccaaaattgtatgcttatcagcattcacattgatcacatcatactgcatccgcatctgcacaccttgttcactaaattcactaggattagcgtacaacgcttgatccaaattatggatggtaccccctaagtgtagataagtcccacaagacatatatgaaatatccgcgtgccgttcatagacggtaatttcagtgcccggataatatttcaagatttgtttcatggcggcaatccccgcatgtgtacagccaataatggcaactttcattgtttcgaccacagctttcattaaaagttaaaatttaacttggattaagttaaacatttatttaagttgacgtatacttagagtatacagcgattcggttgatattaaaacgattcaatgattttaaacttattataaaaggcgatggtacttatggaaccaatttaccgctattttgtacaacctcaacttaacttactcaacaatacagtttacggatacgaactactaatcaaacaactaaccccagacggctggcgtctgcctgaatcctttaccgcaattagttcacaagttacctctgatctgctcattgcaacgactaaaattcttggactaaaagttcgttattgtgcagtcaatatcagtcgcgaacaattgatggatacaacggttgcgaaggccattattcaaagtcaggttcagctctatcctgctaaattagtcgttgagctaactgaggaacgtagtcctaaggattatccagataccatgttaatcccacacttacgggggttcatcgaacatggtatgcaaatttcacttgatgatgttggtaccggaattaacgatttcaagagtatccaagaaattttgccattagcttctgaattaaaatttgcgttgcaaaacttccgcagtgatatcaaagatcctaagattcagcaaaagctccatttttggcgggccatcagtagtgaatacggattgcgtttaatcttagaggggattgaagacgccgaagatgatcgcttgagtagtcacttcgatattaatcttcgacaaggttattactatggcaaaccgcaattattacgcctacccggtgaccccgtcaactttgaatatccgacaatgaattaatttctaatatgaacaacaactaaataacgccttacgaaattaacttgaaatttcgtaaggcgttatttatcacttagcatggctagtcagctgggccgtacaacttctgactaaataaccaatttattctttaataaacgcttgaatggcatcttcaaatttcgctaacttatcattagcttcttctaacgtactacctagcgttccaatgtagaacttgatctttggttccgtaccagatggccgaatggcgatccaagtgccatcatttaaatgatacttcaagacattcgcctttggcaaagcaattggtgccgtgtggccatcagcaaagctttccgtttgactctggaagtcttcagtcccagtgacatcgtagccggcaaaggcagttggtgcttcgcttcggaatttagtcatcagagccgcaatcttatcgctgccgccaacgccatcaaattcttcggacgtggtttgttcgcggaagtaaccgtattccttaaacaagtcttgtaatccatcataaaggttcttaccttgttgcttataataagccgctacttcggctaaaagcactgtggtttgaatcgcatccttgtcatgaacaaatggtttgattaagtaaccgtaactttcttcaaaaccaaacatataggtatgttcgccagtggcttcaaaatgttcgatttgttcagcaatatacttgaaaccggtcaagacattgatcatcgtgacaccatatgaagccgctactttagtagcaaattcacttgaaacaattgacttaactgcggccgcattggtcggtaacgtcccggcatccttgtttgcttgcaagatgtagtgtaacaagacagcggcaatttgattacccgtcaacagaacatactcaccattaggttgacgaacagctgtccctaaccggtcagcatcaggatcaaccgcaatcaagacatccgcaccttcttttttacccaaatcaatggccatcttaaaggcttcaggaaattcaggattagggaatttaaccgtcgagaattcagggtcagccacagcttgttccttaacaacactgaagtttttaaacccggcattcttcaaagccttttcgccaagcatccggccagtcccatgtaatggtgtgaagactaacttcatgtccttaccgacttcatccactagtttttgattgatcgtcacttctttgaccttagctaagtagtcctgatcgacatcatccccaataatggtttccgtcttatcagctaataattgttgttcatcagcaacggcaatcgcaaagacatcgtcaactttacgaatatatgatgtgataagatcagattccttaggtggcatttgaccaccatcttcgccataaatcttgtagccattatattgcttcggattatggctcgccgtaatcatgatccctgcgtaagtatgcagatgccgaacggtaaatgaaagttctggggttggccgcaagctttcaaaaacgtatgacttgataccatgttggcccaatactcgcgcagattcatgcgcaaaatcttctgaatgatggcgggaatcaaaactgattgctaccccgcgttccttaacctcagcaggcaaggtatccatgaagcgtgctaacccttccgttgcttgacgaaccgtataaatattcatccggttgataccaggtccaagtaccccccgcatccccgcggttccgaattccattggttcataaaaggcgtcttctaaggcggcgtcatcgccagccatgcccgtcaattcttgttttaaactagtttcaagtgtcgcttggtttttccaggtattataagtatcctgccaactcacaaaaaccatctccaattccgatatttgttagtgcttacaaaaatagtatacaacattgacacactttacaaagtaaaatttactaagaaaatccattaattaatgcattttaaatgcgtagtgggcccgcatcagtgcgaatacccataaattctgaagtgctagttagttcagtcactatcaaaacttgctataataaatcttataaggaggccatcatgactttttattcatacaactacttagtccatcaaaataacaatcatactcttgtccaactcgcagccatcggcatcattatattaataatcgccatactcagctggttatggtaccgccataaaacagacctaaaataccgcgacttattcattatcatggttttattattattgctgctcgtcggcattcaatttaatgaatggcagacaatcaaaaatagtttcaaccaaaaatcacaagtgacacaaattatgcagcgtgtcgccaaagaaaaaggggttcgtaaaaccgcggtctggtctaatacaagttctgtcagcagtgggatgctcattaaagtccatgaccatatctataacgtgacgatcaatacggatggaaacagttataccctgactaaagccacaccgattcaatcaacaatcaattatgttaaggaggggcaatatatgttttcatactgggatgtgacgatcaaactggccctcgggctattgaccatcattctacaaatcaatctatctggtaaaagtaaccttgcgccaatcagcgccctcgaccaagttcaaaactacgttctcggtgcaatcgttgggggcatgatttatagtaccagcgttactgttttacaatacattttagtgcttctcatctggacactgctagtgctggtcctgcgattcctaacacatcacaatcgctacgtgaaacgtttgattgatggacagccacagctattgattaaaaatgggcaattactcgtcagcacggccctcaaaaatgggatgagtgctaacgatctgatgtttcgcttgcgtacggaaggtatcacggatattcgctacgtcaaacgggccgtacttgaacaaaacggccaactgacgattacccaagtgggcgacgacgccgtcaagtatccaataatcgtcgatggtcaggtcaacctcgatgcgcttgaaactagtaatcatgatgaagcctggttactgacccaattgcaggcccagcactatactgtcagtgatatttacctggcaacgtatactaacaagcaattgcttctatttccctatcaacactaattcgcgaacctttggtcatcgtcaaacaatgactaacgctatatttaccaataaaaaatgcgtggctgatctcaattaaatcagctacgcattttttaattttatttaattgttaactttgtcgcctaaagcagtgatataagtgtaaacgccttgaccggcagttccgccttcaccaaccgccgtcgcaacttggcgtaaatctttcttacgaacatcaccgactgcaaaaataccagggaccttggtttccatgtggtcattagtttcgatccagccgttttcgtcagtaatcccaagattactgaatggcttcgtaattgggttaataccaacatagataaagacaccatcgaccgcaatctcactgtcttcaccagtcttattattattaaccttaactcccgtgaccttcttatcatcaccgatgatttccgtcacgttgctattccaaacaaattccatctttggattagcaaaagcccgatcttgtaagatttgttgtgcccgcaattggtcacgacgatgaataaccgtcaccttatcagcaagctgtgtcaggtaagtgccttcctcaatcgctgagtcaccgccaccaacgacaactacatgcttgttacggaaaaacgctccatcacaaactgcgcagtatgagacaccgcggccaccatacgtatcctcgccagtaacacccagcttacgatattcagaaccagtcccaatgacaagggccttagtctcaaacgtatcgctatccgtcgtcacgattttaacatcgccgcgatcttcaacggattcgacgctaccatacgcgtattcagcaccaaactgggtcgctgattcatacatgtctttagccaaatccggccccaaaacagatttgaagcccggataattttcaattgcggcggtattattcatttgcccaccatagattccgcgatctaatagtagcactgatagattggctcgtgaagcatagagggcggctgtcatgccggcaggccccgcaccaataataatcacgtcgtaactctttgccatttctaaagaccccttccacttaaattcctatgacgcttaatatacccccaaaatttacatttgtcgactatcttgtttgtacacaactgaagtcaattatagcttttaaccatatattgactaaaaaccgagatttaaataaataaaattatgccagttcacttgaattcaacccatggtaagacttacttcttattgtaaatccttgtcattttgcttggcccaatcgccataggccgtaattcgtgggtgattgcggcctgcctggcgttcttgttcaatcgcttgttgggcgacgaggttcagataattgaatggttcatcaaaattaggtgagaataacatatccacaaatgctagatcatcgatggtgtttccattttgaatcgcgattgataacgcattagcagactgtgccacttcatgcgcacttaagaactgagcaccgagaattttacgattttccggattataaattaattcaatcgtcagtttcgccgtacttggcatgtaagctggtcgccagttgccctcataagtcacccgttcagctggaatatgattcaatttcgccattgccagtgttaaccccgtggttgccagcgtgtgatcgaagagttgcatggccgatgtcgcttgagtccccatatatcgttgctggttaccaaaaacattggcccccgctaacgcaccctgccgaaccgcattggttgctaatggcgtataagccgaacgcccagttgggttgaagttaacgacacaagaatcaccagcagcgtaaatatctgggtcagaggtctgaacgtaatcattgatgataatggcaccgtgcttatccatctcaacttgaccgcgtaacagttctgtattgggaacaaacccagttccgacaattgctagatcagcattaaaatcgccttgattggtttcaatgacaagttcaccatcatcattaccagtaaaggcagttacttggtgattcaatagcacgttcacgccatgatcttttaatagctgaactgcttggtctgaaatttctttactaatgtaattattcaaaatttgatcatgcgattggaataacgttacttcatgatgtgtatttgcataactttcagataattcggttccaatataacccgccccaatgattgcgatccgctgattgtcttgggctgtttggtaaatttcctgtgcttggctgtaggtcttgcataataggaccttagactcatcgattccaaaaatcggcgggaccgcaacatttgaaccagtcgtcataatcaatttatcataagtatcgccaaacacttttccagtagtcatgtcaaccacttgtaaggtcctcgactgggcgtcaatttttaacacgttatgtttggttctgaccattgcccccaacttggctaacgtttctggtgacgaatagaacatatcctccaagtgattgacctttcccccgagataaaggtagatcccacatgataagaatgaaatattgtcatcacgctcataaatcgtgaccgtagcctccggatgatccttcagaatttgtgcagccgcagcggtccccgcatgcgtacatccaacaattacaatcttcatttcattttgctcccaattataattttatttatttaaccataggtatattataaccgctttactgcgcaaatacataactctagtcaatataaatacaggttatgatgaaacgtaactacttttaaaaaccaatcagcgatacgctggcaagcagttattctcacaatatcgtccataccagctttgccaggcaaccactaattgactttttactcattttcagaaaattaccttgttcaccaagcagtttagcacaatcatcattagcccaattgataatcgataccatgcaaaaaaagatggtgtcaaacagtttcacttattcattttttggtatagtatgtattaggaagcatcaaatcgtgttaattcaagtctaaggagttcccttatgtaccgctattttattcagccccagttagataaatttaataattcactgattggctacgagatgctgattcgctatcgtgagactgatcaggaccggtggaccttaccagaaagcttcgataatattccgatcgatgtacaagtcagcttactaaaggctacggctagtgagcttgcattaaaaatcgggtcagtatcaattaactttaatcgcaagcaatttctaaatgatgatattgctgccgcagtcattgatgctcagaaaaagttattcccggttcatgttatcgtcgaagtcacagaagaacccggtgaagatacgtttacactggcggcgatgcaacaacaaattgataagtacaaggctaacggcctacaatttagcattgatgacgttggcacgggaatcaacgtttacgaccacattaaaccgctactcgaatcggccgaagaaatcaaattcgccatgcaaaactttcgggccgaagatcgtgaaaacgagattcccattcaattaaaattctggcgcgacattgcggtacaacatgatatccggttaattctagagggtgttgaaaacgatgccgaagatcaaatggcgaatgacttaaatatttcactacgccaaggttattattatggcaagccccatttattcaaattaaaagccgaccactaggtgccagcttaattagtgaatcgcaattattcagcagttaactaaaaacaaccgtgaaatcttaatagatttcacggttgttttaattaatcaagtattatttagttggtttcttcgttgttttaggagcggcgctatcttctttagataacttagcaccaagatccttgatgtaagtccgcaagtcagccttaacatccggatgagttaacccgtattcgatcgtcgtcttcaagtagccaaacttgtagccaacatcgtgccgagtccccttaaattcatgggcaaagacccgctgagtcttgttcaacgtatcaatggcatccgtcaattgaatttcgtcacccttaccaggtttttggttttcaagaacatcaaaaatttctggtgttaataagtaacgaccaatgatagcaagatcactaggcgcatcttcaggtgatggcttttcaacaaagttattaacgttgtataggcccggttccttttcactttcaggattgataaccccatacttagaaacttcctcatgaggaaccttcataacagctaacgttgacgcatgtgtcttgtcatagctattcattaactgtttggttaacggtactttgtcttccattaaatcatcaccaagcatgacgacgaaaggttcgtcaccaacgaaagctttagccgttaaaacggcatcgcccaaaccacgtgggtgtgattgccggataaagtacaagttaatgtctgtggtttcttgaaccagcttgagcatttcttccttgtgcttagcccgtaagttatcctctaattctgggttagaatcatagtaatcttcaatactacgcttgctcttacccgtgacgataacaatgtcttcgatccccgatttacgagcttcgtcaacaatgaactgaatcgttggtttatcaacgattggtaacatttctttaggcatcgccttagtagcaggcaaaaaccgtgttcctaatccggccgctgggataacggcttttctaacttttgacatgtgataaatcctcctaaaaatagtgaaattagtttggaaattcctactgaatctcaggtttcccctcgcgccgcatcaattgtggaatgacttccttaatgtcggcactcttatataatacatcataaatcgcttcagtgatgggcatttcgatattttgttgctgtgcaagctcgtaagcggctttagttgacgggataccttcaataaccatgcccatggtatcaatcaccgtcttgaggtcctgaccagcacctaactcattaccagcgcgccagttacgcgaatggacactagttgccgtaacaattaaatcgccaacaccggataaaccgataaatgtcaacggctctgcgcccaacgccactccgagccgactgatttcagctaaaccacgagtcattaaggctgccttggcgtcatcaccatagcccaggccgtgtagcgcaccagcacccagggcaatgatatttttgagcgccgcacctagttcaacaccaaccacgtcggtattcgtgtaaatgcggaaatagtcattcatgaagagttgctgtactaattcggctgcagattcatcggcgctagccgccgtaatcaacgtaatatcgtggcgggccacttcttcagcatgactagggcccgataagacaacgatcgcttgtcgtaattcggtgggaatttcttctgccaaaacttgcgacagccgcttgtgtgtctcttgttcgagtcccttgctagcatgcacaataatcggccgctgatgggtcttggcaagcacggcagtcacttgttgggccacttcgcgaatcgctttggttggtacgacaaacaagattacatccgcaccatcaatcgcctgtgttagattagaataagcagtcaacgtttctgaatatttaaaatcaggaacgtatcgctcattcgtgtgtttctcatttaattctgtgacttgggccggtgagtacgaccagagccgcactgagtggccattttcatccaacagatttgccaaaatgctaccccatgagccagcacctaaaacggcaattttttttatcattcaaataaccctctaatctacttattttctgcgacaaccttttgaccagaacccgctaaataccaacgattattcggattgtgatgccggcgccagatcattaagccaatgctaccaaagaacagtaccactgacaacgcttgtgagacccgaataacgttaaatagcatgagcgagtcagtccgcatcccttctgtgaagaagcggccaaaggcgtaccaagcaacataagtcaagaagacatcaccctgcttataccaatgtgtgcgatgacgcgtgagcatcagtaaggcaaatcctaatagatcccataccgactcatacaagaatgttggttgccgatacgcgccacggatatacatctggttaatcagccaatcaggtaagtgcaagccttgtaagaaactcagactagtcactcgaccaaaagcctcctggttcataaagttaccccagcgaccaataccttggcccataatcaccgttggtgcggcaatatcaagcattagccaagttgggataaagcgtgaccgacagaataaaatgaccacaattccggcgccaatcaagccaccatagatggcaattccaccatcccagatacggatgatttcaccgggattctgacgataatatgaccactggaaaatcacatagtaagtccgcgccgcaattaaagtaaacggaagtgcccataaaatcatatcgtaaatgtcatcgggccgaacaccccgtcgctgaccttcacgtactgctagtgcaaccgcaatgacgacggcactagcaataatgacgccgtaccaatggacctgaattggtcctaaccgcagtgcaattgggttaagtgcccctaaaacggtattcacgctactgccatctccttattacttgtgagaatcatgcacggaattcgttttgatcaacttgttcaagttatcgtcaaagaccttggtcgcatcgtagcccatgctctcggcccgaaagttcatggccgctgcttcgataatgattgctaggttacgtccagtcttaactggaatcgagatttcaggaacttcaacatcaaagaatttccggttctgttctccatttcctagtctatcaaattgcttatcaggcgtccaattctcaaggtgcacgataaggtcaatgtcggtatcttgacgaacagccccagcgccaaaaagattcataacatcaataattccgatacctcgaatctccaataagtgattcaagattgcgggtgcttcaccgacaagcgtttgttcatcctgttgatagacatcgacccggtcatcagcaatcaaacgatgcccccgtttgactaattccagggccgtttcactcttcccaacaccggaatcaccagtaatcagcacacctaatccatagatgtcaactaataccccgtggacagattgtcgttcagctaatttaccttccaagtaattcgtcatattacttagaatccgtgatgatgtcattttcgttcctaaaatcggcacgccattttcctcaccggcttgcacgagttcttctggaacgggtaaccccgttgaaatgacgaacgcgggtgtggttaactgacacatcttacgaaaaatcatcagtcgttcatcatgactcatatttttcgaataagcggtttcagttttacctagcaattgcactcgttcacgaggatagtagttgaagtaaccggtcaacgccagccccggacgtgaaatgtcgctcgttgtaatatctttcttttctaataagtcagcgccatgatacacatccaggcgcgtatttttcaccaaatcggcaacggttacacttcctgccaaaagaatccctcctaattgttccactaataaaaaagtgtggcccgcgttgtccagtcgcgccattacgctaccctttcaagcggccacacttttatgactgaaaacggattatttctatcttctaatcttagcactttaaagcgctttattcaccatcaacgccgtctttcgcgaaaaagttggaaacaatcacgttagcaattgacatgagaatcgaaacaaccatcgccatgccaaaactcgaaaagccgaaattggccttacccacaacgtaggatgtcatctgaagcataaaaccattgatgacaatactgaatagcccgagtgtcaataacgtaatcggtaacgataataacagcaaaaacggcttaatagcggcgtttaaaattgcaagcacaaaactggcaattaaagccatccacacacttgcaacgtgaaaactgctctgaaaaaagccagcaatcgcaataaataagattgtattgattaaaattcgtttccaaaagcccactgtataatcactccattaatcttagtgacgcggatcatcctcttcatgaacgttatgaatctctttgcgcccatgcgcttgcggtttagcttgagtaccggtactttgccgcatctgttcgaagaaacccgtattgtctggtttacttgggataattgtcattaatactaagtataccaaaacaccaaagccatgggtaaccaaagttaaaataacgtagagtactcgtagaatcgttgcattccagttcaaatattcagcaatgcccccgaggacgccggcgaaaacgcgattattagatttagttaacttttgttttgtatttgatttcatcgttagacgctccttatcagtttatctaaccatatcttactaattgtaaaagccggttgcaaactagacgaccggctttaagcaattatttatgattagttacactaaattagaactttctggattcaattcgataatctcaccagtattcaaatacacgatccactcaccaatattagttactaacgccccgatgcgcattaggtaagttgcaacattcaggtaatccgtggaaccgatgaccgtctcaggatggcgctccatcttggagatccccttctcattaatacgatcatacatctccccgacttttgcgtctttagctgcgacccggcgtgcttcctgatcatcacttttgacgtaagctgccaacatctcttcgaccatctttcgcacgcgattccccatttctgataacgctgcctcaatttcagggacgcgcacatttcctttgacccgaatcgtagcgtgagcaatattacgtgcataatcggccatccgttccaattcagagacggctttcaaaatggtgacaatttctcgcaaatcagaagtgacgggttggtataacgcaatcatctcaaatgatttctgttctagttcaacttcccgttggttgattttagcatcattatcaatgatttcttgtgcgaggtcgcggtcatggtcgataaacgccttgactgccttttcaatcgtctcgctaaccatcattcccatttcagtgaagtttgcatcaatatcgtttagttcatcatcaaaaagtcgtcgcatgtttttttcctcctaaccaaatcgtcctgaaatatagtcattggtttcctgtttaactggattcatgaaaatctgtttcgtgtcgttgacctcaattaattcaccattcaggaaaaacgccgttcggtcagaaattcgtgacgcctgttgcatgttatgcgtaacagttatgatagtgtaatcctggcgcaaattcaatagggtttcttcaatcatccgactcgatatcggatcaagtgcactagtggcctcgtctaaaaggataatatcaggttcgacggctaggacgcgtgcgatacaaacccgttgttgttgcccaccagacaatgatagcgcattggcatgcaaccggtccttaacttcatcccaaattgcagcctgcttcagacttttttctaccgccgcgtctaagcgttctttatcatggactcctgtcaaccgtaacccgtaaatgacattctcataaattgagaatggaaagggattcggctgttgaaacaccatgccgatctctttacgcaattgaaccgtatcggtcgtgggcgcataaatattgtgaccattgaagttcacctcacccgtgatcgttacattaggaatcagatcgttcatccggttcaagcaacgtaaaaaggtggatttaccacagccagagggcccaatcaaagccgtgattcctttatcatcaaaatcaatgttaattcctttgagggcctcttttttaccataaaataatgataagttctcggtcgttaaaattgtactcatgaacggtcctcctatccaaagtttccggaaatatagtcattcgtcagatcaacctgaggattggtaaaaatctcaccggtctctgagtattctaggactttgccgaggttaaagaacgcggtatagtcgctaattcgcgatgcttgttgcatattatgcgtcacaataataatggtataattctgctttagttctaacaaagtatcttcaatttgacttgtcgatactggatccaaagcactcgctggttcatcgagcagtaaaatgtctggcttgattgcaattgcccgagcaatacagagtcgttgttgctgcccgccagacagagctaacgcacttttatttaagtcatctttaacttggtcccacatcgccgcttgccgtaaagaccgttcaacaatttcatccaagtcttgtttcttgttcattccgcgctggcggagtgcaaaagcaatattctcatagattgatttggcaaacggattaggccgttgaaacaccatgccaatgtgccggcgcatctcatagacatcaatatcattactgttaatatctaagccgcgatacataattttgcccttaaccgttgcaatacggtcattcattcggtttagcgaacgcaagtaggttgactttccggaaccggatgggccaatcaacgcactaatcttataacgttcaaactgtaaatcgccctctgaaatagcctcggatttaccataaaagacgtgtaaatcctcagttgaaagcgcgatttcatgatctttaggatcaaacgccatgatgttacgttgtgtcgtcgtcattgtgttatctgccatcaaaacggcctcctttattcagcggttaagtgtttgtacaagcgtttgccaagccaacgagctaagaagttaaagagcaataccgcaataattaatacggctgaagcccccgccgaaacggctttcgcgtccggcataattccttctgagttgatcttccaaatatgaacggccaacgtttcggctggacgtagtggactgagtggactactgatatcaaatggattccagttaccaaagtccaaggctggtgcactttgacccgcagtgtagattaaagctgcggcttcaccaaagatccgcccggcactcaagacgacccccgttaaaatgcttggtaaggcagcgggaaccacgatcttcgtcaccgtctcccaacgtgatagccctaacgcgtagccggcctcccgttgattatctgagatattggcgagtgcttcctcaatactccgggttaaaatcggtaagttaaacacggtcagcgcaaacgccccggaaagaatcgagaagcctaacttgaactgcactacaaagaacaagtatccgaacagccccacgactacggatggcaatgaactcagaatttcaatggtcgtccgaatcaggccagtcaccgtattttgcggcgcatattcatttagatagatccccgcacccagtgaaatcggtaatgaaatcaataacgctaaaaatagtaagtagaaggagttaaacaactgaatgccaatcccaccacccgcttcaaaagccagggccggcgacgttaaaaaatgccacgaaattttgggcaccccttggatcagaatgtatcccaatagggcaactaagatgatgaccacaaaggctgcgacgccgtatagcacgccagtggcaattttatcgatgcgtttagcgttcatggtttaatttcccctttcgaccaatgtagcgaatgactaagttaaagactaaggacatcaataacaggatcatggctaatgaccacaatgcattattttgtaatgaacccatgacagtgttcccgattcccatcgtcaagatacttgtcaaagttgcggctggtgaaactaggttatgcggcaacaacgtcgcgttcccaatcaccatttggaccgccagagcttccccaaaggcgcgggccatcccaaatacgacggcagtcagcatgccaggaatggctgcccgcaggacgactttataaattgtttgccagcgcgtcgcccctagagctagcgaggcttctcggtaataacggggtaccgaattcagcgcatccgccgtcattgacgtcacggtcggtaagatcatgacaaatagcacaaaggtcccagaaagaatcccgtagccactacccccaaacgtattacgaacaaacggtacgacaacttgtagcccgataaatccatacactacggatggaataccaactaatagttccgtaactggccggagaatcttcgccccccgccgtggtgaaatttcggtcataaagaccgccgtcccgatagcaaacggtgtggcaatgaaggccgaaagaatcgtaatcaaaaacgatccaacaatcatcggtagtgcccccacagctggttgtccattcgttccgactgttccggggttccactgcgtcccactcagaaattgccatagattaatgtgattttgaaaaaaggttgctaacccccgtgatgcaacaaagtagaaaatcaaaaagacaatcccgacaattagcgctagacaaactagactaatggccttaccacgccgttcaattttactagcaactgatttttttaataagctttctcgaattttatccatgcgctctccctcatttcataactgaaactttaccggccgcattccgctgtacttgcatgtcatggaccgaaatataacctaactgcttgactaacttctgctgaacagcggttgataaaatgtaatcaataaattttttggttaactgattggggtgcttccccgtatataaatgttcgtaggaccagatgtaccagcgattattccgcacatttttttcggttggccgaataccatcaacattgacggtctggactgagttgtctaagtaagaaaaagccacataactaattgcgccaggtgtactagcaacaattgaccgagctaatcctgacgaatcttgttcttgggaatcaacactctgattaccctttaaggcgtatcgctcaaatgtcttccgggttccggagccttgagcacggttaattaacgtaatcggtaaattacgtccaccaacttcacgccaattcgtgaccttgccagtaaaaatctgaatgagttgctgctgcgtcaaattggtaatgcccgcctttttattaacgatgggggcaataccgacgacggctacccggtgatcaattaacttgctcgctgtaatgccagactgttcttcggcaaaaatatcagaattaccgattgccacggcccccgcctgaatttgactgagtcccgttccagagccaccaccctgcacattgataaacacaccggtatggttgctgctgtattgttcaccggctgcttcaaccagtggctgtaaggccgttgatccaaccgcggtaattgattcactggcactagtttgatcgcgatgtgtgtaccctaatccaactagtccaatgatcgcgattaacacgattaattggatgacccgactttttctcataactatatacctcctacccattgctcatattcaataatacaaagtttgtgtaaatgctttatatgagttttgtaaagattgtgtaaacgtcgatatatttttaattattaccggcttttagcccccaatatgaaaggaaaattaaaaaagtgcacaaaaaaaacgattttcaaggtttacatttaccttaaaaatcgttatcaattcgtctggcttaattacgacacattcaatgctcaactaatgacatcttttgactcagcaatgcaactcataccgtcaccacgtcatcatttgatagaccaccagttacaatcagaactgtccgtatgcttaacgccttactactgctcggaagcactcgcagctagtggcaatgtaactgtcatagttgtcccaacgccccgttgactgacaacgtcaattgttccgtgcattgtgttgaccaattcttgaacaatcgctaatccgagtccagtcccactcacaagttgctgtgaacgtgacggactcgcccgatagaagcgttcaaaaatacgctgttgatcatcggcactgataccaatgcccgtatctttaactatcagcgaccacgtttgatgactgaccatggtggcaatcgtcacgctaccatgaggtcgattatacttgattgcattcgttaacagatttttgattatctgactcaacttctgtgaatcgctcgttatcattagatcagcatcgacttggttattgatcgttaagtgctgacgttcgattgcctgctgaactacagccagttcctgttcgatcaatggtcgaacagcaagcggaactaaggttaacatcgtcgtattctgagcacgaattcgcgatagcgacagaacatcctgaatgagatcaatcaaccgttgactttcatccgcaataatatgcaagaattggtcaagcgtgtccggatcatccttggcaccacttaacaacgtttcagtgaaaccggaaatggctgtaatcggcgtcttcaactcgtggctagcgttgctgacaaaatcatcctgcatttgttcaatcatatagacttcagtgatatcatacaacatcaggacaatttgaaattgtgaacgattgccttggatataaacggttgaagcctcgacaacctgcgtgttaggcgctggagtcaacgtaatcgttgcccgttgatttttgccactagtaatcgtatcttcaatcaatttagtcaacgcgtacagctgaatatccttggtataaatgtgggccaccgtattaaccgagacttgcaatagttcactcatcgccggattagacagttgaacctgtcgccggtggtcaatgaccatcactcccacaggcaagtaccgcataatcatcattaactctttttcttgcagttccgcacggcgcgtctgacttttttgataactctctaactggttgaccgcttgtgctaggctgtataaggggtccgattgtggcaataagatatgtggtggaaattgctggctactcatctgacgaagcttagcttccatacggtcgatcgtgcgctgccgttcactttgttgccgccaagcgatcaagccctcgattactgccaaaaccagccaagcaccaactaaacaaccgactaggcgccaggaccacttaattggcgaaaagtgctgcaacacgaccaacacgatcaaaaccagtaacacattttccatgagcaataaccgtgtcgtctgttgccagcgattatgcatggccgtcacccacaaattcgtagccaaaaccccggaccgtcctgatcaaccgtggctgcttggaatctgcttcaatcttttcacgtaaatgtgagatgtgaatatcaacgatccgcgtctcactagcatagtcgtagccccagacgtgatttaaaatcgcatcacgactgagaacccgaccttctcgttcaacaaaatacacaagtaattcaaattcctttggtgtcaagctgatatttttcccgttgcgcgcgactcggtatttgttttgatcaatctgtaaatcaccaacaagcattaccgcacgattagcaggcggcatgggtgccggtggtgtcacgggctcgtccggcgttgtccgccgaataactgctttgatccgagcgagcacttcgcggggtgaaaacggcttggttatataatcgtccgcacctaattccaagccgaacactttatcaaactcatcatttttagccgtcacaataataataggcgtctgaaccttttcttgtcgtaacttttttgttacttccattccatcgagtttcggcaacatcaaatctaacaaaatacatgtaaatgattgggccaggcctaatgacaacgcgtccgcaccatccgtcgccgtcacaacttcgtaccccgcctgcttcaagttatatgataataacgtgacgatagctggttcgtcgtctaccactaaaatcttatccatggtcattaatcctcctgatcagtgaataacacaattcctaactcgtgtggggcgccattatagatcgccgtttcggtaataattaattcctgttgccgattgcgcactttgaggtgaacatacgtcggacttttcagtagggccgcgtaaaattcagcttccgtattaactggttgccggttacattccaagataatatctcctaaatcgagatttaatttatccgcgggcgtgtgggggcgtaacccaatcacccgcacaccttgttcagtatcagaatatcgaaactgttggtgtcgatcataataacggtgctgtgctaagattccccaagttagcacaacgattaatcccatcaatgctagcaaccactgcgggctgagcactgcaaaacgggcaatgattgcaaccaaaacactcgcgagtgttacccaaccatagcgggccgctaactgccgccatgcaatttgtggcagctgcttataaacgcgaacactcgtcccaactaataaaggcaacaataaaatgctgaaggagcgctcgccaaccataaacacaggccaccaactgatagttgcgtgtaaccaatcaccggggaccagtaccccaactggtaagaccaacaattgttgccactggtaacgaacaagtcgctttccacgttggtcgggctgtagttgcggtgaacggccctcataatcatagtgtcgtaacaagaccgccgtagccgccagcacgatggctaataacaatagtccgttcaccaccaaattgccactcatactggtcatggcaacaccgtgccgttgtaaagcgccccccaccgtcgttaattccgggctcataatccaataaactaaccagctgaggccaaaagcggtcactggtaccagtgcaccaggaataatgatcaagctaatggccgccactacttcgtatataaccacccagatgggggccaccactaatcccaatgccaagctaataattgtcattagaactcctagtaaacagccatccactaaaaagtggtggacttcaactaattgtgggttgatagcactctgaaaatgctgccgttcactcttcacccgccgtttagcggttaaataactacgcagcaatcctaaccaaactagcggttgtaaaagaaacaattcaaaaatctttaatacctgcatgtgcgtgacccctaacgttaaactctgaagttagtatagcatttttgcccaaggagaccaacgccgtttcaattccgtcagtcctgctattaccgctttaatatctctatattataagactagtagccaaaaaaatactaagacgacctgcgcaatgataggtcaccttagtatttgtgcaatctattgcggattacgttgggctaatttccattgtaagtaagcatccataaacggatcaagatcaccatccatgacagcctgaccatcatgtgattcataattagtccggtgatccttgaccatcgtatacggatgaaaaacgtaggagcgaatttgtgagccccacccaatgtccatttgctcaccttggatggccgcccgttccttagccttcttctcttcttcacgttcgtacaacttcgctcgcaacatgttcaatgctgtttgtcggttctgtaattgtgaacgttgtgcttgactggcaacgacgattcccgttggcacgtgggtaatccgaaccgctgaagaagtcttgttgacatgttgtccaccggccccactggctcgataaacgtcaatcttcaaatcttcaggtcgaatatcaacatccacggtatcatctaactcaggcatcacatcaacactcgcaaaagatgtgtggcgccgaccagccgcatcgaacggcgaaatccgaacaagacgatgaacccctttttctgaccgcaaataaccataagcattgtgcccgctaattaataaagtcacactcttaatgcctgcctcatcaccagcttggtagtcaacagtctcgactttgaaattgtgactcgcagcccagcgcgtgtacattcttagtagcatcgcaccccaatcttgggattcggtcccaccagctccgggatggatttctaaaatagcattattgcggtcgtacggaccgtccaaaagtaagttgagccggtactgttgtaaatcatgttcagcgtgctgaaagtccgtttcaaactcagcctgcatctcagcatcgggttcctcactcagtaactcataagcgactgccaagtcaccgacttcatcagctaattgcttaaacgtatcatactttcctttcaacacgttattctcatcgatgactttctgggcggcagcctggtcgtcccaaaaaccgggttcggccattcgagcttcattttcttgaatgctttcgttcaaagcatctaagtcaaagcgaccccctaaagtcgtcgacagcactttgcatttcttcaatcaggtgtttatattcacttaattccacaaaggacccttctttcaacttatttattaattatttaatatctggtttaactgtaaaacgagcctaagaccttagtcttagactcgctagcactaacgttaaattttaacgctgaatattttggcgaatttcagacttcatgaagagtcgcgtcgtatcataatcaatatccgcaaccatttcttcaaacatctggtaaccgtctcgttgatattcaactaacggattcaattgaccatagccccgtaaaccgatcgattgccgtaattgatccatcgcatcaatgtgatccgtccaatgagaatcgaccactcgcagaataacgactttttcaaattctagcatctgacccgcatcgtaaagctgtttagccttgtccgcataaatcttatcgacccggtccatcaagtaagcttcaacctctgctggcgacttacctttcaagtcagccacactaattgaatcttccttcaccatagcagcttgggcaaagtcaacaactgcatctaaatcccagtccttggcatcgccttgcatgtgtaactgaacggtccgttcaacggtccgcttgatcattggcatgataacgggctttaaagatttttcttccataatgacttgttgccgctcgccgtaaatcacttcacgttgagcccgcataacatcatcatattgtagaacgttcttccgggagtcatagttgttcccttcaacccgtttttgagcggactcaacctgtcgagtaatcatccgtgattgaataaccgcatcatcatcttcaacattcatccgttgcaggaagttcttgattcgttctgaaccgaaccgtagcatcaaatcgtcttcaagtgagaggtagaattgtgacataccaggatcaccttgacgaccagcacggccccgcaattggttatcgatccggcgggactcatgacgttcagtcccaataacggcgagccccccgacttctttgacaccaggtcccaacttgatatcggtcccccgaccagccatgttggtggcaatggtaaccgcaccacgttgaccggcgtttgcaacaatgtcagcttccttcgcatggttcttggcgttcaagaccacgtgcggaatgttttcctcatccaaacgatgcgacaagtattctgacgtttccacggcaacggtcccaattaacattggttggcccttttcatggagttgtttgatttctttaacgaccgcgttgaatttgctttgtaacgttgggtaaagcaaatctgaacggtcatcacgaatcatcgggcggtttgttggaatcgtaataacttccatgttatagatttcgcggaattcttcttgttccgtcttggccgtcccagtcatcccagataactttttgtacatccggaataagttttggtacgtgatattcgccatcgtcttggtttcttcttgaatctcaacgtgttccttagcttcaattgcttggtgtaacccgtctgagaagcgccgaccatccatgatccgccccgtaaaggaatcaacgatcaacgcctgaccgtctgaaatcacgtagtctttatctttcaacatgatgtagttcgcacgcaaagcttcatccaagtaatggttcaacgccgtattatcagtatcgtaaaggttttccaagccaaagtatttttcagccttccgaatcccttcgtctaataatgcgaccgtcttagattccaagtcaaccttgtaatcttcatccttcgtcaacgtcttagcaaaacggtcagcccgcttatacattcccgttgtaccttctgattgaccagaaatgatcaacggtgtccgggcttcatcaatcaggattgagtcaacttcatcaatgatggcaaaattaagtggtcgttgcaccatgtcttcacggtagaccaccatgttatcacgtaagtaatcgaacccaatttcaccgttcgtcgaataagtaatatcggcgttataagcggcacgtttttcttcaggcgacttttcagccccgttgattccgacactcatccctaaccagttatacagttcacccatttcagtcgcatcacgcgctgataagtattcattaactgttacaacgtgaacacccttaccagagatggcattcaaataaactggcatagtggccgttaaggtcttcccttcaccagtcttcatttcagcaatgtcaccttgatgcaaaacgattccaccgaggatttgaacgtggaatgggtataaaccaagtacccgcttcgcaccttcacgcgccgttgcaaatgcttcgggcagcaaatcgtcgagcgattcgccctccttgtaccgttcacgaaattctggggtcttcgcttgcaagtcagcatcacttaacttgccgtattcgtcggcataagcttcaactttattagcaatcttatccagacgccgaatagtccgcttgtcgctttcaacccagcgttttaaaatgttggccatttacgtatcctctccaaataattaatcttaattttaatttcaattgtccatttcaaaataaaataccatctgtcattttaccattatttactagcaatgaaaaccacaggcccctatgtaaccgataccgtcgaccgttttatttacatccttaactaaatattagtctttaaccacagcccaacaatcactgacccgtgttctttaattctatcaatatttgcttaactgtcttgagtcgctggcaaaaacgtgccgtgagtcgaacttcagcttactaacgcgggctaagtcactctcatgatcacaatatgttatacgggcgttccgggataaaaataaagaactggtcaactgaccagtcctcataagttgcgcttttaaaattagtgattgtcgtcggtttcaatcaaaccgtaacgaccatcgttacgccgatagacgatgttaattgcgtccgtttccgcgtcttcgtagataaagaagtcatggccgagcatatccatttgcagaatcgcttcttcattatccattggctttaaagccactcgcttcgtacgtacaacgtctaacttatcgtcctgatcattgtcggcagcggcaactgtttcatcagtcgctgcaaaatcaatcgctttataacccttttcacgggatttgcggttaaccttagttttatacttgcggatttggcgttccaacttgtcagtaaccaaatcaacactagcatacatatcaggagaagtttcttctgcccggagaactaaatagggaagtggaatggtgacttcgactttagccgtcttgtctgggtgaacttttaagttgacatgggcaattgagtcaacattattgtcaaagtacttctgtaacttacccacccgtttttgaacgtagtcccgaattgcttgggtcacttcgatattttcaccgcgaatattaaaatttagcatagatcttctctcccttcacacacattgctgtgtacccaaagtaattaaaggaccactctttaattactttgcttaaattcattataatagaaagcgctataataaacaatccaaataccactttccctcgaaattaacgtgctagtgttagccccgtcacgctcttggcaccgttttccaaaagtagcgttgccgcgtggcgcatcgttcggccggtagtatagatgtcatctactaataatacccgccggccggccaaaatcgtattaggagccatcttgaatggttgtggtgttctcaaccgcgcttgccggtctttcttagattgtggcactgacttcgctgttgcctgggtcattaacccgggcgcgatgggtgcggctaaccagccggcaacttgattaaagccccgtgtttgcaacgttgtgggcgtgacaggcaccactaagcatatctcagcacaccgttgtaccactgcttgttgcatgatcttcgcaaagacttggcgtaattgataatcaccctgaaatttatagcgttgaaaataatcatgcatcgcatcattatattcgaacaacgcctcgttatgaaagggaccgatttcaggccaccactgacaatctgtacacggttgcggtcgcttttgagcacgtccacatttggaacatgccgttgcccgatcgatgcgtacaaattgccgccaacaaaccgagcagacgaccggccgcataaccggctgccagctaagaatccagggcaacgtaaacttagtcgtgataatgttgtgacacagtaggcatgctagcacgtaattgtcgcccctttcgattgatcacccgaatctggcgctgagcgcgtttgatattgcggctatgactgtgacaaataaaccagacgaggccagtcggacgctcactgctgcgtccgacccgtcctgcaatctggacgagggcagccgtagaaaacacttcgtcgtccgcaccaagcacaatcacatcgattcccggaaacgtcacccctcgttccaatatcgtcgtcgtaactaagtattgaaactgctggttccgcatttgttgaaccttagtcagtcgctcaggatcggctgagtacaccgtctctccggtcatatggggaaaatagtgctggagtaccgcaaacactggcgctaattgttggatgcgcgggacaaatagtaaaaagcgctggtgctgttgttgatactgttggagttgccggataaggtctcgtggtaattttccttgttgcaagagccgagcccaatttggctgtagcttaaccttaattgccggtaataaatgttggtgaaaccgcaatggtaaataactgattgcaagctcaccacgatgaacttgggacaacaaactttggctgggcgtcgcggtcaaataaagaatggccccctccaccttagctgcctgattcactgcaaacgccaaacggggattggcagcaaacggaaacgcgtcaacttcatcaatgatcaatacgtcaaacgcctgacgaaaacgtagcaattgatgcgtcgtacaaatcgtcagctgcgtatactgatagggagcgggattgcggccatgtagcacagcaatttgaacatcagcaaaggccgcctggagccggggtgctaactctaagcaaacatcgactcgtggtgaagcaatggcgacccgccactgatgcgctaacgcccacgcaatacctggaaacagcatttcagtttttccagctcccgtcaccgcccataataattgccgtttatgcgccatgaagttagctttgattgattgcgcgcagtccgcttgctggggcgttagggttccttgccacgtgcaaaccgggaccgttgcaaaagcattcggttctggcatatgatagagtttaactagtgtactcactcgacctaaatttaaacattgataacagtaatattgctgattgggtaattgggctcgcagtcggtccaagtgactgccgcaacgctgacagataatttgatgttcatcaacctgcatggctggcagtatctgcgtgccagcaggtactgcggcagcctcatttgcagataatgcgagctgacgaccatataagacttgtgcttccattgtgcgcacctccttagttatcaagtacgccatttaacgatttattcacgaaaggaaccgattaatttgactaaaccctactacaccatcacccaagacacggtatttgaacaaaccatcaaaaagtctcgcttcatcgctcatctataccgcatcagtgacgaagtggatgctcaagctaagattgccgctgttcgagcagataatcctaaggccaaccacaactgtttcgcctacatgcttggtgatgatgatcatattcagcggatgagtgatgacggtgaaccggtcggaactgcgggctcaccaatcttagaagtgctcaagaccaacgagctacacgacgtgcttgcggtcgtgacccgttattttggtggtatcaagcttggcgccggtggactgatccgagcttataatggcacccccgcgcaagcaattgaagtcagtggtaaggttcagcgaatcttacaaacccgcatcgccatcacgctcgactatcgtaacgtcgatgctttaacctactatttacaacaaaataagctaacgactctgaataccgactacggtgttcaagtcacacaaatcatcgcagtcactcaatccgaaattgcaacgattcagcaggacatcactaacctcttgagcggtcaagttaccttttcggagcaaggtgaacaatttacagaaattccggtcactacgcctggcaactagattgctggttatatataattgggagcctcacaaactttgattggcagtcaaaatcgaaacagccaactcgtcttaacaataacacccagcacttgagccgatgatttgttttttcattgttaaagtccgcgttgcactaattgcggcccataaaaaaagtcgagctatcgctcgactttttgtctgttatttattttaaattagtgattgcaccagattggccacgatcaacctccatcgaagtcaatggaatatatcctaatttctcaactaaactaccttgaacggctttagaagtcatgtaagttaagaagttcttcaactccccagttggttgccccttagtatacatgtgttcataagcccaaatcttccacttgttcgtcgctacgttagcttcggttggtttgacgttatcaatagaaagcgcctgaacgtcactcttaacgtatgagaatgctaagtaactgatggcaccaggcgtggtgctaacaattttttgaacggtcccattcgaatcttgttcttggctagttgcgaccttcgcgttgtctaatccccatttttcaaacgtcgcccgggtcccactaccttgagcacggttaacgacggtaatcttttcgtccttaccgccaacatctttccagttagtgatcttgccttggaaaatcttgataagttgttcttttgaaatattagtgacaccggcatccttattaataacgggtgccatccccacaacagccactttatggtcaactaaccctttggcgtctaaccccttttgttcctgtgcaaataaatcagagttcccaatattgactgaacccttcgccacctgacttaagcctgctcctgaaccaccaccctgaacgttaatggtcacgttagcatgttcgttctggtaagcctgtccagcctgttccactaatggttgtaaagcggttgaaccagttgcaacgatcttagtagtcttggaactaccactactgctactagtactcttcgtacttgtggctgagctactgccgcaaccagctagtaaaatggtcatcgttactgctaatgcgccgagtgtcagtgcttttttcataattgaaactccccttcttcaattgactatcaaaattaagcaaccaacccggcaaccatcatagcaaaactgggtaggagtgctacgactagtgatggagcaacatcaccgtccgacggttacacgtaattgattgcttcggaacatgcttaatattactaatcgtttgtaaattgtgaatgacgattgtgtaaattgcttgtatagttttggtaaagttaagattgatgaaccaactgatgaccaactaaaaacaggcatcaccgctaatcacacggtagatgcctgtaacactttaataattttcaatgatttatttggtttttaatgattactcttggaggtcaaacgcgcgacggtccgtttgatccaatccagtagcggttgccgattgtcaccagctaatccgattgcttcaacgaataactctagcccaaataataaaccaatcgtcaataacacagaaccccaaatagatgagatcggatagagcaatgaaataaatgagaaaataagtgcaatcccataaattaccatcacagtctgtcgatgggtcaatcctaattgcatcaagcggtggtgcaaatgatgcttatccgcttgcgaaatgggcttcttattcaggatccgtcgaatcatcgcatacaccgtatccgtaattggcactcccaggatcataaccggaataccaactgagattaaggtgacatttttcaatccaaataatgagaacacagccgtcataaagccgataaacaacgaaccggtatcaccgagataaattctagctggaaagaaattatacggaagaaagccaatcatcgccgcaactaaagtaaaaatcaacaacgaaacgaacatattagcattcaagaagaacaacccgatgatccccatggtactcaacgaaataatcgaaacaccggtagctagcccatccagtccatcaattaagttcaccgcgttcgtgatagccagtatccacagtaaagtcaccggtaaactcagccactgaaagtgaatcagccccagcaacgggaacgtgaaagtcgtcattcggataccaccaataaagtagacctccaaagcggctaacgtaatccctaacattttttgccgtggttttagctcataaatatcatcgataacaccagtcgcaataatgatcagctcaccaccgagtagtgcgaaaaaaatgcgactgggaaactggtgcatgagatacaacacagtcgtcccaacggtgtaagagataaaaatagccaagcctcccattgtcggcattggaattttattgacccgtcgtacatttggtttatccacggcaccaattttaaatgcaagtttccgcacaaacggcgtcaagatcgcagaaagtatcatggtcgccactaggcttactaggatttcaaatctgatcatttgtgcgtaactcccttctcactctattacgataattatacaaatcccagtgacgcttgacaactcgcttcactaaaacttagtaaaggcaacacaattcgttcacatttgccggtcactgggctgattaagtatctaaattataaccttagttactcatattatgacacaaaaataaaaacccggtagctataccgggtttcaatactaagtcactattcttttaaatggtaattataagttgaaacaataatattttcacgagaatttaataccgctcgtaatcggagactcgtttgattatgcaaaatattctgccatggtttcttcggcacgaattgtgggacaagaaccgttgtcgagaagttgcgttccgctgctcgtttagcaatcacatcgcagaatcgtaacgtcggggttgcaatcgaccgatacgacgaatggatgtccacgaaacggacgtctgggaaggtctctttgaactctgccgccgtcttgtgttccttttcagggttctcatcaaaggacacgtgcatcgcaatgacgtaatctccgatggatcgcgcgtagttgactgcttgagcagttacccgcgtcacattcgagacgaggacgatcaccgttgcaccgtcataatcatgaatcgccgctttttccttggcaaccacgcgtaactgggccgcaacccggttatagtgcacgtggattcggtagaacatgtacagtaagagtggcataacgattaagtatggccaaacattgccgaaatgtagcaagaataggaaaatcactaggagaatcgaaatcaacgccccaagtaagtttaccgccgccttcatccaccaccattgcccccgttcgcggaaccaatgaataatcataccagattgcgacaaagtaaatgggacaaagacccccaccgcataaagtggaatcaaaagcgtcgtcttcccatgaaagataaagatcaacgcaattgccccgaccgccaatgagataatcccattggagtagcccaagcggtccccacgatccatgtaagcatgtggtagaaatttatctttagccaagttataagctaaaattggaaaggctgaaaaaccagtatttgccgcaacggccagaattaacgccgtcgataattgtaacaagtagtagaataagccgtgaccaaagaccgccgtagcaatttgtgacaagacggtattgtctacttgtggtttaatgcctaagtaataacttaaataagtaataccaccaaagaagacggccaagactaatgacataattgctaacgtgttcgccgcattcttgcgtttcggtcgtttgaagtttggcaccgcattactgattgcttccaccccagtcagcgaagacgaaccggaagaaaaggcccgtaagaacagcaccaaggtcatcccttgaaccggtgctccaactgctgcggaggcgtggtaagttaagttaccactcgcaatattcataacgccccatagaatcatgccgataatcataataatgaaaaaataaacgggaaacgttaagaatgatgcggattcgcgcattccacgcaaatttaacgccatgatggcgatgacaatcagtacggcaatcaatacttgataattagctagcgccggaatcgctgacgtgattgcttcagtaccagaagtgacggaaaccgctacggtcaacatataatcaaccagcagtgatcccccggcaactaatccggctggccgcccccagttcgtacttgccaccacgtaggcgccaccgccagatggataagcccgaataatttgtcggtacgacatcgtaatagcaaacaacagcactaacacaagcgccgccacgtacaattgatacatcaacgcggccgctgaaagtgtaatcaaaacggtcgtaatctgttcagtaccgtaagccaccgatgatagcgcatctgacgatagcagcgccagtgccttgaacttggtgagtgcttgcccaccctcgtccatggtttttaacggtttcccaataactaaccgctttaaataacgccacatgataataactcctttattccaaaataattatcccaaagtaaactgagtcaaagtagattctactactttaccctgccaaatactaccagttaaatgtcgggtgcttcaccgcacccacattttgcgttaacgactaatcctaccgctctaatatggataaatcaatacctttattctagttgattcacaccctaacagcactaaaaaagcacttactcagccgagtaagtgcttaatgttacgatttgtttacatcataccgcccatacctgggtttggtgcggctggtgcagctggtgcattttcttcaggtttttcagcaacaacggcttcagtcgttaagagaagggctgaaacagaagcggcattttgtaaagcagaacgcgttaccttagttgggtccacgataccagctttgatcatgtcaacccattcatcagttgcggcgttgaaaccaacacctggcttttgttccttcatcttttcaacgataacagagccttccaaaccagcattttcagcgatttggcgaactggttcttccaaagcacgtttaacaatgttgatcccagtttgaacgtcaccagtttccttcaatgcagcaacatctttgataacgttaatcaaagcagtaccaccaccagcaacaaagccttcttcaacggcggcccgagttgcgttcaaagcatcttcaatccggtatttacgttccttcaattcagtttcagtagcggcaccgacacgaacaacggcaaccccaccagctaatttagctaaacgttcttgtaacttttctttgtcaaagtcagaagttgtttcaccgatttggttacggataaattcaacccgttctgagatagcatccttggaaccagcgccttcaacaatggtggtgttatccttagtaaccgtaactttgttggcttgacctaattgatcgatggtcgtgtccttcaattcaaggccaaggtcgtcagtgataaccgtcccgccagttaagatagcgatatcttgtaattgttccttacgccgatcaccaaaaccgggtgccttaacggcgacaacgttaaacgtcccacgcatcttgttcaagactaaggttggtaaagcttcaccagaaatgtcatcagcaatgatcaacaatggcttgccttgttcaacgatggattgtaatagtggtaaaatatcttgaatgtttgaaatcttcttatcagtaattaagatatatggattgtcaagatccgcttccatcttatcattatcagtaaccatgtattgtgataagtagccgcggtcgaattgcatcccttcaacaacgtctaaactagtatcaacaccacgtgattcttcaatcgtgataacaccgtcatgaccaactttttccatggcttcggcaatcaatttaccagtttcttcacttgctgaagatacagaagcgatttgcgcaatatcttcttgcgtcttaacttcgtgtgccatagcgtgtaatgagtcaaccgccgtcttagtagcttcttcaatcccacgacgaatgccaacagggttagcaccggccgtaacgttcttcataccttcattaacgattgattgtgttaagaccgttgcagtagtcgtcccatcaccagcgatgtcattagtctttgaagcaacttcagaaactaacttagcacccatgttttcgaaatgatcgtctaattcgatcgccttagcaatcgttacaccatcattagtaattgttggtgaaccatatgattgttccaaaacaacgttgcgacccttaggacctaacgttgacttaactgtgtcagctaattgatcgacaccttttagcatcgctgaacgtgcatcttcagagaactttaattctttagccattatctctattcacctcatgaatttaatttattttaagttgcgcaatttaaatggattagtcttcgattgcaacgatatctttttcgtgcaataccaaatacttagcaccttgatacttgacttcggtaccggcatacttatcgaataatacttgatcgccgaccttcacgctggggtcaacttttgtcccgttatctaaaacacgaccgtcattgacggcaacaaccttaccgctttggggcttttccttagcgttattggcaatgacaataccgccaattgtttgttcttcttcttcttgttgttgcaagataacgcgatctcctaatggttttaacacgtgaatccctccatttattcttttttagcactcctcaacctcaagtgctaattacattgtcaactatatcattttaattcaagattgcaagtgatttgtcaattattagtcaaagaatgtcaaatcgactataatgaatactattgaagtatcaataaatcttaaatcaaacttttaaaaggacgtgacttgatggttaatcgccgccaatcaatctttattcttatcatctactttattatttacgcactaccgagcgtccttgtgactgctttccatcagctaggggcccaagtattcgtgattcaaacggtcgactacttagtcggtgcaatcctactcatctggttggcgagtcgcatgcggacaaaaaacgttgttgaaaaacaaccaagtaactggttcatgacgttcatctggggattgatcggtcttgtcctagtcatcgttggtcaagtcatcattttaaaaatgacggctttactgggacagtcaacagcgtcaaccaacacgaccaccctcttaactgttgggcaacaatatcccgctttcttcttagccatcattgtcggtgccccgattatggaagaaatcgtcttccgcaaagttatctttggcaatctaagtgcggttactggtcagattggggcggccttgatttctagtgtgctatttagctttgcacatgcggatggtcactttatcctctatgcctttatcgggttattattctgctggttataccagcacaccggtcggattcaaacatcgatgacggctcacatcctaatgaacgcatcggttgtgttacccacattattaggcttactgcactagtatcattactaggtagcgctaacctagcgtttcaacgttaattttcaccgaatatttatacgttacaatcaatgattcgtgatctaagtatgttaaaaaggcttccctgaataattcagagaagcctttttatagccatttaatttcaaagataaagcgagttattaatcttcagtctcattttcatcgtcattaccattgtcacctaattgctgaccgtaatgttcaatgaagtagatcaatgtttgtaattcgttggtcaaatcaacgttctgaacccgtactgtctcaggaacggagattcgtaacggcgtaaagttcatgattcctttgacgtttgcatcaaccaagtcatcggtaattttctgaacaaccgtggttggcaccgttaagatagcaatctcaatctgttgttcgatcaattgctttttgagctccgtcattgggtatactggaaccccactttggactgtattggcaatcgcctcgttgacatcaaatgctgctgagatgcggacattactgtttttgtgaaaattaaagttcagtagggcgtggcccaaattaccgaccccaattaaagcaacattcgttaaggtgtcttgatttaaaatctttttgaaaaatgcaagtaacgtttcaacatcgtatccataccctcgtttgccgagcgccccaaaatacgagaaatctcgccgaatcgttgctgaatctactttaaccgcctcggacaactcggtcgatgagacccgcttcttatctgcatctagcaagatatttaaatagcggtaataaatcggtaaccgttttgccgttgcccgtggaatttttgtttctgccattcggacgtgtcctcctaattaaaagcttgtgaatttgctgacactattctagcataacgcgtgactttgtgaaataataattacttattattccgaataattgggtcaggccgttacaatatgctacaattatgtcacgaattaaatgtgaaaggagcttaataaagcgtgattttactacaagtacagcaagttatgcggcgttttggcgccgatgtcttgttcgataacgtacaaatggatattcaagaacacgctcgggtggccctcgtcggtcgaaacggggccggaaaatcaaccttacttaaaatgattgccggcgaaacggtaccggacgaaggccagatttcaatgcgcaagggcttaacaatcggttacttggcgcaagaccaaggactggatagtaacaatacgatttgggaagaaatgagtagtgtctttgctgagttacatgccatcgaaaaacggatgcaccagctcgaaaatcaattgagcgaccccgcaatcatgaatgatgagcaggcttatcaacagaccctgaaaacctatgatcagattcaaactgaatttcaacaaaaaaacgggtacggctaccaagctgagattcggggcgtgttgcacggcttccaattcgacgccgatgtgtacgataagtcggtgacggcactatccggtggacaaaagacccagttggccttggccaagttgttacttgaaaaacgggacttgcttatccttgacgaaccgacgaaccacttggacgtcgaaacccttacttggttggaaagctatctccagtcttactctggtgcgctgctaatcgttagccatgaccgctattttttagaccgggtcgttaacgaagtctatgacttatcacaccatgaaatggtgcactacactggcaactacgaccagtttgtgcaagaaaaagcggctcgaatccaagcacaatggaaacattatgaaaagcaacaagcggagatcagcaagcttgaagactttgttaatcgtaacatcgtgcgtgcttctacgacaaaacgggcccaggctcggcgtaagcagttagcaaagatggaccgccttgaccgccctgatagtgacgagaagactgcccactttggctttcatgcggctaaacaaagcggcaacattgtgttgaccgtcaaagatgcagccgtgggctatgatggtcagattctttcggaacccgacaacttgaatattaagaaacatgaagctattgccattgttggaccgaacggtattggaaaatcgactttcctaaagagtattttgggacagattccattcattaaaggccaggccgtttttggcaccaacgtcgttacgggctactacgatcaagagcaacgtaatttaaacgacaaaaaaaacgtcctcggtgaactttgggatgaacatcccactactcctgaaaaagacattcgtaccattttgggcagttttctcttcactggtgaagatgttgataaacccgttcatgccctatctggtggagaacgggcccggttactgttgaccaaacttgccatgcaaaatgacaacttcttaatcttagatgaaccaactaaccacttggatatcgatagccgtgaagttttggaagtcgccctcaacgactttgacggcacccttttattcgtgtcacatgaccgctacttcattaaccaagtcgccacgagtgtcgtagaggtttctccggaaggtacggaactcttcttaggtgattacgactactacatcgacaagaaacaagaacaagctgaaatcgcggctgcggctgctagccaagcggccgaaaaagctgctgaagccggtgcagcggattcaaccagtgccacaactgctgctccccgctccaaaggccagcaaaattaccaagccagcaagcagcaacaacgtgaaaagcgcaagctcgagcgctcagttaccgccctggaagaacagatgactgccttagatgaacaagccacacagattcaaactgaaatggcgcaacctgaagtatcggccgatgttggtaaactacaagacctacaaaaagaacttgaagccatcaatactcaacaagaacaagttgaaaccgaatggaccgaacaagctgaagctttagaagaattgagctaattttccaatgactcatcagataaaaataatagtcgcctcaagaattaatataattcttgaggcgactattattttgcccctatccgcggcataaatcatgattgaaaggtgccggttaggtgggttcctgttcgtcagcaatgcgcgtccgattccgacctccggggctgggtgacaattgctggaacgtaagccgacgtcgatttgagtccgtacacaacccgcccggtctcaaatacgagtcttattctaagccggaaggaacccacttccagctaagaataatttggctactgagcattgtcacccagcccctccagtcgggatgccgctcgaatggctgatgaacggccactgaactcggtacaatttgtcgttggctattttgatactgaaccctttaagtcaaatatcagagtgccttctccactttttcgaaatattcaattattactacggtaattcagaaatagtgagttatcacaagaccttttcaatctgacagttgattgataaaattaacgtttatgaaaaacaacgacaaattcagcaaaagttgggtatatccttgtcagccattcgaacgctatcccgactggaaggcgtttctgacaatgcccagtggtgaaatttcacttagcaagcgtcctgtgcttggttagtgaaaggccagtatttgagacgtgatttttcggctcaaatctgtgcccaccacgttccggcaattggcagaaatgcctggaggtcggtgtaggacgaactaactaagcaagtttacactaacttgaactatttccagcgggcttaagctggtcatttttgattctaggaatcatcctcttttaatcataattaatgaaaagatactaaaacgggtgtgaaaaggactgacttttcacacccgtttataactgcttcattacttcaacatacctggcatccaatcaaattctaagcttggatcggcattcagcgccgcgtcaccgaattggtgatgctgatattgaacatagcccgcagcaccaatcatggcaccattatcaccgcataactttagaggcgctaagattagttcggtgtcaggaaaagcggttggtaaatcttgttgtaaccgttcacgtagcccctgattagctgcaacgccaccggctaagactaattgcttaactggatattgtttgaggactcgtaacgttttactcatcagaacatcaaccacgctggcctgaaagctagccgctaaatcgttcttatccagagtcgcgccaatttgatctgcgtgatggaccgtattgatgaacgcactcttcagcccactaaaactaaaatcgtaattatcttcatcaatcattgctcgcggaaatttgaaagtgtcgtgacctgcatgtgccatctcgtcaatgactttacctgccggatatggaacacccaatacccgaccgattttatcataagcttcaccagccgcatcgtcacgtgtctcaccaataatctcaaactgcccatctgcttgcatgtagaccaattcagtatgaccgccagaaactaatagtgccattagcggaaattcgaatggcttaacaaaccgagcggcataaatgtgcccggccatatggttaactggaatcagcggtaattggtgcgcgtatgccactgtcttagctgcattaacaccgactaacagtgcccccactagaccggggccatacgtcacggcaacagcatcaaggtcagcatacgtcacgtgtgcctcttgaagtgcggcttcaatacaaattgtaatttgttcaatatgatgacggctggcaacttcaggaaccacgccaccaaaccgtttgtgactattaatctgcgttgcaatcacgttggataaaatctcatggccatctttgatcactgccacactagtctcgtcacaactggactcaaacgctaaaatcaagttttgtttttccacggttcccatccttttaattaatcattttacgcatgatccacgcatcttcttcgggatcatgataatattccttacgcgtggcaatctggtcaaagccgcattgctgatacaagcgctgagcggcgagattactagcccggacttctaggaatacggaccctgccgataattgtgctaagcaggctgttaataaccaccgcgcatgcccttgacgctgataggccggatcaattgcaatattcgtaatttcggtctcatcaagcactgttgagcggctgacaaacccgatcagttcatcctgccaccgtaataaatcatagtgtaccgttggtaacgccatgtccgccgcaaacgtcgcttgccgccaaggtgcgccaccgggatatgctaatgtcgctaactggtaacaaacttggacggcccgacccgcgtcaagctgcgtactggcgacaagctgtcgttcagtcatccgtagctaccggaatgcgataagtcatatcaatggcatcttcatggtcgccaaaatagtaccgtttcttgataccagtcttttcaaaccctaaatcgcggtaaagttgttgcgcaatcgtattactgtaacgaacctcaagggtcaccgtttggtaatgcaacttacgcgcccgcttcatcatgacttgcatcataaaatggccgagtccttggccttgaacatcgggatgtacagcaatattggtgatatgtgcatcttggcggcgatcatcaaagacacaaccacaaaaagcgacgaggcgatcttcatgacgcatcacaatatagaaacgaccgctctgtcggcgaagttccgtcttaaacgcattttcatcccacggtgtctgtcccgcatatacggcccgttcaatggctagcatctcgggcacatcggtaatcagtgcgcgtgagacatagtaattgacttcgcccactttaacgatgtgattttgaatggccaatacacgttggcggcgctgattgccaccggtggtcattttttgaaagtactccttaaattttctcaacatagggcgcatgttccttttctgggtgcttggcttgccaatcacgttcagcttgcgttaaacgcaaatagtttggcacaaagttatgaatttcactcacgggtgtcagcgttcgacccatcaaacctagtactacggcttggggcaagtcaagttgtggggctgcatgaacgaactgcttagctaacgattgctgcaaagcatccgcatattgatcgacatccgcgccgacaaaggtaattggttcatcataactagctaatcgttgaccccactcggccacactgatatgttgatcagcgataacggcaactgggcgctggttcttaatccgatataacccggcaaagatgttgtcacgacgcgcatcaaataacggcgccactaattggccttccgtcacaatgttgccagctaacacggccaaactcgatacaccaactaaggctttatctaatgtaaaggcaagtgttttagcagtcgtcacgccaattcgcaaccccgtatacgaccctggtccggcagcaacgacgatccggtctaaatcagctggtgccaatttagcttgagccatggcttgttcaataatcggtaataatgtactactgtggttacggccaacattagtggtcgttgtggccaagatctgggtatcttctaataccgcgacactcaatggccgattcgaagtatcaatcgccaacaacttcataattttaaaaaactcctcattttgaattacttcacatatcttatcataatttacttactttgaaagctttacggtagtaaccaaccaattcaatccagaaacaatcaacaactatcctgaccagtttccactcatacttaccaatcgctgaattgaaaaccgaatgtaaatattatttacataacttatacatatacttcactaatccttgtccgcacatttacaataccttgttatgctacacaagtaactaaaattacttggaggtaattggaaactatgtcaaaagttagtaagtcattattaggtctttcattcatttcggttttaggtttaggactcgcaggttgcgctagcggaaccagtgctaaatctggtggtagcagtacggatagcagcaaaaccatcacggtggtcttctatcctaacgaatcagccaagagttttgctggttcccgtacggccattaagcaagcagttgaaaaggcaacgggtaagacggttaaattacaaaccacgaccgactataacgttgcgattcaagcaattgcatccggcaaagctcaagtcgcatacatgggggctaacggttatatccaagcacaccacaagagcaaagatgttgtaccttttgccgcacaatctgatgctaaaggtaccttgaaagacgctacttataactcctacttaatggtacaacaaaaagatgccaaaaagtatgaagaaaacggtaagtacagtattaagaacgtcaaaggcaagaagatgtcttatgtttccaacagttcaacttcaggcttcttagtaccaacggctgaaatctcacgtgaattcaacatcaaaaccgctgaccaagataaattaactcaaagcggatcattctttagtaaagtgctctatggtggctctcatcagggttccgcggtcaacttaatcaagggggatgcggatgtcgctgcctttgatgatgctgatttaatgccatacttaaacgttaccaagggatcatgggacaaggtcggctcaactttcactgttaaggataacgccgaagcgccatttacaagtttagccggcaagtcggtcgttaacattgccatgatgcctgttcaacaaggcccatgggtatacaataccaaggccctcagcaaggatgatcaaaagaagatcgccactgagttcacgtcgaagtcctttgcccaaaacaaaaagatcttctctgaaccaaatgcgaagacaccaatgatgttccctaagaaatcagaaaagtccaaattagttaatgttaccgacaagtggtacgcgccaacgcataagttagtaggttactaaaccacgtaccattagttcacaatgaaaggatttgccaatgctcaaggttattcagctagataaaacatatggttccaataagcattcgctcaaagcagtcaacttcacagctaaaccgggcgaagtaactgccatcatcggcccgtctggtgctggtaaaacaactattttacggagtatcaatcagttgatccgcgatgatagtggtcaaattttgctcgatgacactgacattcgtcaagcgaacaaagctgaattacgcaaagttcgtcatcatatcggcatgattttccaaaactacaatctgatcagtccgttaacggcccttgaaaatgttctgcatggccgcttaggcgctaaatcaacggttgctggcatgctcggcctttacagtagcgccgaaaaacaagaggcgctacaactactcgacgaagtagggttaaaagaatacgcctaccaacgttgcgatcaattaagtggtggccaacaacaacgggtcgggatcgcacgggcattaatgcaacatcctaagatgattttatgtgatgaaccgattgcttccctagatcccaaatcaacgaccattgtcatggacattctacggcgattggcaaaggaaaaacaactgattatcctcattaatctacatcaggtcgatatcgcaatggcgtacaccgaccatatcgtcggcattaacagcggcgccatcgttttcgaaggcgccactaatgaagttgacgacgcggtcttacaacacatttatcgccaacctgaccaatcaacggcggtggctgccaatgaaaactaatccaatgacaccgcaacgcttttttcggcaacgtcggttgcgattatcagttgttttgctcattttaattggcatctacgtcttatccatggccctcgttaattttcaggcgtgggcttcgatcagtaagattccagcgggcttaatgtggttatttaccaactttattccgacaagtcgttcgatttcttatctgggaccgattctttatcagctgtggcggaccttgctcgtggcaatttcatcaaccatggtcgctagtctcttcgccctgatctttgcgattctcggtgctaagacgaccaccccaacgcctgtcctccgctggattattcgttttggtgcttcactcttacgtaatattccggtggtcgcttgggcgatgattcttctgttttcttttaaacagagtgactttacgggcttcttggcactgttctttatgacgctaggctatctaacacgggcctttactgaaactattgaggacctcgatgccgaaaagcttcaagcactgcaagccgttggcgccaactatttccaatgtgtcttctgtggggtgttacccgaagccgctagtaccttgactagttggattctctacatgattgaaaacaacttacgggacgcaaccttggtcggactcttgacgggtacgggtgttggttttctctttgactactattttaaggcgttccgctatgacgctgctggtctaattgttttgttaattgcgattttagtcattgttttagaattgacatctaatcgaattcggagggcaattgcatgattgaaaacagtcaacccaaaacacaagtacttcaaccgtcagcaccaccaacccggtcgatttcgttggtgactcggccccgcaaaatcctgcgagccgttatgattggcctaacgcttatcagtgtctattcattagtcacactcaataatgccaacctgaacatcattgacgctttgcatagcttaggtctcaacctgaatgctatgttcttacaccctagcgttggtcaagacacactggggcaactcttacgggccctaatgactagtgtttcattagcgatgttgacaactttgttaggagcgctaatcgccttcttcattgccgtcggtgctgcccgtaacttagcacccagttggttagctactagtattaaagcagtcatggcctttattcgtgccattccaacgattttatgggtgttaatttactccgtagtcatgggattaggtgctagtgccgccgtggtcggcttgaccttccacagtgtagcgtacttggttaaggcttattctgaaagtattgaagaaacctcgcaagatacgattgaagcgttaaaggcgagtggcgtgggtttttggccaattgtttttcaggccattctcccgtcaatcattccagcacttcttagctggacgtttatccggtttgaaattaactttgccaatgcggtcgccgttggtgctgcagctggtgctgacgatatcggttactacctcttcatggctggcagtttctacttcgatttccatgaagttggtttgattgtctacctactcttgggtgtcgcaatcgtgctcgaactggtttctatgcggttacgtggccactacttaaagaacaactaagtaaattcaaaggagttttcatcaatgacaattaaagcagtaatttttgactgggccggcacgaccattgactatggcagccgggcgcccatcgtggctttccaaaaagcctttgccaacgttggtattcaaatctctgaagctgagattcgccaagatatgggactagataagtacacccatatccataaaatcatggatttaccggccgttcaaaacgactggcaggcgcgtttccaagtcttaccgactgaagacgactgcaatcaaatctttagcaacttcaaggcaatcttgcttagctccctgactgaattcggacaattaaagcccggcatgtcagctgtaattgactatttgaccgctcacaatatcagctatggcacgaccaccggctatgacgctgaaatgttagccctggtcttaccgatcgcagctaagcaaggctatcgtcccgccgtcaacatcacttcagaacaaactggcggtgttggtcgaccagcgccggcaatgcttgcgttagcagctgaacagctcacagtcactgatccaacgaccgtcatgaaaattggggattccgttaatgatatcttagaaggcaacaacgccgacgcagtctctgtagggattattgatggtagcaacatcatgggactttcggagttagccttcaacgcccttagcccggccgaacaagctgaacgacgagcccacgtcactgccgcttatcaacgcgctggtgccgattacattttacaatcgatggctgaattaccggcattgcttgatcaaatcaatcaaccggttgccactgatcattagcagacaaggagcccgatttttatgaaacaaccttattgactcctaacacccggtccactcagtacgactgccagtgttaaggacgcaatgcaaattgattattgtacttgggatagtgactatcggcacgtcaccgaaaccattcggcaacaaatcttagctatggcccaagccaatccagaaaactatacgaccgtcctactacaaggaagcggcagttttggtgttgaggccaccattggcacagcagtaccacggaccgatgcaactttaatgattggcattaacggcgcatatgggcatcgaatcagtcaaatcgcagaatattacgatattccacatatcgacgttgtgttcaacgaagatgaagccgtcgatccggttcggattgaagcaaccttagctgatcatccggagattacccacttcgcaaccgttcatagcgaaacgacaactgggattctcaacccaatcgaagctttaatgcccatcatgcatgaacacgggatcgtaacgatcatcgatgccatgtccagtttaggtggcgtcacgattagcattgatgaattggattgtgactacttgattagtagtgccaacaagtgtgtgcaaggcgtgcccggttttgcgttcatcattgcaaaacaagcgaccttggcccacactgctgacaacgctcgttcactttgtctagatctctacgaccaatggcaagccatgaccaagcaaccaggaaaatggcgcttcacttcgccaacccacgtggtacatgcctttgcgcaagcactcattgaattgcaagcagaaggcggcgtgacaccacgctaccaacgttaccgtgctagtcaacaactccttagcgacggcttacaagcgctaggttttgaattagtgattgatccagccattcaagggcccatcattacgtcattcaaatacccgaacggcgactttgattttgctgacttctatcagttcatcaagcaacgcggcttcgtcatttatcctgggaaggtttcaaatatccctagcttcagaattggtaccatcggtgatgttgatacaactgatattcaacgactcttaacaattatcggtgattatcaacaacttcaccgctaactgcattgatcaatctaaaaggtgcgtgccaaggactcaatcctgacatgcaccttttttgacgaccacaaaagcggctttgaaatctattgacgagatttcaaagccgctttcaattatcagctaaccgatactagtcacgatcatcgtagccattgggatgcttctgcgtccaagcccacgctgtttcaataatatcgttaacattgtcataatttggttgccaacctagcacgtcacgcgccttatcactcgccgcaaccaatgagtctggatcaccaggccgccgtggcgctagcttagctggaattggttgcccggtaacttcacgagcagccgctaacatttgtttgttagagaaaccagttgaagaacccaggttaaaggcattactttcatttcctgcagccaagtacttcaaagccaagatatgtgcatcagctaagtcgataacatgcacatagtcacgcacattcgtcccatccggcgtattatagtcatcgccgaagattttaagttcatcgcgttttccttgcgcaacttgtaaaatgattggaaccagatgtgtttcggggccatgatcttcgccaatactgccatctggcttggcacccgcaacgttaaagtaacgtaacgcgacaaacttaatgccataggcgacgtccgcccagtgcataatctgttccatcattaacttgctagcgccatacgggttgattggtaactgtggatcagtttctttaattggaatctgcttaggtgtcccataagtagcggccgttgatgagaagacgatttgcttcacatcatgggcctgcatcgtttcaagtaacgtgatcatcccaccagtattgttatcaaagtacttcagtggcttactcattgattctggtacgattgaaaaggcagcaaaatgcacgacagcttcaatatcctcagtatcaaaaacgtgattcaaaaaatccgcatcccgcaaatcaccctgataaaacttggccgccgaattaacagcagcacggtgtcccgtgaccaaattatcaacgaccacgacgtccgtaccgtgttctactaaccgatcaaccatgtgagaaccaatgtagccagctccccctaaaactaaaattgacataatgaacctcccctgtatggatgtattaatcatagcatactgaatcgctagcgactctaataaaaacgtgcgttctaatcgaccaagtcgctcatgaccacatcattaacacactagtgtaaataccaacccagcgaattactgaatcggctctggtaaagtccgccattgaatcgtgacctcacaacacttctcatcatcaacttcgatcaaatgactcgtcgtgacctgatcggccacttcgctcggtaagatgttcgcatgagcagtcaccgtttgcccgtacttgacttcattttcatagcgaacgtcaacgtgaactaaatcatgttgaagcaagaacgtcgcgggtagcgtatctacgagccaatcaaaatagtgtgcattattaacatgccggttgggatcaatgtcaaagaagcggacatggtacggcttcgtaatcgttgtatcggtcgcttcaaaactaatcggtcgtggcaagcgcggaatgcgcttgacgacttccgactgatacggcgcgaccagttctggtaaaatttttacgattcgccgggtcgtttgactcatcatgacccagatactcgtaatataggccaactgttgaccatctgcgtcccgaatccaaaattcacggtaagcaaaatatggattataagcactaccccgaacggcaatcgtaacgacttcgtcttggcggggcatccgtgtaatatcgatggcatattgcgtgacgacccaaccgacaccatggctttgcaccatttccgtcgttaaaccaagggcgtcgctttgatcctctgatgccagtacggcaatatcaattaatgtcgttaaggttgcgcgaccagtgcggtcacattcataatacgtaatccggtgctgttcactgtaaagactcgcatttgcgcctaaagttgccattcatcaagactcctcatcgttggtatttagttcatgaaactgattataaacgctttgccggggaatattccgtcgcttcgcaatcgtcttaatggccacgttgggcttatctccggctgcaatcaacgcttcgacttgggctttgactggcaactgtgccaattcgtccattgtttctggttcatccttatccggattaccaccgatcaaaaggacaaattcgccctttaactgatgatcttgcgcccacgtcaccatttcagtcaaggttccgcgcgcaaactcctcgtaacgcttagtcaattcccggcacgccacaattggccgcgtcccttcacagacggtcgctaggagggtcaaggtcttggcaacacggaatggcgattcgtacaagaccaccgtttcatgtcgccgagccaatttagctaaatcagctttttgttcgttcttcttacgcggtaaaaagccgtagaaataaaatggctgtggcactaggccagaagcaatcagcgcagtcaggccggcattggcacctggtagtggcacgactggaatattcgcggcaatgcaggctgccacaagttctttgccgggatcactgattgacggcatccccgcatcgctaacttgtgctaagttaacgcccgtctgtaatttttcaattaactggggaatccgttcttgggtgttatgttcatgaaagctaatttgtttcgttgtaatttcaaaatgattcaataacttttgggtattccgggtatcttctgcggcaattaggtcaaccgttttaagcgtcgccactgcccgataagtcatatcctgtaagttgccaattggcgtcggtactaagtacaaggtcccgatacccgcatgatctgcaaaactttgttgtgtttccaaaacgtcctcctaacaatcctctcgaccgtgacttgttcctatgagtgactcgtggtgaaaagcacaaaaagtctgggactactcccagactttttcgactatgcgcgttcacgttcaccataaatgacttccaaacaaaaaacgcaggattcgtcatcgtcacgccgtttgccgtaaaactggttgcagacgtggaagccctcatcatagagtttttccaagttttgccgtgactttgagagcgtggtcgtgctagccgcttttttcggcaattcattttcaatttcgaccatgtgttcacgtaaatgttcattttcaatgaccaattccgcgtttttctctaacaccgttgtcatatcggcgcgtaacttagccattttgtctagcatttgttgcatctgttgttccatctcaccgaaactatcgtataaatcacgcttatccacgcgctcaccctcgttttcctttatttaagcgtttgtttgaaaaatcggccataactttaacgttaagccttctaagacattttgaaaactaatattgctagctagctggcgcttggccgttaaagctagttctgtcgccgcaatcaactgctcatcgctgacttcagccgttaacccggccaattctttttggtactgaccaaaggttaacgctgtcgttgccacctcaaaatgtaattgcaatagatcttggaacaaggccgcaattaaatccaacataaccagctgatgatcagcgtccttagccaaaccaactaaattgacctgcacagccacaaaactccgtggatcacccttaacagcctggtcaaaccaccgccacaatgcttgcgcagcttgtggtaaccaatcatccgctagcaacgcctgcgcctgggtcacgctatttgtcaggccccgtaacatctgcgcttggtttggcgcaatcccggcctgttcaaacgtctgctgtaacgcctgcgcatttaatggtgggaattcgatcacctgggttcgtgaaataatcgttggtagcatcagttgcttattagtcgttaataacaaggccgtgacgttaccacttggctcctcaataaacttcaataagctattggcagcactcgctgtcatcttctccgcatcattaatgatgaacagtttccggttaccttcgaccgcactcttagagaattcagcttttaagtaacgaacctgatcaacgtgaattcgctgaccctcgggagccactgtcacaatatcagggtgcgacccattagcaatccggacgcactcctcacaagtgccatctggttcaccatcattaatatgcaggcagaacaaccgttgcgcaatccaatgggccagttctggttgtccagcgccttccatccccgcgaataagtacgcgtgggccagatggttctgggcgatgatgtgtttaaatgccgctaataagcggggctgtttcgccgctaacgtttgcgcaaatgactcggttgttgccattaataatcatccttcattaaaattggtgaaattgttcaattggtagaacaaagaccgtggcgccaccgacttgaacttcaactggataggcagctgcgccatccatcgtcacgtctagattgactggtggtgtcataaactgttcccgcgcatgactcgtttctttaatcatggctaaaacttcatccacacggtcatcatcaataccgatcataaaagtggtattacctgaacgtaggaagccccccgtcgttgagagcttcgtggcccgaacattggcttcaatgaactggctgctcaaccggttactgtccttatcttgaacgattgcaataattaatttcattggtcttcccctcccttggatgccacataagccggtaactgtgacgccataatctctaaggcctgcgtcacaacttggtccaatggctgacttgcatcgacgcgcttgatacggtcaggatgatcagccagtaatctcaaatacgctgcttgcacccggtgatggaaacttaaggcttccacgtccaagcgattaatttcattttggcgatgttgttgaatgcggtttaatccaacggcagcatctacgtcaaaatacaacgttaaatctgcggttagccccgcggtcgcgaactgattcatatcataaaccgcttgttccccaataccacgaccagccccctgataagcgaccgagctatcgatgtagcgatcacacaagacaagttggtcgttctgcaatgctggttgaatggtttggacgatatgttgtcgccgtgctgccgcatagagtaacgcttccgtacggtcgtccatcgccgtattatgacggtctaaaatgatttttcgaattgcttctgagatttgattcccgcccggttcacgcgtcacaactaagcgatcccctaattgtggctgtaatttggccacaatcgcgtttaaagctgacgttttgccggcaccgtctggcccttcaaaagtaactaattttcctgtcaacattcccaatcccatctattttcttatatgtagcaattgtacttgatttttgagtacctgtctaatacggttaccactagtgagggtactttttcacgatttttacgtgggtcggctactaccaattgtggttttgatgatttattcggtgaattgctaaaaagttattaggtagtactacccacgattgataaataccgattttagtttgttattcattagtagatacacatcttctattccaattgccgcacctagcatgtcttaatcacaatgcatgacagattaactggtaaaataatgctagggttctaaatcaaaaacgcacgccgtagatttacaaaaatcaacgacgtgcgtctttattttgaaacaagttatctcttaaatcactaacagtctatttatcaacgaccgagcgctgaatcgtctgcccatgaacttgacgtaaacgtgcttcacgatacagatataaatacttagcacgcgctaaggcggtctgcgtaactagttcactcgtattattatcataaaccgcttcttggttctgcttcgcacggtcccagtccaacttagcggcattcagggtcgacaataactgttcatcaaaaacttccttgggatgcttgatcttctgtttacgtttaaacatggtggcacctccaattacatttcttggcgaccttcaacggctttgaataaggtcatttcatccgcatattgaatatcactaccaaccgacaaaccgtgcgccaatcgggtcactttgattcccgccggcttaactaaccgcgagatgtacatcgctgttgcttcaccttcaggcgtagcgttggtggcaataatgacttccttgatggcttcattttgctgtagccgtttcaataaactggcaatgttgatatcttccggacctttgccatcaatgggtgacaataccccatgtaagacgtgatacagcccgttgtattccttaatcttttccattgccatgacatccttggcctcttcaacaaccagaacggtgctttgatcacgcgacttatccttacaaatcacacacggatcatcttcggtgatattaccgcaaatactacaaaaatgcaggtcccgtttggccgcaatcagcgacttagcgaactcggtgacgtcatcaccgttcatatcaattgtataaaacgccagccgcgtcgcagtcttgccaccaatgccgggcaacttcatataactatcaatcaacttagcaattggttctggatactgcatgtacttacctcgtttttactgtaatcccttagtatattttcccattgtactttgtgtctgttcatcgaccttagtcaatgcgtcgttcaccgcagcaacgactaagtcctgtaacatatccacatcatcaggatcaacagcatcagggttaatcgtaatatccttcatcttcttatcaccagtaaaagtgactttgaccatgtcgtctggcgccgcacccgtgaaggtttgttcatttaaagccgcttgttcggctgtcatttgcgcctgcatcttcttcatttgtttcatcatactttgcatattgcccattccacgcatcataattatcagttcctttcgtctttagtccggctgtacttcaactaaatcaccgaacatattcttagcttcttcaacgaccggttctttggccggtgcttgttgctctgatgttgcacctcctggctggtgagtggccaaataatccttacgaatttgtggccactgttctttaggcacacagacaatcttgggtgcctgtcccatcagccgatccaaaccatttccgagtgcatcgatcaaggtctggtcatcaatcgctttttgataaacaaacgcatagtcaaacgcaaccacaacaccttctgaactggccgcaactggttgggccacgtgcattagggcccgctgcgtcacactcaaaatattcatcaaatcagtccaaacatcgcgcaccttaatgagatcattcttcgttgccgctcccagaataggataaatctgactgacattaaccttcttaacaaccgggccattactcgaccgcggcttagccggtgcaggtttagtgatactaccaccttgagaacgtaacgttttgacctcgctttgcaactgttcaacttgttgtgccagtttatgcacagtgggatcttcaggattgaccgttgccgcagctaccggttgaacggccgcttgaccatccaactgagctagcttgaccgtcaacacttctaaataaacgtcggggtgcgtcgtgaaccgcatttgttgttgaatatcgttcaacgtcttgaccatttggtacaggacttcagcatcgatttgcttggcaaatgcttcaaattgttgatcatcctcgcccatcgccacactatcgaccatttcaggggcctgttgatagagtaacacgtcacgcgtataactgatcaaatcttcaatgaaacggttcgcatctttaccttcttgtaagatttgtcgcatcgtctctagtgccggcttcgtatcatggtcggtgacctcactgacatagttagccagcaactgcttggtcacacttcccgtcaccattaacgcatcatccaacgtaaccgtgttatccccaaacgaaattacttgatccagaatacttaaagcatcccgcattccaccttcagcagccgctgcaatgacgcgtagcgctttttcatcataggtcacatccttctcattgaggatgtacaccatccgatcgtagctatccttagccgtaatccgccgaaaatcaaaccgttgcgtccgtgaaataatcgttaatggaatcttatggggctccgttgtcgctaagataaatataacgttagccgggggttcttctagcgttttgagcaacgcattaaacgcgccagtcgataacatatgaacttcatcaataatgtagactttatagtccgcttgcgttggagcatacttcgctttgtcccgaatatcacgaatctcttccacgccattattagaagccgcatcaatttcgatgacatcatttagttgccccttggtaatcgccgtacaagtctcacattcattgcaaggttccccatcaacaagatggtgacagttaattgccttggcaaaaatctttgctgccgacgttttcccagttccccggggaccggtaaacagatacgcatgactcgtctggtgggtcataatggcattttttagtgtctgggtaatcatctgttgcccgacaatctcatcaaagcgttggggacgccaaacccgatatagtgcccgatacatgcgattcttcctttcttacatcagtcatactttggttatcattacttattataagccattgtttaaacgtcctgaacagttagcttcctggttgtgctgcttccactaacgatcagtgtcagttatgcaaattaagcatctaagcgcacttgccaacgagtcgatgcccaggcctttaaccacctttgttaggcgtttggttattccttcaacaagcagtggctttaactatcagcctgaaaagcatcacccaaataacgtattactactataataataggtaaataaaaataaaccaacctatcagcacgttcaaaactagcactcaatatttaatttaaataaaaagctctcaaccgaatggctaagagctgttacatttcataaaaacaaaaggcacaagatgaagcaaacttagtgctgcttccttccggacctgacacgattcgtaaatccacccttgccttttggccttgcggcaaatactataatacatgatttgcgccacaattaccagccatcggcctaatttttttcagcagcttcacgtcgtgcttttttagccgcctttttccgtttacgaatcccacggaagaagttttccaacatctcgccggccggacgtgccaagatgcgttcatgaaccgttacttgatgatttaaccgggtatcatccatcacctgatacaaactacgaacggcgccagccttgggatcacgggcaccaaagtagagttcaggtagccgtgcattaataatagccccactacacatcaaacatggttccaaggtgacatatagctgacaatcggctaatcgccaactatgcaaatattcgcaagcttcctgaatcgcaataatttccgcgtgcatcgttgcatcctgaccatgctcccgtaaattgtgaccacggccaataatttcaccctggtgaacgatcacggccccaatcggcacttcgccaattaagtaggccatccgcgcttcatgtaatgcttcttgcatccagtcttccgctgttggttccgtcacgactatccctcctttacactttgtaggatgtaataccctttgtccttcttaatcacctgacaattaccaaaggtcgtttgcatcaatttcttcgcagatggtgcgccctgctttttctgtaaaacgacggtgagtgttccaccaacgactagccgtgaaacggcccccgttaacatcgcatccaccactgccttacctgcgcgcaccggtgggttggtgacaatcgccgcgtaattagtcgcggtcacttgttgatagacatcagacgtaaaaatattggtattcgtaatttggttcaaagcaacatttttacgcgctaagcttagcgctaactcgttcacatcgaccatatcaaccgttcgttcgggtgattgatacgcgagcgccatcccaatgggaccatatccggttcccaaatctagcattgggcccgctggcaaatcagttggatcaaacgctgcaagtagtgttcgtgagccgtaatccacggtacgcttggagaagacaccgttgtccgtcgtaaatttaaacgagtgattaaaaatttcaaaattccattgcttttcatcatgcacaatatccggattgtgtgtataataatagttggtcatatttattttcctctaaatttctggtctatatctatgataactgattcagcgagtgaaccacaaataatttaaaaaactttttagtcggttaaaagctgacactaacacaacatctaggacttgtgatttttaccacaccctagatgttgtgttttttgattgtttttttcaccacatgttgtatactaaatttatcagaaaaacgagttaggatgatgaaaaatgaaaaaagttactgtatttactaaaaacaactgcatgcaatgcaagatgactaagaagttcctcacggcgcacaatattgcctttgaagagaagaacatcaatacgaatcctgaatacgtcgattacctgaagaatcaaggtttccatgctgttccggtcgttgaaatcaatggcgaagacagcattgccggcttccgtccggatgctttaaaacaattagctgtttagtttgttcacgcttttttgcgtggttacatagctggtttaccctttaaaatatgataaacgacccacaatcatcaacctactgattgtgggtcgtcgattttgccagccacaattatactgatagaaagaggattccttatgaccttaaaagatttaaaagacgtcacgtattacgacttaaataatgagatcaatattcccgttaacaatcagattccgctcaacaaggatcaggaggcacttgccgctttccttgaacaaaatgttgaaccgaacacgatgaaatttgatagtcttaaggcgcgctttgactacctacgtgaacacgactatttggaaacccctgccattgataagtatgattttagctttatcgaaaaactttacgattacttgcggtcgcaagacttccacttcaagacgtttatggcggcttacaaattttatgcccaatacgccttaaagacggatgatggcgactattacttggaaaactttattgaccgtgtggcaatgaacgccctctactttgctgatggtaatgaagacttggcgatggacctggccgacgaaatcgttcaccaacgttatcaaccagccacccccagttttctcaatgctggccgggcccggcgtggtgaattgatttcttgcttcttgattcaatcgaccgatgatatgaactcaatcggccggacgattaactccgcgttacaactttctcggatcggtggcggggtcggtattaacctcagcaacttacggggtgccggtgatccaatcaagcatatcgatggcgctgctagtggggtcgtacccgtcatgaaattattagaagacagtttctcctactctaaccaattaggtcaacgtcaaggtgccggggtcgtttaccttagtgtctttcatccagatattattgcctttctttctgctaagaaggaaaacgccgacgaaaagattcggctcaagacgctttcactcggtgtcaccgtacccgacaagttttacgagttgatcaaggctgacgctgatatgtatctcttcagtccttacggcgttgaacgcgaatacggggtaccgttctcatatgtcgatatcaccaaagaatacgacaatatggttaagaacccgaacatccgtaaaactaagatcaaggcgcgtgaccttgaaaatgaaatcagcaagttacaacaagaatctggctacccatacgtcgtcaacattgataccgcgaaccgcgaaaatcctatcgacggtaaaattgtgatgagtaacttgtgctcagaagtgatgcaagtgcaaaccccatcattaattgatgaccaacaacagtatgagaagttgggaactgatattagttgtaaccttggttcgactaacattgttaacttaatgacctctccagactttggacattctgttgaagccatggtgcgcgcgttaacttttgttactgaccactctaacgtcgacgtcgttccttccatccaaaaagggaaccgtcaagcccataccattgggttaggtgccatggggctccatgcctttttcgcgaagaatcagatggaatacggcagtaaagaagccgttgactttaccaatatctacttcttactcttaaactactggaccttaaaagcttctaacgaaattgcgcgtgaacgtcacgaaaccttcgttaattttgaaaaatccaagtatgccgatggttcttactttgacaagtacaccacccaagattggcaaccaaaatatgacaagaccgctgcactgtttgacagtatcttcattccaaccaaagctgattgggaagacctcaaagaagccgttatgcgtgatggtctctatcatcaaaaccggatggctgtcgccccaaatgggtcaatctcgtacatcaacgatacgactgccagcctacacccaatcatcaaccgggtcgaagaacgacaagaaaagaaaattggtaagatttattatcccgctccttacctatctaatgatacaattaactattataagtcagcatacgatactgatatgcgtaaagttatcgatgtctatgcggctgctcaacaacacgttgaccaaggaatgagcttgaccctcttcatgcggtcaactattccagctggcttatacgaatggaaagatggtcgcactgataagatgaccacgcgggacttaaacattttacggaactacgcctaccgcaaagggatcaaatcgatttattatattcggacctttacggacgacgatggcgaagtcggtgttaacgaatgtgaaagctgcgtaatttagtatcttagatctctaggaggataacaaatggcaacagacttggcttactaccaaaaactgctcagtaatggcaactataaggcaattaactgggatcgagtttcagatgcaattgataaaagtacttgggaaaagttaaccgaacaattttggttagacacccggattccagtttccaacgacatggcagactggcgtgaattagatgatgatcaccggtgggtcgtgggacacgttttcggcggtttgacgctgctggatacgttacaatcacaagacggtctgcaagcacttcgccgcaacgtcttaacctcacatgaaacggccgtattgaataacatccagttcatggaatccgttcatgcaaagagttattcaacaatttttgaaacattgaatacgccggacgaaattaatgaaatttttgactggagtgacagtgaagaattcttgcaagcaaaagcccaatggatctacaagctttacgataacatcgacgaagatccattgaagcaaaaagttgcgaacgtctttttggaaactttcctgttctattctggtttctatacgccactgtactacttgggccacaaccaattgccaaacgttgccgaaatcattaaattgattttgcgggacgaaagtgtccatggcacttacattggttataagttccaattaggcttcaaagaccgttctgaaaagcagcaggcagaatttaaagactggatgttcgatttcttatacaaactctatgagaatgaagaaaactacattcatttagtttacgatcaaattggttggtctgatgaagtcttgacttttagtcgttataacgccaacaaagccttgatgaatctcggccaagatgccctcttcccagatactgcggaagacgttaacccggtcgtcatgaacgggatttcaacggggacttctaaccatgacttcttctcacaagttgggaatggttaccgcttgggtcaagttgaagcaatgcaagacaccgactacgatattggtaatccagacgattaatcaacacgttagttcacaaaaatgcggcgcctatccgggccgcatttttgctagaaaattttatcttgggggtagtttagaatggcaattcataatatctgtgttttttgtgggtctaattctggtttagatcccgcatttagtgagaaaacggtggcactcggtcaatacttggccgctaatgattaccaactcgtctatggcggtggcgaccatggtttaatggggaaagtcgccaaagcaactatggatgctggtggccgcgttatcgggatcatcccgcattttctggtcgcaagagaacttgcatttaaggacgtcacgacttttatcgaaacgcgcacgatgaccgaacgcaaggaaaagatgcttcacctcgctgacgcctttatcgttttacctggcgggtttggcacctttgaagaattcttacaaatgttatcttggagtcaaatggatattcaccaaaagccgattgcgctctacaacatcgacggcttctacgacgatctagtcgccatgctacaaaagaccgccgatttagggtttgcccccgaggctaacctcgacctattcattaatgggcatgatcttgatgaaattttcgctggtttccatgatttcaaacatgtgttaccgcctaagtatacgaactaaataatctagcctacgcaaaacagctctagtgcttctgccacaattagttcagccctcatcatattagtcggctgaattctaaagtcatcataaaatgccccatcattgcttctcgcagtgatggggcattttgctatgtcattaacgatacttactttatgacatactattcagttatttcaatcgtttcaacaaccatactggccggtgccgctcagacttgtgtacccgggtattaacgacttgtagcaattgtaaaatggtgaagattagtgaattacgttttcggtacgcaatgtacttcggttcccactcagtcacatacttctctttgtacgaccgtaatccctgaaaaccatataactggtagccatattcgtaaattaaatgagcaattttttcttgaataaaactgtagcgtgaaacccctacaccggataatggtgccattcccatattgaaataagcatagccatcgtcacgcgcctgttcaaataggtgcacaaagaccgtgtccataatgccggatggcgccgatttgcttgaccgcattaagtcaattgaagtcgtctgatgatttccctgcggcataatattcgcaaacgcgacaattcggtggtcaggatcataaacgaccgctacgggtgcctgattgagatactgctcatcaaaaaatccgagcgagaatcctttttccgtctcacctgctaaccaactatccgaaacggctcgtaattcagccataacgtcggcactgaacggtggctgcaagatggtaaactcatagtgatcacgggtaaacttattcattagggcccgctcaccccgtagccgtttaccagccaaactaaagtctgccaatttaacgtgcccttcttcaccagttttgataaagtcaaagcccatttcgtgtaggcgcatcgtcagcatctcactaatttcgtaaaagactagcgagcaaccgtcactatctgcgtcatccaataactgttccaaggcagtttgtaataccgcttgattaccgaatggctctcccataataatcagtttatcggccttctgttggtataagaaaatcagttgatcgaccccatcgacttgatagtaatatgctaacttatcattcaaataagccaagtgtgagatttcattgccgccataagtttcaatcacttgtttgacccgagccgcatccatcttttgacgtaatcgggcgttataaccactcgcaaagtagcggtacataataatcaaaatcattgccgctaagactaacccaatcactccaaataaccagagcttttgtgatgggaagaacagagcttcaggaaccgcatgccgatgatgaatttggggcgcgttatagactcccacaatcgtatacaagataaaggtcaccacatacacgcagctaacccacaacgtttgcccccacgaaaaagccaaccgatcacgataataagcatgccgcgacaaagccactagcgctagaatcacaatcaagaaaatcacaaatttcatcgaaattgcatcataaacgacgagccagcgaatcgtattcaaaattgcaatcagcaggacaatcaccgttggccaaaaagcttttttgacccggccagcagttcccaacgccaccccaatcagtaagaaggccataataatactgctggcctgattaataaagaaaaaggtgtacggataaaactgtaagaagagtttattgttatatgcaaagttagggaccgttgacatcaacaacatcagaaaaccagaaaaatagagaaaaaccgtcagtaccatctgagcaacacgttgtaatgcctgcttaggaatacccgctaagcgcacgtttaagcgatggccggtgtcatggatgaataagaccaacccgatggcaaacgggataatatagtagaataaccggtaaaataagagccatgcgactgcgtctggtcgagaaactccgaccgcaccgaggccaaaaatcatgaaaacgtcgaatgacccaataccaccgggtaccattgacacttcaccgacaaccgaagcaatcacgaataacggcacgaccgctgcaaaatcaatgggtaatcccataaagtttccaattaataagaagaacagcacacagccagtccattcaccaaacgacccactcaataaccgaacgacgttgccgagcgtaaggccatcgaagaattccgaatcgttgactcgtgtaaaaataaagatggctggaaaatacagtgcaccaccgacgagccagatccagtaactgccatacatgttcccaatgccaaagccatagactagcacgagtgaaatcatacaatataatgacaatcccgaaactaaaaacaaagcgatcttggaaatggcaaacacgatttgtttcttagtggcttcgcgattataaaagttagcacgcagtgaggcgcccagcacgcccccaaaaccaccgatattcgtaaatgtattggtgatccatccagcttttaagatatagccaagtgaatagtggttgggtaaaaactttgtaatcatgacgtcatacgtcagcattggtgtcactgcgataataccaatcacgaccatgcttaacagatgccaccagctttgcgaagcaagcgcattcgccaactgcgcgccactgacttccttcgcaattttgccgacttccgtaatcacaaataacaggacagagaatacaaataatgctttgatgattcccatgcgtttattgagtgccgtcccgattttctgtaacgttgccttcaaaaaaattcccccattggtgtgtttgttctattatcgcaatcttagcctgtttatacaaccgttataggtcgttaataacccccacaggtctgatttgtcgccgtattaagctatgaacattttaaatatctactactaaattgttccgaatgggtgttagtagttagcactaattatgattaattgtcgaaattaataccagcataaaccaatattaattgatttttagttaccaaacttgctttaccaacctttaccgtttatgtataattaaagtgatacataaataaggaggaatttcttatgcaccacgcaaaaaaactcgtcgttgcactaacgagtctactcatcttaaccggctgtaccactggtaatcaacaagccgccaaccataccagtgtcaaaaccaagacggttcgggttgagaaacggactgctgctaataaagccgcctgggcaaaagcaagggccgctagtcgggctaacgcggcctcagccaaagctcttagttcaaacacgacccaactcgcaattgcaactagtcaggctaagcgtcaatccgaacaactaaaagcaaaacatgacgacgcaatggcatcatcaaaatcagcgtcacaggctgccgccaaatcagctgctagtgaagcggccgcacaatcacgctcccagtcagaagcccagtccgcttcggccgtcgcagccgctagccaatctaagcaagcggtcaaggccagcagtcaagcagctgctcaaagtcaacaaactcaaactagtaccgcaaccacgagtcggcagaataatttttctggcgataccgataccgcccaaactggacgcatcgtgggtaaccgtaattccaaaatttatcacgttgaaacgggtcaaaactaccggatggccggtaaaaatgccgtttactttagtacggaagacgcggcgcgggccgctggtttccgtaagtcatttcgataggaggatcacttcatggcattgatcggcaccatcttattatttgcaaccctgtactggttctggcgcttgcatcggcgctaccgtgggcgtcaatggtggcggcatagttggccggccattatcgcattgctcgtcagctttagtattctcggcacatctgatgaatccactcagccaactgtgaagacaaagaccgttactaagacccacttagtaacggctaataatgacaagcaactgacggcacttcaagctgccaatcgtgcttctgctagcagcttaaagcaggctgcgaaaaaactttcgagtagtcaacaacatattgacaagctcaaggctacgaacaagcaagctggcgcaacttcgacaacagcaccaaccaaggtcaattctgaccataacccaagtaacaatgcgttggctagtaaaacttacaacggtcaacaaacgatcacgattaatcagaatcagcccgcatttaccgctaaggagctcagtacgagtcagggtgcctggcaacaatatggcaatttagactcacttaaccgggtgacggctgctaatgccctcttaaatcagtcactgatgcccaaagctgaacgtgaggccttgaatgttcgaccaactggttggcataacaaacgcatcagtagcggttggctttacaaccgcagtcatctgattggctatcaattaacggggcagaacaacaatatcaagaacctcatgaccggaacccgttctttgaatgaccctgaaatgacgacctatgaaaaccaagttgcggcctatttgaaagaaagtccgaaaaactacgtccgctaccaagtgacccccattttcaaaggtaacgaattgttagcccgcggtgttcaaatgcgtggtcagtcagttggtagcaatactgttagttttaatgtctatattttcaatatccagcccggtatgaccttgaactatactgatggcactagtcaggtcagtcactaacgatcattgatcatcgtattcagcctatcacgcagcagccacaaaagtgatagtgccctgttgaccagaagttcaacccaagtgaaattttaaaacaagcccaacagacgtactatgcgacgttctgttgggcttgttttgacttgcttaatccaatacggttacgcctctaacgccaagtcaccgtaatcatacggtggttgatatcaaattgcactaacacttagcctaagtataaattctcagtaatcgttatatgcgtggtcatgcacgtgatgattcacaccaaagccacattcagagataaaaaaaaccacaccccatagtagggtgtggtctgatgacgttccgttaagtaaataattacttaagggtaacgacaccaccaacttcttcaagcttagctttcatatcgttggcttcgtcttctgaaacgccttctttgatgattgaaggtacgttatcaacaagacccttagcatctttcaagccaagaccagtgatatcacgaacggccttaatagccttaaccttttggtcaccggattcagttaattcaacatcgtatgaatccttagcagcggcagcgtcgccaccagcagcaccggcaacagcaacaggggctgaagctgagacatcgaattcttcttcgatagccttaactaagtcgtttaaatctgagattgaagcttcttttaatgagtcgataatagcatctttatcaaaagccatttttttgttcctccattttatatgaacttatattttagtttttttaacacactgacagcaaattaagctgcgtcttcgtcgcctttttcagcaaccgccttaacagcgtatgcaacgttacgaacaggtgcttgtaacaagttggcgatcgtagccaataattcttcacgtgatggcatcgtagcgtattcttgaacagtttcaagatcagcaactttaccttcgatcacgccaccctttaattgaagggcatcagcggtcttcgcgaagttagccaagatctttgcaggagcaactgggtcttcttcagagaaggcaacggcagtaggaccagcaaatacaggttttaagtcttcaaatccggccttatcagcggcacgcaccatgatcttgttcttgataacgcgcatcttaacaccggcttcacgtaattgcttacgtaaatcagttacttgttcaacagtcaaaccacggtaatcaacaacaatggctgatactgagctcttcaattgttctgcaacttcttcgacttcttgtgctttaacagcaattgtttctttactcaacagattcacctcccagaattttggttcagggatttataaaaaaatccctatgtccaccaagacatagagaaaaaacaatgtcctcggcaggtagattaaggccgttaagccgcctgagtcttaggtagagatattacttaacctctagtaatctatcacagatcacccacggggtcaattgttttcagaatttaatccttaaaatgatgctaaatcaacacgtaccgctggggtaaaggttgaagtaacaactaagttttggatgaaagtcccacgtactgaggctggacgagctttcacgatggtgtcttcaatggtcttgaagttaccaactaacttgtcagtatcgaatgataccttgccaacaggaacgtgaacgttaccgtcacggtcagtccggtaagtcaccttaccagcttttgaatcgttaacggctttagcaacgtccatcgtaaccgtaccagtcttagggttaggcattaagcctttaggtccaagaacccgacctaaacgaccaacttgggccatcatgtcaggggtagcgattgcgacatcaaagtctaaccaaccgtcttggatcttctgaactaaatcagtttcaccaacaaagtcagcaccggcttcttcagcttctttagccttgtcacccttagcaaaaacgataacggtttgatctttaccggtaccattaggaaggacaaccgcgccacgaagttgttggtcggcttgctttgtatcaacgtttaatttgaaggcaacttcaacagttgcatcaaactttgcgaaatccatttttttaaccaagtctaccgcttcagttacatcgtaagctttgtcacgatcaacgagcttagcggcgtcttggtattgtttacttttctttgccatctaagtgttttcctccttgcaaatgtggttcaaacggagatttcctcccacttgacacattcattttgatgaagtgtccgacatactcaacagtactgaattagccttcgacggtgaatcccatactccgagcagtaccttcgatcatgcgcatagctgcttcaacgtcagctgcgtttagatcttgcattttagtttcggcgatttgcttaacttgatctttggttacagttgcaaccttcttcgtgttaggttcaccggaaccactttcaacaccggcagctttcttcaatagaacggcagcaggtggggtcttagtgatgaagtcgaatgaacgatcttcgtacaccgtaatcacaacagggatgatcatacctgcttgatcagcagtacgagcattgaaatcctttgtgaaacccatgatattgatacctgcttgacctaaagctgggccaactggcggagcaggtgttgctttgcccgcaggaatttgtaatttaacaacgttagctacttttttagccacgagacattcctccttagtccgtgatgtggtaaatggagctgagtttttgctcctcccacgtaaacgtgcatacgtgacgcacaaatatcattgtagcatatctatttttcaccagcaaccttttttgtggcttctggatataaaaactggacgatttggcgatcaacttcatagttttcatgtaatcgtgaatggcgggcattcttaccatgtaccacaaattcttgatactggtcacgcgtcggtcgcagtaaaaagcgcaatgacaacgcactattcagagcgacagcaccatcactttgcgccgcatcgccaatgttacccgcaatattcaaatacgaaatcgtgtttggcaatcgttggagcgttcgcaaaaaataattataaacgggcgtggtcttagttggtccggtcgccgtcaacgggtggttttcaatcggatacgtattctgcccgacctcactatcattaaacggcgcaccaattgtgacaaccttgcggacttccggtaaattgaccagtttggcagctgtcgtcaagtattgaaagagcaccacaccacccatcgaatgagcgactaaattgatcgtctgaacgtgctcatgcgcaatcaaatactgcacaactgccaagacgcccgccgcctgttgccgtacagcaacgcgtggcgtggcaaaaatcaactgtaccattgggcggtaagcgtctagctcaccagtcacatggggatgattatgtcgatcaatcattacgactaatgacttattggcgatgcccccggccgtaaaacgttggagcatgccaccaaaagagaaccggttgcccgcataccctggaataaatagcgtcacggcgctatcatctgctgaattagccgacaccgactgccgcaaatgctgcggtcgcccgtattgccaaaatttaaaggtgatacgccccaaaataccgagcactaaggcgccgatgatgactaaaattacttctgccaagatggtccaccagcttacttaaattaattaccgaatctggtcaacttgatcgaagtccaattcagtacttgtttcccgaccgaacatattgatattaaccttgagcttcatcttttcgttgtcaatttcagtaatttcaccagaaaggccagagaaagcaccatcgatgatggtaacttgttcgccaacttcaacgtccaattcggtatgccgagcactcatgcctagttgatgcaagatttgttccgcttcttcaggcaacaatggcgttggtttactaccttgcccatgtgatcctaagaacccagtaacacctggcgtattccgaacaatataccaagcttggtccgtcatgaccatttcaaccaaaacgtacccggggaagatcttcttcatttcaactttgtctttcccattcttgacttcatgagcttcttcttcgggaacaacgacccggaaaatattgtcttccattcccatagattgaatacgggattccaagttagaactaaccttattttcataaccagcgtaggtatgtaagacataccatcttttctcaacagactcgaccattattattctcctttaaaatgtcttttggcaaaataaaaaaacctcgtttgcacgaagttttctttcaatgccattattataacaaaaatttgttcaaaaagccattaatgccagcttgttaacatttgtaataataattggataatccaatcaaataaagcgaaaaacgccacgaagaacagtgatgttgagacaactgtccacgaatcacgacgattttcccgccaagttggccaggtcacttttttcatttcatgtccaacttgaccaaaaaatttaaataagcgcatgtctaatccccctaccgcgtttcacgatgaagtgtgtgtttaccacaatatttacaaaatttcttaacttctaagcggtcagttcgattcgggttagcatcaatcgtgtagttccgcgaaccacaaacggtacatgccagtgcaacttttttctgtgccatcgacaaaacctccataataaatcaggtataacattagcatggaacttttcgaatgtcaatttcaggcagcgtcttgtaaaaagtcacgcatcttcttgcggcatcgatccgtggcgttgaccacttgatcaacttccacttgccgactcaatgcaatccgttctggcgattgccctgccaatagatccataaaaaccaatccttcaaatgccgaacagattgctggaaaaatccgcacctgctcacgaacatgaaccacatcaagggtcgaggcccttagcgtctgaatattgcataagatatcctcatcattaacatccagtgataagatatccccttccggacgacgcttgcgagcctgtgtccgccgaatatgatcaataatctgattactcaatagcacccggtaataagtgccaaagctacattgccgtagccgttgatactttttagccgctcgataaactgcaattcgaccttcttgaagccaatcatcctcgtcaaagttccggacatagtattgccgccgcaaccgccaaacaactggcacatactgctgggctaatgcattaatgcttgcatcatcaccatctgctgctaagtggatcaattgctgttcattcacgtgacattcctcgcttctgactagtttcagaaactgcacccctgagcatctgtaatgctaatataccgggttaattgtgccgtcacaagcgaacgaacgtttcaattcagccacctcagcactcacagaaatcctcttatacgcggctatcaaaactactatgatcgtcctattcatcaacctaatagtgccatatcgcactaattattagtaatatcaaaatattgctaacgccaaagacaagtgcgacctacttaagcccgttggcgacgagtacgcgcgtccgctggagttgcaagaagccactgcgctgtctaaccaaccgattaatgcaatcgccagcgcaaactccgataacaccaaaactgttatgacaagccatcctaacatctagtgaacagcagctgaactggggcatttgattactagatattttaatactagaactgctttcgagccttaaattgccactggttatcttttgcaaaatttaaatattaattatgacgatttagaaacaacccacgctcgcggcaaccacctaattacttgtgatgatgtttaacgtgattgcgttctagttgttggcggtattgatccaaggccgataattgatcctcattccagggtgatttacgaacggcacctaaatcctgggtacgcacggcggtatgacgcacatctttcagtgcagtcttgacgcggtgccgtaattccaaagctggtactcgtagcgcaccttccgaaaagattacccattgttctgcctgatcactagtcgcaaccgtcacttgaagtactcgcgattgcttttcacccgcgtacttttcgatataactgtcagcggtctggtctttactcgtccaaataatctcaagatcagcttggcgataactcttagaattacccggaacgtacatcgcatcaaaaaccaggctaatattaaggcccgtaatttttttatactcagtcaacatgctaattaactcgtcacgagcttgcggcaaccggtccgtttgttttaaatgattgagttctggccagttgccaatcatattgtaagcatcgacaatcaataattgttgtttcatcttattttcccagtggatgccgggacgtgtagccttgataaatcagaaggctggccgccacactggcattcaaactttgaacatgaccaatcattggaatggtcaacatttcgtccacactcttcttaagtaatggtgaaattcccttaccttcattaccaataatcaaaccaacggcaccggaagcatcccactgtcggtagtccgtcccgttcatatcagtcccaaagatccacagaccggcttcttgcaattgtttaaccgtttgaaccaagttcgtcacccgcgcaactttcacgtgttcgatagcccccgttgacgtcttggcaaccgtactggttaaccccacggcgcgccgtttcggaataatgatgccatgggcgccagctgcatcggccgtccgcataatcgaacctaagttatggggatcttcgatattatccaagatcaagaaaaatggcgcttcattcttagccttagcaacagcaaataaatcatcaatggtggcatattcaaaagcagccacccccacagctaccccctgatggttggcgttgtcggttaaacggtctaacttttgtttcggcacgtactgtacgatcaaattacgtttcttcgcaatcttggcaatgtcattcagtacatcggcctgtagaccgctttgaataaagactttgttgatctgttgatcactcttgattgctgccatggcggggtgccgcccgattacaaagtcagctgctgtttggtcttgttcgttatttgacactggaaaccctcccttcatcaacttgtttaatacaccactgtgccagttctgcaattcggtccgcctgctgagtcaattgtaaatacccaaaaacggcttcaaaaccggttgagatccggtaagtgacgacatcggtatgtttggccgacgtatgactcttggcattccgtccacgcttaaaaacgtccacttcagttggcgttaaaacttcttcggcctgcatccgttcgatcagtgccgcttgcgctttggctgaaacatagtgggttgcgtggtggtgcaacttagtggctttagtaaaaccactttcaatcaaatgttggcgaataaacggttcatacaccgcgtcaccgaggtacgcgagtgcaatcccgtttaattgttgataatcaacttgcatattattcctttctaaaccgcacaccctgaggcgtatcttctaaaataatcccctgaactttcaaatcatcacgaatctggtcggccttagcaaaatccttagctttacgagcagcttctcgttcatcgatcagtgcttgaatcgcgtcatcagccagcgtcgcattaaccatttcaaaagtgacgccgaagacgccagtcaactgcactaatgccttctgtaaggcaatcaacgtctctttttgaaccgttgccttggctgcatagacattggctaacttagctaattcatacacagcagccaccccgttttgaacattgaaatcgtcatccattgcggttccaaagttagtgatgagtgtctgtaactgttctgccaccgcagtatccgtcccgttcgtcgcatcttgcaaccggaacgtgagattacgataagcattacgtaacttatccaagttattagctgcctcgtctaagttggcctgcgtatattgaatcggtcgccggtactgggtcgtcgccatgaagaaccgtagcacttgcggatcaaccgttttaataatatcgtggaccgtcacaaaattacctaatgacttgctcatcttttcgttgtcatcgccaaccgtcacaaaaccgttgtgtaaccaataattggcaaacgtcttgccggtcttcgcttcactctgggcaatttcattttcatgatgtgggaattcaaggtcctgaccaccaccatgaatatcaaacgtatcgcccaagtacttagtagacatgaccgagcattcaatatgccagccgggccgacccgcaccccatggcgattcccatgaaatttcaccgggcttggctgctttccagagtgcaaagtcaattggatcttctttacgatcggtttcttcatcggcagtatgctgactggcacccacttctaaatcatcgattcgctggtcagataactgaccatactttttaaacttccgtgcgcggtaatatacgtcgccagctgattcgtaagcatagcccttttcaatcaatgcttgtacaaatgcaatgatttctgggatattctcagaggcccgcgggtgaaccgtcgctggttcaatattgaccgcagtcgtatcttccataaaagctttaataaaccggtcagcaactgctggtaccgtggtgtgatcttcagcggcacgtttgatcagcttatcatccacatccgtgaagttggagacatagtcaacgtggtaaccgcaatattcaaaataccgtcggatagtatcaaaggcaattgcagaacgcgcattaccgatatgaatatagttataaacggtcggcccacagacatacattttcacaactccgggggtgatgggcttgaacggttctttttgacgcgttaacgtattaaaaacacttaacatattggcgacaactcctttcaattgaatcattacttttgatgatagtttaccatgtttgaaacacaaataaaaagcatccctcgcacggtggaaccgaaactccaccatacaaaagatactttcatatgcagtcacgcgccactgggtaactttcgcgatactgagataacgctcacccggggactagcttgctgaccgcacgatgtattaattgcgttgtcttgctgacgacgaccgccacttacgacaaccaactaatattttaataatccattcattacttggcgagttccgcaatcatagcatcgagatgctttttggtcgtttcacgccctaataattcaatcgtttctggtaattctggcccgtgcatttcgtgagaaacggcgatccggatcggcatgtataatgcccggcccttgatcttcgtatccttttgaatgctcttgatcgtcttttgaattgcggttgcttcgaagacgtcaatatcttcgattcgttgccggaattccttcaagacagggagtgccgtgtcattatcaagttcggccttagcttcatcattgatatcagccggaccattgaagaagagatctgctaaatcaacgatttgaccagtatagctcatctggttcttaaataatgaaaccaacgtccgtgtccattcaatctggctcatatctgggcgttgtggtaaccggccagccttgatcaattggcgaattgacattgcaaagacttcattttcgtcagccttcttaatgtactggttgttcacccattccaacttcttgccatcaaaagctgctggtgacttgctcaaccgcttttcatcatacattttgatgaattcgcgcttactgaacaattcactttcgccaactggtgaccatcctagtaggatgatgaagttaagcattgcttctggtaagtaacccaattcacggtattgttcgataaattgcaatacggtttcgtcacgcttgcttaacttcttaccggtttcggtattgataattaagctcatgtggccaaacttcggtggttgccaaccaaaggcttcataaatcatcaattgcttaggcgtgttggcaacgtggtcatcaccacggaagacgtggctaatttccatcatatggtcatcaacaaccaccgcaaagttgtacgttggcatcccgtcacgcttcttgatgacaaagtcgccaccaaccgtcttggattcaaacgaaactttacctttaaccatgtcatcccaagcataggtcgtattttctgggacgtggaagcgaataacgggttggataccagccgccttagcagccgcgatcttcgcctgtttttcgtcttccgtcatgccagcaaattcgtagacgtagtgtggcatttccttacgcgctttttgagcttcacgttgtgccgacaattcgtcttccgtcatgtaagattcgtaagctttaccttcatcaattaattgttgaatcaacgggtcatagattgatttccgttctgattgacggtaagggccaaagtcgccacccttatccggaccttcgtcccaatcaatccctaaccacgtcaaattgtccatctgactcttttcaccgtctttaacattccgctttaaatcggtgtcttcaatccgaagaatgaactttcccttattatgccgggcaaataaatagttaaacaatgcagtccgagcattaccaatgtgtaaatggccagttggacttggtgcgtaacgcacacgaatcttgctctttgccaatgtgattaacgcctctttcgtattttttcatcttaaatgttacgccggaacctttctatcgaccagaatattccgactttcacttgcttttccagtttaccatgtttaccgctaaaaattaaggtttcagactgaacccattgtaaaaatatcgaaacaggccctaatcgtacactaacaacatcccaatttattgataatgagcattaaccctcctattttgttgcgattcggccgcctcccttacgacgtcctggattagtcatcattgaacaaaaaaacggtagcccccatcaaatgagttgctaccgttgaatcgcttaacctagtgccgattatcgcgattattatttcgattattactatgattattgttgtgcttattatttccatccgcatgatccggaattccgcgattagcgtgcgctaaacgggcaaaaatcattcgaccagcatccgtttgtaaggcgctcgttacaacgacatccaccttttcattgatgtaaaacttcccatcttcgacgacaaccatcgtcccatcgtccaagtaaccgaccccttgttggcgttcgctaccatttttgacgaccatgacattcatctcttcaccaggaataacccgtggtttcaacgacttagccaactgattaatattgagaacttgtacgttttggaactcaatcaccttattcaagttgtagtcattcgtcacgatcacaccgttgacttttttagccaattgaatgagtttactatcaacttctggaatatcctcaaaatcgccctcgtacatttcaaccgggataatattttcattttgtagcttatttaaaatatctagcccgcgacgaccccgcacacgtttaatactatcagctgaatccgcaatgtactgtaattcatacaagacgaagttcggtactaacagtgtcccttctaagaaaccagtcttgacaatgtcgtaaatccggccgtcaatcaagatgttggtatctagaatcttataatgatgatagttctgatctggctgagcatcagtaatctccggacttgtttccttttcacgacggcggaagttgaaaactttccgccactcgtcgatccgggtagtcccgactcgcgcaccaatgtaaccaaaaaacaacatcaaaataattgggacgaccgtgttcaataggaataatggactacgattaaataattgcgaaatcagaaccgcgatcaataacccaataataaatccgatactgccaaataaaagtgtcattgggttttgcttggataagttcttttcgactcgatccaccagtcgtacagcggcattggctaagaacaatgacaaaacccatagaatcagcgcccccaacaaaaagttggtaaaaacgttattcaataacacatttggttgcgacaaaattgtcgtccacaagaacggcaggtaagttagtcctaacgtacccccgacgacaataaatactagtcgcaccgttaacttcttcatggcatcagcccctttttaataatttggttgttgtaatgctaattggagcgcttcttttagcgtggcaactccaattacttcgattccagttgggatatcccaaccttgcagattattcttaggaataaagatacgtttaaaacctagcttagccgcctcaccaactcgtgattcaatccggttgacccgccgaatctcaccagtcaaaccgacttcaccaacaaaacagtcactcggacgagtctgctggtcacgataactagaagccacactgaccgcaatagctaagtcaatcgccggttcatctaacttaacgccaccggccgctttcaaatacgcgtcctggttctgaagcattagactcgcccgtttttccaacactgccataatcaaggagactcgattatgatccaagccacttgcggtccgcttcgcattaccaaagaccgttggcgttaccagcgcttgaacttctactaagattggtcgtgttccttccattgaaacaacgatggcggaacccgtagcatccttcagacgttcttccaagaagatctctgacggattggccacttcatacaaaccgcccgtccgcatctcaaatattcccagttcattcgttgacccgaatcgattcttgactgcccgtaaaatgcggtacgtatgatgtaaatcaccttcaaagtacaaaacggtatcaaccatatgttctaagatcttaggccccgcaatggcaccacccttagtcacatggcccacaataaaaatggtaatgccgttagtcttcgcaatttgcagtagttcagccgtaatttcacggatttgtgatactgaaccaatcgcagagtccatatcaggttcttgcatcgtttgtaccgaatcaatgaccacaaattctggatgcgtcgattcaatcgttgaacgaatattcgacatatcagtctcaggataaagataaaagtcttcactgctaacagccagccggtccgcccgcatcttcacttgggaggcactttcttcaccagtcacgtatagtacagaaccacccgtctcggccaattgccccgaaacttgcagtagtaacgttgacttaccaatacctggatcaccaccgatcaaaactagtgaacctggcacaacaccgccacctaagacccggttgaactctttcagcttagtcttgacacgcggtgtcttagtcagcgacacttctttgagtcgttgtggcttagccgacttacccgcaaagctcacccgcgacttgcggtccggttttgtatcaaaatgttcttcagttagtgtattccattcaccacagttcggacaccgtcctaaatatcgcggtgttgaataaccacagttagaacaaacaaactgagtttttgcttttgccacgtacacacgtctccatttctccgccaacatatcaatttaatgttgggtattggaatttctaaaataattacttcatccgcgtcacactgtcatgagtcatgattaaaacgtgccgttttttaaatttaaaagcagccagcttaggcccgctggaaacagtccgggttagcgtaaacttgcttagttaattcgtcctacaccgacctccaggcatttctgccaattgccggaacgcggtgggcacagatttgagccgaagcccacgtcttaaatactggcctttcacgcttttatgccatattggtgaaacgtgttcgggtcagactgagacttcacactcttgcagtactgggcattgtcagaaacaccttccagtcgggatggtattcgaatagctgatgaagatgtactcaacttttgatgaattggtcgttgttcttcataaacggtaattttctcaatcaactgtcaggccgaaaatgatattgtgatgacttactatttctgagttaccagtcataatacattgaacgtttcgacaaagtagagattacattctgatgtttcgctcaaagttttcgtatcaaagtagtcagcaaccaattgtaccaagttaagcggccgtttatttgccattcgagcggcttcccggctggaggggctgggtgacaatgctcagtagccaaattattcttaggcggaagtgtctttcttccggcttagaataagactcgtatttgagatgacgcgggttatgcgttagctcaaatcgacgtcggcttacgttccagcaattgtcacccagtcccggaggtcggaataggatagtcattgcagacgaacagaaatctatctaattggcaccttttaaccatgattcttactaaacaaccagccagtacgatgcagacttaaataatcaatcaaactcaattaactggatcgtcattttcatgctatgggtataagtttattttaccattattaatcattaaagcctttaaatcaccttggctttaccgattttttattatttcctatttattggtcgaaccgaagcccccagaacgtgtcgttgtcacattcgtttcatccgtaacagtcagataaggggtaaaaatcccttgggcaatgcgttcaccctttttaatgtgaacgtcgcgaatccccatgttgattaattggacgaaaatcgcaccttcgttcttgggattgttatagtagtcagcgtcaatgacgccaatcccattcggtagaatcaagttacgcttcaaggggttgctagaacgattggctaatagtaagtattcaccatcattcataaatgccttaatacccgttggaacaagccatggtttaaggactttagccgccgcatccaaatcggctgcagaactcgtttcaccatgatgtatttgccaaagtactttgataaagttcattttccaaattgacggtaacgtaaaatcttccgccgcttcgaagtcatagccagctgcttgcttggtagtgcggtaaggtacatgtaaccccgcctgcgcgtattgacttacaatttcaaatccccgtgccatttcaaattcctactttctcaacattaatttagtgttcacattttaccatacttttattatagaagtttcgttgacaaaacgggcaattaccggtttaattacggtagatataaaaccctttacaaggtggtgaaatcaatggaattcacgcgtgaagcacaccgcttttattttaatgacgatcacggcaagttggctggtgaaattaccttccccgccatcaataatgatcagacctgggtcattgaacatacctttgttcgtgacgattttggtcatcagggcattgccggccaattaaccaaagccgttattgacgccgctcgagttgaacacaaacgtattcagccactgtgtacctacgctaaggcttactttgatcggcaccctgaagctgccgacgtattagtcactagttctcaatcaaaggagtaattcatattatgaatcaggatcagttaaaacaacttgttggtcaaaaagccgttgaatacattcaagacggcatgcaggtcggcctcggaaccggctcaaccgttaaattcatggttgatgctctgggtgaacgggtcaaaaatgaacatttaaacattgtcggcgtctcaacctccgaccgaaccgctgcccaagctaaggcgctcggtatcccgatgaaatccgttgacgaagtcgaccatctcgacttaacgatcgacggtgccgacgaaatcgccgatgatttccaaggcgttaagggtggtggcgccgccttactcttcgaaaaaatcgttgccatcaattctgataaagtcatgtggattgttgatgaaagcaaaatggtccatcaattaggtgcctttggcttacccgttgaagtgattccttacggcagccaacatgtctttgaaaaaatggctgcccggggctataacccagtattccgtaaagtcaacgatgaactcgtccggaccgattctaataatattatcattgatttacacatcgacccaatcacggatccccacgctttagccgaagatttaattcacatggttggtgtggttgaacacggcctgttcttagacatggtcaacactgtcattgtcggtcatgccaatggtcccgaggttatcgaagcgcgaccatagttttgtgcgactccccgcttgccccacccgtcataaaccgatacaattagaattagattaaaggagagtgatcttttgagtaaagcaatcagtatgaaccaaattgctaactttcaagccgacttggaccaacgtcccgaagcaaaagtcatcgaacgtagtgtcactaagaacggtatcttagcaagcagtcaagatattcaggccatgagccaaaccacaccagtattttccattgatttggatacaggtgacgttgcgaaccaaaagcaaagtggccgttgctggatgttcgccgctttaaacacgatgcggcattcattagctgaaaaattcaacttgaaacatttcgaactatcacaaaactacacctttttctgggataagttcgaaaaagcgaactatttctatgaaaacgtgttggcaaccgctgaccaaccaactagcagccgtaaagttgcctggttgatgaccacgccacaacaagatggtggccaatgggatatgctcgttgccattattcagaagtacggtatcgtgcctaagagtgtcatgcctgaaacttacaacagttcaaaatcggctgaaatcaacagcacacttaacttaaaattacgtaaagatgccgttgaattacgtgaactagtggctgccggaactagtgacgacgcgattcaagaacgcaaggaaaaaatgttaaatgaagtctatcgcatgttagcctatgcctttggcgaacccgtttcacattttgactgggaatatcgtgatgataagaaacaataccacatcgaccaaaacttgacgccacaaagcttcttcgaaaagtacgttggctggaatttggacgattacgtttcaatcatcaacgccccaaccgacgacaagccttataaccatacctacacgattgaaatgttaggtaacgtcttaggtggccgtgaagtcaaacatttgaacgtgtctatggccgacttcaagcaattggccatcaagcaattacaagctggccaaagtgtctggtttggttgtgatgttggtcaatcctccgaccgccaaaaaggggtcatggctaccgatgtctacagtaaagatgaattattcgacgttgacctttcaatgtcgaaggctgaacgtcttgattacggcgaaagtctgatgacccacgccatggttatcaccggtgtcgacctcgttgacggccaaccaactaagtggaaggttgaaaatagctggggcgacaaagttgggactaagggcttcttcgtcatgagcgatgcttggatggacgaatactgctaccaagttgttgttaacaaggaattcttgtccgatgacttaaaggcagcccaagccgaagaaccaactgttttagcaccttgggatccaatgggtgcattagcctaattaagtttaatgggccatctaaattaagtaccatcactgctttagcgtgatggtgctttttggactgcattagacttaactaccgctcaaggaactactaacaacaaacaataaaaaaatcgaccaaactcgcgtgagtttagtcgatttttttattattacgtttacttatagcaatcactattataattatttatacatctgcttaagcgtactaatctcacgagtcgtgatatgtgctgctcgatgcgactggtaatacatcaccgcactcttgttgttctcgtgctctagtcccagtgcatgtcccaattcatgggtcgcaacggacagcttatattctaccgaatgattgctggctggaaagcgattcgtgtaaatcacacacttcgccgaatccatccaagttgttccttgcgaaccactttgatagtacgtccgccaagtccggccgatttccgatccggtcgtctccgtctcgtcttcactctcgcccaacgtaatctgggctttcgcttggtccttagcctcaactaacctcaccgcgttagtgttattccaacgttccacggctcgtagccaaatcgctcgatacaccttgctatcacttgtaatccgatacgtgatgacccgattcttgaagcgagccttataattcaaaaccttagtcccgttatttatataatcatattgataattatccatctggtcattgtagtagacctgatcatgagttgtatcgtgatcactagtcttatccgcttcaactcgcgaggtattcgagttgatcagcgtactaagctgcggtgcaaacatcagcagcatgccgcaaaaacccaggctcattattattagtaataataaatttttatgcttcatcatcgttaacccaagatttctgatcagatttttggctgttaaccgcgccaaatcgcgagtttgtccatctgatatgttacagcgtttaccattctattacaagtgatatattatatttatttatgaaaactgaaggattttattacattaaaaatatttatattgactcaaatagttgtgaaagcactgttatatcaattttttaagcctgtatcattttttgagtactcgtcggcaattattatcaatgattataattacttatactgggcatttatttaacactttaactaaaaaagagcttcagcgtctgctgaagctcttaactcaggctcgattaatctaataatggtctaaaaaaacagtccagattagcacttactttcaataaaagtaccgcttaggagaactattactaaatttaatactcttctttaccgataacgtgcagttgctgatcaaggtgataacaaattggcactccgttagcaacttcgacaccatcaatcccagtatcactaatatgctctaaatatttgatcatcgcacgcaacgtactaccatgcgccaccacgagttggttttggccgtctaacaaccgcggtgcaatctcatcgatccaataaggcatgatgcggtcgtaagccatcttcaagctttctccccgcggttcgacggcggcaccgtacttggtgtaacgtcgatcatggtctagttcagctggtgtcaacaacggcggcaccgtataaaagctccgccgccactgttgaacttgcgccttaccatactcttgacgagtcacatccttattttgaccacgtaaggcaccgtaatgtcgttcatttaaccgccacgtcttatactcaggcagccataactgatcaatttcacttaacataatattcgcggtaacgatagcccgttttaggactgaggtatgcacagcgccaaactgcagtcccgtagctcgtaatcgcttgccagcttgatgagcctgtgcaatacccactgctgttagcgggacgtcactccaaccggtatacgtattatcccgattggccgtactctcaccatggcgaaccaatactagttctgtcattctctttcccacctactatcttcaatacttcctatgataatcgatttggttcatttttcaaagtcacaaccagctgttacgtgcgataacgcgcttgccacaaaaaaacggtcaagctgattaatatcaccctgaccgtccacgattaattaattttcttgatttgaaacggtgtgcgcggctttgatgacatgttcatcatcagtggcggccgctgttggctgctcaatcgcccccatcgtatcccgttcacggaaccgattaccaacaaaggtcacgacggaaccaatcaaaatcacaacaattccgaccactgtcgtccacaaaatttgttcatggaggatcaacgctgctaagattggcgccaaccccggcttaatgaagaatactagggaagccgttgaaacatcggtttgttccattgccaagaaataaaacgcgaagcccccaccagtaacacaaacgccgataaaaaatagtaaccagaaatagttgagattaacattcaccaaaaccggaatggcagcaaattgccgcaaaccgatggccgtcaacccattggcgacagccggaatcttagtaatccaagctaaaactagaagttcaaacgcaccagcaaagaaagtaaaacaagtcatcgtcagcccattcaagccccgtttaacagacccataacgcgagatgatactgtacagcccaaaagtcacggcagacccgatggctaatagcagcccaagcccattcgtcaaatgggccggattaacaatgatcaacaacccaatcacagaaatcacgacggagatcaagttagctcgacccaaccgttctcgcagaattaaataggagaataatagcgcaaataccggattacaactaaacaatacggccacagtcgaagcttgatcgaccgtaatcgcgagttggtaaagcgacatactgacaatgacacacactagcccggttaaagcaaatagccgccagtcagcactcactaactttcgtccggtttgctttaatgcccgcaatgcaaatggcagtaacacaattgccccaataaaaaatcgaattagattcaattggattggattaaaggcactgccggccatctttagcgcaatttccatcgaactaaacattaaggtcgaaattgcaatgtaaagatatgctttcttcacgaaacgttcgcttccttcttaatcaaaatttaatacgcaacggttctcagtatagcaccattttcacgtgactttcaaatcagctcagtatactacctcgcttttatccacgggaaaacgccgtttaacgcggaatcaggcgttatttttttcaatttttaattgcttttgaaaacaattttcatcaggcttgaaccattcaatggcatcttgccgcctcaaccatcatccagcacgcactcatcagcttgtcatcaaaaactaccagcgagacgtgttgggacggccctgagcagaaagtatctaattggtcaaaccttgttgaccgaactaaattgagttttcatcattaataaccagcaaaaaagcacccgcaacgcctgtcactagtggcacgcattcgggtacttttaattttaagtcacataataattaacgaataaaattggcttgaacgatcaccatcaaaatcggaataacgatcaggctcaatagtgtcgtttctgtcaccatgaccgcggcataatcggcatccgccccgtacagtttggagacaactggcgcgttcgtcatgacgggcatcgcggactgcagaatgaagacttgcttcatctccaatggaatcgacattggaataagcatcagcgtcatcagtaccggcgcaaggataaaacgcccaagtaaaattcccaagctatcccggtcgaagcgcatgctgcttaacccggcgttggccattgaaatcccaataaagatcatggacagcggaatcgttagaccgccgatatatgagaaatcatccatcaagaattttggaacgtgaatgtttcctagaacaagcaagacaccaatcataaatcctagtaatggcggtgagaagatcttggtcagtgtctgcttcaagtcaaacttagcagtgccagtaccgtcacgttgaatcaaataaacgcccagcgtccagaaaatggtggtattggccatgtaataaactaacacgtatggcaatgcgctattcccaaacaaggcttgattaaccggtagcccaataaacaccgtattggagttcaaaaacatggaggcaaataagccgcgatgactctttttaatatttaaggctcgcatcaccccgaacgaaatgccaaacaaaatagccatattaagaactggaaaacgtaatcctggcaacgttgataataatttatgcgctgtaaactgctttgtgatcgttgcaatcatataggctggtagcgcaatttgagtgaccaatcgggcaatcagcttagtcgcactttcattaaaccagccccagcgtgccaacaagtaaccaactgcaatcatcacgatgatcgtcatgacaccttgaatactctgcacgaatgtctgtaaaatttgcacgctcagtcttcccctcttaacaaattgctcatcattgaatatcgctatcaagctatgtaaaataataattcaatgagaattattcaagtataccactgttttatgatggcttgtaccgtaatttatagatggaaacgtttgacgccggtcacaatattacttatagtgttctataattgtgttactactgatgccagtaattttttgattattaaaatctttttaaattactaactttaaggaccaatgatttgctaaacgtcataaaatgactattgagggaaaaatctaaagtgatgaggaacgaatatgtcagaaaataacaatgataatgaaatgggaccacgccaacgccgctatcgtgaacagcaacagcgtaacccacatttgaaaccacacaaaaaacgtccttggttaattactttactaatcgtcgttgtcctgttgatcgttacgggtggctggtggggctacaagacctggaatgccgctaaggatacgatgaatacgacctaccagtcgaccggctcgaccaagcttcggaatgttgatgccgttattaagaagggcaagccattctcgattctactgttgggaactgatactggtgcactaggtcgcggcaaggacttctcagcccggactgataccatgattgttgcgacaatcaatcctaaaaaagaaagtatgacgctcactagtattccacgggatacgcaagtgatgatcgatgggcaatcacaaaaaattaacgcagcctacaccattgggggcgcaagtggtgccgtcaagtcagtagagaagttactggatgttccaattgacttctacgtcttactgaacatgggtggtttaaaacagatcatcaacgcgatgggcggcgtgaccgtgacacctaagctgactttcaaatacggtaatgccaacgttaagaaaggcgttaagatcaaacttaatggtgcagcggcacttgattactcacggatgcgttatgacgatcctcagggtgattatggtcgtcaaaaacggcaacggcaggttattatggccatggttagtcagtctaactcacttgggtcaattgccaatattgaaaagattacgaaaaaactcgctaagaacatgcgcaccgacttaacttggaatgacatggtcgcactcgatacgaagtacaagaatgcgtctcaccatgccaaatcatataccgttcaaggtactgacgcgacgatcgatgggctctcttatcaagttgcctcttcgtcagaacgttacaagaattcgaagcgcatccgtaaagcgctgggactctcaaacagtaatttaacagagtcagtcttctctgagacagcttcaattacaacgggtagctcaagttccagttcaagttcatcaagtaccacaacgtctagtgataccactacttatggcactagtacgacacaagatacaacgacgcaggaccagaccacgactcaagatcaaaccacgactaatcagtactaagcaactattaaaaaatgggtttcttcagaataaaaattctgagaagcccattttttgatgattatttttaattgaccggccaagattgtaaaaagtgttgaaactttgcttcgcgctgttcaattagatccggtgccggcaatgcttctagtgcagcaagttgggtctcaatcgcctggttgatcgcagcgactaatgtctgatcctgatggtcaataaccaggtcaactaagccgcgcgactgcaaagcgctagctgtcattggtaataaatcgatggcgtcactgctggtctgttgcccatgtaaaatcgcggtgactgcctcgggagaagcaacgttgaaaagtgcatcatctagcatgataatgcggttggcgttggcaaaggctaacgccccaccgctatggccctcaccgagaaatacaacaacgttcggtacggtcagctgaccagtcgccgcaatcaagtccgcaatggcctgactctgaccatagcgttccgattgggggctcgcatcagcacctggcatattgattaagctaacgaccggccacccaaatttagccgcatgggttacgactcttaacgccgtgcgatagccgggaacagttaatgctcccccgttttttcgacgccggctcgcaatatcaacaccccggtcaacgcccagaacagctaattggcgaccagtggcagtgcgcccaaagccagccgttaaagccgcatcctgacctaataaacggtctccccgttgttgcgtcattgtcggcaataacgcttgaatgatagtcggcgcactgatccgatcagccgcccgtaatcgctgtaatcgtttatccatgggctgacctcccaatcccataattcgctaatgcttgtcctagcgttgaccgcaattgaggtcgttcaacaactgcatccaccatgccatttttaaacagctgatccgccgtttgaaaatccgccggcagcttgacaggcaaagtttgttggatgacccgggctccggcaaagccaatcttagcacccgcttctgcgataatcaggtcacccttaaacgcaaaactcgccgatacgccccccatagtgggatctgtcagcactgtgatcaagggtaacggcgttgctgctaaccgtgctaattctgccagaatcaaattcattccgaccaaggcataaacaccttcttgcatccgagcaccacctgaggcggtcacaatgatcagtggtagccgttgggcccgcgcttgttcactagcatgcaataagcgacgtgtgaccgccgtgtttaacgtccccatcataaaatgactatccatcactgctaagatacagggttgttgctcaatcagggccgttccacagacaacagcctcgtttaacccggtctggcgttgggcccgccgcagtttgttcgtatagtccgggaaccccagctgattgacaggccgctcagtcatcgtcaacggctgaaacgacccttcgtcgacgagttgttctaatcgttgcgccgtcgtcagtcgttgccaatagtgacaataaggacattgctgataagtgccccattggcgttggtggacgtgccgaccgcacttagggcaggcttgccaggtcccagaagctggataatgactcatttcgacgcctcccaacgtgctagactgtgaatcgtgtactgatcatgaatgtaggccggccgggccaccgtttgctgtagaaaagttaagttcgtcgtgggtcctgtcaatgttacttgcgctaaggcccgttgtaagttgcgcacggcttgctgacggttcgcaccggtgaccatcaacttggcaattaaaccatcatacatggttactagccgatcgccctgatgataatccgtatccactcgtacatcggctggccagctcagcgtttcaatccgcgtctgcttaaccggtaaggtagcggtcaatcgagcttcgatcgccgtacacttgggctgcaagccaacatgctctggaaaatcaaccgtgacgccagccgcctgtttgatttgttcagccacaatatcaattccggtggttaattctgtcaccccgtgttcaacctgtaaacgcgtattcatttccatgaaatagaactgaccatccgcaaataagtattcaattgtgcccaagctttgataatgtgtacccgctaataactgccgggacagatcgtataaggtccggcgttgtgtctcagtcaaaatacttgccggactttcttcgagaaccttttgcttgtgcaattggaggctacagtcacgatcaccaagaatgaataatttcgtccccgtgccgaggacttgaacttcaatgtggcgggcagttgtcagaaattgctctaaatacatcgcatcgttcaaaaaggacgcagcagcttcttgacgcgcagcccgcaattgttgatggagttcatgaacgtcggtaagcactcgaatacccttgccaccgccaccataactggctttcaaaactagtggaaaaccgatcttggcggccgcgtgtttaatatccggccatgctaagccctgtaatgattgacctgctagtaccggaacggcttgttgccgtgcaaaatccttagcgcgggccttatcacccatcaacttaatttgctcagtctgcgggccaatccaggcaatgccacattccgcacacatggcggcaaaatccgcattttcagctaaaaaaccatatcccgggtgaatcgcatcggcgtgcgtattaattgcagccattagaatcgcttcggcatttaaatacgatccactggcagctgcaggtccgatacagaccacttcatccgctaattgtgtgtaacccgcatgccgatcagcagttgagcaaacggcgaccgtctgaatattcaattgttgacaggctttgataatccgtacggcaatttcaccgcgattcgcgattaacagcttgcgaaacatagctaccgatcctttcgcattgtaaataacggttgttcgtactcaacagtggcgtcgtcagcaactagtactgctgttaacgtcccatcggtcggactaactaatggattgaataatttcatactctcaatctggcctagttcttgaccagctgtcagtgactgaccaacctttaaatctggtgccaagtggaccaccccgaccatcggactcggcagtgtaacgacttcatcttcagtctccgcaactgtgctggcaggcgtagcggctacgggagttaccgtttctgaagctaacgctggttttgtcacttcaatctccaagtcgccggctttaacgcgaatttgctgataaccctgtcgcgcgtatttctcaactaatcgatctaaatcttttaattccatctgcacactcctacttcttgatcaagactgagccatacgctagcccgccaccaaatgctgttaacaacactggcccagttaaggtatcaaaaacattggctaaggccattgccaccccagctgaggacgtattaccataatgatcaacattatgtggaaacttcgtcattggtaacgccaagttagccgcaattttttcaatgatccgtaaattagcttgatgacagatcacgtattgtaaatcactgggtgtcagttgcgcactcgcaattaacccacgcatctgttctggaacaaccgtcgtggcaaattgaaaaacatcccgtccaacttggtaaaacgcatccgtttgcgggtagttcgttgcggcaacttcagtaatcggccgtactcgtccagagtgaatgaccgtagcgtttccttgcgattctaatttctcagcgatcaagctgttttcatctggattgtcagtagcttgtaataacgcgccaccagcaccgtccccaaagaagacggctgccgtccggtcttgaaagtccatcatcttggaattaacttccgcactgatcaccatcacattttggtattgcccactgcgaataaacttgtcagccgttgctaggccaaacgtgaacccagcacacgctgcactcaggtcgaacgcaaacgcattatcagcgccaatattagcttgcactaaacaagccgtcgcaggtgttaaggcatcgggcgtaattgtcgtaactaggatcaaatcaatggcactggcagctaaaccacttttttgtagtaactgctgggcgacctgggcggctaaatccgaggtgttttcatcattcatcgcgtagtgtcgggttttaatcccagtatgcgcctgaatccattcgtcgctagtgtccataatggctgctaattcgtcattatcaacaacgcgtcccggaacatattgtcccatggcggttaattttgtataagttggcatttttaaacccccgctactttccgtttcgattagtttaattttatcaataaaagcctatccgtcaaagtttacggctgtatttttggtaaatccttagaaacctagccaaaatgaaagaacagtggtgcccataaccgacacaccactgtccatcataactttgttaatacttatctggcgccataaagccatttttagctaatagcggcatcacatcaacccttttatccgtcgggactttctgcgcaaacacctttaatcccgctgcttgtaacgcatataatgcccgtgcttcggcttgaccgattgcaatagcattggtgaccatcaccatgcccgctgaaaaagctagactaccaatatcaatgcccgttttgctaaaatcaagtccccccgctactaagcgcgccatgttctggggcgtatcagttaggattagtggctttacttcatcaaatagcgagtcttgataaatctcgatcattttgtcaactgtaatcacattagctttcacaccagggggcgcggcttgcacaattagaatcttgcgaagtgcatcctgggcaacttcgtctgagacgaccaaaatacggttaggactgaccgtcttggtccacaccgtggcaacttgcccgtggagtagccgactatcaatgcgtgctaaacgaatatccatcgtcatagcggttcatcttccccatcgtcctgtaacaacttgagatgcttaatcccaatctttccagtctcttcaaggtgggcaatcacctcatcaattggcttatcacgaacagtgtaagcctcaatcagcattggcaggttcagaccggtaatcagacccatgcgctctgtatgttcggcaacgatccgactagcggcgttaaatggcgaaccgccccataggtcaaccaagaataagacttggtcatccgcgtcaaaccgggcaaccgcagcagctaatttatcagctaattcattaggttcttcgtccagttgaaaggtaaccgtttggaccttatcttgcttgccaaagatcatgtaggatgaatcgacaacgccctgcgcaaaactcccatgactgacaacgacaaatgctaacatctactttccctcctcagtcggttaaatctactcaataagatacatgcaaaaagcatgccaagttagtgtatcaactcatcgcgacctttgcctgatgagtctccaataattgcacaatataataattttcagcatctgagaaggttaactgtagttgatctgtcaattgctgattggcctgttgcacaagtgggtaccacttcgatgccataatgtctggcatctcttcggtgggtgccgaaatttcatctttgatggccgttcgttctagcgcacccgctaagtgcataatcaaatcaatgcgaaaagcattcgtcattacaccatccaagtgcgtcgcaatcacttcgctatactcccataaaattcccgttaacttcttaggatttaaaaacgtgaagtaatcgcctaagtaccgttcgcagagttccggtgtcaactgctgactttcttccgccatggtctgtggcgaatcgatccccgtcgctaactgatcaataaacttttcgccaccaccttgtagcaattcttccaatgaaataaaagggacgtctaattcgggttttgtaatcccagttgccgcaatgatttgataattttgactgatttgttgtatccgtgtcttcatttcgaccactgagattgggaataccgtgataccttcgataaagttttgagctaataaactgtctaaaattgacttgatacgttcagccgtcccaacgccggtcgcacaaattgcaataatcgcccgttgtgccgtcttatccgtcgctaaggcgggcttgactgttgcgcgctgactatccgttggtaggttccgtgaaattcgcgaataacctttgaaaccaacgagctcctgatacatagaatccagatcactatcgaccaggctagccttccgaacggcttccaaaacaaccggcgtggtcaccatgtcaatcgttcgcgtcgcaattcccgtctcctgctgaattcgttccccgaaggtcgttaacgaccccatatcgactagtaacaaaattcctttcccagaatcaagcttttctactcgtcgcttgacatgatcataggcgacactcgggtccatatcgagaggcatgtcgaaagcctgaacatcataatcatctaacaattgtccgacgacctgtgccatggaagacgcggtactcatcccgtgcgctgccaccagcacgccaactttgccgttaagctgcatcgattttaacgagatgagcaaaatggccagataataaacttcggacttgggaatcggtaaatgataccgttcctctaatccttgcttgagcgcctccgctgctttgatttcagccggatattcacgcaccatcgctaacatatccgaactcatttgacgcatgggcttgcctgcctggatgcgtttgataaaggaactgacgtgcaagctcacagcgtaaataaagttatccttgaaattataacctagcatgtcttgaaccgtcatctgcgccgtcttggtaaaatcaatgacgtcctgatcaacgatctcggctaacttgttttctggtgaaacttctaactgattttgtttataaaatgattttaaatgcacattgatatcggtcgtgatgaaacgattgatgtgttctttatcaaggccttcccgtcggagtaacgctgctttatcaccaataatctcatataaattatatggtaattcataattatcgttcttattacgaagcggcgttggaccatcatttggcttcacgatgagaaccgggtccaacaactcagagatggcccccagttcgtgacggttagaggctactgtcatgagaccgctacggatattttgtggcaaatcatccatcgtgattgtgatttcactgtcattttcgatgctattgacaaaaccctgggcacacaccagctgaatgttcgacttcaactgaccgacgttcccaaatgtgactgagccaagtaaggcctgcaccacgtcctccgttaaccgaatctgtttattgattcgattagcttccaatgacaataatgccttcagtaattctaaacgttccttggctgagcgatgattgaacgctggtagctgaatcgtaatcggaattcgccgaacaaaggtctgcagtagggtactttctgggtcctcggtcgttgcacaaactaagcggacattggcatggtgactcttcgccgtctcaccgagtcgtgaataagtcccgtgatccatgaaataaaaaatcatttcctgaccttctggtggtagacgatgcacttcatctaggaacaacatgcccccatccgcttcttggatcaaaccgtccttatcttcattagcacctgtaaaagaccccttaacataaccaaacaaatgcgacatcaataattccggattatgcgcataatcggcacaattgaacgtaatcaggccttgcgggttcgttaagacttgttgggtttccgcaaaacgatacatggcgtttgcaaagtaagttttaccagaaccagtcgggccaatgattaatgtatttaatccccgcggtgggtaaagaatggccgctttcgcctgttccacttgattagcaaggctctcatgcgagccaatcatgctggcaaatatatcatttacaaccggtttaggcacagacgtcgcgacgggcgctgtcggtattcgctctgtcgtcgctccattcgctacgccactagttgttgtggccgttgtggctgttgcattcaccggaacatagtgcacaggccgccctgtcagcttgtgcaactggccttctcgcaccagtgcatttaattccttgctgacgtttgaacgcgctatcattaaagcagtcgctaccatttccgtcgtcagtccgtgtcgatcgctatgttgacggacgtattcacaaatcttggattttctggtcaacttcgccactccttttcaccactatcaaataactgatccgttttgatacactataacacactatattctaccatagttcccgaatcagttactttttaagacttgtcagtacaactatttctgtttcatggtattgaaattccatttatgacgcaccttaacgtgctcggatactgcttttgatgcatcaaaaaaaagcttaagtatcaacccgcgctaaccccacccgttgatacttaagcttcttaaactaactattaaataatcaccaatccgtcggcaaagaaccctcgacagcattggtcattatttcaaatacttatcttttttacctttacccttgaatattctcccaaggacttggaaaaatgtcagtgattttacaattcgatcaggctcaatatattgccgaacggcccgtaacacttttttagggtccttagctgaaaaagtgatcataccattacgtttcgtctgaaaagagaaccgtggaatccagcggccaccaaacattacggatacaactacatatttcacctcagtccaaggaatttgaataaaattacgaacattgcgatcatcataaaattcaaaaccattatcaccgaccatgattttgccataatcagtcaatcccatgtgcgaattgccgttcgtaactaaatcaaccttagtattaattgattgcaccatactaacccctcctcgtatccattctcataccgattatacggcgagtctctatgttatgcaaagcacgcttgtaaataaaaaggatgagctcccacgagtccatcctttaaatatgacacaagcaagtattacatccaaccaataacgtgcagcagaaccccaaacacgaagaggcctagaatgataacgattggtgagactttcttctttaataaccacatgcagaggaaggttaataacaaggccattaagcctggaattaattgatccaagttgtcttgcaaagtggttaccttgtatttgtcaagtgaacgaccggcagcttgctgtgttaaggcttccttaacaccagaagcaccctttggtagtttatcccaatcaatgtacgacccagcttgttgcttaatggtcgaaaccttaaccggactgaagtccaccttaacccaccgttcaatcaatgccgctaagataaacatccccagcatggaggcgccacgggtaatatcttgtaaaataccaccagataaatcgtcggtaatcttagaaccggctttgtacccaaattcttgagtataccacatgaagcccatccgaattgcattccaaacaacgaagtataagattggtccaacaatactaccagaaatagccaacgatgcagctaaggcaccaacgataggcttaaccgtgtaccagaacactgggtccccaacaccggctaaaggtcccatcataccaactttaaccccttgaatcgtaacgtcatcaataggtgccccattggcacgttcttcttcaagcgctaaggtaacaccaataactggtgaagccacgtatggatgggtattgaagaattccatgtgacgcttcaaagcagcagcacggtcttctttagttgtatataatttcttgattgctggaattaaagaataagcccaaccaccgttttgcatacgttcgtagttccatgaaccttggaggaacgttgaacgccaccaaacatgcagacgatcacttttacttaatgttacttttttagtaatatttgtagtttcagacatctcagtttgcctccttctctaatacttatcgataatgtcgccaactggatcaccagtattagcgccaccgccgttgctaccagagttaccttgcttggaaagtgccaagtacattaaggctaaggaaatcccaattgcacctaaaccaatcaaagtaatttcactgattgcggctaaaacaaaacctaaagcgaagaatggccaaacttcacgagaagccatcatattgataaccattgcataaccaacggcaacaaccataccaccaccgattgataaaccatcagttaaccaactaggcatagcatttaacattgctttcactggcgtagcaccaacggctaaaatcaaagcggctggaattgcaatccgaagtccttgcatacagatagcaacccattgccagaagtcaatcttgctaaagctaccttcttcagcagcacggtccatgatgtgaacaatcccagttgctaacgtacgagcaatgatcgttaaaagtaaaccagcaacggccaaaggaacggcaatcgcaatagctgaggaaaccccggcacggccttgaccacctaaaactaaaataattgcagatgcaattgatgctaacgcagcatcaggtgcaacggcggcaccaatgttggcccaacctaaggcaatcatttgtaaactcccacctaagataatacatgggaccaattgtccggttactaatccgattagggtacatgcaacaactggttgatggaagtggaattcatccaaaataccttccataccagctaaaaatgatacaagtacgactaaaatcacttgaattacgttcaaattcatgatttaatcctccatcttttctgatattcttggaactatttttgttccttcaacatattttcagctttgttcaaaatattatccatattttccttactatcacttggaaccttccgaacatcaaattcgatgccatcttgttcaagtttacggtaagtgtcgatatcatcttgatcaaatgccaaaaccttgtttggttgaactttaccagccgaatgggccattgacccaatgttcaatgtcttaattggtacaccgccctcgattgcacgtagcgcatcttgtggcgtttcgaataagaccaatgctttttgaccaccaaagtgcttgtcgtctttagcaatcttaatcatttgagcaattggaataacgtgagctttaacaccagaaggcgctgcttgcttgatcatgttagtccgcagttcgtctttagcaacgttatcagacgcaacaatgatccgagtcgggttaaccgtcttactccaagcagtggcaacttgtccatgcaagagtcgcgaatcaatccgtgccaaaccgtatgttaacgttcctggccgaccagcgttattgttagtcgttgcagcggcagcagccttttcttccttaggtgctaatgcttcaggacgaaccttcacgccatccttagcagtttcaatgatatgcgtggcaatttcgtgtgccgaatccattgaaagtcgtgaagcatacgcttcaattaacattggcaagttcaaaccggcaacgattgcccatttgtccttgtgtgcttcaaacaagccgttaacttgattgaatggtgtaccgccccaaaggtcgactaagaataagacttgctcttgatcgtcgaatgaagcaatggctttttccaacttagccttgatgtcgtcagggccttcgctaggcatcaacgtaacggcttgaacgttttcttgttcgccgaaaatcattgatccagattgatagatgcctttagcgaattcgccgtgactagcaatgataatgcttaccatctttgtacctcctattttttcgttacagtcatataaaacgaataaataatatctaaattgcctgtaactatttatgtttttgatactgtaagcgcaatctttttcgcactcacttatatatatgcaaattccgtgccaaaatacactaaagctaaaagcccttatttcaggctcaaagttgatacactagcgcgatacagtattaaaaacgattattttgtgtgtcaaatagcgtatttttaatataaaattatgaaacagtaactaatgttaactatggtatcaatttcttaatagctcagtgcccgacgaccatttaattgccacatcgtctcaaacgcttggttacccatctgtccagattgaccacgccaaggatcattgtacctaatagttgccgttgtatatccagtgagcgtcactgtatgactcgcaaaaccatcgagtccctgaacccaagcgactaccggatgacgtttagcgagctgtgctttaagtcgttgcaggcccaccccgctgagatctacagcggacggcagatagtggcggatcgttggtaacaagccttgggggtagatgtagagaccaataccgtaagccgaagcaggatcaccaacaaaaccagtgttaggattcgaactgcgcggcacgtggctggcaaactgttccttattaatattaacgccggcatactgcagcatcatggtagtcgctgtcatctcacaccccgttggcaactccggtagctggtcaatcagtggtacccgcagttgaaccgacgccgtactggcgggttttagctgattagcagctatccagccgctctgctgataaccattatgcacatagtagaagcgttggtaatgcccgttgcgataaatatcagcttgctcagtacgcgtccactgtgtatgctggtgatactttaaatgtaaattaacacgcaattgggcacgctgatgacgcacgacggttaaatggtaaccgacaccgttctgactattcgtctgatagacccgcggctgcaccacctgaatccctgtaatcggataagtcgttacggccgcttgtgcggggtaaaccacgccactaaccagcaagccgcccaccaagatacgccaccaccatctactcattctaatcaatgcctggtcctcgccttctcttaatatcgtaatcagtagattaaccgttttcattataatgctggtaatcatgagattaaacaataaggtacggcaaatttggtgaacatagttgaagtagttggcaaaaaagcaagcctggaataacgtgaccagtccaatttaccgcaacaaaaaaagaatcgatccttcaaggcctaacctatcgaaatcgattcttatattcgttagtgcggccaagaagattcgaacttccaccgggttaaccccgacaagatccttaatcttgcgcgtctgccaattccgccatggccgcatcacaactcacaaaaaatatcataacaaaattttgcgagtctgacaagcttattttaagatttttgtacttttacaccagttgcatccattggcaataagaataattggccggtgagtgttgtatcttggctcaattgtgcctgcaacgtagcgagttgaccgtaatcacccaaagtaatcaccgtcggcccagcaccactcaaataagtccccgttaatcccagagcatgggcatggtctctaaccgtttgtagtgccggcactaacttagcccgatactgttcatggaactggtcctgttctagcagcggtaacgccacgtcccaattttgagttgctagagcagccactaacgtatttgccacactactaccagtaacggcttggtggtacgccaattcagttggcaaggcttggcgactggcggtcgtcaatagcggttcgttaggcacgtagacacttgcaaaaagcatcggtaacggtaacttcaccgcacggacgcgtccatcagtgttcgtcgccacaaccaagcctcctaatagggctggtgcaacgttatctggatgaccctccagttgagtggcaacttccagtagctcagcagaagagcgcgttgcgccggtcaattcgtttgccagcactaagccggctacgatggccgtcgagctactacccaatccgcgcgctaacgggatttttgaagccatctgtaaatgctgtggttgtaaatctggtaccaaatgcaacgccgttttaataattaagttgcgttcatccgtcggcacatccgccccaaagggatggtcaatctgccaatggtcactaggttgcaacacttgtagcgttagttgcatgtccagcgccagaccgattgaatcaaaaccgggaccaagattagcggaagtcgccggaaccgaaatcgttaacatgtcctcacctacgcattctttaaaactttataactcgctaatagttgcatattctcttgttcaccgatttcacgagtgatatctgctaactgttgatcattcatggcatgggtaatgatcacaacacgagcgttgccgtcacctaattgattttgaatgattcgactaaatgaaacttctgcgcgggtcataatcgccgtcaatttcatcatcatccccggcacatcacgcatcttcaaggcaataaagtgaggatacacaacatcttcaggcgttgctaagactgtctcctggcgataagagttaaacgtgttaccagtcgtattcaacgcaatatttttcgcaaccgttgtaatatcactcagcacactgttggcggtcgggagttctccagcgccgggaccgtaaaacatcgtgttccccacagccgttcccgttaccattacagcattattctcattttgtaccgtggcaagtggatgttgatcagaaacgagcacaggcccgactgataccgcaatgcgatcgtcaatttcttccgcaatcccgagtaatttaatcgtatacccaagctgatgagcttccgcaatatcctctgggctgattttcgtaattccctgaacttgaacgtggtcgagggaaagactcatcccaaaggcaaactgcgttaaaataatcatcttgaacgccgcatcaaggccttcgacatcattagtgggatcactttcggcaaaccccaagtcttgtgctgagctcaaggcttgatcatacgaccaatgcttagtcagcatctgcgtcatgatgtaattagtggtcccgttgacgattcccatgacccgttgaatccggtcagcggcgaaactattatcaatcgtccgtaaaattggaatcccaccagcaacactagcttcatagaataagtcgcgatgattttcacgagcaatctgaaccaactcccggccatattgcgcaatcaagtccttattggccgtcaccacgtgtttgccagcttgcaaggcttgcgtaatatattccttcgccggatgaattgaacccatcacttcgaccataatttgaatggacggatcatcaagcagggtcgcgatttggtcggtcatctgaacgtcccccaaatcaacttgttcgtgctttttcaagttgtggacaactacgcaggctagttccaacttacgaccggtaatttctgaaatcttttcctgatgcgcttgaagcatttttacaacgccggtcccgactgtgcctagtccgaccacaccaattttaatcgtttccatcttaatccctccatatcaatagttaagctaattctatcggaagcgtaccactttagcaaaccttttcagactaatttaattggcccctgacaacgaccacacgtatagcggcgagtgtccatgcggcgcttgcggtaataccgccggccacaccgttggcattcataaatataccgatacggccgggccgtcgcctgcttcggcgctggtgcatagcgcgagccacccatttgcgcgagtaatcgtttaaagtctgcatcacgatgccgatatccccgcttagtcaaatgtaaatgataatggcacaattcatgcttgatgacgccaatcaaggtggcctcatcaaaatcagtcagcatcttcggattgatatcaatatcatgcgaggccaactgataacgaccacccgtcgttcgtaaccgagcattaaaataagcgcggtgctggaacggacggtgaaaatcacgcatggaaatggtcgcaacgagctgctgtaactctaaatcagtcattatgcttcagccggtgcaatcatcgtcaaagcgatgcgctgccgctgttcatcaacttcttcgacccacaccgttacgatgtcgccaactgccaccgcctgacgcggatctttcaagaacttatccgttagtttggagacatgtacgaggccatcttgcttgacaccaatatccacaaacgccccaaagtcgaccacgttgcggacggttccttgcaactgcatccctggttttagatcactcatctttaaaacgtcttgccggagtaacggtgcgggcatcgtatcacgaacatcacgcccgggcttttgcaaactactaataatatcctttaaggtcagttcaccgacaccggtgctggtcgcaagttgcgctaaatctaattgattcaactgttgggctttagtcgtcccaacgtccgtcgtcttcaatccagccgctgccaataacgctttggctgcgggataactttctggatgaatatccgtgttatcaaaaacattcttgccgtcaatgattcgcaggaagccgaccgcttgttcataagctttcggtcccaaccgcggcacttttttcaattgtggtcggctcgtgaattcgccattttcatcccgataagtaatcacattttgggcaatcgtgctggatagccccgaaatatgcgtcaatagctccgaactagcggtattcaaattgaccccaacttggttaaccgcggtctcaatcaccgtatccagctgcgttgtcaattccttctggggcacatcgtgctggtattgccccactcccactgacttcggatcgattttgatcaattctgccagtgggtcttgtagtcgccggccgatactgatcgcactacgttgttcaacgtgtagctcaggaaattcagcacgcgccttagcactagcagagtacacggaagccccggcttcgttaacgatgacataataaaccggtcgggtcatagtcttcaatacctgtgccacaaactcctcggattcgcgggaagccgtcccgttaccaatcgcaatcatttcaacatgatacttctctaaaaaggttttaaactcacccgcagcagcttcccgtttggcagttggagctggtttgtgtggataaatcacaagtttatctaagaacttaccattcgcgtccatcacggctaatttacaccccgtccggtaagcaggatcgaaccctaataccacgcgaccctttaatggtgcctgcattaataagtggtacaaattatcgccaaagactttgatggcctgttcattggcagccgcactcaattcgttgcgaagttcacgttcgatggctgggccaataaagcgtttgtaggcatcctgataagcagcttctactagttcaatcgctgggccgtggtgctgaccaataaagcgaaaatgacaataccggtcaattccagcacgatcaacatcaatgctgactttcaatactttttcggcttccccacggttgatagccagtacccggtacggtaccatctgcttgatgggactattaaaatcataatactgttggtaaacaccttgttcatcggctgctttacccttgggtttcacttttgcgactagcaagccccggtcacgcgtataattccggacccagtttcgtaaaccggcattatcaccaaaggcctcagccaagatttcgtgagctccagctaacgcggtattcgcgtctgtgatgtcctgcgcttcgttcacaaactgcgccgcgtgttcctgaataccacttgccggaaaacgtaataaccaagctgctaacggctccagtccagcatctttcgcaatcgttgccttcgtacgtcgcttctgtttgtacggtaagtacaaatcttcgacatcttgcaacttgtcagctttttcaatggcttgctttaaagccggcgtcaagtgatcttgttcagcgatcaacttcatcacatctgccttacgactctctagactcgcaagccgatcatagttatctttaatttcgcgaatttcaacttcatctaaattaccggtacgttcctttcgataccgtgcgataaacggaacggtgttgccttcgtccatgagtccgagaaccgctttgatctgttgcggtttaaacttcgtcagcgtttgatcaactaacgttaaaatctgattatccattatttcacccaatcttttaatctcattacattatattatacgcgttttactccggtttccgcgccgaatgaccatctgaaaattgtcgttgactgtcactaccaatcgaagccattaccgatactgttcacacattggttgtgagctggaaaaaaccagcccattaggctaaacgagcacggcgcggccgcacagttggctgccccgcaaccaacaataaaacgctcggcaacgcataaacgttaccgagcgttttattagtgtgctaaatccaatcacccagattagcgctcctacatgactgtattcatgatccgttgcacgttatttgaaacgcggcccatttcagtctcttgatccgtttcagcctgattaaaagcagccacatcaatcgtttgatcgtcgatgttcatgctagccgtcatggccgcacacgcattcgtgtaggcttcgtatgctgctaacaaattacgatgccgccccattaaccgtgcgggtaccgcaacttttttcaactgtgccaaattttgttgatactgttcagtaccatcgctaaattccatctgaatatcattgaattcagctggaaccattttggcaactgcgtcattatcaatggcctgacgtagtttttcaaaagatgggtttaattcttcccccattttttcagtactttcgataactttagacagtactggcatatacgtttgaatcgttgcttttttcatgtacaaactcttttctttaaattagttagccttattttacccctaatgggtgggttatgcgcgccgcatgtgtcgacgttggaagaacttaacaaattcaacaatcacgaccatcgataaggaagctaaggccacgattccccattggtaagcatccaagtgactcacgtggaataacccattcagaccgggaacgacgattgtcatcgccagcatcacaaatgcaactagaatcgcccaattaaagaacttgtttcggaacaagccgaccgtaaacaacgattcatgaatagatttggaattaaacgcgtggaacaactgaatcaagccaagggtcgcgaaagccatcgttaacgcatcagcatgagctaatgaggccgttgcgtgaaccggatacgtcaaagctaaccagtacacgagcaacgtaatgccaccttccagtagcccttgataaataatactgctgaagaccccacctgagaagaaattagaatttctcccgcgcggtttatgctgcataatgttcttttcagttggttcaacgcctaaggcaattgctggcaaggtgtcggtcactaagttgatccataagatatgcactggtgccaagatttgccagcccaacatcgtcatcacgaacaaggttaagacttcccctaagttcgctgacaaaaggtactgaatcgccttttgaatattggcgaacacttttcggccttcctcgacagcaaccacgatcgtggcgaagttatcatcagccaagaccatgtcactagcccccttggaaacttccgtcccagtgattcccataccaataccgatatcagcagccttcaaggcgggcgcatcgttgaccccatcaccagtcatagcaacaactttgcctcgtttttgccatgcgttcacgattcgaactttgtgttcaggcgccacccgggcatacaccgagtaatcgccgacctttttgccgaattccgcatcactcattgcatctaactcggcaccagtaatcacagcgtcatcttcgccagcgttaatgataccaagacggacggcaattgcttcggcggtatcacggtggtcacccgtgatcatcaacggccgaattccagctgatttagcttctgcaacggcttgctcaacttctggccgttccggatcaatcatgccgaccatcccggcaaagaccaggtcattttctaacgtctccgtattaacagtcgtcggaaccgtggtgatcactttataagcaaatgctaagacccgtaaggcttgcgttgccaattcatgattaacagttagaatctggtcacggcttgtcttggttaatggctgaacgtcaccgttactttcaatctgagtgacccgtttgagtaattcatcaggagcccccttgacggctactaagaagcgaccatcttctaaggggtgcaccgtcgacatcaatttacgttccgaatcaaaggggacttctgttactcgggggcggtccgtcaataactgatcgactggataaccctgatccaaattatattgaatcaacgctgtttccgttgggtcacctgctaacccatccggcatgatcttcgtatcattacttaaaatcatcacttgcgctaaatggctatcaagcggcaattcagtagcgcgcgcgtccaccagttcctggttgacgaccaacttttcaacggtcattttgttttgcgtcaacgttccggtcttatcagaggcaataatatcggtacttcccaacgtttcaactgcgggtaattttcgtactaacgcatgccgtttggccatccgctgggttcctaacgctaacgtgatcgtaacgattgccggcaacccttctggaattgcggccacggctaacgaaatcgccgtcaataacatgttgatcaaactctcttgaccacgcagcattccgataccaaataccactgcggcaataactaagattaaaatcgtcagcgacttacctaactgtgtcaagttcgcttgcagtggtgtggtcgtctcatcggccgcttcaatcatgccggcaattcgacctacttcagtctgcatcccagtcgccaccacaatcccagtggcccgaccatacgtcacgttactattcatgtacgccatgtttaaccggtccccgattggtaattccccatcggcaatcatctccgcctgcttctcaactgggacagattcacccgtcagcgccgattcttcaaccttcaatgacgcactctcaattaatcgtaaatccgcgggaacgatatccccggcttctagcgacacaacatccccaggaaccaacgcgtcactcttgaccgtttgcagctgaccatcccgtaaaacagtcgcgtccggcgctgacatttccttcaacgcgttgatggcctcttccgctttcgattcctggaagacaccgaaaatcgcatttaataccaccaccaataagatgataacggcatcgacggcttccccagtaaaggcggcaatcaaggcggccactaacaggacgataatcatgaaatccttgaactgcgcaataaatttttgcaacaaggaagtcgttttttgctgattcaacgcattcggcccatattgttctaaccgttgcgacgcagcactttgctgtaagccgtgttcatcagtgcctagttcctcataaacggcggataacgcttgttgatactttggttttgtactcatcgtaagctccttttctggcatccgagccccactccctaactgatctccagatagaaaatgagactcatgtatgcacgcaaaattgtgtgaacatacataagtctcactatttaagacaataccggattggcttcttgctgacgatattgccgcagaatatttctgctagttactcccttatgattgtatcgtaagaataccagattccatgggagctgtctagcaaaataatcgctttgactacctctgcattcgccacagcacttggatattctcacattaagcgtttacatattttaaaccattctaccgcttttccaccaatcccaccaatattacggtagtcaccataaaattatgtgactatgcaaaaaggcgacctgaagctgaataatcttcaagtcgcctttttaattaggttagccgtaatcctaatcgattatcagctaactagcttatttccaaaaatcatcaaacacagtgatggccgcgtggcgtttgtgggcagtctttaagtaccacgcctcaatcttttcggccgcagcatcgctgaccgtccggccttccaagtaatcgtcgatgtcgtcgtaacgaacacctaacgcgacttcatcaggtaatgctggccgatcttcttccaagtcagcggtcgggactttgtcatacaaatgcttgggcgcatctaaagcggccagcatttgtttaccttgacgcttgttcaatcgccatagtggcacaatatccgcaccaccgtcaccgtacttggtataaaaaccagtaacagcttcggctgcatggtcggttcccacgacagcaccgtgcatttcaccggcaatcccatattgcacgatcatgcgttggcgcgctttaatattgcccttgttgaaatcatgaatcgtcaattggttagcttccaatgcagttaccatggcatccgtagccggttgaatatccacccgatccgtcacgtcggcttgcataaaatcaatcgctgccatcgcatccgcttcatccgcttgattgccatatggtaaccggactgcgatgaattgatagcgatcatcacccgtttcctgccgcatttcggtaatggccatctccgtcaattttccagctaacgtggaatcttgaccgccagagatgccaagcacataggtcttcaaaaaggtatttttagttaaataagccttcaaaaaatcaatacttcgacgaatctcaacttctggatcaatcgttggtgcaacgtgtaacgctttaataatctcagcttgtaatggccgcattagtaagcttcctcctcatctttatggttaacgtggtctctgaccgtgttaataatattcattttatgatcataaagtttttgtgacaagtcgaccgggtaatcctgagggtttaaatcccgcttgtattcgtcccagagtgcatctagactttcaaatgaatactccttgatttcatctaacgttggtaaagtataaacttgttgaccgcggtcatagatgggaaccaatagtggtcgcgcatcaaaatcactgaccgtcttattaatatacgtatagcttggatggaacatgtaaattgattcttcgttgcgcggatcttcatcgtacaacgtcacatagtcaccttctgacttgccatccgcacgcttcgtaatccgccaaacttgtttttgaccaggcgttgagaccttttccgcgttatttgaaagtttgatcgtatcaaccatctgatgatgatcattctcgatcgaaaccatcttgtacacggcccctaacgcgggttggtcaaaggccgtgattagcttcgtcccaacaccccagacactaattttagcaccttgcatcttcaagttttggatcgttttttcgtccaaatcatttgacgcataaatcttggcatccggaaaaccagcttcgtctagctgttcacgcacgcgttttgataagtaagccatatcgccactatcgatacgaaccccttggaaattgattttatcacccatttccttagccactcgaatcgcactcggcaccccgctacgtaacgtatcatacgtatccactagaaagacacagtcatgatgggtctccgcataggccttgaaagcttgataatcgtttcgataagtctgcacgagcgcatgcgcatgggtcccgctaatcggaataccaaaaattttgccagcccgcacgttactcgtcgcgtcaaagccaccaatataagccgcccgggttccccagatggccgcatcaaactcttgcgcccgccgagtaccgaattctagtaagccatcttcaccgacaaccgatttaatgcgcgccgctttagtcgcaatcaacgtttgataattgataatattgagtagtgccgtttcaattaactgacaagtggccagtggtccttcgacttgtaacaacggttcattattaaagaccaagtccccttcacgaaccgcacgaatcgtcgcatcaaatttgaaattcgctaaataatctagaaaaccgtctgagtagccacccagttcacgtaaatacgcgatgtcagttgccgtaaaatgtaaatgattgatataattaacaactcgttccagacccgcaaataccgcgtacccattttggaacggcatcttacgaaagaacacttcaaacaccgcatgtttgttgtgaataccttgttcccagtaggtttggatcatattaatttgataagcatccgtatgcaaggtaaaactatcatccggatagatttgcgtcatgagtataattctccatttcgtaggtaataaccgtgtttacagtaagttaagcttattttagcattttttataaaagaatgcgcttaagcatccaaaaagttgcagaattccttgatttacctatactttaattatgattagaaagtgaggtcgcttatgtcagtcccttttgacacggttaacatcttaaacgtgccgtttatcaagacaactaacgctggttttgttcagcaacttcaaaccgatattctcgcgcatcgcaatcgctttgtggtgaccgctaaccccgagatcttaatgtacgctcgtgaacaccccgattaccaacaggtgttaacgcaagcggactatatcacgccagacggcattggcgtcattcagggggcccagattcttggcacaccactccccgaacggatcaccggctatgacacccttttaacactactagaatggggtagccaacagcaccaacggatctttttgttaggtgccaagccggccgtgttaaagcaagtgaccacgatcgttcaacgagattatcccggcatcgttgtcgcgggtgcccgtgatggctattatgacgacgaacaaaccgttgtcgaccaaatcgtggccgcgcaacccgatatggtcttcgtagccactggttttcctaagcaggaatttttcatcgccgaacaccgccaacgcctcgatgcgctctggatgggtgtcgggggtagcttcgacgtaattgcaggcgcggttaagcgggcgccgttattttggcaaaaacaccacgttgaatggctctaccgtctgattcaagaaccaagtcgtttcaagcggatgctcgtgttaccccgctacttgcggttagttaaaaaaatagcgcgccagcaagcccattaactggcaatcattaccagttataagccactgcgttacgatgacaattgcttttgtgcgtgtacccagtcttcagtcataaatccaaaaatagctcacctagaataacatcctaggtgagctatttttggtatcaccactctaatcaggtgcccagcacccgactgactggttatttttcaagataaaactcaaaccggttaccaacgtactgggtccgcacgtattcaaacggttcgccggtttgcaaatacgaaatctgccgtaaccgtagcaacgcatcgccacgccggactgacaagtattctgcgatacgctcagaagcagacatcgccgaaacagtctgttgagccttaccaggcactaaacttgccttctcttccaacgtccgatacaacgaactcgtaatttcgtccttggtgaactgcttgacgagtcgttctggaactgttgcgacctcaaaacaaattggcacatcatcaccatagcgaattcgttccatccgtagaacttgttcgttggcgcctaacgccaacttttcgctctcagatagcgacgggctcgtcacgtgatatgaaatcgtcttacttgatgggaccttaccctgggccagcattagatcagtaaaactggtgacaccggacattttttcttggaccttctgattcgcgacaaacgtgccggcaccgactcgccgctctaatattccttcgtcaaccaatgtctggattgcttgtcgaagggtcatccgactaacatcgaactgtgtagccagctcccgttcagacggaatccggtcaccaacggcccaccgacctgcttcaatcgcctgcttaatttggttgtggatttgaatataaattggcgaactcatggtactcatcccttacttctaatttatttagctgcttttttaccgtagctatatgttgcgactaaatcttgattgccatctaagatgttgatatcagcatctttaccggcttccaatgttcctttcttagtcaacccaaattcacgtgcttggttgacagaagccatcttaaccgcttcagcaatgccgcaaccggtgaacttctgaatgttcttgaaggcattaatgaatgtcaggacagaaccagccaagttaccttcttcaagacgtgcttgaccatccttaacaatcactttttgaccacctaattcactgataccgtcgggttcacccttggcacgcattgaatcagtcaccaattcgatccggtcaacgcccttttgttcgtaagcgagcttgatcatgtcaggcacgatatggaacccatcacagatcaattcacagtacatgttgttttcaagcatggcatgaccagtaacacctggttcacggtgcttgaattcacgttgcgcgttgtataaatgcgtcacgtgagttgctttacttgctaataattgttcacgagtcgcgttactgtggcccactgaaggcacaatgccactttccaagcagtacttttcaaattcacgcgaaccaggatcttccggcgcgtaagtaatcaacttaacccgaccacccgacaacttgttccagttgtctaataagtcaacgttaggattcttaatgtacttttcaggttgggcacccttaaacgtcgccgaaatgaatgggccttccaaatgaaccccttggataaccggattttcatcggcggccttgttaataccggccatcgaatgatctaagttttcgttggattgcgtcatggtcgtacagaagtatgacgtaataccttcgcgggcaaccatatcattaaccatttcgttaatttcagctggattcccgtccattgaatcaaaactataaccaccatggctatgaacatcaatgaagcccggtacaatcgttttgccactcacaaattcgatatcatcatcgggttgggccacgtagtcatccattggaccaaccgcttcaatttccttaccgaaacgaatgtagccgtcatcgatcttttctagaccagtataaatgatggcatgttttaacactttgctcatgaacaattcctccttggatttatctggtttaattataatcggtatagaccaaacttgcaaccactagcaccaagtaatttaagattcgccaagttccttcgcaatcgtcgcatcaattcccttcaccactgcggtcataaagccggcctcttccatggccagtaatccagcaaccgtcgtgccaccaggtgaagaaacttgatcgatcaggtcaaacggaattttatcagaagctaaaacattctgcgcactgcccagcgtggcctgcgccgcaatcttagtcgctgcatccttgctcaaaccgtgcttgacgcctgcgcgggccatcgcgtcaataaagaaatagatgtaggccggcgaactacctgctaaggctgaaaaagttggaaaatctttctcagcgatggcactcgtggcaccaatcgcatcgaataattgttgcccagccgcatattgctctggtgttaaggcatcattaccaaccaacgccgtcatcccggcaccaatcgccacattcacattcggcatgattctcagaacggggagatcagggacaaccgtggcataatcggccaaactcaatcctgataccattgtaataacccacttgcccgttaaagctgcttgaacttcttttaatgcggccaacgcaatgttcggcttaactgccaaaacgataacgtcagcagcttgtgccacggccaaattagtgtcacaggcctgtagcccatttttttgcgcataaggttgataactcgcagcatgggcactgtgaatataaatatctgctgggacgaccgcttgttgttttaaccacccatcaataatcgcgcggcccatgttaccggcaccaatgaatccgattttcatccgtaaaacgctcctctgacttataatttatatcattaaccactaaccgattaacggctaggcaggattaaacagacattcccgcttactcttctactataccaatatttgtgaaactgtgggtaattaatcacttctttcagctcaactttcactatcaacaaataaatatcacgagccactctattaaggtgattgcttatcaatactgaaaccaattgattaatctattaataatcggccttcaatatgtgcgaagctcgttgacaggtctgcttgaacaagctaatgtaaacagcaatcaaacacagcgttgcttccgaacacggctgtctaaaaacaactaaggagtgtttcactatgaaccagaacaaccatttccgactcaccttatcaaccctgctgcaacaatgccagcaagacatcactagtctgcccacggccatgtgcgccgtcttcagctggcaacggggacttaatgaattaaagacgcttcgccgcaccactaagttgatgatgagcacgatgctaatcgtgaccatcattggttttattctgggtcgcgattacagcctacatggctggattggcctattgaccgggattacggtcgtgattaacttaattctggttgatcaagggcgactgacgaactatagttggggcattattgcctgtgcggcttggcttactacggccatcaccaatcggctgattggtgacattgcgtcgcaatcattttaccttatcatgcaatttgtcggcatcaccgtctggcatcgtaaaatggcagcgcaacccgatgccagcgaactgactggtcgtaaattgagcaaattagccggttgtgcctggttcgcgttagccgtactcgtctacgccattgtcttacactttagtaaacaacttaacggtaaccaaatctacctggacgcgaccctgttaccacttgggattgtcggtagtgtcctcatggtcaacggttatcgttcccaatgggttgcgtggatcacactcgacgtgattaacgttattatctggttcaaccaattaaaaggcttcagtcctgcagccgcctcaatgttagcattgcaactagtgatgctcgctaacgcgttatatggtgcctacttgtggttcttcggtcaaaacactcagcaagataaactagatacacattaagcaagctaactggcaatcaaaaccaagcactaatcgcttcaaagttaaacacataactttgaagcgattttttatttgggttaccgttcgggtggctacatccttatctgaaaaatgtctatcagtttacatttagcgacgagtttgtttaagttagaactaattaactgactattgagggggacgtttaccatggtgacagtcgttcgtcgcacacttcacgataaaatctttattattgcattaatttgtgctggtttaagtttgttcatcgggacaccccaactgacggcaattaattgggctacgattggcaccttatttgcactcatgatcagtgttcaattacttcgcgcgatgtatttgcttgatactttaagggactggctcttagttaaatcacacgatacccgtcaaatgtgtcaattattcatcttactggcctttggtggctcaatgattttaactaacgacgttgcgatcctaacgttaattccaatctttctcacactcgcccggcggcagcacctggccattgcctacccaacgactttaattatcatggcagccaatcttggtagcgcgtttacgcccattggcaatccccaaaatttatttttggtcacgttctatcacgttaatctattcacgttttttaaattgtcgactccgttaatgcttgctagtctagctttattagttgccttaagccggcggttacctcggttgccgctaactgtaacaccaaccaaatctacgcccatttctcgcagtcaaatcgggcttgcgggcggcctgctcagtttcattatgcttggcatttttaatttggtgcccatttcactagttattatcggaacgattgtcgtaggcctcatgattaaccgacgcgtctttcagtacgttgattacgcactactcttaacctttatctgcttcttcatcttcgttagcgccatcagtcataatcccgcaataacgcattggctcaaccaattaactcagacagcccccagtgtctatattactggactaattactagccaagtcatcagcaatgttccagccgccatcttactagcgaatttcacgccccatttatcagcgctatttttaggcgtcaacatcggcggtctggggtcattggtggcctcactagcaaatctgcttgccttaaaacaattgttgcccttcaatgatgaacaaccaatccaccattttttgatcgtgtttacggccctcaatggacttggcctgttcattttaggccttggtggctggttctatttacacctataattcagttacgctgagtaacgattcagtgagaacttgcaaaccaatcaacttgaaatagtgcgaaaaccagtaactagcgtgacatcataaaaggagcagtctcaatatcatgtgagcctgctccttttacgttctatctctgagatgtttagtgatacttagtgcgcctgatccaccaacatggccggagtgacgatttgctgaccatcgtagcggtgacccttgatcacgcgtttcgccctgacaaattcaccatcgaccgtcagcgttaacgcacaaattccaccatcaaacaggcctgaacgactgcctgcatcaattagatatcgtggaacgtcttgcgcatctgcctgcatctttaaataaccagtgtgtgaaccagtcaaggtctgcaccggcgtatgaccagtaatgatgactttattgaataagttccgatgccaacggtgactgccagtcgtgaagtcatcataatagtcatcccgaatccacagtaggtcagtcgttgtttgttgtgttaatgggtattgccagttaacacccgcgtgcatagccagtaaccgaccatgttgccacatcagtggcaaatgtgctaagaaatcagtatccggctttaatagcgcaccatttaatgcccgccgaacatgattgggattggaggagtaaatccctaatttgcgccaggtccggtgaccaccgttcaacacccaagttgcggtggcattgtcatcaccatgagctgtccgtagccaaaattcatcatgattgccaagtaaagccacatcgccgtattcccgtacccgttttctaaccatcgtcagtacttttagcggcgccaacggagctgactcggtggcatgaccaaaatagcgtgccgccgtaccatcaatataatcgcccaagaaaatcaagcgcgtcgcggtaacttcaggatcggctaataaaactgccagatcatccgcggcactatgaatatcaccaataaacgtatacagcggcatattactccctccgtctcatcgataaccacgtgcattagtcgggtttaacgaccaccaataacatctgaaatccttgaacggcatataacgcgtgccgggcatccttaggaatcacgatcgattgtcccgcagttaaatgataaatggtgccttcaatcgtaatttccgcttctccacttaaaatattgaccatcgcatcgccctgggcagaatggccgccaatctcttggtcggttgcgactgaaaatagcgtcatacttaaatcatcccgttgaaccagtgtccggctattaacttgatcatcatccagtggaatttgttcagttaaattgaggaccttagcatgatcaattttgttaattaaactcatttgaattcctccgcatctcgctattaaggcctatttcgtttctaattgaataaactggcacggctgctcagcgaccaacgtatggaccgtatgagctggcaccactaacatctcgcccgcatgcacttcttggtcggtctccgtcgccaaacggacggtcaaagtaccatcaacaacctcaaataagcgggtcagcgtggattgttcagcactaatactttcacccgccgccattgcgtacatcgcaaacggcagttcaatccctaattttcgagcaaatgatttactagtaattgcatgctcctggtaagtcatcgtggtttttaaatcaattttagttaccgccatttcaaatcctccttggtcatcatcatggtcgcttacgttattcatgatggtatgatttcttaaattaagcttaacgctaacaaactcaattttcgaggttcgattgaataaacatcttataattctgaataactgactgctagtcatatacttaataaccacgtcatctctggcaggtaaatgcctttgaatccagatatgggccatgcaaaaaagctgcccaaacattattgcgacgctggacagcctgccgttactgaatttgataacagttctgtggaaaatttgatttattcagtcaactagttggggctggtagtgggacaactaaggctacgtagcctcttcaaccaaatctcatagatcaagttccaatacgacttattttcgataataagccttggcccagcagttgcgacgctcccgacaccactgttcaaaagtacctacaaacatttggacatcttgcgcaggaattagttcttccgttcgctgcatgtgcacaatatcagatatcaccggatcaaaagtatacgtaacaaccagatgttgtgggattcttcgaataatcccaccgttacgagtaatctctaatcgcatcgtctccagctcaagttgaacttgcgaataagtctctctggagcaataatcgacaacatcatactgctcataacatcgtttataccaggcatgcgaattagccggcaaatcatcaaattcaccacgattcatacgatttcgaacagcacggctagcgcgcttctttccataacccatatgtgctttaaaaattggtgtgcttttataagaacgactcataataattgtgatggccgtcatgacgcgttaactagtacgtatttttaaaattaacaatgccagccattaacctcttccgtgtacttacggaataaataaattcattgaccagacctcctatcccatctggatcgtgccccaaatagaatactaaaacatatcacattattattgatgatggcaaataaacagaccgagacaaaaaaatccacttcatgaagaatccgttacgcattcttcacgaagtggcactacccgccgatattaagataaatttaagccaataaaaaagtcgttacatcaagatcctaagacctgattaacgacgaaaggcgtaacaattgggctagctgggttcgaaccagcgcatcacgggatcaaaacccgttgccttaccacttggctatagcccaataatgaaatggaggggagtggattcgaaccaccgaacccgaaggagcggatttacagtccgccgcgtttagccagacttcgctacccctccgtaaatcattcaactatattagaatacataattttgaataaaaaatcaagacttttttcaaagttttttcagtttttatttcaaatccagaatttgcgtatcttgataccactccgccataaaattattggcttgccattcattgatacgcttgagtccatagcccactgcttggtcataataggtggtctgaccaaacacccgcggttgcggatggacgtgcaaatgaccaaataaaacgtgcgccacgttaaactgctccaacagttgtcctaaccggggcgttcccattaacgcgttagccatattccaaaaccgattatcatcagaaaaacgcaaataatcgatccggggaacaaagtgcgtcataaaaataacttgcttgtgatccacagcagccaagttaagctgcgcttttacttggttgagcattaaatcagtccgctcctgatcgctcatcggctgtttaatagcccggtcgatccaaaacgcattcttccagtgtaagaagtcggccgcagtcgtatcagggacctgggcagcatactgatagtcataccacccattatgtccaatcacgcgccaatctgtaccagaaatatcgatataccggttatgcaggtagccatcaaaataccctgtttcaagctcgtcaaacgaaatgccatggaccatgtcatgattacccgcaatccagtaaacacgcgtctgtgcgcctaatagggcctgtaaatcgacgacaaactgctgactacgctgaaagtcattaaaaagatcgccagcaatcaaataaatctgaacaccattctgtaaaagataggtcgcctgagatcgcatcatcgcagtcgcatccactcgattaacatcaaaatgattatcactactgaaagcaattcgtacgatggtcaacccctccaaaacaaaaaagatatgctaccactaagataacatatcttcgagtaaatattcaatttagcgaatgccttgcatcgaccgtttaatcattggcaccatcataaagaggataatccctaaaacgacactaacaatcccggtaatcgcaaaatatggcacttcggtttgcgtcgagtagaaacggacaatctgtgcattaagcgcactaccaaccgaatcagttaggaaccacatactcatcatctgagaagcaaaagcctttggtgcaagcttggtggtaactgataaaccaattggtgaaatcaacatttcagcaatttcaacgactgcccaactggcaactaaccaccatggactaaccttccctgcagttccaaagagcgctccaggtacagccatcactaggtaagaagcccccgcgaatagcaacccaatcgcaaatttagttggtgaactaggttgttttttaccccacttagtccacaaccacacgaatggtgttgtataaatcatgatgaacaatgggtttagcatttggaaatcagaagcagctagatgggtaaaaccaagatccaaattaacccgattagctgcaaataacgcaagtacggacgaaccctgttcttcaattgcccagaataaagcagcggcaataaacaatgggatataagcccgaacacgtgaacgttctgttgcattagtcttgtcagacgttaacatcaaaataaagtaaacgattggtgtcaagataacaagcgtactaattaaactaataacatttgctaacgtaagagcattcattaattgcattaatagtagaatcaacccaatcccaacgattcctaagattgtccaccgcatgattttttttaaatcaccgggttctaatggatcagttggatagaggctagcagaacttaaattcttcttaccatcaaagtagtattgcaatagaccaaagaacatcccaatcgcagctaaggagaagcctaagtggaagttaacatttaagccgatccgaccaactaaggctggtgcaaccaatgaacctaagttaatcccgaagacgaaaatactaaaaccagcatcccgacgtgtatcttccactgtatacaattgaccaaccatgtcagagacgtttggctttaataacccagtcccaatgacaataagtgcgattgaaacaaatagtgcaccaactccaaatggcgttgataaaacgatgtggcctaacatgatgaagaccccaccaataaagacggtcttacggctaccccagacacggtcacttagaaagccaccgaggacactagaaacgtaaactaatgccgaatagattgacataatggatgctgcggtgacttggtcaaatccaagaccacctttagcgacactgtagtacatgtaatagatcagtagcgcacgcatcccgtagtaactgaatcgttcccacatttcagtgaagaacaacgtccgtaagccacggggttggccaaagaacgaccgatccagcttttgttccttatccaatagagattcctccaaacttcttaaccagtttgtatttcgtttaaaagtaacaagttttgtttcttaattaaacataataactattatactagccttaatcttaatcaacaatagcactaaccgttttctaatctaataaccattaattaaattaatatccaccatacataaatagtcttaaatccttttatagcaccaaaaactagttgatagaacattttataaggcttttagctttctaaaattaacactaaattctaatttaatataaaataattaatagcattcaaatgctgaaaatacgcaattggtattaaaaatctaattaaacaaaaaaaacaaaactgaaattatcaacaataaagtaccgctattaaaatggctatgattgttcgcagcatgtaatttacagttattgcgactaattataataaaccgcaagattgatatgctaagcatacctaaaaagcagtggcgacaataggcatcatcctactaagcccttacgatcattttgatacttcggcattcaaatagctaacattcttatatcaaaaaagcagctttgcgtttgcgcaaagctgccaatcattttatgtctatttaaaaataaaaaggcgagaaccacgtcccacctcacaagtgccggctaccagagtcgaactgatgaccctcggtttacgataccgatgctctaccaactgagctaagccggcatgatataaaaatagatgttaacacaattgccaacatctatgtcactccgacaggcgggctcgaaccgtcgacatcttgattaacagtcaagcgctctaccaactgagctatgtcggaataatcgcatggcaacgtcctaccc

SEQ ID NO: 5 - DNA, 208152 bp, synthetic construct
  source 1..208152: mol_type = other DNA; note = Lactobacillus plantarum PDG8 -Contig 5
gttttctgtggttactaaatatcataagggaaggcattccctatttctatacaattcagaaatcttttatgcatttacacaagatattttacgctctctttgataccagtgttactaatactttttctaagaagtattagtaaatttatggggattaatgcggattttctttttagttttagtacccgagcgcaattggtaaatttaaatcgtgctttgaaatttgcacatcctgttgctgctgttcatccaactgcttactcgacgttatattcttgttttgcccatttgggtggcgatggcatgttactcgcattgataattgtcgtgctcatcataggaaaaaatcaacatttgaaaaggttattgacttggtcgttcataccgacgttttttaacttctcagagccagtgatggttggctttccaatcatgtatatgcctatttatctaattccttttataatgagtcctttagtaacgacagtcattgcttatccgtttttaaagtacaatattgtcccagcgcctgtttatccagtgcctaatggtacgccaggactgttgaaagcttttattgccactgggggcaacattccgaccctactattagcacttctttgcttagttgtctcttgttttatatatttaccgtttgttaaagcagagatgagactaattaatctagagcatgcgaaaattagatcttcttttaaaagataaattttgaatttgtgagtctagaggataatagacggagtgattaacttgcgaatctcaaaaaaaattattatttcaataggcctattatgcttccttatgacgttaatttttttgtccgataaatggactaaacagaatatttcaaatttgaagattcaacgaaactcagttactgaacccatagttttggttccaggaagtaatgcgacacaatatagatttgatccgcttataagagacattaataaaagggaaaaaacacctcattctttgttaagagtgttagtgcataagaattatacaatttcctatagtggtgcaataaaaaaaggtgaaagacaaccctttattgttattgcttttgaagataataaagatggttttaaaaatataaagaaacaagctatctggttaaaatacgccttaaaatatatatcacaacaatatgaatttcgaaagatttcattaattggccattcgaatggtgggctgattatcacgtatgcacttgaacataatttgactagccattatctaactgtacaaaaggttatgactattgctgcaccgtacaatttgaacgattcttctgttagaagtgagactgagttgttagaaaacttgattgcaaacagaaaatatattccaaactcaattgatatgtattctttagctggcactcaaagttatagcaatgacggcttagttccgttgtacagcgtattggcgggtcgctatatttaccaaaagcaagttaagcattatacgcaaataactgtttcgggtgttggagcggaacatttggacttaccacagaaccaacaaataataatggccattgaacaatatattgaaaagtagaaattttttctgctttttcctttaattacttatcctaatttatattctgaaatagttcggatattatctgttttatgttattttaaaaaaagtacaagtgcagttctagtcaataattcatatcttgcaagaaggtaagcagatgaataagcataacttctcaaataaacgtagctatgcaaaagcttacagacagtgcatgcgggaagatattctaggtcaatatgcggtagctacgttttggtatctgtattaaaagaaaataccatgatgtgtgatacgtgcgatacacgttttacatggatccttttgaacgagaaagaatgattgttgttcctaatactttcaaagaaattgacagaagggtgacttttgcagacccgttaaaattttcagaccatactaaaggggcacagatggacactgaagggtatggtatttaaagaagtgaattggaaaaattgaggggattgaatttatagactgtcattttagaatgaggcgcatggctacagttgctggcagcaaaactgtcaaattggtttcgggctgtattaaaagaataccgttaaccagttctactaagaaatttacaggacacatggtggagcctacaggagtggttgaagtggtcatgaattagctggtgcccacaaatatagggctcaacaaacctgacaaaactgtcaaatttcgcgtgttaacgtgagcaacagacataagaaggtctgatttgccttgagcacgtcggcagcattcggtggaattaactcatcacttatgctggggctagcataaaaagagtagcgttcatcttcttgatttgaacgctactctattattttaaatgccgaactgtttaaaccaaagagggtaaataatgaatttgaatatttatgatctactactatattgatatctttttctacttttgacatcgattgaaagtgcgaagtttaaaaaaattatatatccaggcgacgtaatcaggattagcgtttttaatttaaaaaaattgggtagattctttttagcagagtgtgaaattaagaaagataatcaaatctgttccagaatcaaacttagttgtaccaataaacaatagttgttttgtattaatttttgggttgaaagagtgatgtaattaaacttgtatcaagatcagaaatagatatgctttgagtatttaagacacgccataaaccaccagcacaaaaattaaaaaaattgaattgctgggttgaagtgagatgttgccaatcagaattttcggttaagttgacaatgtccaacagtttgagtgcagttaaccgatgtaatgtgtatgagaaaaagtcggaattttgtaaaacttgtaatcgatttttgttgccaagccaaaatttgaaaagagcgtcgataaaatcatttaaacaaagtattggtgtttctttcaatatttcgataaagtcatttgcagaattatccaaaaagccctcaatgactttttgtgtggatgaataatgacgataaaaagtttttctagatactcctgactttaagcaaagttctgtgacagtaatactttcaagtgcttgtccagtctcaattaaatcaaatagctgttttaccaatttagcatcagttagttgatattgttcttgtggcatttgctttatctcctttcatctttcatcaaaatctttttggaaagataaattatcatttattgaattaaatagtggcaaatcagggatatgctggacacaccacctgatttaaccactattcatgttttaaattcgtcttttctgggttcaggaggtttaaagaagccgtacgtcttatgctaagctgtctttttttcgtttcttaatgagggtagatgcatacatggcaaaaattgaagctataccaatgtacagcaagctcaacattgaaggtccagtgattaatgcatctgtaatatacatttggttaagaataagatcataggcaaagcgaattggcgtaatatcataaacataattatgatagaagggactcagcatttgcggaatgaaagtaatgactgccattgaacctatccagataataagtagtaatggccatccttttagtccaagcaaatcgagtacagctgactgcagtagatagaaaacaaatgatataccaccaatcatcagtaggaattgttttggatcatgaattggcacagaatagcaaacttttgtgaagaagtaaactgatacagcaatcgcagtgacaattgcgatacccgaaattaattgacttgtgacactagttaatgagaggcggccatcagtacgtttcttctcattcttactatggtctcgccagttcagtaaactagcaataagactaccgagccaacagaagatggttactaagaatggcgccataccacttatttctttagttgaaactttattgcgtttgataagagttgtgtgaattggtgtttgcaatttagaccagtcctgaggagatagtgttagtcctgacttatttgcaacggttatatattcgttagaaatcttctgatttagatgatcagtcatctttggaagtgcagtagtcaaaatagttgcaaccgtcatattacttccttgactgacgtataaagagatttttgcttgttcgggggtcttcttggttaatgaatttgctaaggctttttgttgttggaatggggccgtcttagcagccattggcgttttaactaccagggcagctagcttctgagttatgattttaccttttaaatagtctgtttgctgattgatagctttagtaaatcccgaatgaatgacaacagccccgtagtattttccggatgcaaagcctttagtgagttcactcgtgtgggttacattgacccatttaatttcagcgcttttcttatggctctctttccgtaatttcttaacaacattcttagcatcttttcctttatcgtttactactaacgctaatggtaaatgacgaaccttaactgtgctcctagctccaacttgtgcgaaggcaaataatccgattaatatagtggcgactaacatgctgatccagatgctttttctcttaaacacgttgaacattttcactacccccttttttatgctacgggtagtttatattaattttgaaatgaaaaacatggtcaaattaatatgatttgtgtcttaaggctacaaatggcagccatatgagccataaggttacagaattggcaaaactggtaatggaggaatcgatatgacggattttagaatgaaaaaaactgacgacgttatcatcaaatcatttgttgacctagtcatagagaatggatttgacaacgttactgtcaaggatattgcactcaaatctatgattagtcgtaaaactttctatttacattatgaggacaaatttgcactgacagacgcaatactacaagatattctaacgtggcttgatgagacattgaaaaagaagcgattactcataaatcaaggaattggcttaagtaacgcagttggtcaattagaaccggaacttagacaattactgatgtgttggagcagaccaataaacgcaataatgacaattccacaagctaagatgcaactaatggatggtcttaaagatattttaagtaatcatttacaggcagctctcacacatacaaagtcagatttggaaataaatgttattggtggcatgatgttagggatgataagatattacttacaaacaaatgacttcccatcaagcaaagaaattcatcaattatcagacacccttaatttgatatttggcgcgtagtataagtcagtcacatttctgtccatttaaagtggtattttgctttagtgattaagcctgattgtgaaatcttatagcgttttttattgggattaatttggcgcctaaattatgactatacgatgttgtacaattgctttattagtataaacttcatattgtaagggtcgtcgtagatagaaaaggcattttatttggcgttattagttatagcgccagtaaaaaaacaaaactggaatttaactaatttcgataaaacggcgtctcactggcaatggtcggaaagttaaacagtgagaattcactggattggtgcggccaatgagccacaaaccacggtgaaaaaacaagctttttagggtcaacagataaaggtatgacacggcgtatgctaaatgagggtcggtattgagttttattgtgagaaaatgcttgccgggtcttactcaatttgtcataccatagtatagttaaggacaaacgagttaacgggagtgacaatatggactgggaagactattttccaacggcaatcgctgaacgtgggtacgattattacttacaggggtatgtcactgatttaaagcggaccaaaacacaaattacggcaacggttacgggcacgcaggactatggcgtggtaatcactctcgctaatggtgactttcacgatggcgcgtgtgagtgtccgtatgccaatagtcatccgtattgtaagcacatggcggccgttttgtaccaagcgacggcggctgacaaacctgccagtcaacatccagtttccaaagcaccaactagttgcgacagtcttgaacagactgccactaagctggttgagcgggctactgatcggcaagtccgggactttttgagtgtggtgttggcccatgacaagcatctcgtccagctgttccggacggtcatgggtgagactaatgttgtgacagatttacctgaatatctcgcgagtgttgatgatttatttgacacaaacgcggatggcggtggctttatcgattatgacgcggcgacggatttcggtgatgaggccttaactttcctaaaagaagaggtgcagccgttggtcgatcacggcgagtatggtttggtatttcaaatcttagcgcatctgatgcttaaaatcgaccacgtcgacattgatgattccgatggtgagattatgatgatcatgagtgctagtgacgacttgtgggaagctgtcttaacaaaagccgacgcggatgtgcagcagcaggtgtttgattggttatgcaaacaattaacgaagtcgttgaatattattgaagatacgcttgacgatttattattcacatatttcaagacgccagcgtttattgatgcaaagctggtgtataccgctaagcggttccgtgcggtgcaaaaacacccggatctctgggactatgactggcagataaaaaaatggctaaagcactatttacaaatgatgtctgcggctcatgtgcctgataagcaaattattaaattttgtggcgctaacttggcgataccgcaagttcgcttgttttatagccagttctgtcttcaacatcaagatgaggcgcacgcggtccaattgctaaaggatggtaaaaagttggtcacggacgatcccagcatgttagcggaacttagtcgccaactaaaggacgcttatcagcaattaggtgaacagcaattgtatcgtcaggaattatggcaattgttgactgaatatgcgccagcggatgagatgctattttcagagttgaagcagagttacccgaccacggattggccggcgattcgcgagcaactgttgacggcgatcgcgaagaattccaatgtcgatttgaaaccactgtatgtgcaagaaaacttattgaacccgctattaaaagcggtcgtggccgcggacggactctgggatttacggacctatgagccgttattgaaaccacgtttttcagatctgctgttagcgaaatatgatcatgaagttcggaaaatggctactactactggaactcggcggaagtatcaacaattagttggcatattggaacggatgctcgcttacccggctggtaaatcgaccgtgcaggcgattgtacatgattggcagcaacaatatccgcggcgttcagcaatgatggatgagctctcgcggctaaactggtaattgatcgttagttggcgcagcaatcgcgaacagagttaagtcgcatcgctaagtttaggatcggttcctaccccaaacttagcggtgcttttttcatagccaactgcgggcataataaattgtctttgggccttggtcatcctggccaagataaaatggtaggacattagtttatttcaaagttattaatagctatccgtactcagggctgaccggtggctgtcattgaccctgttattcaaaataaggctaatcagtcatcgaatcacaattaagtttaaataatgaccgaattatcatcttggaaccggtataataagccttaagcgaccgaactgattaaccatagggtgtggatatgcgctgttggcgtcattcgtggtccggccgttgctacgaataaattagcgagtgatgtgaggacgtgatcagtaatgaatattttgattattggaacgggtaaattggggtatgaagtgtatcgtcgagtggccgtgatgccgcagcaccacgtgactttgttggatcatcaccggcatgagcatgatgtctcgttagccacgcagttaatcggggatgcgagcaatgttgatgatttaaaacgcgcgctgcgagggattgacgtcgtattctcaacggtgggcattacccacgcggcgcagtttgccacggcattggtgcaagcgatggatgcagttggggtcaaacggctattttggacgacccagtttcaaatcaactacgatcagatttcagaagcaatgtacaccttagcccgccgcgagtttgggtttagtcgtgaagttgagacgacctatgtggcggggcaaaaggccggggctgcagttatcaggaatagtgatttggactatacattgctagcctgtcattttttcaagtacaatgatgaagcggatcagttaattgttgaaccagctggaaatgctgttagcggtgggccacttagtctattctcattggcgacattgatcaccgatatgttggaacatccacaagattatccgcaacgtgagctcatgatctcagctcggccaggcgaaaagtaacatcagttctggctgattaacttgaattgacaacagtagtactcataaaatataagttttgatggcgatagctaagttgcaccaacaggtaactgggctatcgccatttttgtgctaagtttcaaaacttacgactgttaccagtgtactaatgtaaattggttctatttttctgagccagacggtacaatatttgtaaattcatcaaaagattgaggagatgggagcaatgtcacaatggcaacaagattgggcttaccaaaagtactgggtcatggcacactcacagcagcattataatgccatccgacaattagctcggcacaatgattggtcagctgcaaaacaggaacgctaccaacaattattagcagaagccgaacaaattacgccaactaaagccacgttgacaacggcttatcagcacgtctggggctattttaaaaagcggtgtacgctggccgagaagcaacgttacctgaatttactaacgaatttaaccccggcacacgatcagcttgggccgttcttgtggcagttaacggtgaagtacgaagtggcctatttgctggcgtcacgcttgctgcgtgcgtttgatcagcatgaaaatcaacggtgattcgtataacatttatattatttaaacaataataaatatgaaaaaacaatgaattttttacgattacttcgttcaggtctttacaaagttatgaataacctgctacaataataaaaaagttataattatcataataaaaacactaatcaaggaggcgaaataattatgattaaattgtttacgcaagcaggatgtaactcatcgcgaaaggcccgccaatggttccgggatcatgatattgcatttgaggagaagaactttagtagcgcagcccctactgttagtgagttaaaacaaattctgtgcctaactgagaatggattggaagatattatttctacccgttcacaaagttatcccgcaattgctgataagctgccagatatgtcattcaatgagacgctccggctgttatgcgaacaaccccagttgttgcggcggccaattattgttggtcgtaataaattgcaagtaggctttaatgatgatgatattcgccaattcattccccggcatattcggcgactgaattttcaacaaaccttagttggattggtggatatgtaatgataggggacttaaagtccaccatattgtgaaaatggtaattactaggttgatgtaaattaatgttaatccgacgctctttttcataattgttgatgccaatagcggcctaacttgattgaaagacgtcataaagaaacaaaaacatcccggctagcagacaggctagtcgggatgtttttggcgcttcagcagtcatttagtcgactgtgatggtagtggaagatgccattagctgtgccaactgttcttcggttgtccggttttgggacaacggtggcaagttgtcgagcgtaaagtaggctgtttgggcgacctcaatgttaggctcaaattggccatcagtaatttcacaagcaaagaccaatttataatactgaaatggttggggaatatcgacacgtagagcagtgtcaaaaacggtgatgagcccctgaaccgcgacgtgacggccagtctcttcccacacctcgcgttgcacattttcagtcggcgtgtagcccacgtcagcaaagccgcctggtaaggcccatagtttcgttttaatatcttgaacgagtagtagctgattaccatggcgtatcaagccgcggacgtcgattttgggggtgatgtagccggaatcctgagtcagagcagtcgttaagtcagcagttgatatgttggaagtggcggccatttgttgaatcaataaggtttgtaacttttgatagcgatctttgtcgaacgggtcagtcgtgtaggctaagccactttgaatcagagctaacattgcccgttgagtggttaatagtgaagatggcatgttaatgatcctcctctaaaggtaaataagtttatcaggtgcaatcttagtagctaggttatccggtagtggctgatcagtcacaaagtaatcaaaatcactgagagctagcaagttgaagttgtggctgacgttcaccttggtgtggtcaaacaacagcactagccggtcgctttgggcgcgtaacgtttcctttaaagcaatatcagattcgtaagcgtaataaacgccgtctgcggtcaacccagcgcaactcaagaccgtggtcgtaaatcgaaatttgtgtagtgctagaatgctgtcagcgccttgaacacaccgttgttgtgcatctaatgtgccacccaggatacgcgtttgaaaattgctatgtcgtaatgcctggtcagcaatgtcaagggaattcgtaacgatcatgccggggtccttggactggagatattgtggtagacaggcaacggtggttgagatatctagaaataataacgcatcatttagtaaatacgaactggcagtgtgggccagggctcgtttagtttgcagtaagtcatcatcccggtccaggtattgatctagcttattaaacgtattcggccgactaatgccgccgtagtttcgttcagccaaattatgagctgcgagtttgacaatatcgcgccgggcagtgtcgcgtgaagtccccgttaattgcataatgtcttttaaactcagtgatgggtggttttttaattcatcaagaatcaatgttaagcgtgttttttggttcataattgatcaccttaagcttttttaagtgttaaacacatactaacttattttagcttaaatagaaagccaatgacgtcaattaatgaaaacggttgaattaatcggcgttgatgttgtggttacgccttgaaacccttaaaattaagctaattagtggcagggctacagcatacctacgaaaggatggttcagatggaagtgaaaaaagtggtcattgttggtggcgttggtggtggtgcttcggcggcggcccgcgtgcgtcgattggacgagttcgcccagattacaatttttgaaaaggggccggatgtctcattttccaattgtgccttaccgtacacattcagtgatgtgattgaccagcccgatgacgtgattttaaagacaccgatgcaattcgagcaacagtacaatattgacgttcaagtgaatacaacggttgtcgccattgatgcgcaggctaagacagtgatgatcaaacggcaaggacaggtagcaacgacgatcgtcccatatgatacactgattctttcacctggtgctcgaccgatactacccgcagtgattgcgggaatcgaccggcccaatgttaaaacggtccgcaatgttcaagatgtccgaacgattcaagcgtatctgactgaacaacacgttcatgatgtgacgattgttggcggcggctttatcggactagagatggctgagaatttacaacaggctggctatcagatcacaatcattgaggctgccgaacacgtcttgggcactttggatgacgagtttgctcagctagtacacaaggaactatacgattacggtgtgcaggtgatactgcaagaacaagtgacggccattggtgcaacacaagtgcagctcgcctcgggacgcgccgtgaccagccagttagtgattgtggcaattggggttacaccagtaactgaattagcggttcaagcgggttgtgcgttaggcgtgaccggtggtatcaaggttgatcatcgttaccagacgtccgtggccgacatttatgcggtgggtgatgccattgaagtgactaatcggcttacacgtcaatctacgcggctagcattggcatttcccgcacaaatgcaggcccgacacatggtggatcatttatacgggcggacgccacagtatcagggtgtgatcggatcgcaggttcttcacatctttacgttaaacgtggcgtcaacgggcctgaacgctactgagtgtgatcaccagcaacttgattatcggttcgcaacggtggcaccacagaatcgggtcagcgtgatgccagggacaacagccgtctttcttaagttgatattcagttatccgaccggtgagattttgggcgcgcaggccattggtcaatcggacgttgacaaaccgattgatattatcgctagtctaatcacgatgcacggtcgagtcagtgacctgacagatgttgaattatgttattcgccatgggtcagtaccgccaaaaatgtcgtcaacatggttggcttggtggcggaaaacgtcctgaatgatgaatttaagcaggttgcggtgacgcaggttcgacagctggtcttggcgggggcgtttatcatcgatgcccgtgaaccacaagagtacgctgatgggcacatcaagggcgctcataatattccactgagtcagtttcggcagcgcttagtggaaattccgaccaatcagccagtttatattcattgccagactggacagcgaagttacaatatggtccgcgcgttacttcagcgcggctatacgaatgtggtcaacattgctgggtcgtatgccgaactagttcagtatgaatattttaatgatcagacaacggggcgaacctcaattttgacacgaacatgatgattgataactaagatattaatttcaacaaaatttgataacgtagcagaggctattgggtaaaatagaaggttcagaagtgttagactgaaattatcataagaaagttggtggcaaaatatgcgaacgattgaagacgatgcagcgcttaagattctagcggatgtgattaagattccatcagttaacgaccatgagttgacggtcgcaaaatatttgcaagccctgttggcgaagtatgatatttcagctaagatttaccccattaccggtgatcgtgcaaatctagttgcagagattggtcatgggcagcctgttttagcggtttccggtcatatggatgtggttgcggcaggtgacctggcggcgtgggacaccgatcctttcaccttagtagaaaaatccggtcagttatttggtcggggcgtcacggatatgaaggctggtttagtcgcattagtcgctgcgatgatcaatattcagcagcaaggtggccctaaacatggcaccattcgcttgttggcgacaatgggcgaagaagttggtgaagctggctcagctgccttttatcaacaaggggcgatgcaagatgcagctggtttactgattgctgaaccttcaacggtttatggaacagcggctgagcagaaggggtcttatgacttaaaattgacgtctaagggtaaggcggtacacagttcgacacccgaacgcggctataatgctttagtcccgctgattaaattactcaatgaagccaatgactattttgaaacgattccggcaggcgaggtgggaccggtcagatttaacattgacgtgttaaacggtggggaccaagtaaattcgttacccgatttagcgactgcactcgttaatgtgcggacgattccggaatacgataatgaccaagtgacccaaaaattaacggacctgatcgcagcgtataatcagcaaggtgctgacattaagatgaccgctatcatgaatgagtcaccaattgcaaccacggctgataatcggttagtaaagttagtgcaggccattggcaagccctatgctggccgcgatgttgtcgttgtctcaagtccgggaattaccgatgcttctaatttggctaagcgtcaaccagccgattttccctttgcggtttatggaccgggtaatatgacccaacatcaggtcaatgaaagtttaccaaaacagatgttttatgactttattgcaatttatcaacagctgtttacacgttttttggccgagtaatcggtgttgattgatcgtaaaatcaaagacccgctagcagtcagtgactgtcagcgggtctttgaatggttagtaccaattttcaggtgcatgggtcggtgttgaaaaagcaacggcaatttgtcgcagggcttcgtaagtttcggcggtatttacccctaaaattgtcgccattcgttgttcactggtttcaaagaaacgttcgatcttggtggctaattggcgggccttgggtgttaggagtagtcgtttgtagcgaccatcgtcctttgctggcacacgaatgagtaaatcagcggcttccattttggaaacgaggctggaacaggttgctttacgaatattgaactctaattctaagtcccgttggaagaggtcgtgatgctgttcattgttggcaataaagttgatcgtactgatttgcatgccagttagtcccagtgattttgcataatggtctgagtccctggctaatgcattgttcgctttcttaatcatgatccctaatgaatcttgcatgggaggactccttaatgatattatggttcgtattctaactaaagtgaattataagaactaattgttaaaaagtcaattaaaatagggcttaaaattttgaaatagtgtgctaaaatagttaattagttcgtattcgaactataggttaaggagctgattttaagtatggaaaaacgtgttgacctcaaattgattcttgcaatcgtggctgccggattactttcattttgcggagtgatcgtggagactgcgatgaatatcactttccctaagttgatgcgagaatttgcactcaatacggcgacggtccagtggatgaccacggcttacttgttagtagtcgcaattattgtgccaatttcggcgtttctgaaacgccgttttcgcactaaaacgctgtttgtgacagccaatttattgtttatactgggattggtcgttgacgcgaccgcgaccagttttcccgttttagtcactggacgaatcattcagggaatgggaactgggattgctttaccgttaatgtttaatattattattgattgggcaccagcacggcagaaagggaccttgatgggaattggcacgctgattaccgcaatcgccccagcactggggccgacttttgggggcttgatcgttagttggatggattggcattggattttcgtattgctaatcccggtactcgtgatttcacttgtgttagggctgtatgcgattcgacaagcccagccgacagttaaagttggatttgatgtggtcggttggctgatgatcgtcctcttattcgttggctttacaattggatttagcaagttagccacgattaccacgcaaccactgatttttgtggcttggctagtggtcggtctgattggtcttgtggggttcgttatccgcacacgtcgagcggcacaaccgctaatcaatctggcgatttttaccacaaaatcttatgatttgcacttaatggcgtactttttggttcaaatctgtgccctcgggttggccttcatattgcccaactacatccagttagtgaacggcaagagtgctttgttagctggcttatttgtactacctggcgcggcaatcggggctgtttttgccccactaggtggacgtattctagacagtctgggtgcagccaaaccagtcctaacgggttcaacaattttggttattgccatggcactgtttacggtgttggggatgcacctgtcaggcggttggattttagccatttacattttattaatgattggtattggcttaaccatgggtaatacgatgacgagtggcttacagcagttgtcagctgagcatcaagctgatggcaatgccgtgttcaataccatgcagcagtttgcaggggccattgggacttcagtcgtgtccgccgttatcacgttagttcaagtacagacgactggaacgagtgcgcatcggacagcgttaggatcaaccatggccttggggttgttgctgattttagtgctgattgaattggggaccatgatattggcaatgaagacgcgtcaagctggtcaacgataaaaatgttataaaaagattgacattgttttgagaaggtgtaatctttagttgttcaaaagttaatcggcgatgacgttcgccacataataattgataatcaatttgatgacgtctactgtttgtttttcagacagtaggcgtcttttctttttggttaagaaggagagattgatatggaaaaacaagttattgaaacggtaaaggctcgcgaaatttttgattcacgaggtaatccaacagttgaggctgacgttattttgtcagatgggacgctaggacgcgcggaagtaccatcgggagcttcgactggagaaaaagaggcagttgaattacgcgatggtggtgatcgtttagcaggtaaaggtgttcttaaggctgttaataatgttaatacggtcattaatcatgctttacatggtgctgacccgtttaaccaagcccatattgatcaaatcatgattgacctagatggtacgcccaacaaagcgcgtctgggtgcgaatgctattttgggtgtttcaatggcaacggcacgagcggcggcaaacgcattacagcagccgctttatcgttacttaggtggcactgatttagagctaccccaaacatttcataacgtgatcaatggtggggagcatgcagataatggcattgatattcaagaattcatgattacaccggtcgaacgaaccagttttcgggacggttttgaaaagatcgtgaatacttatcatactttgaaaaaagttatcgaagatgccgggtacacgactggtttaggtgatgagggtggctttgcgcctgatcttaaaaactcagaagaagccttgcaaatattacatgatgcgattattaaagctggttatacacctggtaaagaaattgcgattgcttttgacgcggcggcatcgtatttttataatcgaacgacccacaattatgactttgagggcaaaacgtacacgccggcagcccttggtgattattatctgcagttattagcgaagtttccagaaatcgtttcaattgaggacccatacggggaagaggactgggataactttgcaagctttacagctgctcatggtgaccagcttcaaattgtggctgatgatccggtctgcactaatccgcaattaattcggcaagcaattcagcgggggatggctaacaatattttaattaaattaaatcaaatcgggaccgttaccgaaactttggccgcgattcggctagctcgcaaaaatggttatgccacgatgatgtcacaccgatctggcgaaactggtgatactttcgtcgctgatttcacagtggccaccaatgcggctcaactaaaagctggtgcgccagcccgctctgaacgcattgaaaaatataatcaattattgcgaattgaggaagaattaggtactgatggtgctcggttggcacacttcccaaataacgtgatgtttgactaattatttgtgataaacctgattcgacagttaggttgccagtggtgcttgtcaaattcgaggtgcagacatgattgaagatttaacggagcaacaagcagccgctaaactagcggcagatggatttaatgatgtcccagaaccaacgtttaacttttttaaggccgtagtcagtcgtctatgggaaccatcggcatggattttggagggagctttagttattgaagttgttttgggtaaagaaattcaggctggctttattgcgttaatgctggtctttgcagccgtcaatggtgcaattcaatcgcgacgtgcggccctggttttacaggagctggcgcatcaattgacgccaaccagttcggtacgtcgtgctggtcattggcagttgattgatgcgaaggctttagttgtgggtgatctgattagtttacaggtagggagtgtaatcccagctgatattcgtgtgttaacgaatccaattcatacggatgaaagctcaataaccggtgaatccgttgcagttagccatacgccgggtgaaacggcctttgcaggcacaatggtggtagccggggaaactttagcacgcgtactggcgactggaagtcatagtcgggctggaaaaacagtcagtttgattaatcaaaacaatgcgcctggtcatttacaacgattattgggtaaaattattggttacttggcattgttagacagtgctttagcactcatcattgttggaatagcgttaattcgccatgcagacatgattcagatgttaccgtttctagcgatgctgttcattgcgacgattccgattgccatgccgtcaagttttgcagttgcaaattcggtagaagcccgtgaacttagccagcagcggattctggtcagtgaattaacgggtattcaggaagctgccaatttgaatttattacttgttgacaaaacgggaacgataacgacaaatcagccgcaagtcgtgcagtttaaaaatttgtcggccagatcagatcagcaattgttgcggttagcagctagcgcgaccgattcgcgacatcctagcgtggtggatcaagcaattgtgaactttgctcatcgctatcagttgaaacggctgccacagcaggaatttaagccatttgatgcaagtgttggttatgccgaagcgctagttggtgaagcgccaacagttgtgcgggtacgtattggtgcacttagtcgtttgtacgagttaaccgcacagcaaccggctttagcaatcaaccaactggatttgacccggggccgttcagtggcggtcatgattaataatgttttacaaggtgtgttgattttgcaagatcaaccgcgcccagatagtgcggcggccttaaaaaggattcaacaccggggcgttaaaacgattatgctgacaggcgataatttaaaaacagcacaggctgtggctgatgcggttggattaaagggccaagtggtttcctaccagacctttaaaacgcactcgcgaccgttagcgcaagttgctgggattgccgaagttgttccagagaacaaattggcaattgtcaaagctatgcagcgcgcgggttacgtggtggggatgacgggcgacggtgttaatgatgcgccagcattaaagcagtcggaggttgggattgccgttgacaatgccactgatttagccaaacgaagtgctaagttcgtcctgttaacgggtggtttggcaaatattctgacgattttagacagtggtcatcgcgtctaccagcggatgctgacttggacaattaccaaattcactcggacggtcgaactgaccgtgcttttaacaatcggctatttatggctagattacgtgccattgtcgctgaatgcgatggtattagtggctattctgaatgatttagtaacattggtccttggcactgatcgcacaatcattcgccatcgtcccgaacagtgggatatgccccgcttaagcaaaattgcggggttcctagcgactgggtggacagctgtgggtgttggtttgatagtctggctgcatggtttggggttgtctgctggtcagttgagcactagtctttacgtctatctcatatttagtgcaatgttaacaatcttgatgactcgtactagtggtccattttggcggggacggcctagtcgcgcagttgggttgaccatcggcttgaactgtctgttgaccatcggattagctagcagtggttggggagtgccggctattagtggctggctaactttaatagtgatcgtaattagtgttaatgactggtatcggtttgacggtggccggcgacctctggcgacgattgactaaatgattgcaatgctgatattccgcaggggattaattaattgcgaaaagcgtgaatctcagctatcgttaaattggcattaaaaacgaacggaggtagcaaagttgcaagcatacgtcgtgaaccaactaggtggaccagaagcgttacaattaacgacacttcctgaaccgaacgtcaaaccggggtggacccgggtaaaagttttaggttttggtatcaaccactcagaaatctttacgcgggaaggcaagtcaccgagcgtgcagttcccacgagtgctcggaatcgaagtagttggtgtggtcgatgagaccagtgcgccagcaacattcacgtctgggcaacgtgtggtttcaatcatgggtgagatgggtcgggcatatgatggtagttatgccgaatacgtattattaccgaacgagcaggtttatccgatcaaaacgaatctatcgattgcctcattggtggcaacccctgagacctactacacggcctatggcatttttaagtctttgcagcttaaagcgacggaccgggtgctgattcgagcagctactagtggggttggaattgccgatttaaatctgatcaaggcttataatccaaagatccatgtggccgggactactcggcggctagttaagcgccaacaattgattgatgctggctttgatgaggtcattgtcgctccggatagcgctcgtttaccagccgcaacggctcattttgataaaatcatcgacttgattggtccgctcagtgtcaaagattcattgtcgcatctcaacgaaggcggcattgtaaatatgacgggcgaattaggtgggctgtggaccgttcctgattttgacccgattagtgatattccgaatgggtgttatttagcgggcttttcctctggcgatgtttctcagacattgttgcaagatttatttgacttcatcgcagcatatcatgtgtcggtcgcccccgctcggatttttaactttaatcaggtaccggcggcccatgcttatttgcaagcggcagacagttttggaaaggtcattgtgttgttggaccaaaacgctgagtaatctggtggttggatactgctcagcctagtacttgcatgtggggcttagaccaccggattgaaatctgtaaaggaatctataataaagaaatcacgatcgtgtctgaccgtaaatcggctaatgctgactggtctgacgcgatttttttgcctaaatggtcgcttaagtgtatggtttgcttgaaaggtaaagcagttggaatcgtatcaaaaaatacaatcattagctggtaatgttcgcgaagtgtacttgtaatcccatgggaatctattagactgggtttaaggttgaccatcggttgatctggtaaaaattcgaagaggtggtagcagtgacgatgatttctagtccgtcgatggaggtcactgacgttggcgattacctcaaactaggggcctgtactgcggtgatggcccagccaattctcacagacgcattggcaagtgggccgtcgattgccacgcaaactgggattggtgttgtttataatctggtcaagtatacggcaccggcctttatttttggcattctctatacgacgacgcgtttgacgcttaatcagaccgcgttgacctataccgactatttgcgccagcaatggcatgcgctgtttattccaacgatttggtggaccatgatctacttaatcttgatgccacaattgcagcaaggtagccagtatcatgactggcggggatttttctggcagttcgttaatggtaatgcagcgcctcatctgtggtataacaccatgatgctacaatttatcatattaatgccgttattctgggcgcttggccgttggtgtcagtctcgacctcgacgcggctggatcgtatttggcggtacaacactggtcgccgttctttggttgtggttttatgaccaacaagttttccatggtcctcacagccgtgattggtatttactggaccggctttttatcagtttccagattttcgggttctatggcatgttagcttgggtgtttcgagatacctttcagcgcatgcttaacaagtggtggccgggattacttggtctatggttagttggcctgatctggactaattgggaactgttcagttacggcttcccggttaatttgcgcaacgccccgtattacaaaccatcaatgacggggtatgcgctagcagtcatcggcctgttggcggcgttgtgtgagattcaagcttgtcgtcaacgtccttttagcaaatttgtacatttctttgctggtatggcctataaggcatacttagcgaatgttttctggtctgaattgttgtggcgtggttttggtcgtactttgatggtcaaggctccctggctgagcattgcgctgtgttatggtttgacctggttattgtcctttacaacggcttttggtctgcatgcaggatggatgcgacttaaacgtgaatacgagcatgattaggggctaaccttgtaattagtcgtattcttcatgattaaagcgggacaattgtcgtgtcatactgggatgtaagttgaccagaccactttctgaatcggcttgaggtgtcgtgaaattgaaattgcgttactgtgttaatcataaaattattgatgctgtgcagatgttcgatgacaaaataagcacgttgtaaaaatcaccagagtgtggttttacaacgtgcttattttgatgtgggaattaggtcaacagggcttttgctgcgcgctttatgaagtagcgtttttgataagtgactacctgataatttttcaaatgaagcgcctggttgtttggttgttagttgaccacgattgtctctgtaatttgaccagcattggggtcggttagatagttaatactattggtcatgccaacttgcgcgggaccggcctttaccgtaatcgtcgtggcgacttcaccagcttttttttgatccatttgcttaaataaatcaacgtctgttttcggtaggtcgttagcagcgacgacggcactggttttcgtataggtcgtaacaatctgctgattgatacgaatgattttattagcgttgatgatgagatataacataccggtactatcaccactggcaacggcggtatgtgttaattgatagccagcgtgggctgcatcggttttgaaggccgcataggtcacgttttgattcagtgagcctaatgaatagtgactgaggtcctggatagcagatcgttcataactatcataacgatgctgatatagatagccatctttgatcagcaacttgcctgtatcgctagcgctagtcgtagtttcggcagcaatccaggtaccattcaaattcgctacgttgacgtgtttaggcgccgccttggcactagtatcagtgaaagcgcggccccgttcaatggtcgttgcctgttcagtatctgaatattgaatgttgacagcgtagaggtggtgccccttagcagcaaaggcggtgttgactggtaacggatcggtgtgattgccggattccaagtaaatcaagtcagtcagtttgttaatctggattgaggcaccgagctttttcaaaaccgcgttgatctgactaactgacatgtgatgcagccggtgtcggtaacttttcatgatatggcgttgctgatcatggtgccatttggcgtacgaaacttgacgatgtttgacgccggcggacaaaaattggccgttactagtggtccagcttgattgggcagtagttttgtcaaccacggaaatgtctaaattgctggcgacgccgtgttttgtttggctggaactaacggcttgatcaaaagtccatgttttggttggtgcttgaatcactttttgggtcgtcgctttgacggaccgatgatgcttcactggagcgaatgtttgggtcgtacaaccagcaagtgcaaggccaattgtcatcaccaaaatagctaatttgtgcattagggtactcctccaaatcaataggtatcgtgatcatcagtatagcatatgcgattatggtgagtgtcaattgtactggacctggtgtgcgcagggttcatgagtgttgggaggtttcacaactgactgcttattttctgttgagtcgtgcacgctaatctattgatttcaatctgcatcagtttaaacgaaaaatgtcgtggtgcttgatggctagggttatttggatggtgagtgtttcgaataacagctagtccgatttaagggttgacgatgatgaaaaagcgtgtatacttctaaaagtagttagccggctaattaactttagaaagaaggatttcaatgcctgacttttcgtttcgtgatcgaccagataaacagcgagtgcaattgacactgggcaaagcaagtagctcggcggatgctgagcaggtgttggcttttctggattttcagtggacatttcgaaccatgcaagccacctatgaacaattactcgatcaatatcaactttcagaatccaagtttattattttaatgttgctggaaaatgaaactgatcacacgctattgccgtcggagttagccacaaagctagggtctgctcgggcgactgtgagcaagttactggtcggcttgcaaaagcgaggctgggtggaaaagcagcatccacaagatgataagcggacggttgccattcatttgaccgccgccggtagtagtgttttgacgcaatttttaccggccaattttaaggcggttacaacaatttttgcgtcgtttacggttcaagagcagcagcagtttaaaggcttattggataaaatcaagcaaggcacccaacaattaaaaagtgaggcaattaattatgaatgacaagaaaattgaattgttaacaacatatttaagcttatacatcgatcatcacaccgttttagccgatatgcaaaatgcgacgggcaagtacgtcgtcttagatgttcggaatgcaccggcccaagtgaagaaagatcaaatcaagggtgcaatcgcgatgcctgccaaggatctggcaaccagaatcagtgaactggatccggcgaagacctatgtcgtgtacgattggacggggggaacaaccctaggcaagacggcgttactcgtgctactatccgcaggctttgacgcgtatgaattagcaggagcgctggaaggctggaaagggatgcaactgccagttgaagtgcttgcgtttttgtgataaacactgggttgcgtcgtccacaatgagttgatttcgtatattgtgaaataagttcgttaattagttggccttacagtttatcattataatccgagttgatttgaaaacatgtccccattaaatgccttttctttcaagcctgtgttgaactttaacgggcgtaaccagtcaacatcaccaactatattttgccgataaaataatgaaaatgggttttactttgtgtaaaaatgaactacaatataaatggttaatgtaaacgcttacagaacttaagtttgataatgatgatattcaagtgcaggaacatagggaggtaatcttatgagtagtcgtgatacggcaaacgttttatggtttgatgaattacaccgcgaagatgtgaacctagtgggcggtaagtcgtcttcactgggtgaaatgacgtcatcgatggatgttccagtcccatatggctttgcaaccaccgcccgggcgtatcagtacttcatgacccagacgggattgaatgataaggtcaatgatttgttagccagcattcaggattatgaaaattctgatgaattgcatactgcgtgcgaacaaattcgtaacttgatcgtgaatgcgacaatgcccgcagatctggcggctgatattgaacaagcctatgcggatctcgctaagaaaatggggcaaactgatccgttcgtggcgattcgctcttcagcgactgcggaagacttaccaaacgcttcatttgccggccaacaagaatcttacttaaatattaaaggtgctgccgatgtcgttaatcgggttcaacaatgttactcgtcactgttcacggatcgcgcgacatattatcggcacaaacagcattttccacacgaaaaagtggccctctcagcggcgattcaaatgatggtcttttctaaggcttccgggatcatgttctccgtcaatgtagcggatggggatgcttccaagatcgtgatcgatgccatttatggtttgggtgaatatattgtgttgggcaaagttacgccggatcactttgttatcgataaacaatcaatgaaaatcgttgaaaagaatattatcaaacaacctgtccaattaatgcggttaccgggtggcgggactaaggaagagtccgtccccgatgaattacagggtcagccagtattaacagatgcgcaagtcattgaattggccggctacgctaaagaaatcgaacggcattacggttgttatatggacatggaatacgctttggacacgaataccaaccggctatggatcgttcaagcgcggccagaaacagtttggtcacagcgtaataagcacaaagatgcagctgacgatgaagatgttgtggatgaggcggatgccaaagttatcgtccgggggttaccagctagtccgggcttagccagtggggtcgtgcatgtcattgataatccgaaagacattgatcagtttaagcaaggcgaagtgttagtgacgttaatgacatcaccagattgggtaccggcaatgaagaaagctgcagcgatcgtgactaataacggtggcatgacttgtcacgctgcgatcgtttctcgtgagatgcagattccatgtattgtcggcactaaaagtaaggaagtcgcggcaaccgacgtcttgaagaccggcgatgtcgtaacggtcgatgctaagaacggggttgtttatcaaggtaaagtcgctagcatgttgaagccaaagagtggtgctacggcggttgctggtcaggtggttgcggccgagagctttgctccaactgctacgggcgtgatgatgaatttgggtgatcctgatttggctgacaaatattcaagtttaccagctgatggaatcggcttaatgcgcgaagagttcctatggacaacctttattcatgaacatccactatacttgatcgagcagggtcaccctgaaaaggtggtcaatatgctggcggatggtatcgcgaaggttgttcgggcaatggcaccacggccagtcgtcctacgcttctcagactttaagtcgagcgaatatcgtaatttaaagggtggcgacaaatacgagccgcatgaaccagctgatttactgggttggcggggtgcatctcggtactatgattccaagtatatcgaggcattcaagttggaactggctgcggtcaagaaagttcggaacgaatttgggttgaagaatttaaatgtcatgattccattcgtacgaaccgttgacgaagcacaaaaagtaacgaccattatgcgcgatgaaggcctagctcggagtgctgacttcaaagtctatatgatggctgaaatcccaaccaacattattttggccgaccaattcaatcaattcgttgatggctattcgatcggttcgaatgaccttgcaatgttgattctgggttgtgatcgtaataatgatacggtggctcacctctttgatgagcggaacttggccgttaaacgagcgattcggcacctgattaagacagcccataaagatggcaagacggtttcgatttgtggtcaagcaccatcagagtacccagagtttactaacttcctgattcaaagcggcatcgactatgtttcagtcaatccggatatggtcaaggagactaaacgaaatgtggcgcactttgaacaacgcattatgttggacaaagcgactggccggggcttacaggacccaattgattataaatggtaaactatgattcctgttaaaagttaaataatcactaaaggcgaaccaattcgtaactgaattggtccgcctttaagtttgtttagagccaaatactgattcagggttaattcggagcaagaggtcatctaaaaatgacgggcaggtggcatatgatttactttttaaactgtttcaagtaccgactagcaaataatttgtgaaacttaacgcccaaagtcgggttggcagcgtcaatatccgcatacatcgcggtggtaattttggttaacaagggtgccagttgatcgagctcgtcgtcagaaagcgtgttgacaaatggggggacctcctgggctgcggatgcaatctctttgcgaccagcagccgttaagttcacaaggttgacgcggcgatctttggtggacttggataaagtgaccagctgacgattgacaagtttatagacgaactcgctcgttgattgcggcgacatgccaaggcgacttgccaactgtttttgtgagaggtggtcctcatcggctagtgctagtagaatcttgccctgaccttcaacagttattcttggacgggcctgcttgacaatgtcatcataaattttgcttaattgttcgtactcggccaattttccggcgactagttccgccttaatattcgttgtcacgattgatcattccattcgttcttttcttaagtatacaacattctttggtatgcggtacgttaaggttagttgatttttagattgatggtcaataattagtcgttgacaatttagtcagggggccttaacatatatttagtcagggcacctgattgatttgtgggaggttttaacttggatgaagaaatgatgattcaaatgacacatgttcagaagcgatttggaacgaaagtcgccgttcaagacttgtcactgcaagtccaacggggtgaaatttttggcttattgggtcctaatggtgcgggtaaaacgacggtcatcaggatgatgacgaccctattgcgacaagatgctgggaaaatcttagtcaatggctttgattcattgtcgcaagcccgacgcgttcgccagcagtttggtttgaccggtcaaaccgctagtatcgatcaggacctgagtgcgcgggaaaacttgcagatttttgggcgcttgaatggtttaagccgtgcggcggcgaagcatcgagcgatggaattactgacggattttgatttgaagcattctgcggatcacgttttggccacattttctggcgggatgcggcgacgattagatttggcggttagcttgattggtaaaccggccattctttttctcgatgaaccgaccacgggcttggatccgcggacaagagcgcagatgtggcaagcgattcgtcaactagtggccgatggttcgactgtggtgctaacgactcagtacttagaagaagccgaccagttagccgaccacattgcgctcatagatcatggccagttagtcgccagtgggacgcccaccgctttgaaacaaacagtagggggtcaagagcttgaattggaagtcagtgcgacgacggccgtcacaccggctaaggatatcttacaagccatgctcggtcaagatgtccgtgttgcggaacggaccctaacagtgccgttggataccgctagcttgacgccggtcactgaaattctgatgcggttacaagctgctcaaatcacggtcagtaactttgcgatgcacgcgccatcgctcgatgatgtgttttttaaactgaccgtgggcacaaattagaggaggacaaagcgatggaaatcaaacaaccagcagagttaagtcatgttttgacaatgacgcatcggaacttattaaaaatgtggcataatccagataatgttagtgacgtggtgatacaaccaattatttttaccctattattcggttacttgtttggtggggccattgcgggcagtgtccaggcctatttaccaatgctagttaccggtattttgattcaaagtattttgaatgcagcatcgggatccggacagcaattacgtgaagacattaacgcgggggtgtttgaccgcttcaagacgctaccgatttcaccgatcgtaccgttagccggtcagttagtgggggatgttttccgattgcttatttctggcttgatggcactggtgacagcttttatgatgggctggcgacctattgttagtccgctagtattgatcggcgttttactgctggcagtatttgttggatggtcgctttcatgggtctttgctttagttggtttaatggtcaaaaatgcggccctgattggcagtctgtcaatgatcattattttagtgctgacctttttatctaacgcctttattccgactaagacgttaccacatttgttgcaaacaattgtccgattgaatccggtcagtctaacaattaccgcgatacgcacaattttgcggactggccattgggggcccgatgcatttggtgtactgttaagtggtttccttattattgtgatttttatgccgttaactgtgttggcatatcgccgatttggttaacggtacgctaaaaatagtgtgtgttgcggcttaatgaccggcagcgcacactatttttgaaatggggaattactgcccgttcgaaattgatggtgatgaaaagtgtcagataagtggagactgatacttgcgagggccaatgattggctgcaattgttgttcgtggtgccaacaagcgataatgagcaaaataataatcaatacttgcatagaagataaaacgaagtctgtcaatccataggctagaatgatgggcaaagtcatcataaagtaacgcaaattcggcgtacgatactggtgccaatatttggttaagtgccagccactgctgaggactaagtaaataaagccggcaccgcctaggataccaaaagaagctagtagcatgagcaaaatatcgtgggcgtgtgggacgtaggttcccgtcagttgcaaatagtgccgcgcaaagccaaaatacgtcacgccgaggtacggggcctgtttgaaaacggtgaagctgttgtgccaaatcgtcaagcgactttgaagtgcggtgatggtcgaagcacttctagggaaaacgtgccagacaattaaactgccagcaatcaagattgttgtaaccaaaatgcgatggtgacggcaaagctggtaagtcgtcatgatcagaatggcaatcatgatcatgagccctgtgcgcgatttggtttgataaacgcccacacaaagtaagccgaccaaaaaccagtttatgagcggccagcgcgtgaaggggtgaacacttccatgacttaactgtgtcaatagtaagccgagggcaatcaataataaacagcaggcatcatttggattataggcggacccgaacaagcgattctgattagcagcatagccccataataggtcacccagcatgaacttcagccacgttggtaatgtcaatacttggttaagccagtggaaagcaaaaccactaattgtaatatacaagccaaattggatgataaatttacgaagctcgtgccaagcaatcgactgcgtggactcacgacacaacaaccaaagattgcccaatacaaaaagcattaggacagacagaataacactacgataatcgtggtgattgagattgagcgtcgtgatgcccattaataggacgataaaccctagcaacgggtcgtgccgactgaattgtcgtggatgtttgagtaacgccagccattgccaccggcttaaataaatcagccatccgatacctaccggcggcagaatagctaataattttaggccagtcaaaaatggcgacgtcgttaaaagacgttttcgcatggttaatcaaactttctctcattagataatatgtcgcttgccagtcgacattagccatattatggcacgtctgcctgtcatccaaacttgcattaatagaattttagttagtttgaacaaagcttaggaattttcaggaaaatttaaccagctgaatgcgtattcacagtgaagcatggtaaaatatgattagtaacgtacggtgatacgggtgctatcctgaatcaccattgaaatgcgttggtttttaaggtcaaagatgattggccaacaaaggtctaatctagtgtgcgacctttgttcagactgctaacttccaggccattgggtatcgccatgatcttagttgaacctcgttgggtatttctgataaagagccgacccgtaattcaacgaccagcacgtttcgattttggtgcatactaaggatagcgagtgacgtgcgtggttagttaaactgaataattaaaacaattgaaccgggtggatttgaccacaaccactaaaagttagtcgtgtgggtaaatcttcccgaattaaaggggaactgtatgtggatgcaaaacaattatcaaaacgattagcaacggttggcgctttcgttcagccgggcgcccgcgtggccgatattgggtcagatcacgcttatttgccagctaatctcgcattaaatcatcaaattagttatggtgtagctggtgaagtcgtccgggggccctttgaaaatgcgcgtcatgagattcaaaagctggggttaacggattgcttagtggcccgtctagctgacggtcttgctgcgattgaaccagctgatcgtattgatacggtcacgattgccgggatggggggccctttgattcgccatattcttgaacaggggccgacccagctcgccggtgttcaacggttggtactcgagcctaatgttggtgaagcgaccgtgcgggaatggctggcggccaatcagtttcaaattgtagctgaacgaattctagctgaagatggccatacttatgagattctttgtgctgatcgggttgatcatcaggtgacgtatacgacggctgaacagatgtttggcccgtttctgctagctgagaagtcgccggtgtttatcgctaagtggcaacgtgagttacaacgagtaaatgcggcggttgcgcaaatgcaacgggctaaagtgataccagaggaacagttagcgctggctcacgctaaaatcaaattgattgaaggagtcttgacggatgcaagcaagtgaattaattgcgcgttttgaaaaatttgcgccactcaagttgaagtgggagcatgatcccaccggattacaaatcggcgatcctcatcaggatatccacaaggtgttagttaccctggatgtgcggccggaagttgtccaagaagccatcacgatcggtgctgacatgatttttgctcatcatcccgtcatgtttcgaccggccaacaatcttgattatcaggatcctcagaaagcaatgtatgcagaacttgcagctcaccacatcttggtgtacgcggcccatacgaatctggactgtgctgagggcggaatgaacgattggcttgcggcggccttagacttgcaaaatgtgcagggattggttcctgggtatcgtgcacaggctgttaagttgactttaacggtaccgaccaatcaagttgaaacggtacaggaatacttaacgaataccgtgggtgccacgctagatcgttacgctgtcaactcgggtgaacagttcagcgtcgacttactagccgatcagattccaactgcggtagcgggcattaatgacttagccgctgacacgtgggattaccaggtcgtgcaactgttgtctggcggtcatcagtattatatgggccgagtcggtgatttgccgacaccgttatcagcgcaggcatttgccgaacagtgtaaacaagtatttggtgtcagcggcctgcgactagtcagtgccgatccccgacaacggattacccgtgtggccgtcctgggcggcgatggtggtaagttctatccccaagcgttgcgagcaggtgcacaagcttacgtgaccggggatgtctattatcacaccggtcatgatatgctggcagccgggttgacggtcattgatccaggccaccatatcgagagtatttgtaagtcacaactcactaagctgtttgatcagtggcgtgtacaagctggctggccaatcgagattgtggcgtctcagctgaatactgatccgtttaccttcatctaagttaatcatgaactttaataaggaaaggaagttatcatatgtcaaaatatccaaacttaatttcagattttttaacctttgtcaaaattaatagtcgttcagatgaggaatcaacgacaattccttcgtcaccacgtgaaacggcctttttaaagcaattaatgagtaagctcactgatttaggcttgagcgatgttgaacaggatgcgcaaagtgcgtacgtttttgcgacgattcctgcgaatagtgacaaagctgttaaaactcttggctttatttcacatattgatacggctgactttaacgcggaaaatgtcaatccacaaattgttgacaattatgacggtgaatcagttattaagctcggaaacggggactatgtgctggatccggcggtcttcccaaacttaaagaactatgctggtcacacgctgatcacaactgatggaaccacgctgcttggagctgatgataagtctggcgttgctgaaatcattagtgctgcggaatatttgttggcccatcctgagatcaaacatggcaagattcggttagcttttggtcccgatgaagaaattgggactggtgctgatcactttaatgtgcctgcctttggcgccgattatgcctacaccgtcgatggtggtccgcttggtgaactggagtatgaaacgttcaacgcggcccaagcgacggtgacgattacaggtgtcaacgttcatccaggggaagctaaggataagatggtcaacgccttgcagttagccgttgattttcaatcggcgttacccgcacatgatgtcccggaacacacggaaggccgtgaagggttcttcttcttgcttagtttagacgggaccgttgacagcgctaagatgacttacattattcgtgatcatgaccgcgataagttcgaagcacgtaaacggttatttatggcaattgcggatcggctgaatttggctgacggtgtggcctggatcaaggtcgacatgaaggaccagtattacaatatgcgcgaaatcattgaaaaagatatgcgggtcgttgaattggccaaacaagccatgctcaagctcggtatcacgccagccatttatccggttcgtggtgggacggatggctccaagatctcatttatgggcttgccgacaccaaacttgtttgctggtggtgagaacatgcacggtcggtttgaatacgtttcagaacaagtgatggcccaagccgtggacgttgtcttacaaatcgttcaggataattatgaccaggactaaatccttgaccttgtttgaccttacgggttatactctaatagtcaataaaggtcaaacaaaaattggcagctatgacggctgcctttttgctaccgtttttgaggaggtacgtaaatatgaatccagaacaatttacagaaagtttacaacaagccttacaacaggcacaacaaatcgcacaaacacggcgccatcaagaaattggggtgccccatctatttaaatttttaacgcaaccaggcgaactggttcggcagatctttagtgaggccggcgctgatttagaccaattacaaacagagctcgaccgtgagctggatgacattgccgttgttagcggtggtaacgttcagtacggtggcagtatgagcagtagtctagctacgctgatgcaggctgccgatgctaagcgcaaagcgttaggtgatgattaccttgcgaccgacactttggctttagcgctgatggatcaaactggtgatcagttgaccaaatacttgaatcagcaaggcatcacggcaggacaagtcaagaatgccgttgatcgtattcgcgggggtcaacgggtcacgtcacgtaatcaggaagatcagtatcaagctttggaaaagtacggcgtcgacttggttaaacaggcgcgccaggggaatcaagatccagtaattggccgggacgaagagattctggacgttattcggatcttgtcacgaaagacgaaaaacaatcctgtcttgattggtgaaccgggagttgggaaaacggccatcgtggaaggtctagcacaacgaattgttcgtggtgatgtgccggagaacttaaaagataagacgttgttctcgctagatatggggtctctgattgccggggcgaagtatcgtggtgaatttgaagaacgactcaaagccgtcctcaaggaaatcaagaagagcgatgggcagatcatcatgttcatcgatgaaatccataatatcgttggtgctggtaagacagaaggcagtatggacgccggtaacttgttgaaaccaatgttggcgcggggagaacttcatttgatcggggccacgacgttagatgaatatcgtcagtacatggaaaaggacaaggcactcgagcggcggttccaaaaagtattggttgctgaaccgagtgttgaagatacaatcagtattttacgtggcttaaaggaacgctttgaaatccatcatggtgttcggattcatgataacgccttagtggccgctgccaagttatctgatcgttatattacggatcgttacttgccagataaggccttagatttagtagatgaggcttctgctgaaatccgggtcgaaatgaactccaacccaacggaattagaccaagtcaaccgacaattaatgcgtttagaggtcgaggaagccgccttaaagaatgaaactgacgatgcctccgttaaacggctagcggatgtgcaaaaagaactcgccagcgcaaaagaaaaacagcgggctttatccgaacgctgggacagtgaaaagaagagcctccaagcgttaagcgacaaaaagtcggcgttagacaaagctaagcacgacttggaaaatgctgaaaataattatgatctggaacaagcagctaagttgcagcacgggacgattcccaagctggaacaagagttgaaggccatggaagccaatgatcatcatgaagattggttagttgaggaatccgtcacgccagatcagattgcaaacgtggtttcccggatgacaggaatcccagtagccaaactggttgccggtgagcgggagaaattattacacttggcggaccatttgcatgaacgagtggttggtcaggatgcggcggtcgatgccgtttcggatgccgtattacgttcgcgggccggtttgcaagatcctaatcgtcccctgggttcttttatgtttttaggcccaactggggttggtaagacggaattagcgaaagcattggctgagaatttgtttgacgccgatgatcatatggttcggatcgatatgagtgaatatatggagaaagagtccgtttcgcgattggtcggggcggcaccgggctacgttggttacgaagaaggcggtcagttgaccgaagctgtccggcgtaatccgtactcgatcgtgttattcgatgaaattgaaaaggcgcatccagatgtgtttaacatcttgttacaagtattggatgacggtcggttgacggatggtcaaggacggaccgtcgacttcaaaaataccatcttgattatgacgtcgaacttaggatcagagttgctactggcgggggttgatgaccagggtcacttgtcggccgacacccatcaacaggttatgcagctggttcaaagtcgattcaaaccggaatttttgaaccgaatcgatgacatcattatgttcacgccactacaattgggcgcaattgaggaaattgtggtgaaattgattgatcggttgtctgcccgtctccaagatcgtgagattacactgaaaatttctgacgaagcgaagaagtggatcgctaagcaggggtatgaaccggcatacggtgcccggccgctccggcgctttatcacgaatcacgtcgaaacaccgctggcaaaagagatcattgcggggcgcgtggcaccaaaatcgacagtcgccattaatttgatggacgatcacttagtcttcgaaaaccaatcgacccagccggcataagcgtaatcactgatttgaacgcgtgataatgcgtttcagtgacgataattgggccaataaaaactggaccgtgagcaccttgcgatgctcacggtccagctttttttaggcggattattattgtgacttggttgagcctatgattctggatggcttgatcgtgtaggtgtgaggcagctatctttggtttatgatgatggtagccgcgcttagcttcggacgagggggaccttgcgcccgtgcgtttaacctcatactgagaaaagagttgttaccgccgacgctgtcgtgttaagctactccaaaatcgaggagtaagcgaacatggacgacgatcgtaaaaggtttgaccagtatgcaaaaaatgaatcgaaaaattaatgtacaacgtggttctttatcagcggccgatttggcattttgggcagcagcacaacgcgcaaagcagaaatatgccaaaacgctgcaaatgctcaaagcaagtgatggatcgtaagcgtcattaatctgaatgttagggtcgggtatgtaccagcattctagttggctggcgcgtcaagcacacaacaaaaaaagacgagtaaccgcaatcgggatactcgtctttttttgttgtgctgagactaagcgaagcaaagcctctggttgtttttaattacttattatctgaacctttagcgggttgggaatgattagtaatataagtgatgctgttgaccacgattagcgcaaaaattgcggcaacgatgccaatttcaccaggattataggagagttgttcgagggcgccaccgatatagccgatgacttcaccgaagaggacactccaaaagataatcgtaagttgtctcatcattttccgacacctcccaatgaaaattattttaacacaccgacaggaaaaagcaattaggtaataacgggatattaaggctttaattaggctgatataattacgacgagacggcggtgaaaccctagtaaacataaccgtgcacgttatctgatgacttaaaactgccgcttagaacaactgtttggtataatgaatagtaacgaatatatctgaggacaagattggtcatcaactggcattgaatagactggtaaattctttgtttacccatcaattgggagcgggcttgacgtagctgatcggatgttacgttttcgatgcgagttgaaagctgatattttatgaaagggggcggcgatagtggcgcaatatgttccattgcaagtattgagtacttttagtttacttcacagcactagtacagttagtgagctagtccaaactgccaagcaacaggggtattccacgttggctttaacagacgttgatatcatgtacggtattgttgatttttataatgcctgtcgccaggcagaaattaccccgatattgggaataacattgaacttattaggacgtgaactaacggcgcaaacgtttagtctggtcgtgcttgcgaaagatcaagctggctatcaaaacttgatgcggttgtcgacgatgaagcagacggcgacggatgcaggattgtcgctaacagccgtattaccttatttgaaccatttaatggtcttaaccccggctaaagacagtgaactagctgcgctgttgttacaaaacaccgctgagcgagctgctgattggattaccacgctgaggcaggcggtcgactctgctagcctttacttagggatttctttggatcaggcccctgcattgcgaacaacaatgacggcctttgcgcaacagcatcaattgccggtagttgcgttagatccagtcgactatgtccaagcaaaggattactttgccgtttcagttttgcgagcaatcgatcggggccaacagatcgaacagcccgaatcgttacaaggtatcgaaggcagtcactacttacggccggccaacaccgtaacggctgactatgagcaactgggattgacgacggcggtggcggctacggccgaaattgcggcacagtgtcaagttgaattacaatttcaacagccacagttgccgcaatttccaacgcccgctggacaaccagcgaatgtttatttacggcagttatgcacggctggtctaacggagcgattggcggcaataacgccgtcggttgatcagcaggcttaccaggaccgtttggatcacgaactgaccgtgatcgatcagatgggctttgatgattactttttgatcgtgtgggatgtcatgaattttgcgcatgaggcccagattacaactggacctgggcgaggttctgcagcaggctcattagttgcttatgcactcaatattacggatgtcgatcccttaaaatatgacttgctatttgaacgtttcttgaacgctaaacgggcgaatatgccagatattgacttggatattccagataatcgccgtgaacaggtacttaattatgttcatgataagtatggtcatgaccgcgtcgcacaaatcattacgtttgggaccttggcagcaaagcaagcattgcgcgatgttggccgtgtgtttggcctctcaacttacgagatgagtgactggagtgccgcaatcccaaaccaattgcatattacacttgaccaggcctaccagggctcacaacggttacaaaacctcgttgctgattcatctaaaaataaattattatttgaaacagctcgccgtttggaagggttgccacgacattattcaacacacgcggccggggtggtattaagccaaaaaccattaattcagatcgtaccactacaagcaggtagtgaaactatgatgatgacccagtatactaaggacactgttgaagcggttggtttgttaaagatggatttcttaggattacggaatttgtctttgatggcaagtgcgctacattatgtgcagcgtcaaactggcaggccactggctattactaaaatcgatttgaacgatccagcgaccctgaaattatttcaggcgggcgacacgaccggagtcttccaatttgaatcggcgggaattcgaaacgtgttacggcgtctgcacccggataactttgaattggtcgccgcggtcaatgcactttaccggccggggcccatggaaaatatcgaccattttattgcccgcaaacaaggccaagaaccggtcagttatccggcggaacaacttgcgcccatcttaggaccaacgtacggtattctggtctatcaagaacaagtcatgcaagtcgccgcggtcatgggcggttttacactaggtgaagccgacttattgcggcgggcgatgagcaagaaaaaacgtgctgtgattgataaaatgcggcaacaatttatcgctggtgcacaacagaatggttattccgaagcagttgcgacacaggtttatcaatatattgaacaatttgcgaactatggtttcaaccgctcacacgcgattgcctacagtaagatggcttttgaacttgcttacttgaaagtccattattccggagcgttctttacctcattgatgaattctgtgttgggcaatggaacgaagctgaaacagtatctagcggaagctcgtcagcaccaagtggcgattattcccccggatattaatcggagcggtcaatactttgattggaatggtcaagccattgtgtttggactcagctcaatcaaagggttgcgccgtgactttattgcgagtgtgttagacgagcggcaggcgaacggaccgtttaaaagtcttcagcagttcatgcaacggattgacgcgaagtggctcaaagccgatttgatggatgcactgatctatgcgggggcttttgaccactttggtttgaaccgtgcagagctactgaccagtgtgcctgaattgatgtcaagtgccgagttagccggtggcagtatgagtttatttgaatcattagcccctaagatcaaaaaacagccggagctttcgttaggtgagcgattggccaaagaagcggagtatcttggtgtgtacgtttcagggcaccctgtggaaacgtatgattggctcgcgcaacaacgacatacgcaattagtcagcacgctcacgagtgaacaaccggcacaaatactggtctatattactaaggtccgaacgattcggaccaaacgtggtcaaccaatggcatttgcaacgggaagtgatttgtccggcgaaattgacttgacgatttttcccaacacctatcaacggattcaggcggaattgaaaccagaagcaatcgtgttaattactggtaaggtcgagcaacagcgggatttgcaagtgatcgtaaacacctggcagttggcggaacaattacccaaaccaaccggccaactctttttgcggttgcaacctgagcaagcaacggcgactgtgcaaaaggaaattttaaggatcttaagtcaatatcgaggtcctaatccagttctaatttactcggtagcagcacatcgaacggttgaactaaattcacagtattgggtcgcagaaaatccagatttggttggagcgcttacaaccttattaggtcgcgataatgtggtgatgaagaacgctatcccttgatacgacggcgttttttaacgcatttaattttagaaaataacagacaatccacgtgaaaagtgttagaatcacttatggagttacgaactcaatttattgcctgaggtgaaaaaatgaaacgcattggtattttaaccagtggcggcgacgctcctggtatgaatgcggccgttcgtgcagttgctggtaaagcaatggctgaagggttggaagcatacggcatcaattacggctttgctggattagttgccggtgacattcacaaaatagaagcagccgacttagatggtgtgattcaacgcggcggaactttactatactccgcacgttatccagaatttgcccatgaagaaggtcaattaaaagggatcgaacaattgaagcggtttgggattgatgctttagttgttatcggtggcgacggttcttaccatggcgcattgcgcttaacggaacacggctacaacacgattggtcttccagggacgatcgataatgatattccttacacggacttcacaattggttttgacactgctgtcaacaccaacgtgcaagcccttgaccggatttatgatacggctcatagtcatgaccgtactttcgttgtggaagttatgggtcgtggcgctggtgacgtagccttatggtccggtgtttcaatcggcgcgactgctattgtggtccccgaagttgattgggacatggaagaaatcgccaacaagattaagcataaccgggccaatggtcatcggagcaacttgatcgtgttagccgaaggtgtgatgggtgcccaggagtttgttgagaagttatccgaatatggtgactttgatgctcgtgggaataccattgctcatatgcaacgtggtgggaatccaactgctaaagaccgtgtcatggccagcaagatgggtgcctacgctgtggaactcttgcttgccggcaagggtggcttagcggttgggattcaaaacaaccaattagtcaaccacaacatcttagatttatttgaatctaagcatgacgttgaagtgtcattagataagttgaatgaagaaatttcattcaagtaatcatggcatgttagttcttattttaatttgataaaaatgacgttaatgtctttttataaaaactttcaagggagagatttttcttatgaaaaaaaccaagattgtttcaacacttggtcctgccagcaccgatactgacactattgttaaattaatcgaagccggcgcaaatattttccgctttaacttttcacatggtgatcatgaagaacatttagatcgcttaaacaaagttcacgaagcagaaaagattacgggtaagaccgttggtatcatgcttgatactaagggtgctgaaattcggacgaccgttcaagctaacggaaaatctgaatacaagatcggtgacaaggttcgtatcaccatggatgattcattagatacgacccatgataagattgccgttacttacaagaacctctatgatgatgttcatgtaggtggccatgtcctctttgatgatggtttattagatatgaagatcgacgaaaaggacgaagctaaccgcgaattggttacaactgttcaaaacgccggcgttttaggctcacgtaagggtgttaacgctcctggcgtttcaatcaacttacctgggatcactgaaaaagactcaagtgatattcgctttggtttggatcatgaaatcaactacatcgctgcttcattcgttcgtaagccacaagatgtcttagacattcgtgaattacttgaagaaaagcacatggaacacgttcaaatcttccctaagatcgaatcacaagaaggtatcgacaacgccgatgaaattcttaaggtttgtgatggtttgatggttgctcgtggtgacatgggtgttgaaattcctgctgaaaatgtgccattggtacaaaagagtttaatcaagaagtgtaatgctttaggtatgcctgttattacggctactcaaatgttagactcaatgcaagaaaacccacgtcctactcgtgccgaagcttctgacgttgccaacgctgtctttgatggtactgacgcaacgatgctttctggtgaaagtgctaacggtctttaccctgttgaatctgttgccatgatggctaagattgacgaaaaggctgaaaacactttggctgaaaacggtacgttacaattaaaccgtttcgacaagactagtgttactgaaacaatcggtattgcgattgctcgggcagctaagaacttgaacattaagacgattgttgctgcgactgaatctggctacactgctaagatgatttcgaagtaccgtccaaatgctgatatcttagcaatcacttttgacgaacggacgcaacgtggcttaatggttaactggggtgttcaaccaatcgtggctgaaaaaccagaaaccactgatgacatgtttgatttagctgcttctaaggctgttgaacttggctttgccaaggaaggcgacttaatcttgatcactgccggtgtgccagttggcgaacgcggtacgactaacatcatgaagatccaattaattggttctaagttagctgatggtcaaggtgtcggtgatgaaacggttatcggtaaagccgtaatcgcaacgtctgctcaagaagctatcgacaaggccgttgaaggtggcgtcttagttactaagacgactgacaaagactacttaccagcaatcgaaaagtctagtgctttagttgttgaaaacggtggtttaacttcacacgctgctgttgttggtatctcaatgggaattcctgttatcgttggtgttaaggacgctactagtgttattgctgatggtcaattgatcacagttgattcacgtcgtggccttgtataccgcggtgcttcaaacgccctttaagatcaaatctaatttgatattgaaaagtcgtcgctttgcggcggctttttatattacataaagtgcttcactcccagttaaattagtatgaaacatggttaaaaggtgccaaatcgtcaacgtcaaatgatccagcttaagcccgctggaaaaagatctacttagcggaaatttacttagctagcggcgtcctataccgacttccaggcatttcggccaattgctggaacgcggtggacacagatttaagccgaagaccacgtcttaaatactggtcttccactaaccaagccaaaaacgcttactaagtggaatttcaccgctgagcattggccgaaacgccttccagtcgtgatagtatgcgaatggccgacatgggtggacccagcattgaacgaattagatgttgctattttaaaacagcgattttatcatacaacagttagtttgataatataattgtgattgtacgattatttctaattccaccgtattagtactgaggtgtccaaaacaattgagacagcattaacgcatgttcaaaattctaagtagtaaacccgttcagcgacaagttaggtggtcgttcatcagccattcgactggcttaccgactggaggggttgggtgacaatgctcagtagccaaattattcttggctggaagtgggttgcttccggcctagaataagactcgtatttgagattgcgcagtgggttgctgcgtgagctcaaatcgacgtcggctacgttccggcaattgtcacccagccccgtaagtcggaataggacgaaccttgctgacgagctggaatccaaacgatttggcaccttttaaccctgttcccgcctaaattaaagaacaggaatcggttattgatcagggggggatagtgaaattggtgagtaacgaccaacacccctcgtaattcgggccattttcagttacaattgataacacgtgaggtgtcgtatggaaagttggttatttttattagcgattttagtggtggcatggttaggaaaaaatcagtccttacaaattgcgaccgtggttgtgttgcttatcaaattgattcctaatacgagtaaattgctgacgacgattggtcagaagggaatcaattggggtgtgacggtgattaccgtcgcaattttaattccgattgcgactggtcagattggatttcgggacctttggcatgcgtttaagtcgccagttggctggattgcggttgcatgtggagtgttggtttcagtgctctcatttcacggtgtcgggcttttgtcagcgacaccagagattaccgtggcattagtattcgggaccattatgggtgttgttttgctcaagggaatcgcggccgggccaattattgcggctggtataacctattgcattattcaagtcttgcatttgagcttacagtaatttaaaagaaccatccgttgatatttatagacggatatattagaggagttatcacatggatagtattattggaacagtggttacggcgaaggtaaccgatgaaaacgatgaagcatgcttcgtacagattgatggacagacgttgtgggtcgataaaactgaaccagagaagccattgcacattggcgggctttacgaaggttttgtttatgagaatgaagaccatcatctgcagatgacgcggttcgtcccggaaatttcgtttgatcactttgtgtggggaacggttgtccggacgcggcatgatctgggtgtctttgtcgatgttggtttaccaaataaggacttggtggtgtcattagacgaattaccgaccatcagtcgactatggcctaaaaaagatgatcgtttatacgttaagttagcccgtgacaataagcaacggctatgggcgacgctggcagaattgacggattttgaagcaattgccaagccatatgaccgggctcaagttaagaatacggataccatggcgaccgtttttcgtttgaagatggccggtacgtcggttattacagatgacaatcatctgggctttgttcatccgtcagaacgtgaacaggaaccacgcatggggcaacacgtcaaggcgcgggtcattggtttcttgcgcgatggtgaattgaatttgtccttgaagccgcggggatacgaagaaattggcgatgatgcccaaatgttattagcagcattgcaacatcaagctgaccacgcgctaccattttgggataagagtgatcccgatgatattcggaattactttggtatcagcaaatcacaatttaagcgcgctgtgggtaatctcttgaagcaacgcttgatcagtcaacaaccaggcgagatcaagttactggaaaatgcggatgagcaagccgacgattgatcaaaaaatgcaggaccagcttgctgattacctgcattttttgcgtgttgaacgggggttagttgagaatacgattaagagttattctcaggacctgactacgtttagcgaatacttgatgagtcagcaaatcacggactatcgggtggttgatcggtacgtcctattgaattatttacagtatctagatgaggctggtaaatcgcgaaatacaatcattcacagtgtttctagtttacgtaagttttttcaatatttagcacagatgcacgctatcgatactgatccgatgctaaaaatcgacacgcctaagcgggcgcagcatttaccgcaagtattgtcaccacgcgaggtcgaacggttgctagcggtgcccaagttgaataccccgttaggattacgagaccgaactctgttagaagtgatgtatgcgaccggtctgcgagtcagcgagacaattaatttaacgatggatgatctgcacttagacttgggattgattcaaacaatcggtaagggtgataaagagcggatcattcctatcggtgatgttgccattgattttattacccgttatttaaaaacggctcggcccaaactcgtctctgccaaacgccggaatagctatttgtttattaataatcacggtggtaaattaagtcggcaaggggtttggaaaaatctgaaggcagaagtcaaggcggctggcatcgaaaaaaacgtgacgccgcatacgttgcgccactcgtttgcgactcacatcttagaaaatggtgcggacttgcgtgtcgttcaggagcttttagggcatgccgatatttcgacgactcaaatttatacgcatatttcgaaaaaacgcctagctgaggtttataataaatatcatccgcgggcatagatgcggtgcggaatcaagcagtcaagggaggcaataccgtgctcgttaaatatcggaaggattatgaaaaggtagcaatggggctactgtcatttattccagattttaaggacctaattcatctacaaactgagatgcagtggtatcagtcaacggaagaccaccaactattactatggcggcaaggtgacggcgatttctgtggtattatcggcattgaagtcggcagtgactttattctactgcatcacgattcattatcacccgaggaacggacggcggccaaccagtatcaaatgttggatgagttggccgcgttatatcccaagcaacgggtcatgggaactttagaaatggcgccgatcattggcgcgtgggagcgtaatcgtgacaaacaaccaacaacaaccaatcaccattaagatttcggagtttgaggggccactcgacttgctgttgcacctcatccgccaaaacaagatggatatttatgatattccaattgcggcaattacgcagcagtatttggattacttacactctatgcgagcgctaaaattagatattgctggtgattatttggttatggctgcgactttgatgacgatcaagagccgtttcttattgccacagcctgaaccagatgagatggacgaagataatgaggacgatgatcctcgtgactcacttgtagctgaactgttggcttacaaggtttatcaggaagccgctggtgaattgcgagaaaaagaacaggcgcgccatcagcattttacgcgtgaagcgatgttagtaccagctgatctgagtgcgcccaagctgactgcggggattacattagatgatctgcaagcggcttttcggcaattagtggctaaacggcggcgggtacggccactaacgaaaacggttgtggctgaaaccatcaacattgatgagcggatgacacaaattacgacgcaattgcaacatcaaccacaaggactggattttgccgacctatttacggttagtgccagcgatgaaatgttagtgacaacctttatggctgtgttagaattaaccaagcaggatcaagtggcgctgcagcaagctgagccactgagtccgattcatttatatttacgacaggatgaacagcatgacgaacattgaacaaattgaaggactattatttgtggctggcgatgagggcatcacggtcgccgaaatcgagcacgccacggggtttgctaagccggcgattacaacgatgctcacacaactggccacgaagtatcaagccgacccagacagtgccctaatgatcttatcaacggcgaatacttaccggctagcaactaaggccgcggtggcgccggtgttaaagcgctactttgaagcaccactcaccacgagtttgtcgcaagcatcgttggaagtgttagcaatcattgcgtatcggcaacccttgacgcggattgaaattgatgagattcgtggcgtacacagtgggtcaacgattcaaaagctggttttgcgacaactagttactgagacggggcgtttaagtgagccgggacgaccaattttatacggaacgacggaactgttcttagattattttgggctaaagtctttggatgacttaccagcgattgacttagctgctttaagtgacgctgagcatccggcaccagagacagacctctttttaaatgcatttcaggataaattacaagcagaacgtgaggatgaataatggcagaacgattacaaaaggtaatggcggaagcgggcatcgcttcgcggcgtaaatcagaagtgttgatcacgtctggtcacgttaaggtgaatgggaagacggtcaccacgctcggtgtaaaggttgaacctagtgaccatgtcgaggttgatggcgtgccattgaatgcagaaaaactcgtgtattatttattttataagccgcggggggtcgttacaactgttcatgatgagaagggccgtaaaacggtattagacttctttgaagacgtaccggaacgaatctatccggtgggacgtttggattacgatacttcaggtttgttgatcatgacaaatgatggggctctcgctaatcggctaactcatccgaagtacgaagtcaaaaaaacttatttggccaaagttgaaggggtaccaaccaatgctgatctcaagcaattgcgcttgggtgttgaaatcgatggccgtaagacagctccagcgaagtcgaacttgttagatagtgatcacaagaagaataatgcgctggtccaactaacgattcacgagggtcataaccaccaggtgaaaaagatgttggctgcagtgggtcacccagtgactaagttgaaacgtgaacgttatggggttctcgatttgcaaagtttacaaccgggcgaataccgtaaattgaagccgattgaaattagtaagttaaaaggtgaacgatagcgcttgcatttttgaatgaaagccgttaaaatgaatttgtaaaaataaatattggttcatcttcagggcagggtgtgattcccgaccggcggtaataacccgcgacctatgcgtgtgcatagtgatttggtgcaattccaaagtcgacagtaaagtctggtataaagaagatcgagcttatttgccaagcgttgcaagtaagtccgcccccagatgacagttagtgtgatcgggcggacttttttagttgaacaaatggtaatgcggttcattgaagatgacccataggagggtgcgttatgcaacatacaacgttacaccgactagtgggcatagccttactcggtgccattgcgtatattttaatgttactggagtttccgattttaccggtagcgccatggatgaagattgatttttcggatattccaattctgattggtctctttctctttggtgtcgggggcgcgtttgtcatcactatcatcaaactgctcctacattcagccatgatgggctttgccatctatgacttaatcggttcttttgctagttttttaggtacggcagtattgattttagcatttgcattagtacttcgttactatcggggcaatcccaagtggcggatgcctgtggcgattgtggtcgccacaatcggcctggtggtgattgaatcgttggctaacttaacgtttgttctgccattctatttgcaagtaatgggtatgaagctcagcatgtcgctgaatacagtggtgttagtggcagtcattccatttaacttgatcaagggattgctagtgggtaacgtcttctggctggtctatcagcgattagctaagtggttaggcaaccataatcagcttatgagccgaatttaatttaagtcgttaaaataatgtgggtggtcactaattgcgtaactgcagggtgactgcctttttatattggtgccaccgtgatattcttaaagacgcacactgccggttggcggatggttatccatgagctttaatgtggcagtaagttgataaatttgaagcttcgatcaaggcttagaaagattaaaaagctgtcggtcgctatgctgtgtcgcgggtcactgtcagcgacactgacgcacgtaaatttgggctgatcacgacttaatttaaaaactggcacatttagtgcgcaattaacaatcacaacagcaagacttaagggaggccttagcgtgtttacagactacgttttattgttattcagtacaacgccgcgacgagcaaagggcctattcaatgtcttgcgcggtcgccgtacggtctccacgctttttgcggggttaactgccggctacttggatttgctcgacagttgccacgaggttcccttggaagatttcatggcagcaactgcggctttgactgaaaacggtcaattgacgagtacggccacgggatgctggcaattaacgcagacgggggaacaacggcaagccaaactccggcagactttatacatgccccaaaattttgaagtgtttcaaaccactgatgtccgccgatttagaatcgtcagtcagctagccctacaagtcgtttccgaactcgtacatcataatcgccattactatccggtgacgactgatccggggattcaggcccaggtcaaacaatggttacgtcagcagtcgaaggtggaacttggcgagcaaattcatgcggccttgactgccttcttgacgagtttggcagacccagagttaccaacggtgtttgttcaaggcataacggggtatcaagaaccgggactgactaatgagcaattagcggcacaattaggtcggcaaccctgggaggcgagcttgatgcacacggacgtgatatgccaatggattgcttggattcagcgacacccgcgtgatccatttgcccagttgttgtcagtgctcactcaagcgagtgccatcagtcaaagcgctgagcaaacttaccaagctttcttgaagacccagcaacttgcagcaattgcgcagacgcggcacttaaagatgagtacggtacgggagcacttgttggaggtggcgatttggtcgcctgattttccgtttgaaatggtgttgaatcatgaattaactcagcagttgaccaccatctttgcagcccagtccgacattgcaaactggtcattccaagaggcccaagctgcgctacccacgctagatttttttgaatttcggctatttcagattatgaggtgtcagcatgtcagaagatgaattatatgagctgttgaaaacgaaatatggcttcgatgaatttcgccccgggcagctagccgtcattcagaaattattagcaggtcaagatgtcttggcagtgttaccaactgggaccggcaaatcattgatctatcaactcgtcgggaccgcactacccgggctagttgtggtggtttcaccgctgatttccttgatgcaagatcaggtggctcgcttaaactatcaaggcgaaaagcaagttgctgctttgacctcccaactagattatggtgctcgccagtatctgctgaatcatttaggacagcttaaattcttgttcatttcgccggaaatgttgggtcaagacattattcaaacagcgctgatgcaagtgcaactggcgttattagttatcgacgaggcccactgcatttcaacttggggaccagattttcgccctgactaccgtcgcctgggtcaaattcgacaacggttacaggcaccgacaacgctaatgctcacggcaacggctacacaacgcgttcgacaagatattttgacacaattaaccgttccagatgcccagcaagtcttatattcggttaatcgtcctaatatttacttagcagtcgaacaggtcaatgatgaagctagtaaacgcgcgaccttgcaacatttagtgacgagtgcgcgcggaccagtcatcgtttactttacttccaagcggcaaactgatttgatagcggaatggctacgaacgacaaccacgttaagggtcgcggcttatcatgccggcttagcgaccgatgaccgtttcaagatccagcagcagttcatggcaggacaattggatgtgatctgtgctacatctgcttttggaatgggtatcaacaaagctgatattcgcttagtgatccactatcatttaccgacgactttggccgactacgttcaagaaattgggcgcgcaggtcgtgatggtcagcaggcgatggcgattatgttgtacgcaccaggtgacgaaaacctggtgcggaatttgaacgaattgacggctgcgactcccaatgaaattcagcaagattatagccgttatcaagcgcagcagccaccgactgatgatcgtagtaaggttttgcagtcatactggctacaaggaactcccccaacgaccgtggcaacgatttttgctgatcgccaagcagctaaggaacgtgaattgcgggcgctcatgggttacgtccaaacgacaacttgtcatcggaccgtgatgttaacttactttggtgagccagctgttacccatacagatcagtgttgtcagttggctggtgaaccactaccgctggctgcgttagggttgatggcgacgcatgatgagtcaacagccacgataatgtcgtgggatcagcacttagctcaattgtttttaccaaattcttaaagaaatcgattccgggttatgttacaatattggttgaaagttttttgaggaggaacaccctatgagtcaaaaaaatgataatgacaaatcccaagcggataagccgtgggacaaaacttttgaagacgatcgggatgactcgggcaatttatcgcgaactcaaaaacgaaaacaagacagtagcaactctacgctaacgaccgtgttagtcgtactaatattgttgcttgctttggcaccaattggttatttcttggtgaaaaagaattcgcttaataatccgcaacagactgaacaagttgctagttcgagctcgaagaagtcatcggccagtgttgctgccagtaagtcatcgactgctgctagcaagaagaaggcggccgcatcgtcgaaaaaggcggctgctaaaagtagtagcctagccttggctagctctaaagctgccagttccaaggctgctagttctactgctgccagctcggaagaaagtgcgagtactgacgacagcagcgctagcagtagtagtagctcctcagaatcatcttcagggactaagtacgtcacggtagaagccggtcaaggggtctatcgggtcgctacgaatgctggaatctcagtggataagctattggaattaaatgggttatcatctgatgcaacgatttcggctggtcaacggttacgtgtccgttaatacacgattttttcagattgtgaggggttagttaatggctaagcaagcattacaggtggccatcgatggtccggcttcagctggcaagagtaccgtagccaaactcgttgcaaaacggtttggctatatttatgtggatactggtgccatgtatcgggcagtcacgtactgggcaatgcaacagcacgttgatttagcagacgaagcggctgtgattacggcaatgaagtcgctcaagatcagttttaaacccggcgagccggatcaactggtttttgctaatcaggaagatattacggcggcgatacgccaaccagacgtgacgaataacgtctcgacgattgcggcgttaccacaggtgcgtacgattttaactgagcaacagcgagagatggccaatgcaggtgggatcgtgatggacggtcgtgatatcgggacaacggtattgccaaatgctgaagttaagatctttttagttgcttcagcggctgaacgggctaagcgtcgatacgccgaaaatgtaaaaaaagggatcgacacgcccttggctcagctacaggctgagattgaattacgtgaccacaaagattcaacgcgtaaagtgtcaccattaacacaagcaacggacgccacacttgttgatacgacgccaatgtcaatcgatgaagttgttgctgccattgccaaaattattacaaaaaaacaaagttcaacaatctaattgcattaacttaatgcttttagctagcttttcattgcattttcagctatgatataggttagagttattgttgacaggaggaaatttgcatgagtgaaaacgaaaacagccaagagaaaaatgaacttttagacgctttaaacagcgttgaagaagtaaacgtcggtgacgttgttaagggtgaagtcttagcaatcgacgacgacaaacaagtaattgttggtatccaaggtaccggtgttgaaggggtcgttcctttgaaggaactctcaacacaacgggttgacgatgtcaacgaagccgctaaagtcggtgatgtattagacttggttgtcatttctcgaattggcagcgacaaggaaaacggcagttatttactgtcacatcgtcggttagaagctcgcaaagtttgggacgatgttgaaaaagaatacgaagcaggtcatacgattaaagctccggtaacgcaagttgttaagggcgggttagtcgttgacgctggtgttcgtggcttcatccctgcctcaatgattgatgatcattatgttgaagacttaaatgcctataaaggccaagaacttgaacttaagattattgaaattgaacctagcgaaaatcgcttgatcttgtcacaccgtgccgttgttgaaaagcaacgcgaagcacagcgtgaagaagctttgaagaccttacaagctggtgatgtcgttgaaggtaaagttgctcgtttgacgaacttcggtgcctttgttgacctcggcggaattgatggtttggttcacgtttcagaaatctcatacgaacgggttgaaaagcctgctgatgtattgaaggttggtcaagaagtcacggttaagattttatccgttgatgctgaccgcgaacgggtttcattatcaatcaaagcaaccttaccagaaccttgggatggtattgaagaaaaagcaccacaaggggctgtacttgatggtaaagttaagcgtttgacgagttttggtgcctttgtggaagtcttccctggtgttgaagggttagttcacatttcacaaatctcacaccaacacattgcaacaccaaacgatgtcttaaaagttggtcaagaaatcaaagtcaaagtcttagacgttcgtccagacgaaaagcggttagctttatcaattaaagctttggaagaaaagccacaaactgctgacgatgacaacgaaagtcaaccagaacgtcggagtaacaataaccgtcgtcgtaacaacaaccgggacaaccggactgctagcgaacgttcaacggctaatgctcctgaagaatcaactggtttcactttaggtgatttgatcggtgacgaattgaagaatgctgaaagcaacaatgatgaaaactaatcattgattgattaaaaatacccttcaagcttgccttgaaggatatttttttaggaacagattagttggtgttaccaattaatttgagactcgtagcaggaacctgacgctacgagggtaaaggaggaattaatatggcaaaaccagtcgtcgccattgttgggcgaccaaacgttggtaaatccacgatttttaatcggattgcgggtgatcggatctcgattgttgaagatacaccgggtgtgacccgtgaccggatttacgccaacagtgaatggcttggtcaagaattcagtttgatcgatacgggtgggatcgatatcgaagatgccccattcattaaacagatcacacagcaagccgaaattgcaatcgatgaagctgatgtcattatttatttagttagcatcaaagaaggcgtcacggacgctgatgaacacgttgcccaaatcttgtaccggtcgaacaaaccggtcgtgctgggtgttaataaagtcgataaccctgaacttcggagtgaagtctatgacttttattcccttggctttggcgatccgtaccctatctcaggtgcgcatggactcggacttggggacttgctcgatgctgttatcaaaaactttcctgaaaaaagtggggaggacgaaccggggacgattcgtttcagtttgattggccgcccgaacgtgggtaagtcatcaattgtcaacgccttgctgggtgaagaccgggtcatcgtttctgacgtggccgggacaacccgggatgccattgataccaagtttactgatcaggatggtgaccggtttgtgatggtcgatacggccggtatccgtaaaaaaggaaaagtttacgaaaataccgagcgttatagcgttatgcgtgcgctcaaggcaatcgataatagtgacgtggcactctttgtcatcaatggtgaagaaggcattcgtgagcaggataagcgggttgctggttatgcgcatgaagcgggtaagggtattatcatcgtggtcaataagtgggatctggttaagaaagacaaccacaccatgcaagaattcgaagcatatattcgtgatcagttcgtttacttgagctatgcgccgattatttttgtctctgctaagactaatcaacgtttggagcaactacccgcgttgattaagaaagtcaatatgaaccatatgcggcggattcagtcgtccgttttaaatgacgttattatggatgcgattgcgatgaatccgacaccgagtgacaatggtaagcggctacgggtttactatgccactcaggtggcgattcaacccccaacttttgtggtcttcgtgaatgaccctgatatgatgcacttttcatatgaacgcttccttgaaaatcaaattcggaatgcctttgattttagtggtacgccgatccacatgatcgaacggcgacgtaagtaggctaaagcgcgtaaaatcagcattttagcacattatttgattgatgtaaacgattatcatctttttgcgctattttcgctgaaaaggctaaaaaagcttgctattacagcattcctatgctatctttgatgaagaaatgatgcttgttatcgtttctctcatttttggaccactcaaaaatgatcatctggatcaacgatgttaaaaagcacggcgatccttcactctgtaacggggaggtgaatcaaacatggcaaacaaagctgaattagttaacaacgttgctgcggcaactaacttaacgaagaaagacgcaactgctgcagttgacgcagtctttgcatcaatccaagacactcttgcaaagggtgaaaaagttcaactgatcggatttggtaactttgaagtacgtgaacgtgcagctcgtaagggccgtaacccacaaactggtgacgaaatccaaattcctgcaagcaaagtacctgcatttaagccagggaaagctttaaaggacgcagttaaataatgcatatcagttaatgaaatgcaaacatgaaagccagtatagcgaccgttatactggcttttttgctgtcgtctgcggtatgatagactgtcagttcaagtgattaacagctggtatcccatgtgacgatatcaggctgactattgaaataaatgatgaaaccatggcgactaaatgaagtcgtttcttagtggtttaaaggatgggtgtaatgagttattcagaaaaaatgctcgcagcactatcaaacgggcaaattgacacggccaaaaagcactttgcatgggccttacgtaaggatgatgaccagacgctgtatagtctggctgaagaattgtacggtttgggctttttaaagcaagcggaacggacttataagaagttactggctaagtatccggatgaggacgacttacggacaagtctggctgatattgccatcgatgaggacgatacggacctggcactcgactatttacaacaagttaagccagactcaccggcatacgttcaagcgttgttagttgaggccgatctataccagacccaagagttatttgaagtcagtgagcaaaaactcaaggaagcctatcagctggcaccggacgaaccagttgtcgaatttgcgctcgcagaattttacttcttgattcgtaactacggtcaggcgactcgcttctacttggacttgatcaagcagggacaactagagatctctaaagttaacttagttgaacgactaggggtggcttatgctgagtccgggcgctttgagcaggcggtgggttatttagaacaaatcaagcctgccaagctcacgccggacagccagtttgaattaggcttcacttatttgcaattaaacgaacctcagaaagctgttgatatcttcgacaaactgcgggaacaagacaatcagtatgcgtccctgtacccatacttggcccaggcccaagagcaacttcatcaactggacaaggcgttattgaccttacaagaaggtttagcggtcgaccagtacaatgagcagctgtacttgcaaactgcccgcttagccttgaaattagacgatcaggaattagctgaaaagtatttgcgggaaggcttgagtattgaccctgataacttgactacggtattggaactgtctaatttgttagttcagcgggaacgttatcaagacaatatcgacttgttagatcaatatttgcaaagtaatgagtttgatccgcagttctactggaacttggcaatctctaatgaccggctcgatcattttcaggcggctaaggataattacgaagcggcttatccgttctttgaacataacaaggatttccttaagccagcaatttatttcttccgcgaagcaggaatggccgacagtgccgtggcagcgttgcggaattatctaacgattgaaccagatgatggtgaaatggttgcgatgctagaagactacgaggatcagggctactaggcctttagttcttcaccatttgctgagaggcttcatttctaaagttattgaaaccactttcaattttggtaaaatgaacgtataccaaatttaagtgaggcgtttactatcgtgaaagtagctattattgccaccgatttagatggcacgtttttgagagacgaccatcagtttgatcaccatcggtttcaggcccagttggatcaaatgaatgctcagggccagcactttgttgtggcgagcggcaatcagctgcaacattgtattgatgtttttgacgggatcaatggtgaattgacgtatgtggctgaaaatggcgggttagtcattgataatcacggcaacgtgttggctgaaagcctgattgagccggcgctttatcaggaactgttagtttacgtggcgactgaaccagcactagctggtgctgagatctcggtctccggcaagcaaggggcatatattcggccccaagatgacagtccgatcatgcggtactatttgagccggctgcaagtggtgccatcgctatcagcaattgatgaccatatctataaagcgacttttagttggcaagccacggatgctgatgcgcacgccgctttgatcaatcagcaatttgctggccggttacgtgcaactgtcagcggtggtaatgggcttgacgtcattccaccacatgttaacaaggcaaccgggcttgcttatctccagcagcattggcacgttgtccctagtcaaacggccgcgttcggtgataacggtaatgatcttgaaatgctacgggaggccgattacagttttgcgatgcaaaatgcgattgcacctgtcaaagagatggctacgtaccttacgtcacatgacaataatcatgatggggtgttagcgacgattgacacgttaatttagcgtcaccaggtgttgttgacggccgaaatatataagcaaatagtgttcgaccgagcgggactacgctttgagtcagacactattttttattcatatcagtgttataggacggacgtggctcgtctcacaaagtagcaagttaattagcgggaccgttttagtcattgggtacgaacaaaatgggggtagtttaacagtttaaacaggttcggcgaggattctcctgcctaatttggcaattgtctgctaaaatataattagcttaatcttgaggaggaatttattgtggtaaaagtaattgttgccggctataagggtcggatgggtagtacggctgctcagatggtcattgataatcctgattttgaattggttggggtctatgacgcgcgcagtggagaacaaaatctaggtgaggacgaccgctttaagggtcaagacgtgccagcttttcatgatttagaccaaattaagacggatgccacggtctggatcgactttacgattccaaccgccgtttatgaaaatgcaaagtttgcacttaaccatggtatttcgcctgttattgggactactgggatgaccgatgaacaagttgccgagttgcaaaaattagcaaaggacaagcaagtgggcggcctcattgcgcctaactttgggatcagtgccgtcttactcatgcaatttgcccaacaagcagcgaagtacttcccagatgttgaaattatcgagatgcatcatgacgataagattgactcgccaagtggtactgctatcagtactgctaagaagattgctgaagttcggcaaccaaaggaacaaggtaatcctgacgcaactgaaactctacctggcgcacgtggtgccgaatatgaagggatgcggattcacgcggttcggttacctggactagtggcgcacgaagaggtcatgtttggcggccctggtgaagggttaacgattcgccaagattcctttgaccggatctcatttatgactggtgtcaaagtggcggttgaaaaagttaaccagtatcacgaactctttgttggtttggagcacttactatgattttgacgcagttgccagctgagtttcaagcagctaagccgattattgagacgatcgaagcggccggctatgaggcgtactttgttggtgggtgtgttcgcgatacgattttggggaagcccctacatgacgtcgatattgcgaccagcgcgtttccggctgaggtcaaacaattatttaaacggacggttgatacgggaatcgagcacggaacggtgatgattttagatcacggcaatggttatgaaacgacgacgtttcggactgaatctggttaccaagattttcgccgccctgatcaggttacgttcgtccgatcattgaaagaggacctgaagcgccgggatttcacaatcaacgccttagccatgactgctaacggtgaagtgattgatctgtttgacgggttagcagatatggaacaaggaatcttacgcgccgttggagtggctgaagaacggtttcacgaagatgcgctgcggatgatgcgtgccgttcggtttgcaagtcagttaggctttaccattgaatcgcagaccgaacaagcgattgccgataatgcggcgttgttggcgaaaattgccgtggaacggacgcgtgtcgagtgggagaagctgctgatggggcagcacccagttgctggtttgaccggcttgctgaccactgacttgtatcgttatatgcccgcaatggctgatcaagaagcgatgttgcggcagttaatggcacttccagcttggcatttgccgagtattgaaagtacttggaccttgcttagctggaccatgcaacggactgacgaagcggctgttcgccagttgttaaagacgtggaagacgagcaatgagctgattaatcacgtgacggccgctattaaagcgctgatggcgttaaaacacaacggtcagttaactgcgcaggagaacttttatacgggcttagaggcgctgaaaacggctaatcaggtggctacgattttaggctttggccaggaccaagcacaattggtgcaagcttatgctagcttaccaatccatgacaagcatgaattggccattaacggtggcgatttattgaaagctaaattggtgacgcctgggccaatgatgggtcaaattctagcggcttgcttacaggccgtggtgatgaaacaggtcccaaatcagcaggatgctttgcttgattttgcaaggatggtagcggattcaaaaaaccattgatattttctatgaatctgttacgattaaagtgaaactaattcaatgaggtgatttgaatggaacgagcattagaagcattgaaatttcattttcggaatggtgacacttggacagttcatcatcaagatatctctgacctgtggatcggccgggtaacgacgagttacggtcgaattaagggtggccatatgaccatcattcatccttgtaaatcatttaaggctgaatttaaacctgacgctgatgcgatcgatccggacacgacccaactatcatccgtgacaagtgggatgtttgaacgggtgacgcattatcaagacattgaaaaaattgacatcctgtttggcgacgaacgtggtagtgaacaaatttacttgccattcaagccacgggatgcggatggtatcgacaacatttatcagacgagctcattagccagcgatggaaaattacacttagtcgttgatgatgaacggaccgtctttgatgtttatggtgatcataactaataaggtgttgccaaacaactcttggggccgagtgagcctcaggagtttttttgtgactcacgacccaatcgaatcgatgatcgttaggaaatattaacgtttgcgcgtttgtcagttgtgttttaagccgattctagctaagatagaacttaatgatgtaaaaaaagggtggatcgtaacaatgcaaactttaagagcagaaaatctgacccgaacttatggtgagaagacgttatttcacgatatttcatttattgtgaatgaacatgaccggattggtgtcattggcgttaacgggtccgggaaaacgaatttattagacgtattagccgggattacggcaccggaagccggtcaactggtgatgcccaaaaattatacgattggttatttaaagcaaaagccggaacttgaccagaatctgacagtcattgatgccgttttggccggtagtcagcaagtctttcgaacgattcgccactacgagcaaacgttggccgcttatgctgatcatcccgaagaccaagcgacccaaaaagcttacgtggccgctgaggatcgaatgaaccaagaagatgcttggacggctgaaagtgatgtcaaaacgattttgacacaactgcacattaccgacctgacgcagaccgtcagtcagatgtcggggggccaacagaagcgggtgggcctggcgcaagtgttgattcaatcaccggatcttttattactagacgaaccgaccaaccatcttgattttgactcaattgagtggttagaaagctatttagctagttataagggtgctttgattgtcgtgacccatgaccggtatttcttggatcaagtcgccaaccagatgtttgaattgtcatttggcgagctgcataagtatacgggaaattaccaagatttcgtgcaagcgaaagccgaacgggtcgcccgtgacgtgttagctgaacataagcaacagcagctgtacaaaaaggaactggcttggatgcgtgcgggagcacccgcgcgtagcacgaagcaacaggggcgcatcaatcggttcaatgatttgaaggataatttgaatacgctccaagttgataacgatgttgatatttcgctcggtcagcagcgtttgggtaagaaagtgatcgagttaaaggacgcgagcttgcagtttgatcggcaaaccatcctggatcacttttcgatgttgatccaagccaatgaccgcatcggtatcactggaatcaacggtgccgggaaatctagtttattgaatgtgattgcgggtcgactgccacttgatagtgggaccgtgacgatcggtgagaccgtcaagatggcctattatactcaacagaccgaaccgattccgggcgacaagcgcatcattaattacttgcaagatgtcggtgagacggtcttgaataagcagggcgagcatgtttcagtgactgagttactagaagagtttctgttcccacgttcgatgcacggcacgctgattcgcaagttatctgggggcgaacagcgccggctatacttactgaagttgttgatgcaacagccgaacgtcctcttattggacgaaccgactaatgatttggatattggtacgttaacggtgttggagaactacctcgatgattttgccgggaccgtcatcactgtttcccatgaccgctattttttggacaaggtcggcacgaaactactgatttttgatggtcaggggcatattgaacgctattctggccgtttctccagttatttgaaggatcaaaaagacgcggccaaggccactgcgacaaaaactacggctaagccggtcacggatgactcgaccgcaccattggccaagaaagccaaagtcaagctgacttacgcggaacagctcgaatacgacaagatcgaaggggttatcgagcaattggatagccataagagtgagatcgaagcggcgatggctgccaatgccagtgattatggcaagttggctgatttgcaaaaagaattgactaagacggaacaaacgattgatgagaagatggatcgctgggactacctcagccagtatgcagaagcctgaaaggatgatcgcatgttagaagatagttatttacaactcgcgcgcaccattttagaacacggcacgtataaggatgaccgtaccggcacgggaacatacagtgtgtttggttaccagatgcgctttgacctgagtcaaggcttcccgttattgacgaccaaaaaagttccctttggactgatcaagagcgaattactatggtttttgcatggtgatacgaatattcagtatttattgcaacatcacaaccatatctgggacgaatgggcgttcaaaaattgggttacgagtgccgattatgacggccctgatatgacgaattttgaacaccgccggctagatgatcctgactttgcgccgatttatcaagctcagatgcagacctttgatgaccagatcttgacagacgacgcgtttgcggccaagtatggtaatttgggtgacgtttacggtgcgcaatggcgtcactggcaaacgcgtcagggaaagacgatcgatcaaattgccaatgtgattgaaatgatcaagacgcatccggattcgcggcggttaatcgtttccgcttggaatccagaagatgtgccgaacatggcgttaccaccgtgtcatactctgtttcaattctatgtcgcggatggtaagctctcttgccaactctaccaacgttcaggcgatgtcttcctaggtgtgccattcaatattgcgagttatgcgttactaacacatctgattgctaaggagacgggcctagcagtgggcgagttcgtgcatacgttgggtgacgcgcacatttatactaaccatgtggaacaagttaaaacgcagttgacccggcaacctcggccagcaccccagctgactttaagtggggctcatgacagtatttttgattaccaaatgagtgacatcaagctcagtggttatgatcccgcaccggcaatcaaagcgccggtcgcgatttaggaggccgcaatgattgcattgatatgggcagaagatcaaaatggcctgattggcaaccagggccagcttccctggcatttaccagcagatatgcagcggttcaaagcgctgacgaccggacaccatgtcgtgatggggcgcaagacttttgcgggctttaaacgcccgctcccacggcggaccaattgggtgctctcacgtcagtctgatttaaagttgccaccggaagtccatcaactagcagatgtgtcggcgatccaaacactcgcggctgcccatccggatgaaccgatttttgtcattggtggtgcggtggtgtttgaagccgtgttaccggtggccgattatttatatcggacgcgtatcaacgcaaggtttgatggtgatacttggatgccggccgtggattacacgcagtggcagctggtgagccaacaaattgggacggtggatgagaaaaatcaatatccgtacgaatttgatgatttccgccgtcgttaattcagtggcaaccgtgaaactcaggcagatttctgctatactgaaagcattaattttattgtaacgatcgtttaaacgttacaagtataagaaagcgtggcaaagtatgacgaaaatcaagattgtgaccgattcttcggcaaatttgacggatgccgaggtaaaaaaatacgatattaccgtgattccgttgactgtcatgatcgatggcaccatttacgtggaagatgaaacgattacgcgtgaagaatttattgacaagatggcaacggctaaatctttaccaaagacgagccaaccggcactcggaacgttcattgaaacgtttgataagttaggtgcggatggcgcgagtgtgatttgtatcaatatgctcgaagccatttcaggaacagtgcacacggcggaacaagcggcttcgattacgaagaccgatgtcaccgtgatcgacgctcggacgaccgaccgtgcgatggcctttcaagttttgactgctgctaagttagcccagagtggtgctgacaaacaggcggtcatcgatcagattcatgcgactcaggcccatacaaagctattcatgggcgtaatgaccctgaataacctcgttgctggtggtcgaatcagtcgtctgacgggggcaatcagtacgctactgaatgttaagattgccttggaagttgatgacggcaccctagatgtgaagatgaaggggcgcggtgttaaggcgattaataagttttttgataaggttctcgacgatattattgcaacgccgaacgtcgccgaagttgcaatctctcacgttggcgccacggagcgcgtggaagaatatcgggcgcgcctacaagcggctttaccaagtctcaagatcagtgttcaaccaacggtgccaattattgcgacccatggtggcccgggtgcgtttgccgtggaatatcatacgcaagcgccagcgtaaagtgagcggtgtcccacaggcgacttgtctacgagcactaatggcaaatggtgatcgtcccaacaggggatggtgaccattttattgttcaaagatgagttagctctgattaaatggactgctcaacggtgaagaaaggttggatgccaatgtccaaagttaaagaaaccatcaaaatcattttagtggtggcggtgttagcggtcggggtgtttttcggggtcaattatctgctgcatccgcaaaatgaatcggcgacgactaccccaacaacgactaaaaagaccactgccaagaagacgccccaacaggcgaaaatcaacttggtcgcggtcggtgactccttaaccgaaggggtcggcgatgagtccgagggtggctacgttggtcagatcaaaaaaacgttgacgactaagcaaaagctgaaggtgacgaccacgaatgctggtaagtccggtgatcggagtgaccagattttagcacgcattaataagtcgaaagtgttacaacagaaaattgccaaggcggatgtgattactgtgacggttggcggtaacgacctcttgcaaacgctcgaagggtccctaacttctaacaatacggccaaaaataacgcgacggttgctaaagcgcaaactttatatgcgaataaactaactaaattatttaataaattacaaagtttgaatggcactgcgtcagtttttgtctttagcatctataatccaatttatgtgaactttccaaatgtgacgtcgatcacgcactacattagccagtggaatgatcagacacagacgacggttagtcaatacaagcacacgtattttatggatatcaattggaccatgtcacacggccagtacaagacggcagcccagattcgcaagttgaagaaagcagcgagtgccacgaccttaactagcttaaccagctcaaaggccattactggcgctttagagacagaaaacaagacgaatgatttgatttcgactgctgataatttccatcccaataagcgggggtatcgtgtgtttacaaccaaactgtatcagaccatgatggcccatgatgcgtggttaatcaaaaaatagggaggtaatgagatgcgggaagcacaacgaaacaagcaggcatcagcacctaaaaatccgaagacaaacggtccaatcaatgtttggaaatgggtcgccgttgtcttgattgcgttgattgtcggcaccggtgcttacgtcggcacccaggtcttacgatcgcctagcgaaagcactagtttgacggctgcaagcaatacggatgcggctagtgtgccgattacaatgaatcgaaaacaattaaacgcccttgcgagttattatttgaatgatctacaaaagggccaagacatgaaatatcgcttcgtggtccggtctaccggcgcttatttgctcggaacgacgcaggtactgggtcagaacgtgtcgtttgtgatcacgatgcaaccaagtgtcatcgataacggcaatatttcgttgaaagcaaccaatttatcggtcgggacgatgtccttgccaatcagctttgtgattaattatattaataataattacaagacacctaagtgggtcaagttgaatgccaagaagaagacaatcgacctctacttgaataaattagttggtaaacatgatgttcgttatagtgtagataagcttgatttgaagaataatcagttcaagttcgaaatgcatattccaaaaactagtgactaaggagtgaattcatgcataaaacattttatacattcttgatgacgcaacggaacccagacagtaccgatgccattgccgaatttgccaataatgcgtttttggatcaatcgtttccaaagcagagtaaagattttcacgaactctcacaatatttggaattgaacgctggttatttgccaacgatgacggtctttgatgacgcgtggcaagcctatttggcaagtgaagcttaaattaatttgtaggaaagaggacgttcggtatgccagaggaacccaaacaaactaatccgcacataaaaaaagtgccccggcccaagcgacgcgttggtctatggacctatattatttccattgtcgtcgcattaggcattggggtgggtgggacgtactggctgattggtcggcaagtcaatgcccagctcagcagtatgcagcagactagtaaagcaatgaaaaagatcgaatcagtttatgaaacgatcaatgagaattactacaaaccggtcaatgcgaataagttggccaacggtgccattaacggcatggtcaattcgttaggtgataaattttccgagtacatggacaagagcgagacggaaagcttgaatgacacgatcgacagttcgttttctggaattggtgcccaggttcaaaaatctggcaactatgttcaaattatttcaccaattgctggtacgccagctaagaaagctggtttgaaaccgaaggacattattaaggcggtcaatggcaagtcagtggccggtaagaccttgacacaagccgttagcatgatgcgtggtaagatcggtacgacggtcaaattgacgattgaacgcagtggtcaaacctttaccgtaagtttgaagcgggctaagattccagtgacgaccgttgattataagttagtcggtggcgataagaagatcggttatattacggtatcgaccttctcgacgaatactgctaaggaatttaagacggcgttgaaggcactcgataagaagggggccaagaagttagtcatcgatatgcgtggtaatcctggcgggttgatgacggctgccttgaagatggcctcaatcttcttgaagaatggtaagacgatcatgcaggtccaagcacgcgatggttcgaccgaaaaatacacggcgtccaagaagtatgatggtggctttaaagaaacgaagccaacgaccgtcttaattgatggtgggagtgcttcggcagctgaaatcttctccgcagccttgcatcaatcggcaggtgttaaactggtcgggtcacagtcatatggtaaggggaccgttcaaacggtgacgacttttaatgataagactgagatgaagatcacggtcgcgaagtggctgacaccaaacggcacttggatcaacaagaagggcttgacacctgatgttaaagctgatgagccgagttatgcaagcttgacggttattagcaaggtcagtgatttacaagctgacaaggtcaatagcaatgtcaagacgttccagaagtacttgcaagccttaggttactttaaaggaaccgttaatggctactttggtgattcaaccaccagtgcggtcaagcagtatcaaaagcatgccaagttaacggtcaatggcaaggtcgataaacagacactgactaagatcgagactgaattagctaataagatcagtgataatgatcgggcttacgatgcagcaatgaaattgattgaaaagacaaattagttcaaagctgattcgtatattttaaaaggcgtaaccgaaatccgcatggctttcggttatgcctttttagttgcggaattttaatgcggtaccgtcaacgaagctttgacaagatggaggtggatctacgaattaggctcaaaaatggcttgtcacgggtggctttataaatcggcagtggaaagtcttgttcatcatgaatttaaatcaagatttagacttgccttgcggtgggggtaaagcggtatactagaaattgtgcgttaattgatcagtatgaaatagtgaatttcaacgggttggattgaggtaacttttagctgaacgactggcgagatgtttagcaattatagaaagaagttttgttgtgaatcgacgggccatttattttgttcagggcgccctgttactatcgaacgttatggctggtatcgatagtacgaatgtcaatacggcgctaccagcaattattgcggatttacacggtctacggttaatggcgtggatcgtcgctgttttcttactaggaacggcagtttcgaccttgatctggtcaaaaatgggtgagcgctttggtaataagcgagcttatcaaatgacgacggcactctttattgtcggctccttactacaaggattagcacccaacatctggtttttgattattgctcggggtgttgcgggtctcggcaacggggggatgatttccttaccttacatcatgtatgcggacatttttaagaatccgcgtgatcgaatgcgggcactgggactagtctcggcttgctttagtatggcaacgattattggccccatggtcggtggtgtgattgtcgatgtgtggtcttggcactggatcttttacctcaacgtaccaattgggattgtctcagccgtgctgttacaaatcttctatcaagaacctaagcgggaacataacttgcaaccaatggatcgtgcaggggcgttattgatggcggttgggatcatcagtttgcttggtggtattgaactgatcggcatggtgtcgttatggattgtcgcgatcgtgatcgtgggggcgctcattgtgttgggcagtttaaccatcgtggaacgtcgcgctgtggacccggttattccgggccgcctgtttaagaacgcgccgttagtggtcgatttcgtcttatttgtgcttatttggggcgcgttcgttgcctttttgacgtacagtccgatgtgggctcagggcttgctagggacgtcagcgttaattgggggagccacgcagattccaagtgcttttgctaattttgggggtagtgaatcagttccccgcatgcggcggcacttgacgccccatcgcgtcttgacgatcaatattatcattttgacgctgaccttcgttccattgatgattggcggtgttaagcttccatactgggtcttactcttagctggcttctttgaaggttggggcaatggggcctgctttaatgagctgcaggttaaggtccaagtagacgctgatcaacgtgacattccagttgcgacttcgtttagttatttgattcggatgctcagccagacgtttaccacggctatctttgggctaatcatgaaccaagctctgactagtggggtggcacgatcggatggtaaaatcaccatggcgatgatgaaccagttaagtgatgctagtcgggcgggccggctaccagcgcacctagtgccgatgatgcgtggcatcttacacactggactacaaaatatcatgattgttgcgttcggattaatgatcgtcgctttagtgatcaacttatgggcacaacgtcatgagacgcaacggcaggcccagagctagatagcatgtgcaaacttgatttttgcaatgatgattggttcggaacaacttacggagaggtattctaattgaatacctctttttattctgtgcgatgcttgtatcgctgaattactaccgaaccggaattcatccaattggcagattgttttaatcatgattgaaggtgactgtcaagctgtgcctatcagttgcatttaaagagataatacgatatattaacatcaaccacttactaaaagtaagtaaagcaaaagtaatgggggcattaagatgattgatgttaatcaactagaatttgggttagaaacatttggggatattgtggcgaacacggatggtagtttacagtcggcgggagagtcattgcgccaaatcgtgcgcgaaggtcagttagcggatcagtatgggctggatgtttttggcattggtgaacatcaccgaccagactacagtgtctcaagtccggaaacggtgttagcagccaccgctgccgtgacccagcacatcaaattagcgtcagcagtaacggtgctgagttccgatgacccggttcgagtttatgaacggtttgcaacgttagacggtctgtctaatgggcgcgcccaagtgatgttaggacgggggtcgtttaccgaatcgttcccgttatttggctatgatttgacggattatgatgacctatttaacgaaaaactcgcactatatgaccaattgcgaacggaaaagccggtgacttggtcgggtaagtttcgggcttagttaacgaatcaagacgtgtatccaaagacagctactggtgaacttgagacttacattgggattggtggttcaccagaatcaattattcgcgcggctaagattggctataaagtcatcattgcaatcatcggtggtcgggcggaccgatttaaaccgtatatcaagctgtatcatgaagccgctaaaaagttcaatcagccagcttatccgattgcggtgcattcacatggattcattgcggatgatcaggatgaggccttgacggtggcttatcaaaatatcaaagctaattttgatcgcattggattgacccggggatgggcgccaatgagtcacgaacaatttgaccgtgaaaccaaatacgggtcgttttatgttgggacgccgaccgtggttgcgcaacggatcgcgacgacgattgaaacactagggctggggcgctttgacttggtatacggggccggtaatcaaacggcggctcaacgtgaacggatgattgaattgtatgcgacacaggtgattccacaagttaaaactattttacaagcgaagcaggtgacgaccaaatgacagtcaaaaacgttggaatcctcggcgccggtaaagttggtatcgtcttagcggaactggcattggcggccgggtatgacgttcgcatttcgggctctggcaaagtaagcaaaattgaactaacgattcaaacactagttccgggtgcaattgcggcggaaaatcaggatgtcatcgccaacagtgagttaattattttagcattgccgctgagtcgttaccggcaaatcccggctacggcgcttgatggcaaacttgtaattgacgctatgaattattggtgggaaacagacggggtacgggaagaagttctggatccccagacgtcctccagcgaacaagtccagcaatacttcaaagggagccatctggttaaaacactgaaccatatgggttatcataatctgcaagaagacgccagacctaatggcgatccggcgcggaaggccctattggtagctggtgatgagccccaagccgtagcaactgtggcccactttgtggagacgcttgggtttgatcccattagctatccccgactggcggatggtattatgactgaacccggcagtccgttatttggggccagtttaagtgcgaccgcgcttcagcaaatcattgatcattttgatgaaactgattttggtcgtgcgcttgcggccaaacatgcattggatgttgaaacaaacaagtagctaaaccaaactaaaatgtggcattcaacctgaatgtcgtattttttcgtgatcttagttggttagatggggaaacgcacaacgcaagactaattcaaacatgatagaataaattttgaagccgaatattgacagtttgctgtgtcaaaaaatagttggcattaaatttgaaagttggcatttgagatgagttataagcgttggaatgtagagaaggcaatcgttttagcactacgggaacttggtggaacagcctcacgaaaaataatacgccagacaattgctacaaatgaatatgttaatctgaagtatgaggatgtctatgatactaaagtcagtgcacggaccggaagagcgtataatcccttcctatacgatttcaactttgggttaaaaaatctacttacagttggctatattagttccatggaatggggaaaggaaatttcactgacaagtatcggcagaactgctgaattatcaaattatccgacctctgaacaaacccaactagttacgaactattggaatcaaaagacacgtgaaagagtacatcggaaattaacagcaatgcaggaatctgatgacaagttggcagatagggatgaggatctggtcgtaatcgatgatccagagtcgcgacaagatgcagatgaatcacaatggaagagtgatttaattgaatgtttaaaaaaattcaattctggaaagtttgaaaacttttcgcgagcattgatttcaaaaatgggtgtgaccattgataaaaatcgtggtgtggtacgttcagctgatcacggtatcgatggctttggctattttaaatccgacgagtttcgtactagccgggtggcaatacagtgcaaacggtatacgcaggaccaggtatccgaacctgaaattgataaatttaagggcgtcatggatagttttaatgctgaatatggtatctttgtgacaactagtcatttcactaaccgagctaaagctaaggcgatgcagggaaataatacggtaacactaattgatggtcaggagttagctgatttagttgaaaaatatgaattacagattacccctattaaaacatacactttaaatgcatattattatgaacaagattgattgaattttgagtgtgttgaaatctcatcaataaattaagataaaaaaactgatatccccgctgagttaatccatactcagcgggggttttgaaaaaggatatatatgatgtttaaatggtttaggtgtcctgctttagtgaaggcgattgcggtttggacattaaagccttgatcaaattgcaaaaaacaacccgccactgtatgttgttaacaaaaaatgaattcagtcacgtcatgtgtcgatcagtcaattattattaaaaacgtcaaagccatatccttgaatgtgctgtttcaatagtgtcaaatagcgctgggccgtagcgctcaattcgattttcttatggcgcaggtatccaagggtcattgcatcatccacttttagtggaatcgccacaattttttcgtcattgagttcactgctgatgatgcctgaactgatcgtatagccgtttaaacccaccatcaagttgaagatcgttgcccgatcactgatgcggatatgctttttatgaggtagcgtactgaggatttcttctgcaaaataaaaggaactcgtatcgccttgctcataagagaggtagggatagtctcgtaggtcatccaaagtcagttcttgcttgtgcgttaatgggttatcacgaccgacgaaaacatgcgggcgagcctcgaatagcggtacgaagcttaagtctttgtcagcaattaaacggctaagcacggtctgattgaacttattaagataaatgacgccgagctcgcttttcaaagtctgaacgtcattgagcacgttggccgtttcagtctcgcgtaatgtgaactgataggtatcgccaccaatttccttgactaattcgacaaaggcgttcacgacaaacgcatagtgttgcgcagagacactaaagatacgcttgcgaacggttccctgaccaaaatgttcgttgagtaaattaacttggtcgaggacactgcgagaatagttaatgaattcacggcccgtatccgtcaaagtgatccccgttttatgacgataaaacagctgtacttgatattccttttcgagttctttcattgcttgggataatgagggttggctgataaataactgtttggccgcctcgttgatcgagccagtcgtggcaattttttctaagtagcgcaattgttgaatacgcattaagtgcacctcctgagaaatgtctggtttcagtatctaattaacgcatgattgtagctggtgtgattgaataaattatttaggttataggtattgcctattatatcatcaatgcaatcagtcttatctattttttaatcagattgttataataaactcattaagacagacacggaggatgattacattatgacaaaaacacatttccaattggtcggctcactcttacgcccggctagtttacttacttataaaaatcaaatcgaacatcgtgacgatattcaatacccattttatgaggctttgccgggctaccaggctgccgaaacagcggcagtgaagacggtgattgccaccgaaaaggcgcatgggattgatgtgctaacggatggcgaatatacgaagtcaatgtggcatttggattttatttgggggtttagtggtgttcggcggtttattgcggatgaaggttataattttcgcgatcatgacggcagtgattttgaaacacgtaaagatattggcattgaaatcacagcaccactttctggcaagcatcatcattttattgatatttatcagcaacttaagtcacaagccgatggtaatgacgttaaattaacgatctggagtcccgcacacgcctttgttgagtttggatacatcgataagctatatggccctgaccagatttacaaaactgttgatgacttgcatgcaggcttactcggggcgtataaagaattcttaacggattatcaagctgcgggtggcaaaatcatccaattcgatgactgcttgtgggaagtgtttgccagtgataatcagcaaagtccctttggtgctggaaatggcagtctccaagaattagctgatgtagccgtcaacaccaataatgagttagttgattttggccatcaattagggttgaaagtttggacgcataattgtcgtggtaattatgaaagtcggcactttgcagaaggcagttacaatacgattgctaagaaattcctgcatgaccaacactacgaccgtttcttccttgaatgggacgatgaccgcgccggtgatctttcagcgctcaaggtacttgaggaccggccgaatgtggaagtcgtcttgggcctgttatccagtaagaccaataccttagatgatgaagatcgcgcgttacggttactgacgcaagctagtcaaattttgaataagaaccagttatatttatctcatcaatgcggcttcgcttcgtgtgactcaggcaacgagttaacggcggctcagcagtgggcaaagattgatcagggacaaaagattgcggctaaattctgggattaagtcacgtcagttaattagctgacggctatcaaacgacaatcaaacaagcgcgatgttgcggccatcttgatgatgaaggctgtgacgtcgcgcttatttgcagttgtagtaggtgaactgtgtgtatgatcgtatcggtggacgttaacgttaaggacggttatgcgatgtgcttggactaacgagctaattgacagctaccgcaagcttgcagccaataaaatggggtcgatgttccggttagctaaattaacgtgtggaagtattgggcagcagatcaatggtcggtttcaaagcatggtcggtgtaaacatggtaaaatatagattgctgcatcatgccagtcctggactagcaagcgtccggtgttttagttcatgggcggcatagcgaccaacgatttcgttgaatgaatgcattagtggcggttggtgcacagcacttaagcatgtcgccactggagctagcagcatcggcttgacagccagtgccgttaaagaattttaacaatgatcaaagtttgaaggcattcgcgccacgagaaaaaggagcacaacgtaatggcaaatattcaatggtacccaggtcacatggccaaggcgattcatcaaattcaggacaatttacatttagttgatattgtttttgaattggtcgacgcccggatcccagtggcttcccggaatccagaaattgaaaaaacggtccaacaaaaaccacacctcttaattatgaccaagaaggacttggcagatccccaagcgacagctgactgggtcaagtattacgaagaccagggtcaagttgcgatcgcggtcgattcacgtagccgtacgattggtaaacaaatgacgcaagcggctagtgacatgttagctgacaagttagcaaaaattgcggcccgtggcattactaatcggccaatccgcgcagtttgtgtcggtatccccaacgttggtaaatcgaccttattaaaccatattgtcaataaaaaaattgccaaagtcggtgatcgtccgggcgttaccaagggccaacagtggctcaaagcgtccaataaattggaattactcgacaccccagggattttatggccgaagtttgaagaccaagtcgttggtaccaagctggccgtcacgggtgcgattaaggaaaatatctatcctaacgatgacgtcgctttgtttgccttggacttcttcaagcagcactacgcggcacgcttagtcgatcgttatcatttgacggctgagcagttaaccttaccaaatccggaattactgattgcgatgacgaaaaatgcggggatgcgcgatgactgggaacgtttctgcgtggccttcctcttagatattcgcaagggccggctcggtcgttttacgctcgacttaacgggggatcaacccgatgcctgaacgaacgattgcggattttaaacggctactggctgaccaaccaacggtatcgcttctagccgcggctcaagccgatcctcgcaagggcgtgcaacaggcttatcaacactatttgcgacaagctgaaaaacaggcggcgttagtgacacgttttaatcaacatatgcgtttagaacgggatttttgggcccacggcggacaatacgttgctgggatcgatgaagttggtcgcggcccgttagctggaccagtcgtaactgccgctgtagtcttggacgatcattttgatttgctagaagtcaatgattcaaagcaattaaccgctaagaaacgggcggccctgatgccacggatcctagaagaagcggtcgccgtgggaatcggcgttgcggatgcccaacaaattgatcaattaaacatttatgaggcgacccgagtcgcaatggcccaagccgtccgtaacctgtccgtccggccaacacgtttactagttgatgcgatgcaggtgccggtaccaattgaacagacccgtctaatcaagggcgatgcgaaaagcgcgagcatctcggcggctagtattgtcgccaaagtcgtccgggatcacttaatgacaatgtatgatcaagtgtatcccgggtacgactttgctgataatatgggctacgggactgctaagcatttggccgggttggccagtctcggcgctacgccgattcatcgccaatctttttcaccggttcgaaatgctaagcgggtctaaatccgtaactactctttaaagaagccgttccgttgacgactaatgtcaacaagggcgaacttaaggagtcgtgataacatgcaattaagaagtttattgattcgattacatttagcgcacggcatcgggtatgccgggatggtacgcgtgttacaacactgtcggcaggttcagacggtcgtcactgatccccgccgattaggtaagttggcccatttaactgctagtcagcaggggcgttttaccgctgattggcaaagtatggcgtttcaacagcgactaaaacgccatgcgcagcttgatattttaacaatcttggatgatgattacccaccggccttattagaagcctatcaaccaccattagtgttgtttttgcgcgggcagcgtgcgttactaacgacacgtcaacttgcggttgttggtgctcggcaggccacatcgtatgcggaacgggtcacgacgcaattattggcaccgttagcaacggcaaagttgaccattgtcagtggactagcgaagggagccgatggttttgcacatcggaccgcccttcgttttaacttaccgacaatcggggtgattgggaccgggctggatattagttacccccgtcaacaccgtgacctacagcagcaaattagtcaggtcggtttactaatcagtgagtacccgctgggggtgggtccggaaccataccacttcgttgctcgtaaccggattattgccgggctgtgccaaacggttatcgtggtcgaggcgcaggcccattctgggagtctgatcactgctaatatcgcgttacaaaacaatcgcaacgttctggcggtacctggaccaattgatgcaccattttcagttgggtgcaatcaattgatcgttgcgggggccaaaccagtcttaaattcgcgacatataatagaagagtttttaccaaaaatttgacaacacgaaatttttgaaatatgattacagggatttcttaaactgatatttataataatgataatgaaacctgtaaggagctgatcgagtggctgcaagtacaactaaagccaaaccggcggcaaagcggaagaccgcaactaaaactgctaccaagcggaaaagcaaaacacccgctaaaaaattggtgatcgtggaatcaccatctaaagcaaaaacgattgaaaaatatttaggtcgttcttataaagtcgtcgctagtctgggccatattcgggatttaccgaagagcaagatgggtgtcgacgtggataacgactacgaaccgcactatatctcgattcgcggtaagggtgatgtgatcaaaggattgcggaaagaggctaaaaaagccaaagccgtgtacctcgcatctgacccggaccgtgaaggggaagccattgcttggcacttatcctatttattaggacttgaccctaaggataaaaaccgggtcgtcttcaatgaaatcaccaaggatacggtcaaaaacgcttttaaggaaccgcgttcaattgatatggacctagtggatgcccaacaggcccggcgaattttggaccggttagtgggttactcaattagtccattattgtggaaaaaggtcaaaaaggggttatcggccggtcgggtgcaatcgatcgcgctagatttgatcattcaacgtgaaaatgaaattaaagcgttcaaaccccaagagtattggacgatcgatagtgaatttcaaaagggtcgttccaaattcatggcaagtttttatggaacccatggtaagaagcaaccgttggatgacaacgatgcggtgcaaaaaatcttgggccaattagaccggaatggcgattttaatgtcgtcaaagtcgtcaaaaaagaacgtaaacggttcccggcgccgccatttacaacctctaccatgcaacaggatgccaaccggaagttgaatttccggacgcgtaagaccatgatggcagcacaacaattatatgaaggcatcaatgttggtggtaaggaaggtagcgtcggcttaatcacttatatgcggactgactcgacgcggatttcgtcgattgcgaagcacgaagcgtcacaattcttgcataaagaatacggcgcagaatatgcggccaccaaacctgtcaagggcaagttaccagaaggcgctcaggatgcccatgaagcaatccgaccctcatccgtcttccggacaccagctagcatcaaagactacttgacgaaggatcaattccggttataccagctgatctggtcacggtttgtggctagtcagatgacgcccgaagtacttgacacaatggcggtcacgatcgaccaaaatgacgtccaattccgggcgaacgggtcgaagacgaagtttgctggttttacgaagatctacgataagacggaaaagaataacgtcttaccagatttaagtgaaggtgatgtggtcaagttatcgaagactgatccgcaacaacacttcacccagccacccgcacgttactctgaagccaacctcatcaaagcattggaagaaaatggtgtggggcggccgtcaacgtacgcaccaaccctggatacgattcagcggcgctactacgtcaaattagaagcgcgccggtttgtgccgactgaactcggcgagatcgttaacgatattattcaggaatacttcccggatgtcgttaatgtcggctttactgccagtttagaagaacagttggatgcgactgaagaaggtaaggaaaactgggttaaagtcgtcgatagtttctacaagccgttttctaaagaagtcgcaacggctgaggaaagtatggagaagatccaaatcaaagacgaattagcgggcttcaattgtgatatttgtggcgcgccaatggttgtgaagatgggccgttacggcaaattctttgcctgctcccgtttcccggattgtcgtaatacgaagccgatcgttaaagaaattggtgtcgtttgtccgcaatgtaagaagggccaggtcattgagcggaaatcgaagaagaaccggattttttatggttgttcccgcttcccagattgtgactttgtctcttgggataaaccggttggccgtgattgcccgaaggatggccattacctggtcgaaaagaaggtcaaaggtggcaagcaagtgctttgtccgaatggcgattataccgaaaacgttcaaaaataaatgaaaaaaaggtcatctagggatgatctttttttgtgcattgtcaaataatgcgtacaatttttggaaatacgttgataaaattcgtaatttaaactgattaacaagtgttttatcgggaaaataaacgcccgtttaaattaatgttcgctttaagcttgacggtggacatgtcattgcaggatttgctgatgccattagttgtcttctgctagtttctcaggtatgatgacaacaatactatcaatggtatgacaacaagaaaagaggaattctggatggcatcaataccaacagtaaacgtaattggcgccggtttagccggctcagaggccgcttggcatattgctaatatgggcgtcaatgtccggctgtatgaaatgcggcccaacaaaatgactcccgcccatcacacggcgcaatttgctgaattagtgtgtacgaactcactgcgggcgaaccaattagccaacgcggcgggcctactaaaggccgaaatgcggcagatggattcgatcgtgatgcaagcggctgaacaccacgctgtcccagctggtggtgcgctagccgttgatcgggatacgttctctgcagaaatcacggctgcaatcaccgcgttacctaatgttgaaattattaatgaagaaattactagtctcccagatggcattacgatcgtagcgactggaccattaacggcggcgtccttagcgaaatcgattcaagcgtttaacgacgaagatgacttacacttttttgatgcggccgcaccgattttaacgaaagattcgatcgacatggataaggtgtatctcaaatcacgctatgaccgtggtgaagcggcctatctgaactgcccaatgtcggaagccgaatttgacgttttctatgacgcgttgattcacgccgaaatggccgaagcgcatgattttgaaaattcagatgtctttgaaggctgcatgccgatcgaagtgatggcacaacgtgggcgccaaacgatgctatttggcccacttaaaccagtgggccttgaagatccgaagacgggcaaacaaccctttgcggtcgttcagttgcgccaagatgatgccgctggtgatctatataatattgtcggcttccaaactcatcttaagtggggcgaacaaaaacgggtcttttcactgattccgggtctggagaacgttgaatttgtccgttatggcgtcatgcatcgtaatacttttatgaagtcaccgaaactattaacgccaacttatcagacacagcaacggcccgatttattttttgcgggccaaatgacgggtgtcgaaggctatattgaaagtgcggcgagtggcatcgttgctggaaccaacgcagcgcgcttagcacttggtttagaaccggtcgtttttccaacggacacgatgatgggggcgatggcccactatatcacgcatacgagcgctagcaacttccagcccatgaacgccaactttggcattatgccaaaactcaaacagcgcattcgggataagcgtgaacgtaatacggcgatttctgaacgggccttggctgacctgacgacttttaaagatgaaacgttgaccgttaacaactaaaatatcgccccattgacagggtgcataattgtgttttcctccatactttgctaaagtagcaacgtatggaggtttttgcatggaaacggattatttaaccctctttttaaagtacattcgggttgaacgacagtattcggaagagaccgctgctgcttatcgggaagacattcaagcttttaatgatttcttaacggcaaatggcggcgcgaaagcgtatactgaagttgaccggttggacgttaacgtctatttaagtcatttatatgaccggcacttgacccgaaattcaattgctcggaaagtttcaagcttgcggtcgttctataactttttggttaagaatgatttagctaaattgaatcccttcgtgtacgtccaactcaaaaaacacgcggcgcgcttaccccgttttttctatcaaaaggagctggacgtattatttcaaaccgtctatgcggatgatagcgtgatgggggcccggaacgcggcgttattagaagtcctgtatggtactgggattcggctgagtgagtgtgtcgatctacaattagccgacgttgattacgacctaaaaatgatgttgattcgtgggaagggcgataaggaacgttacgtcccgtttggtcggtacgcggctaccgcgcttcagcattacgaaaccgtctgccggcagcccgtgatggccaagtatggtcaaacgcaccaaacggtgtttattaatcgtcacggcggccccattactggcggcggaatcgaatatgtcttgaatcaaatcgttaagaaaagtagtttaacggctgatattcatccccacatgctccggcacacgtttgcaacgcagatgctgaataatggtgccgatttacggaccgtgcaggagctgttaggtcatacaagtttgtcaacgacgcaaatttatgcgcacgtgacaaaggaacatttacaacaagattatcgtcaatttttcccacgggcaacgcgggaatcgacaaaggagactgaacatgacaacgaaatttgaagcaactaccatttgcgccgttcgccaaaacggccataacgccatggccggtgatggtcaggtcacgatgggtgaaaaagtcgtaatgaaagggacagcccataaagttcggcggatttataatgatcaggtcgtcgtaggttttgccgggagtgtcgcggatgcgtttaaccttgaagatcgttttgaaaagaaactcaacgaattttctggtaatttacaacgggcagccgttgagcttgcccaggaatggcgcagtgaccaggcgttacagaaattggaagctttgttgatcgtcatgaacaaagatgacatgttacttgtttctgggagtggtgaagtaatcacgccggataacgacgtcttagccattggttctggtggtaattttgccttagccgcagctcgcgcaatgcagctgcatgccaaggatatgagtgccaaggaagtcgctgaagcggcaatccatattgccggcgacattgatatctttaccaatcataatgtgatctcagaaacgttgtaatgtaggaggaaacgcttatggaagaaatcaataagacaccgaaacaaattgtggccgcgcttgataattatgttattggtcaaaaccaagctaaaaaagcggtggcaatcgcgctacgtaatcgttatcggcggatggaactttctgctgaaatgcaggaagaaattacccccaaaaatatgctgatgatcggaccaaccggggtcgggaagaccgaaattgcccggcggttggctaagattgtgcacgccccgtttgtgaaggttgaagcaactaagtttacggaagtcggctatgttggtcgcgatgttgaatccatggttcgtgacttagtggacgtggctatcgagatggaaaaacaacaggcttattctggtgtgcgggcacaagcggtgcaggctgctgacaaacggctcgtcaaattattagtaccagcccaaaagaagcaggctaagaacaatggtaacgagttccaaaacatgatgaacatgtttagccagatgcaaaacggccagacccccaacgttgacgattcaagtaacgaagaagtgaccgatgaagttcgtaatcaacgattatcagttgccgatcagttgaaaacggggcgcttagaaaactcagaggttaccatcgagatggatgacccccagcaagccgccgcgggtaataataacatgcttggtcaaatgggtattgatcttggtgatagtttaggtgccttaatgcccaagaagcggatccaacggacaatgccagtctcagaggcccgagaaattttagtccgggaagaatccgaaaagttagtcaataacgctgatatttatcatgatgcgattgtccgtgctgaaaataccgggattatttttatcgatgaaattgataagattactaagggtggtcagcaaggttccggtgaagtttcacgtgaaggggttcaacgagatattctgccaatcgttgaggggtcgcaaatttcaacaaaatatggtcccatcaatactgatcacattctgtttatcgcttccggggcctttgcggaaagtaaacctagtgatctgattgctgaattgcaaggccgttttccaattcgagtcgaattagacgatttaagcaaggatgactttgttaagattttgacggaacctaagaatgcgttgattaagcagtatatcgccttgatcggtacggacaacattaaagtgacgttcacgattgaagctatcgaagcgattgccacgattgcctataaggtcaaccatgagacacaaaatatcggcgcccgtcgtttgcacaccattttggaaaagctcttggaagaattgctatacgaaggtcctgacatggaaatgggcgaagtcacaatcactgaaagctatgtcaacgagcgaatcggtaacattgcacaggataaggatcttagtcgttacatcttataaaatttatcaagggggcgtttacgcggatgacagtcgaattaaagaatgagtacctcaccgttttgatcaatgaagctggggcggaattaagtagtgtcaagtcgagtgacggtattgagtacatgtggcaggccgacaaaactttttggggccggcacgcacccgtgctttttccaatcgttggtcgtttaaaggatgaccagtatactgttgctggtcaggcttatcacatgggacaacatggttttgcccgcgacaatgactttacggtcgtcaaccaaacggccacacaagcaacatttgaattgaccgatagtcgtgcgacgcgggagatgtatccgtacgcgtttcgattacgtttgatttatacgttgacggatcatgaattgaccgttaactacaatgtgcataatccagctaatcaagagctgttattttctgttggtgggcacccagcatttaacgtaccactcgctgatccggcgggcacactagctgattataaggttactgtggcaccacgaaaggtctacgcgcatattccattacaggcaccgttgaacgatgcggcaaatgcggatgacttcgacctgaccaagccattagcacttagccgggatttgtttaaggacgatgccctgattttggatttgaatcatcacgagacgacgttaatgttggacactgatctggatgatcatggggtagcgatgacgattgaagatgcaccatacgtcggcatgtggtcaccataccccgcagaagcgccgttcgtgtgcttagagccatggtggggcattgcggataacgttgatagcgacggtcaattaagccataagatgggcattaaccggcttgcagcgaaccagacgtttgatgctaaatatgcgattagctttttctaactaaaatactgtggtttagtgaaaccggtcgacaggtttgaccggtttttattgtggtctgaaaagatagcaaaataaagaattgtattatcttactttaactagaaacaaaaaatacaaacccagcaccaaagcttacccgttcctaaataaaaagaccactcagtaatgaaatggtcttgaaagtaacataattatttgcggttagcccgttgctgacgtcgccaaccaagtccgaagtgtaccaatgattcggtcccgtttttgatacgtgcaatattactgcggtgccgatagaagatgaagagggtcaatgcaaaggccacgagtgatagcaaccaatcctgatagtaaaaaattgcaatcaacgtgacgattggaaaagccgtcatactagcaacactgaccatactggtcgtgtaaaccaataataacatgatggcactagcaattaagaagaactcccagttgtaggccaataagatcccagcactcgtggcaacggccttaccacctttaaagccgatgtaaattgagaaagtatgtcctaaaatagctgctagtccaatcaataaggtataccggttattcatatgaaatagcaaggtcggttgtagtgctgcgatggtgccttttagaatatccatcaccatgacaattgtcccagcggtcgggcctaggacccggtacgtgttggtagttccgatattaccgctacctgcttgacgaatatcagtgtgaaagaaaaacttgccaataatgacacccgaaggaatcgcgccaattaagtaggcgatgatcagcataattattattttcaaagttggttcctcctgcaatagaatcactcaatattttagcattctttttaagattgtggggattaattagtttaaaaaatgatgattgcgtgtcaaattatgaaaataaaatgattttttgataattattatgtgcctaaaagcgggtggttagggcctttaaagcgctaactgtcaaattaatcacgcattttaagaactggtcgtgaccagtaataagtttattcattgaactggcgcttagaatcaacatgaggtaagctagtaagtggcttaatttttaaaagatagttttagacgcgaacgtgtgtttgctattttaattgttaacgtgtatgctaacagatgaagagccacaagtgacaattagaaattaacataattgtaccttgacaggttggggcttttaggactattttattacggttacctgaaagccgcacctagttgaggtagatttttaaagataaaaggagttgtgagaatggccaagaaaagcccaaaatatgatgattcttcaatccaagtacttgaaggattagaagccgttcggaaacgtcccggaatgtatatcggttctacagacggccgcggactccatcacttagtttatgaaattgtcgataatgccgttgatgaagccttagctggctatggtaaagaaatcaacgtgattattcacgccgataacagcatcaccgttgtcgatcatggtcgtgggatgccagttggaatgcatgcttccggtattccaacacctgaagttatcctcacggttttgcatgctggtggtaagttcggccagggtggttataagacttctggtgggctgcatggggtcggtgcgagcgtcgttaacgcattgtcgtccgaattgacggtaaccatcgtccgtgatggctaccgctacgttgaacatttcaaagatgggggtcatcccgtcggtacccttgaaaagaaagggaagactaataagccaactggaacgacaatgacttttaagccggacgctagtatctttacaacgacggtttataattttcaaacgttggctgaacggttgcgtgaatctgcattcttactgaaaggcgtcaaaatcacgctgactgacgaacgggaaaatcaacaacaagagctggtcttccattacgaagatggtatcaaggcgtttgtcagttacctcaatgaagataaggacaccctcggggatattatgttctttgacggcactaaggaaggtgtcgaagttgaggtcgctgcgcagtacaacgatggctattcggaaaacttgttgtcattcgtcaataacgtgcgaacgccagacggtgggactcatgaagtagggttccgcagtgcctggacgaaagcgttcaatgaatatgctcgcaaggttggcctattgaaggacaaggataaaaatttggaaggctccgatgtccgtgaagggttatccgctgttatttcattacgagtaccggaaaatctcttacaatttgaaggtcaaactaaggaaaagctcggaacacccgaagcacgaacgattgttgataatattgtgagtgaacaacttcaattcttcttgatggaaaatggtgaatttgctcaaatgctgattcgcaaatccaccaaagctcggcaggctcgtgaggctgcccgtaaggcccgtgatgaaagccgaaacggtaagcggcgtcataagcaggaacggttactttctggaaaattaacgccagcgcagtctaaagacgctaagaagaatgaattattcttagtcgaaggggattcggccggtggttcagctaaacaggggcgtgatcgaaagtttcaagcaattttgccattacgtggtaaggtgttgaataccgaaaaggccaaattagctgatattgtcaagaatgaagaaattaataccatgatttacacaattggtgcgggtgttggtcctgaatttgatattaaggccagtaattatgacaagatcattattatgaccgatgccgataccgatggtgcccatattcaaattctcttactgacattcttttataagtacatgcggccaatgattgacgctggtaaaatctacattgcgttgccaccgctgtatcgattacaaaaaaagcagaacaagcagttacggacggaatatgcatggactgacgaagagttaacgctcaagaccaagtcatttggtaagggctatgcactccagcgctacaagggacttggcgaaatgaacgcggaacagctatgggaaacaaccatggatcctgaaaaacggaccttagtccgagttcgaatcgatgacgctgccttagcagaaaaacgggtcacaacgttaatgggtgacaaagttgaacctcgtcgaaaatggatcgaaagtaacgtccactttaatttggacgaagacgggtcgttactagataacgaggccgtctcatccgcacatgagcaagccgacgaagaattggcacaacagctaaaacaatagagggggtcgtaaaatggcaactgaacaaccaaaaattcaagaactaacccttgaagacgtcatgggcgaccgcttcggccgttattctaaatatattattcaagaacgggccttgccagacatccgtgatggcttgaagccagtacaacgacgaatcttatacgccatgaatcaggatggcaacacctttgacaaagcgttccgtaagtccgctaaatcagtcggaaacgtcatgggtaattttcatccccatggtgattcttcgatttatgaagcaatggttcgtcttagtcaggactggaagttacgggaaccgctgattgaaatgcacgggaataatggttccatggacggtgatccggctgccgccatgcggtataccgaggcacgtttgagcaaaatcgctggtgaaatgcttcaagacattgataaaaagactgtcgatatggtcctaaattttgatgatacggagtacgaaccaactgttttaccggcccgctttccgaacttattagttaacggggcaacggggatttcagccggttatgcaacggaaattccgccgcataacttgagtgaagtcattgatgcgattttattcctgatgaatcaccctaaggcaacgcttgaagatttgatggactttgtcaagggccccgattttccaactggggggatcattcaaggcttagcaggtatcaagcaagcctatgaaactggccgtgggcgtatcgtcgtgcgttcgcgaaccaagatcgtaccgcttaaggggaataaatcacagattgaagtttcagagatcccttatgaagttaacaaggcgcaattggtgaaaaaaattgatgaaattcgcattctgaagaagatcgaaggtatcgccgaagttcgtgatgaaagtgaccgtcagggattatcagtggtgattgaactgaagcgtgacgtcaatgcagaaggtattctgacttacttactcaaaaataccgatctacaaattacttataacttcaatatggtcgccatttatcatcaacggcccgaacacgttgggctgaaaacgattctaacggcctacttggaacatcaacgggacgttgtaacccgtcggacccaatttaacttacagaaggctatggatcgccaacacatcgttcaaggattaatcaaggcgatgtccatcctcgaccaagtaattaaaacgattcgtggtagcaaggataagaagaacgccaaacagaacttggtcagtcaattcgatttctctgagattcaagctgaagccatcgtgacaatgcaactttatcggttaaccaataccgatgtgacgcagctagaaaaagaatcagctgaactggccaaggctatcgcaacctatcagctgattctggcagagcctaaagaactcgataaagttttacggcgcgaactaaaggccgttcaaaaagcctatccaacgagccgtttgactgagattcaaaatgaaattcaagaattaaaggtcaagaccgaggtcgtgattccacaagaagacgtcattgttatgattagccatgatggttatatcaagcgaaccagcttacgctcttattcagcgtctgagcccgatgataacgggcttaaagatgaggattatccgatctatctagctaaaaatagcacgttagatcatttaatgatgttcaccaacatgggccatctcatttaccggccgatttatgaaattgctgacgccaaatggaaagataccggtgagcacatttctcagacgattgggctggctgaaaacgagcgcatcacgtgggtctattcttttgagaaccttaaagctaccggaaaattcttagtggcaactagtgatggctatatcaaacaaacggcttttgctgattacacgccgggtcgaacttataagactcgggctagccagttcatcaaaatgaagtcagacgatgcaaccgttgtaacagtcgaatacttaccagctgcaccaacgggaaccctgattctgataacgcaacatgggtatggccttcgttatgatttaagcgaggtcccaacgattggtgcgaaggcggtcggcgtgaaatctatggatctgcgcgacgatgccattgtacgggcaacaatcgccgcagatgatgatttgattgccatgattacgcaacggggttcattcaagaagatgaaggtggcagatttacccgtgacaagtcgtgcacggcggggcgttcaagtcttacgggagttgaaaaacaatccacaccgggtcgttgattatgtcttagttgctagtgacgcaaatggggttgcacttgatgtgctgactgatcgtggtaagcaccattcgatcttgaatgatgatcatcctactagtgcgcgttattctaatggctcttttgtagttgatactgatactgaaggggaacctgtttctatgcagatccatccgatcccactaacggtatagtttccaatgcgaatacttgcacgttaacgggcattcgattaagataatattataacagggtaaaagattatgaattagttaatctttatttaccaataacaaccgcttgctttcactttgaatcttgtataaaattatagatatcataagatggcgataagaagaaaggatcaggtaaaattcatgaagacaactcaagaaagtattttctcatcgaaaacgttaacgtatttcttgcaactagctgaaactatgaattacacacaggcagctcaaattttaggaattacgcaaccagcattgacccaacagatcaaaaaactagagcgtaccgttggtgcccctttattttattccgttgggaaaaagttacgtctctctgacgccggttacacaatgcttaacgcaacccacagtatttatagtgtattgaacaaggcaactgatgaaatccagcagacaactagtgctactcaaggaacaatcaatattggcgtgctagcttcaattgaagaccatgtatttgaggattttgccattaagtattacgaggccaatccaaatgttattatttcgttgcacatgctgacgcgtaaagagatttgggaacgattagaaaataatcggattgatttggcagtcatgtacctacctgatgaaagtatcaagaactggaagccataccagtctaagaagattatccaagacgaattgctattcatttcgggtgacgagaagttagcgaagaagaagcgcatcaagttcaaagatacgacgttcaatccatgggtgacgtatcctgaaaactattacttggatcaagtggttaaggaatcttataagaaccagttggctgatttgccaacggcagtcgcacggtttacgacgccacaacagatttatcgctttgtggcagcaactaatactaacacggcgttgccaaattcatttatggtggctaatccggcaactgataagctccacacgttgtcatttgaaccagccatcaagtttgacttaaattttgtcttccgtaaagataaggaccaaattccgcgaatcaagaatttccttgatgaatttgatgcctacttacggaccgaagattatatttcacggttacaaaagattaatcaaaaataagttttaagggagttttgtgctaatgagtaaggaattagtttttggacatcaaaatcctgataccgacgcaatcgtggcggctaaggcgttctcatactacgaaaataagatgggagcggacactgaagcagttgcattaggcgaaccaaacgaagaaactcaatttgttttggattacttcgatgaaccagcactacgggtgattactaaggccagtgatgaagttgacagtgttatgcttgttgatcataacgaacctcaacaaagtgtgagtgacattgctgacgtaactgttagtcacgtggttgatcatcatcgaattgctggttttgacacggcccaaccattattctaccgggctgaaccacttggttgctgcagcactgtcatttacaagttgttcaaagaaaatgacattgaaattccagccaagttagctggattaatgttatctgcaatcatttcagatacattactcttaaagtccccaaccacaacggaaactgacgtggcagttgttaaagacttagctaaaattgctgatattgattatgaaacgtatggtttagcaatgcttaaagcgggcactaaccttgacagcaagactgaaaaggaattaatcgatgccgatgcgaagtcatttgaaatggctggcaagaccgtgcgcgttgcgcaaatcaatacagttgacttggatgatgttttcaagcgtcaagctgctttagaagctgctgcaaaagacgaaaatgcgagtgacagctatgatttattcttaatcttggctactaatatcttagatagtaactcggaattattagtcgttggtaacccaacggaacctgttgaaaaagcctttggtaagacgattgctaacaaccggttaagcttaccaggtgtcgtttcacgtaagaagcaagttgtccctcaattaacggacgccttcaacgcttaatttacagattaatttaaaaagaagctaccacttgttggagcttcttttttgcattctagctagattggggtatgataaatactgtaattagattgtacacaactcaattatggaaggactgatagtaatggataaacagcaaggtgaattacgacagcgtctaacgcctgaacaatacgccgttactcaagaggcagcgaccgaacggccatttagcggtgagtatgataacttttaccaggaaggtatttacgttgatgtagttagtggtcaagcactctttagctcgcgtgacaaatatgatgcgggttgtgggtggccatccttcactaaaccaatcgatcagactaatcttaacgaacaccgtgacgagtcgtttggcatgcatcgaacagaagtgactagcacacaagcaaactcacatttaggtcacgtctttccagatgggccacgagatcgtggcgggcttcgttattgtattaattcagcagcactgaagttcattccagttgccgaccttgaaaaggctggttatggtcagtatcagagtttatttaaataattgagttaataaacgggaggaatttagatgacagagactgcaatatttgctggtggctgtttctggtgcatggtcaaaccgtttgatcaacagcccgggatcaagtcagtcatttcaggttacactggtggtaccgtcgctaatccgacgtatgaacaagttgccagccacacgactgggcatactgaagcggttaaaatcacttttgacccagatgtaatcagttatgctgacttggtcgaaatttactggcgtcagactgatccaaccgatgcttctggccaatttcaggaccgtggtgacagttatcgaccagtaatttttgttaatagtgaagctcaacgtcgaactgcaactgcttcaagagatgcacttgcagctagcggtaagtttgctgagccgattgtgacaaccattgaagatgcgaagccattttatcccgcagaagccgagcaccaagacttttatcgacgcaatccattccgttatcaaatcgaagaaatgggtggtcgtgaggcgtttattaagcaacattggcaataagctagatggtgattaagcgttgaaaatggctcagatttgcgatcttcgtatcgtttgagtctcatctcgataaaaataaggctaaaaacacgaataaaccaacctgcaaccacagcaatcgtcgctgggctagtaggttggtttttgagttcaattatgattgttaacttgcttggtacgcgtccaatgctgaataaaatgattttttgactgagtcacgaatatttaagtaagtaatataatcagataattcatgaacattactagtcaaaggaaaatcaaaatctgagtgcgcataacaagcggctggcgcgaacggaccattttgttcaataaacggttctaaccaacgatagaatgtcatcaaatcatcctttcaatactttagttaaattcaataaaactagtttaactgcaaaaaggtgcgttgtataggcgttttaaggcttcttaattaactagcaaattccacgtaatgcttgtgacgtgtttgtaaagttatgtaaagatcgtgcaacaacgtaaagctactttaactaaaaaagctaactgtagcagttagcccatcagtgtcacttagtcggttttagtggcttttaaagttcgcaaatcacgttgtcgtagcaagttttggtaatactcgaggctggtttcatctaaccgtagttgttgcatgatctcagtcggttcggtcgtccggtgttgcttgagaaaccacagcatgaagtcctggcgcaatgcaaccggctttaatggcacacctaaacgttgactatcacccgccaagtatttatgcaatgccgcgagggtgatatgtgggtcggttccgcgttgacgctgctttaaaaaaagatccgaactaccactttgagtctgtaatggctgcaaataggcccgtagtttaaccagaaaagcctgttctactgctgtaaaggtaattgcattcaactgctgataaaaccctggggttagcatctccgtggcagtataacccttggtcgttagtaacaagaataagcgggtgtatggatgcagatcatccattgctaaccatgccgccaattgctctggccaggtcgttgtttgttgacgattggtcaagggttgccctttgattgtaaaggttggtaaagttgtaataattcggtgtgaaaataaatagctaaagtagccgtttagattcgacagacatttgttcagtgtcgatgttttgaattggcgttgttcacggagcatggccaagtaagcttgaatatcattctcagttaaatctgctaataattgatccttagcaaaggtttcattgaagtgctgctcatagttgaaaaagtcagccaaggttaattcatattgctcaatcgtactagcttgcttgccagcagtttctaatgaggcgagaaagcttttagcatacggaaatttagcggtcattgatagtaggacatcctttctgggttagaattcttactttaactaaaacataaatttacaacaaaaacaagcgatttgaccgatgctgagagacgcgttctaagcgcgtgttcgtttattagttgaagagttgtcccttaaataaaccgtaaaatcgatgttagttatcagcaaattatgagcgtgcatgcaaactagtgataattggatttaggagtctgaaaacatttgaacttttagtgattcagataagttgatccaaattaacgaaaaatgctcggttgaaattcaatcgactaattttagtgttgatgtttgtgaatcataaaaaataatttaagttaagcggacgtcttgaaaaattctgaacagttagagccagcaaaatgattgcgacaaaatgacaatctgagaactgaatcaccagaaagctaacttaaaatcaaaaaattaccacaggggacctaaatcaggtcgtgggggagcaattttgtttttgattctactttgtataatatatattatgtaaactaggaaatgtaaaaaaagccccctagctagatttacccataatccacacataagccatcataatcacaacaaaccgcttttatcgcgtgaattgtcatcaagtttactgctagcacagcgataatttttaggtggtaaattaatttatagcacatttttataaaatctactgaactcactgaatcatatggatgtgacttaccgtgaatatatgattatgattcataaggtggccaccatgcatcatgaaatagcttttgactgtgttaatgatgttattgctcataactgttagtcaatcgactgaattgctgtgcaccttgggtttaaaactggcttttagaacgtaattgtttatcaagccgatttattgaatcgatggtttgctaacgacaatactaatttatcttgtcggcaaccacatcagtctaccgtaatttatattagaggccgcgggctgaacaccataaatgtgagtggcatccttgagtacctgcggttgtatgaagcccaggtaattagcggcaactagcctagctttcaactgttttttggcgattattagtcagaattgtggcttgacaacttgttaattttcagaccattagtcctaaaattaagcgtatttattgaaactgattgtgccattcaatttagtgtcaacaattattgcagactacgaacagtaattcgccatggcctcatatgtttgttggacatgcgctagatcaaaagtttggtgaataatttaccggggtgatgggttctttcaataccacggtaaataaaattgtgtaatttgtagcaagttgtcacgaacgcaatgtcatcacgcgaaccgatattacgcccaaatgggtcgttggggttcatttcaaccttttgtgacaacccctacccggccaaaaatagcacccggtcgccctacttttaagcctattccatttcaacgcacgttttggctgaagcctggcggattgacatgacggctcatagcaatgattttgctagcccgcgtaattacgccgaaccgctcccccagccactaacagcgtcatccatcgcccatagtactgactgtcgccctgcttaagttgcatggtcgccctagcttgaaacccgttgccatgacatgttggcgaagagcaatcaatcatttagtggtcatcaccgggctgtcctggcaccttgacgagcacccaatcggcattagtaaatggggattacgggccattaaagtcaattgatccgtggtatttgctaacgatactggcagtgccagctattaactatgaccgtagccacaataatttgatagtacaaattagacgatctgtccccttttaaacattataaaaagattattactgaagtaacagtcactactgtcagcaataatcttttttatatcatcagtttaattttcattcagtgagcttcgaacgctagcgattcatttgggtattgatcttgaaatggccactgttactcaactctgcttgatttgacgccgccagagcttggcccccgcgatcccgcaagtcatcaacataaggattggtaagtacaagataatatgatagcggccctgtacttctaatggtaaagcgcttaaggtgaaaccgtctaacaaaagcgctgccattagcaaatagtggttaagatagtgttgatgccatagcagtcccagccccattaaaacactgaataacgcaatcaccagcattacctgccaataaaccgtcgcacttgtaatcaatataggggctaaataaaaccagtggcggttaagcaaaccgggatgatggcttaagttatataagctccaatcatagccataatcctcacgaataaagccctgcattttttcattaacaaatgaccccaactgtggcttgatttgtttgagattagtctgcaaagtcctcgccatcgttcgtgtgattcgcggataggcttgcgtcaacgtgggcgccacccgtaattcgtggctgacggtagcttgtagtgccgggctataggtcccgtgacttttaacatctgtccccgtagccaggctgtataaagtttcaacttgggctggcgcaaccttaaagccatataaccagctgtcgagattagtcgctgtgaacatgagtcctaacacgaccgcactgtatgtgaggagctgacgtacttgaacgcggtaaaggtggtgagatttaagcaggacacacaaactcatcaaacccagtgcaattaaccagacgcccatgattggcctcagcatattggccacgacagtcatcacgatcgctaacgctaggtatagtcgtcgatccgtgattgtggtcgtcgtgagtgggactaatgcccgcgtaagcgcatacatcatgagtaggacgctggtgaaaaagaacggttcactaccatttaagagcgtgccgtacagccaataagctggaatccagtaaaaaatgagggcagccatgatgcctaattgtcgtgagagccaccgtgcgactagccagtaaattaagaccatatcgactaaagtacacccaatattgattagttggctgacaaaaaagttggccccgccaaaagctgcgactaaactgtagccgttcgcgatatttaaagcgtgcggaaaaacgacgtaattgccaacgataccatggtgtaacagttgggtccaggtgaatccttgggcactaaacgcggctagtgtatggtaattccagaaatctgaggtcgggtcgatctttaaccctgcaactagtggaaattttaagatagttaaccccatcagtgctgcaactaaccagctagtttggtggcggctcaaccaccagctgccaaggccaatcgtggcaccaatgaacaatacgaataaaccagcgcctatccaagcactgattgcgaggtgtaatttcaggttgacttgccagttggcgacaatcatccacccgagtaaggcagctgcaatcgtgagaacggtaattttaaatatcttatagcaccacttcatcggcatgcaccttcatcttaatatgagcgttttaagccagtatctggatattttgcaacgcgggtcgtaacaccatggcgcgttttagcccacgctgtttgaccgcgtaactgccgataaatggcgacgtatggcgtcaggctaatgatcaataagaatgcctgaaagcttaaactttgtttgagggcattcatgaatccaacgggttgtttcacgatggcacagttgcgttgatacagtgctgctaataccaaacaagccgaaaaagcgatcactagtaatgtcccgatagccaagtgatgccacccaacttgccaatgttgtaggctacggctcacaagcacgactaacgtgattagactggtcagtggcacgatacaaccactgataggcatcaaaatccaaaaggtcgtgtccaatttttgaaaatggttcagacgtcccgaacgccaaagtgctggtagataacgcatgcattgaacggcaccctgacaccagcgtacccgttgacgaaaaaatgggcgtagttgttcaacggcctcttgctggacaaccaaggtatgatcaaaggccgttcgcgtaccacctagcagccaggtccgcaaagtgaattcgagatcttcaagtaagctattcccccacggattctgtaacgctaaatctagccggacgaactgaccattacctgacgcaattccctgaccaaggcgattgcgtaactgttgggtagcattattaacccccatgaattcaaaattctgcatcttagtcagccagttgggctgattgtagatattcacgctcgtttgaatcatggccaactgtggttcttgttcaaagtgcgccagtacccgcgtcaaatcagcagtattcatgaatgcgtccgcatctaggacccccacgatcgtccgttgcggatcagattttagcgctaacgtcttatgaatatactggacggcagtgttgaggacggcccccttacctgcacgctggttgcccgtgcggtgtaggatttgtaagaagcgcgacgatgactgagttaacaacagtagactgtgatcagtcgaatcgtcatcgacggcaatgatctgggcgtgaacggttggtggtaattgttcgagtgattcagtaagttgcgtaatcgtgcgcgagatcacgtgttcttcattgagcaccggaatgaccaaaaataattcatagggtgtgggccctttttcatagctttgaatgggctcccgatagtgattgatcaacaataagttaataataaaatacaagtaaaaaacaactgaaatcataattgcaactctgattattatcatcataactcccccatcgaaacttattaagaaggtattatacgcatacttttttaaaatgcctattatttatgttatgaaaacatagtgaacgaatcatgcctattctttacgtctttttcacgagaaatttacacttattcggtagttagtgccgtacataaattggtaggatagtattattaactaataaggacggcggagattgatgaaaaaagcaacttggggattactcgcattattgattggacaaccgatcgtcatttacaccgcgcaacgggccctattaacgacgattccgagtcgctatggtctgctgggagcaatcgcttatacgagtgatccgcaccattatttggcgatgcttgagagtgcgcttattccggccttattaatcgcgcttaagccgctaaatcggtatgcggcaccctatacttggtcaacgattttgaaaaggacgctcggctggtggctatttggaatgaattggtttattctgatcagcctgtttgttcaagctagctggctaagctggggtatctttctttggtcactcggtggcgccatggtcctgctcgctaaattattaggtgtcctcagtcagtgagttaatctgaaacgacaaaaagatactgggtagtcagcaacatacccagtatctttaaattagttagttggtttaataactagtcatggtgtagtagtggtgtcaacatatcaatgatccccactgaagcacttggaaaggcaaaaatcttctgacttaacgttgtggcggagacgtgatcagcaataatcatggtcagtaagttaatcaggtctggtgcgccattaccatagattgaggcaccgacgaggtaattctcttggtcaaagactaattgtaaatcagcgtcgacctcgttttgatactgaaaggctaacagtttaccatatggcagcgcttgaacgtgaaagtgttcagtatcatgctgggcagcctcgacactgacaccgacttgggcgattcttggtagcgtaaagacgaccgctggaatgaccggataatcaatggcggcagtgctaccaagaagttggccggcaatgtagttagattcaaagatcgtggtcggggttagcttcggcaaagtcttactaatgacatcaccactggcgtaaatgtttggaatgcttgtccgcaaatggtcgtcgacgataatgccgtgccggtcggtcttaatgccaactttcgttagtcctaagtgttcgatgtttggaatccgaccagtggccgcaatgatatcatcactctcaatcttcaggccgctggcagtggttgccattaaccctgtggccgttttagtcacttggctaagcgcttcgccaaagtggaagtgcaccccggctgcctgtagatgtgtgatcatctttttaacgtgttctgaataaaatgcgggtagtgctcgatcggcaaactcaataatatgcacttctgaccctagtaacacggccatgttggcaaattccagcgagatgattccagcaccaattaaggtcaaccgtttaggcatggttggtaggtcaagaaaatcacgactgtcatgcatcaggtccgcacccgggatagccagcttggctggtcgttgtccggtcccgatgacgatggtatccgctgtatacgtgctgtccgctacttgaacagtgtgggtatcagtcagctcaccatgaccggtaataattgtaatccccaattgtttgaagacggccgtcatttgtaccgataaaggttgaatgacttgttgcttataggccatcaactgtgaccaatcgatggtgggcgttgtgttgacgccaatcccttgatattgtttgagttgttcagtcagctcgaagggaccgtctaacagaatcttagcatcacagccaaagttagtgcacgtcccggcgatggtatcttcttcaatgattgctaccttatgttgcgcatgtgctagggccactgccgcatgccacgttgcgtgcccgctaccgataaaaattgtgtcataatctgccattagagattcctcctaaaattatatttcagtcgcacgcgattgaaacggtcaataaaaaggcccgtttaggccaaatcctgtgataatgcggtaataatcttctggttcagggccagtgcttgttgatattcatcgacagtcaggtggtagcgactgatacaagttgcaatcgcggcttcgattggtgcttgttgttgcttaccctgcgtcgtgagatgaatgagtaactggcgccgatctgttgccggtcgctcgcgctgcaaccaccctgcgtcttccatgcgtcgcaaaagcggtgtcaaggtgttgctgcttaagcgcagaacctgacctaactcgtgtaatgactggtcgtcgtgttcccacaatgccattagtacgagatactgtgcgtaagtcagtttgaatggtgttaacgcttcgacataaaatttgttaaataaccgattggcattgtatatgctaaaacaaagttgattagcaaggtcaatttctggtgtcatgcggatgctcctttcaatcgcgtgcgattgattatcagcataagccccttgcccgtaaaaaacaaggggtaaataaatttgtaatctgctggtcgccacagacagcgactaattctaaacttgtaaaagcagttcactcaaaagcctttactgcccttagtcttgggtcagtgacttgatcatgagcaaatcggtttggcgatcgtcccccatcacaaaatcgtgagcactgaattgttcaaagccccacttcgcatagaagcccttcgcgggttcgttatgctcccaaacaccaagccagatcttctgcttatgatcagctttagcaatttgaatcgcttgttgcataaattgattaccgagcccttggtgttggaaagcttttcggatatagattcgttcgacttctaaagtgtctggacccattgcttctgattgtgccgcaccggtgtttaatttcaagtatcctaatgattcaccggctcgttcaacaaaataaaattgtgattcggattccgctaattcatgggttaacttgggcaagttatatgcatcttgtaagtatgcggccatattttcagaggtgttttgtacaccaaacgtgtccttaaaggtttcaatactgatttgttgtagtttgttcacgtcagcagtggtgagccgccgtgtcgtaatttgtgacatgatcaattcctcctatagtttcctagcaaaaacagtcggtcacacaatcaacgctgtaaatgcgctgatgatgtgactgactgctttatcttaacatattatttagcctttttaccccaatcagggataatcttaccatcttcactaatggcgagaccgtcgttattttctaactcagctgcgttcggatcctcgaagtcattttcaagcgcatccacgaaacgagctgtagacttaccatctagatcatcaaagaagaagttcacaaagccgtccaatttagcttggtcaacttgtggatgttgcaactggctgatcaactcacccgtgttttccgctaaactaccaggaataaaatcaaagtagttgaagtaaaaactccgggattgcatgtaatccgctaagtccggcgcaaagaaaatcattggccggttcagtagtgcgtattcgaaacaaactgatgagtagtcagtgattaattggtcagcaacgagtaataaatcgttgatctcacgataatcagaaacatcgtaatagaagtccgaatattcatatggtaacgttggtttgttttgcacaaacggatgaatcttcagtaaaaagacgtaatcttcgtgtaacgcttcgtagattgctctaaaattcaacatttcaaagggatagtatgctgattgctgaccattgccacgaaatgttggggcaaagagaatgacttttttgcccttgatgaatggcaaatcttgcgcgagccgttcccggattgcctgtttcttgggctcatcgaaaaagatatccgtccgcggaattcctagcggctgaatcttatccggcgcaattccaaatccttccgcgtatttatccgcgatgttatgcgaagaaaccaaggctttggtgtaattgcgatgatttaacgattgaaccttaggaccaccaggcatccccaaccggctgtaaccaaatgttttaaaggcaccgaccgcatgccatacctgaatcaaatccgcattttcccggatatgcaatgggtaaactagtgggtaaaagtcatctaaaatcacatagcgactagtagccaacgctttagccaacgttcgaacctctttccaggattttttggttttaatacttggcttcaaatagaatgaaatcttaaaatcagtattgcgacgttttaattcctggtagataaactcgaaattaccagagattgtcacccgactatcggaaacaaatgaaatttgtttcttatgaatcggttgaaggcagtaccaccgataccagagttttagcgcccggcgtttaatggcacgcatcgctacactatctaacccgacatcttcagtaaactcattttcaagcgggttgacatcactcagtttatatgaagtgacctttaaggcttgggcggctaaattataccgaaaaattagactgtatgacttattgcttttcgctgaatagcttgtcattttagtcgtataatttaagtcttgctgtgtttccaccacttgaccaatggaggttagtctgataatccaaccattacctagatactgttttaattgtatcttgatttcataagtgcctggcgttagcggtttaccctcactgagtgtcgaaaagttgatgtcaccatgatacccggcatatggaaaatcagcgttttgaccacgaacgttgatcaacggaatttctaattcttcattcgtcttgctagtcaaaattaagcttttaataattcgttcagtatcttgttcgggatacttttcaaaccacgccattccctcaatcactaagtaagaactgttgaattccagcttagtcacttgacgtttgatcaatgattcggcatctttctcaattcgcaatgtatttagaaaatcaacgtcttccttggtcgtttgtgcgtcctcaaccagttcacgattacgagtatattgcggttgattccgtccgtatacgatgcgacgcgcgattcgttttagtcgttgtatcatctaatgttctccccctgctaatttttcaacaaattgaacgacccgttcggtattatgcccatcttgatgtggaaatgtcttttgctttaattcatgtacataagatagatccatatgatcaacttcctgattaataaaatcgacaactcgcgccgctttgctgaagtgcggtgcttgcaaatattgatagtaatcgacatagaatccggatgtttgcatataatcatcataatcaggcgtatacagaatgattggtcgttcaaaataactaaacgtcaatgataatgacgaataatcggttataaataaatcaatcgttggcatcagcgtcttaacccgctcagcatcttggaagatatgcacgttggatggtagcgtcatcgctgacagttttaagtacggatgcagcgaaatgtacagttcccatggaccggtcagctgctgacaggccgcaatcatgttgttgacatatcccatgacttgctgcttaccctggacaccttgccgataagtcggtgagtatagaatacgatgggcggcgagccgcggttgttgtggttgttgattaagcaacgagtcgaccattggcgatccagtggcaatgacgtgatcttgattgatagccatggcatctagataagcaggctgatcagactttgcattgatcaagacccaatcataatttgtgtgcggcttcatgacgctctgatcagcattcggtaagctgaggccaaactttttcaatgaaccaatggcatgccataattgtaccacttgattatcatcatgtttgtgaattgcgtaaagtggaaaaaagtaatcatcgatcacaaagacgtcagccctggcaatcacgtatagcgctttaatggaggcgagcaagaagcccacttttccagccagggtgcggtcataatgatagcaaaacacagtaaccggtttaacgttggcagtttttaggccctgctcaagagctgccaaattgtcgtttaattgaccgctgcgcatcgtggcaagtgtgatccgtcccttcttcgggccaaacactttataaaaaaattgatagaataaattaaagctcgtgtgtagtaacacgagctttaccgtctttagacgtcccattccatcacctccttgccccaataattagtaagtgcactatcaaagaagttggtaatgtcttgaatggaactcactttttgaacgtagccaactaaattttgcaaccgttcgcgagtgactggactggaggataaaatatcaacggcacgtttaaaatcttcacggctgctgcgactgacgcctcgtaacgtcaatccttctgcaaggacagaccgggtatcgataccgactgggttttcagagacgcccattagaatggcagttcccatcggttgaatatgctggataatttgttgaatcgctgcttcactgccctggccgccggtacattctaaggcctgactgaccttgacatcggctggaatgtcatcgaccaggtaagttttgtctgcaaatgagaaataatctaacttggattgatgccgaccgaataccagcaactgactgtctggaaaaatttgcttaaccagagtcgctgtaatatagcccaagttaccatcgccccaaataccgataacccgttggtcctcatccatggtactttcaagcttggttaatgcttgaacgccgaccgagaccatctcaatgaatgcggccatgtgtggatcgaagtcgcttggcacggtgattgcgcggtcgcgtcgtaaacaaacatattcttgcataaagccgtcgtagccgcttgaacggaatcttgaagaaggtaaataattttcctgaatgattgaatccttcttaacgggcgtattaggcaccattgcgacgagcgtcccaggcttatactcatttcgaggatcataaacgacctcacccacggcctcatggatcagcgccattggtagcttagcacgtaatgcggcttgggagcgttggccaaagaaatagcgcgtgtcagcatggcagatcgataagaactttggccgcacgatcaaatcatcggcgtctacctcttcggcgaccgtttcaacttcaaattgacggggacttactaagcgataaacttgatttaacatcttatgacctcttttctactaatgctgatgcaacgcgtaagtcaaacggcgttgtgattttaaaattataattttcaccacgtactaaactaaccttttgaccagccagcgagcagattttgcatgaatcagacagtgatgccttttgttcggagctgagtgcgttatatgagtcgatcaatgttttgatgtgaaaactttgaggggtttgaccctgatacatttcggaacgaaccggaatatcggtcacctgatcattagcaccgcggacgattgtatcgattgctggaacgacagtatcgactgctttattttctaaaacggcgacgatattgtcgttaatgatacgttgtgtgatgaacggccgaactgcgtcatgggtaacaacaacatcatcgtcttgaatcccgtaatgatcttggatatagttgattccactcattagtgtttcgttacggtcggccccaccaacgacaacgtgaacgcgctcatcggtgatgtactttttaatgatatcttcagtatggctgacccaatcggctggacagacgaccaaaatggcatcaaagcgactttcaagtgtaaatttttcgatggtatggattaagattggtttgtcggcaagcagcaagaattgctttggcatcggaacattgcccatacgagttcctttaccgccggctaatatttgtgcataaatcatatctacatgaccccattcattatttaaattatgtggataatgataaataagaattttatgttttttgtgaataaatatgaaagaagtgtgacgttcctggtaagaattgtttttttatttatttggttaaagtaagattatacgattggcttaaatatatctacgtatcccggcgctcaatttacaggtaaaagtgcctaaacataccttttaacaccatttatgtgcattaattggtatactaggcctagaaaaactaacgaaatggttgtgattatctttgactcgtctacgaaactctgggttggacttctctgtcgcgacgcttaacttcttggctaacgtcggtattgtcctgccctacgttctaattctctttaagtatcagcagacccacaacgcgaattacttagctgcgatcgtggtcttctacgtggcccgggcggcgagcgtctttgggactaaacacctaaacctcaaggctagtagttatttgctcatttgcctctggctgggtgcgcttggtagcttgttgttcagtttgacggctaacatcgtggccgtgctggctggggccctattcttaggatatacatccgccaacatctggccctattacttgacgatcaagttacacttgtccgcgcagacggattttaagttaaagaaaatttactggttaattttcttagttctcggcattctctttgtgctagattttgcgctgaactggggttaccggcttgcctttatcctactggcgctactatttatcattgcgttgcctgctggccgtttgttgagtcagttttcgctcgcattttacgatcaacacgaaatggcccaagtacgtcccatcaagccgtggcgcgttgtggtctttatcgtcttctttgctgcgattggtttactgacgttacttcgtaaggcgagcctacaaatcgcactaccggccgtattaggaattatcgtcgtggccattgttctactaaatctagaactagctgctgattggcaatccatgccggctaacaaactacggatcgttgatcggggctttttactgagttttgtcctactgtttaatagtttcttcggtgtctttgtctttggcaaaatggggatgtacctggtcttcgccatctatttgttgggctttgagactggccggccactatatttattattgggacggcatgacttacatcgtgccaccacgattgcgcgcggtggcttgattgtcggccatttgttagttgccacggcccaacccgttttatatgttgccggtttgctcctgatctcgttgtacgtcggttttgaaaacccagccattaatactagcgtttatgccactgaggttgatgatccagatctcgcaattattcataaatatcgcttttccacttatgggggcctgctttgtcaactgtgtttcttcggcctcttagtaattgttagcagttttcgacaattaaacttgctcaatttcttcaatccagcttcaaccgctttgaagaacacttatctagtagggatggtttggcccttaacggcgatttctctgattgttacgctggtcacgctctacggtcagtattatttcaaacgagcacagtcaaacgactaggcaccatctaaggaggctttacgaccatgatttttattgcaagtgctgcaatcatcctgccactgattcttctcgggggcctgaatttatccgcgacccgtggaatgaccattagcgctctggtggtgattattaccggctactttttctggcagattagtccaacggtcctcaccgcctcaattttgcaggcgattcataaagccctccccatcttatggatcttatttggcgccttactcatgctcaactgtttgcgtgccactggtgcaatcgaccggattaaccagggctttcaaagtttgtctgctgacatgcggctacaaaccgttttggtagccttcctatttgggggcttgattgaaggtgtctcgggcttcgggaccccagcgatggtcactgcaccattactaattgcactcggcttttcacccatggcggccgttatcttggccttagtggctgactcgacccccgcagcgttcggcgccgttggaacaccattgaccgtgggactgagtaatgtgaccgaaaaagcatccgtcttgaacttgattggcctgcgcatcacgcaactcgatttattcgttggtgcgctaatgccagcggtgctcattttaattctcatcatgtggtttggccctaaggcacaccgcttgaaaagctggctttccgtcttaccttgggcgttagtgatcggtttcgtttacagtctactggcactcctcagtgcttggctagtgggttatgaatttgtttcaatcatcgcaccgctgggaacgctggttattgccatcatcacgatccgattgcactggttgttaccaaagtcgagccagttgacgccatggcggacgaacgggatggcagcccagacgcctgcgcctagtccgatgaacctgatgaccgcttggtttccttacctgttggtcgttgtgctattactcgctagccgggtcgtgacaccaatcaaacaggttttgacccgttatgctaacttatcgtggtcccacattctaggttatagtcaaatcaactctgattgggaactcctctattcgccagggacaatcttggcggtagcggccatcattgggttactagtacaagcccgttcattaaagcccttactaccaactgcccattcggtcatccgttcgatgggcaacaccgcaattgccctcggtgttaccctgatcatggttcaagtcttcactaattctggcttgaatcaggccaacctacccagcatgccaatgtatatcgccaagtttatcgcgacctatctagctggtgtttgggtcatcatggcaccattcctaggccaattaggggcgttcgtaactggtagtaccacggtctcgacactgacttttgcgcaaattcaagctgatattgtggccaatgcgagtttgaagcccacgattatcttggcagcccagctcgtcggtgcggcagccggcaatatggtctgtgtccataatatcgttgctgtcagctcagtcgttggcctgagtggtcaagaaggcgccatcttacgtaaaacactactaccaggtctgggttacgccctgttaattggcgtcgccgggtggctactattacgtctcttagcttaactgaatgcgtataaaggcactaatcaccttaactgcggctgattagtgcctttatttcatgaatggattatactaaaataggattataattttcaacgcaaaggaggcaccgacatgcaagtgcgcttagtgccaaacttacaactcggtgaacggattatcgggccgacccccgaccctgaggccaatcgcgcgctttatcaacgttatgcgaaacgattacaggcgcggctaggtatcggctttcaagtctacctagatatgagtgacggttatgatttactgcatgcgcgtgattacgacaccgatacttgttgggtggttgcagcggctgtttaccaagcattaactgattctgccgtgatcacccaccaccgtatcatctcgctgagtgaccaagcacttatcttaaaagcgacgcagcccatcgaacaacaactgcgccaatctccgactgatcaatagtcgcgattcaccagctggcagtcgaatgagatgaaaataacgcctaaccaacaaaagtagcagtgtactagccatctctggctgattacgctgctacttttgtttgtcagctcactgcttaatttaacgagcgtagaaactagttattgattattgcatactggcagccattttgatagccgttgccatctcttgagccttgacttgataaaccactttaccagcttgccattggataacttggtctaaaggtccagagcctgacgaaatcgcgtcaaaagtgatggcgccgaccgactgtggtactggtaagtagacttgctcgaaagtagcgacggcctgtttagctaacgcgacgcccgcatcttcgtgcatcatgttcgcatgcacggtcaacgaccagcggccctcattccacatgatatatcgttgaccagcacccgcgtcgatatgcgcggtgatttgatgaccgagatcgacggttggcagccctgctgtggatttattatcacgataacccacctgctgggccgcggcattagttgtcgcataggtcgtcttagtgacagtcgcataagccgtttcatccaccacggccgccgcgttgaatggctgggcctgttgtcccacactataattgatggtgtaattggctgcgtcacctgaatagcgcatgttcaacttcgaactgccactagttaacccatcgacttgtggaacgagcgcctgctttcccaacgtcttagtcaattgttgattcaatgctgccagccgggtcgtagccgtgggctgggtgaccgacttgttagcggcgctggcggcccgctcacgcgctgttctagacgagcgcgtggctgcggtttgaggccgactactagtactactggtagccttagccttcttttgggtgctgctaaccgttgccttggcactcgtggtcgtctgactagttgacttggaatcctggtgtgttggtgatgaacagccgaccaacaagacggcaagtggtaatacgagcaagttgcgataattcatactgttcccctccccaataatcatgtcacggctgatacgtggtcgtcagcaacgtccatgatgtttgacttaattatagaatagaatgcactattaggggtgattattgcaccttacaaaaatcgccggccattagctggtaaactaattgggtttaccaagactgatgaccggtgattacaattatcgtttttaaacggtgcgatgcatacttcgttcgatgactaataaaatgacgaaccaaacgactgaaccgatgactgcccaacggttgacttgatcaaagcacaagacgaccgtcaccgcgataaagaaggccaaggtcgcgatgttggtaacagggaacaggggcagcttaaacggattatgcgtactgtcagtggttcgtttgtaaacgtaatggcacaccaacaaggcacaccaaacaatgatgaagttggttgttgccacgttagagatcaacgtgaagacggtacttggaatcacgtaattcaacgccacgatcaccagtaagatcaatgatgagaataacaatgagcgggcgggaacgttgtaacgattgacctttcccatccatttcggcgcgttgtcaccgtgcgcaagtgtaaatagtgttcgactcgtactgaagatggcactattacaagccgagagcgccgcggtcagaaccacgaagttgataatgctggccgcggctttgatcccaacgtcgctgaaaacttgcacaaagggtgactgactggtcgtgatctgattccaaggataaattgccatgatcacgaacaaagcgcccacgtagaagaatgagattcgaatgggtaagctattgatggcccgtggtaattctttttctgggttttcggcttccccagctgtaattccgaccatttcgatgcccgtaaacgcaaagataacgagcgaaaacgacatcaagaagccctggacgcctgttgggaagaagcccccgtgactgaccaaatttgtcaccgagaccgtttgcccaccgacatgggccgatgaaccaatcaagatagcccccgtcacgatcaaagcaatgatagccaccactttaatcatcgaaaaccaatattctaattcgccaaacgcactgacggagagcatattgaatactaataaaatcaaaataattattaagggtgtcacccactgcgggatccacggaaaccagtaacgaatgtagataccactcgcagtcaagtcagccatagctaaactgatccagcagagccaataggtccacccaatggcaaactcgaaacgtttacctaaatatcgattaatgaattctagaaacgaatgtaaacgcgtatccgacaataatagctcgcccagtgctcgcatcatcaagtaacagaagaaaccgccaatggcataagccaacaagatcgacggccccgcctgtttgattgctgaaccggagcctaaaaagagcccggttccaatcgcgccaccaagcgcaatcatctgcacgtgacggcgttttagtttacgggcaagttgctgattttccatatgacctcaactttcctttaatccaatttgataataattttcataaaaatacagattttttcacgtccattcattttatgataaaataatccgccgtgcaacttttgccaccgaaggcaaccgtaaaaaacgggttttaattgccatgcaggattttttctggtatctttaattactttgattattactggaataccagtcattagagctaaaggagtttacttatgccaactaaaacaactgatactttctggaaaagattcttcaagggcgtcgtcatcgccctcggttttattttaccgggcgtctcaggtggggttctcgccgccattctcggtatttacgagcgactgttgggctttatggcccacttccgtcgtaactttaaacgggacttctggtactttgtccccgtcggattaggaggcatcgtcgggattgccctgctttccgccccgctggaatacttacttgcacacgctcaggtgatcgttctctgggggttcgcaggggccatcatcgggaccttaccagccctgatgaaaactgcaactagtcgggcgccacgtgactggctcgacggagtttggttcttcgggaccttcattattagtgccggcctactttactttatgagtgagctgtttgggaccttgcccgctaactttggtggtttcatcgttgcgggagcgctgattaccttgggcgtcttagtgccgggactgagtccttccaacttgctacttattttaggccttttcacacccatgctgacgggctttaaaagactagatatcgtaggcgtctacttaccgatcgccatcggtggcatcctggcgatggcgttgttctcgaagttgatggatcacctattagtgaagtttcattcccgagtctaccatttcatattaggtattgttctggctagtaccatgctgatattgattccgaatccatatgcggctgagagtatctcatatgcgcatgccacactcagtacctacctattcagcgccatagctcttgctgtgggaatcgcgctgggttactggatgagtgctttagaaagtaaatataaatagtgccactgaccgttggcaatcttgacgaatgccgttgtgcggtcacggttaaccaaaaaactgagcgtcggaatgtgaaaattccaggcgctcagtttttttggttaactactcaatcagccaccttaactttgattgcgacgtcgccgcggctgcaatcgtcgcaattcgttgacttgtgcttgaatctcacctaacatttgtgtttgcattttctggatttcaagcatgtttggttcatcttgttgaattaaatgatcgactttcgagtgcaggacccggatctcctcttcagacatcgagttcactttaaaatcattggccgcttgtagccgatcatactcagctgcccgattctgactcatcatgatcaatggtgcctggattgctgcgaccatgcttaaaaataaatttaataaaataaagggataagggtcaaaatgatggctaaaaattggtaagacgttgagcaacatccacacgagcatcaccacgacaaacgaaatgataaacgcccagctccccccgaaccgtgcgaccccatccgcgacccgttgaccaaatgtcaatgaactttccagctcgctattaacatcgacgacccgatacgtgtggttagcgagaatcttagataattgcgcattgaccttatcattttgttgataatcgttctcgatcatcgcatccatctttgctaagcgataatgtacgagatgctcactacaaatgaaactgctattatgggcctgcggaaaatcttttaaaatcatttgccgcaaactagtttccaattcttctaatcgcataccgtccacaacttggtaacgttgttgatcgacaatgcacactgctgttttcgccattagacacacacctttctctgatcccggcgtgagaattacgtgaacaatgcggcccccttgattagcaaccggaacctaacatcgcaaaaccacacctcacaccatctatttaattatacaaatttaaggcgcatctgcccagttaaagaccaccaatcaaaaagcgattattcgccggcctgaagtgacgagtttcctcgtattcagctcattgaataatcgctgcgttcagacggagagttcgtccatcaacatcatggtctgatactgaccatcgtctaagactgccaccgtctcgggaaactcccgttggtaattgactggtaaatcgaattccatgatggcatcgtgctgcgcatcaaaagccacggtgacttgcccattacgtgcgatcagggcaaattgcaggacccgtggcaggcgaacgaccccctttagattttgatcaataatatcccaaatgccatcaatcaccgcgctcggtagcttggcggctaaccctagcgttgcaaaccgttcttcatcttgatcaaacatgctaatcacctcattactcaattcggcttagttatcacgaacaatcactgcgacctctttttcaatccggataaataagccttgtgaatcctgtcgaaaatcattttctaacgtggcagacaacggtttaatgcggccaacgacggtgccagttgtcccatagagttcgatagtctgaccatctgcagcccacttaactgtccagtaactaccttctaaggcctcatcgacgaagtactgagttcccgccagcacagcttcattaatcacgctactttcatccgcagtcattcccgcgtctaattcccacttaagtttttgattaacttccaacatgtctcctggaatcaaattttgcataattattcctccacttttgttcatttacttaacatcataccacaatcacaactaatatcaggcattcaaacttatcggtatcagttgtcagtcagaaattgatatggtattgttatgataagaaaatgagattattagaaagtggtgaatgacgtgttggctaaattttcagcttggattaaccttaagcgcacaatttttgcagttatggttatgtcaggggcgcagtctgcgctttttccaagttgaatgaccactagccattgcgaagtcacgagcagctgacgacaatgggtcgtctttttttgtccgctcgtggccgctaaaggagtccaatatgttatcaccacttacccgtcgtaacctaaccctcagttatggttatgcggcctgtgctttttttggtatcaacaccctctgggtgatctttttacagcaacaaggcctatcactcgttgagatagggctatgtgaaagtgtttttcatctgactagttttctctcggaagttccctccggcgttatcgccgaccgctttggttatcggcctgtcctgatcattagccgcctgatggctatcggacacgccctcatcatgttgacggctcacagtctcggctggttgctcctagcattcatcctacaagcctgggcgtataatctccagtctggtacgattgaagcggcacaatatgacagtctcgtcaatactcaggccacgcaacattatccacgcgtcacgacgattctcaacacgacaatcgaagtggccgatacgttgggtgtcgtgttggctggctggttaatgccccagcatctttcagtgacgtactgggtctatttagcggcagctctcattgccattctggcaatcagtgggctgcacgttccccagcgccagttgaccaagactcattcaacacaaccgtcgttacgaacgatccttcgtgctgccgcgcatctgttagtgacccaacgtcgtttacggcttttaatgatctttgacgcgctcttttcggcactcggaacaacttattactattactttcaaacagtgatgactgctcagcactttagtgggagactaatcacgacgatcctcattgcgagtatggccctcaatattgtggcgatccaactgacaccttggctacagcgacatcaaacccaacatcagttactttacgggctctgcctaagcatgattatggccctacttagcgcatttagtcacgccatcggtctactggtcctcatctatttagtcatcaatagtttgatggcactgattgagccactgttttccaactactacaatcagctgattccaaacgggcaacgggcaaccctactgagcgttgccagcatggtctttagtttagcgatgatcagcgcttttcctctgattggctggttaattcaacgggtggggtttgccgttactttcggtagctgtggcctgctgacattgatcgccttgctgagtctttacggctatgcccggcgaagggccgtccagcattgaaaaccataactaatcactgacattactgctgagagatgttcccccacgacttgaccggttgcttttgaccaccccatactaatcgcaattgcgtcaccattaatcatgcacgtgaacggtaaagtgaaggcccccgagaatcgaaaggattcctgggggccttttccgtcgtttggggctgttcggcctattagctagtttgagtgagccagattcgatcgttcaaactgttgccgaatttcctcagcgatggcgcgcattcgctttggcgtatctgcttgtgccagccgatagccgatatagtatggtgagacattaaatagtgggaccactttggcaacaatctggtcatcccgcggatagaaaaataggttataactatcacactgcccatgaaaatacgtatttagcgtatactggacgacctgttgcacagcatcggctaacggtgcaatcgcggtagctggagcagcaacgttgatttcgacaaatcccatgataggccgatcagaaacagttacttggacctgatcgaccgccaacactgaatacccagtcaaattggctgctgtcacgttagcgtaaccatcggcggccattaaaccaacgatttgcatgtgtggatgccgtaaacttccacccgagtgtgggccaaaatttttatagcacaacaccgatttgaaccgaccactcgcaattgtggcttgccagtgcttcagagcaaacgcgaagacagcgcggttttgtgcggatgagtaagtagcaatatcgccatcatggcgggccgcctcgatcacgatcgtttgccaggtagcttgcaaggtcggaaatttattcaatagccagatacgatctgcatcttgcgcgataatatcagtcaactggcccggatcgcaaaaaggacaggcattgtgcgggtgccggatattttctggcttatccttcgcaatggccgtatcaaagattagtggctggtttggcaaggtttctcaacttctttcatgaaataagaaaacgggtccgaaacaccaattaggtgccgacccgtttgccttttatacgcattagttcattggttccggtgtatcagcgcccggaccaaactggacatccgccatcgtgatccaaacaacaaattccgttgaagccaaccgccagtactgcggatccgacgccggcgggagtgattgttcaaagagcgcaatagccaacgcgttcgccgcattgtccgcagcaacttggacactcgccccaaaggtctgggcggcaggaacgtctggaaaacggacatcccagtaggtgccttcatcacgaaaaatggctggatacttaacttccacataattgtgattcaattttatcactcacttcttacaatcattttaaggctattataccgaaaacggtcgcaaaagcccagctcaaacatcatgattgcaattaaaattaatcagcctttgacacgtggtacgagccattgctatccgtcgtgaccttatagttcccactgattgagttttcaccatagtccttcgcgtcatttaaattatcgtatgtcgagccggcatgactactactgctactcttttcagtactagttgacgccgtttcactctttgatgagctgctggctgttgaagtactgtgagaggtggcgctacttgtggtcgtttgatgactggtcgtcgtgctatgcgaactagctgtcgtattgccagcggtcgtattagtggcagttgaactgctatacgcacccgtcgtttctgtcccatctgtgctagtgtcggcatccgtacttgcagccgtcgtttcgctagtactttcactacttgagcttgaatgcttcttctttttcttcgatgagctagatgatttcttcgaagatgattttttgcgcgccttgctgctacttgaggaactcgtggtttcgactaagtcttggttgctagctgctttgacaaagtaaacgactgttccaccgagcgcaatcacgattaaagccaatagccataacgaaacgtgatgttttttttgcggtgacttaggtgcttgcggtttctttggatcgttcggttccttaggtgcatgggatccctgtgaactcgccttacgtccccgcttgccacccgtagcctctcgcgcttttaagcgtgacatgcgcgtctgtttttgttcaggcattaactatcgcacttcctttcttgcttccgccagtttaccatattttggcgggcttgtcttaatgcttaataaaagaaacaatattatttgtgtcgatttttaatatcgacgttcattaattaattgcttgtaaattatcataatagttggcaagtacaccataaatatatggtaccaaccataactggccgattccagccgttaagatactgagaagttcccagcccaaaaagcttaaatgcaacacgaataactgccacttgtgcccgtgcatcaactgacggctacgggtgaccgcatcacgatagcgtggccgtgcttgaccagcaggtgttgcagctaacaagtccttatacgcataaaaagtctgtgaataagcgtacgccttaataatacccggaaccaccaatagcaggctccataggaagataagcacagttttataaataatcagaccgaccagtgcccacccataacgtttcgtgaacccgaccgttgagtcactgaccggatggatctggcgttctggttgtcggacccagtccaacatcgcataactcgtcccaatccgaaagatttgaacgaccagccagacaccaacttgaaccagtaaaaacccagctattacagctaaaatcaacgatatatcagaaccagtcaaggtccccaactgcttaaaagtcgtgtcgtcagtcgtggaactgcccgacgacacgcgatctgaataattggccatcaccccgaaaatcgttaataagctaataataatacataataagatggcatctttccaacgccccttaaagagttgcttaatttcggttttaagttcggccctcgttttttgaatcattgcgccactcctccactacttgtttaatttagtccattttccgtgttttgtccccgttagtcaacggcaaaaccctaaaaaagcgctggcaaaatgccaacgctacgagttgaatcataataattgcttatgcataatcacaacgggggccccatcttcatcatacgggccggccgtaactcgataaccacacagttcgtaaaagcgctgggcagtgagttcaccatgaatctcgccatgagtaaaaccacgttgcgtggcccactcctcagccgctgtcaataattgacgaccccaaccatgaccgcgataggccttccgagtgcagactcgaccaaatcgcatcacgtggtcagcttgtggttctaagcgtaacgttgtaattggtaaatcaggctgtaaatatagaacagcgtattcacgctggtctgtatccttgacgtcaaattcaacgtcagcactgattccacgctcttcaacaaatacagcctgacgtaacgcgtaggccgctgcccgattggctggtgatgctgaaaaaataattttcattttagtaggccttatcaatgtccttcaaccaggctaacgctaatgacttgtcacctaaatgggccccaatcactggaccaaagtacgtgatatcgatcggcatgtctggataaatttgttgtaacttttgtttccaatcttcagcggcagccaaattattcccctgaacgataattgctcgcagcggatagtcgacttttgactgtgcttcagcaaagaggtgctcaactcgcgctaaagctttcttagttgaacgaactttctcaaaggcgacgatttcatggctctgatcatcaaaagtcaacagtggcttgatccgtaacacgcttccaatgaaggctgacgcattcgataaccgaccaccccgaaccagattttgcaaatcatccacgataaagtattcgcccatcgaggcccgcagatcatctaggcgtgccaggatttcttcaacactgtgaccagctttagccatccgcgcggcttcaattgccaaatagcccatcagacggaccgtgatctgggagtcatacggataaagtttgatattatcgaccatatctcgcatgttcatcaagctattataaaaaccggaaatcgtgctagcaagatgaatactgatgactgcatcataaccttgttcacccaagcggttatagaatgccaccatttcccccacgggtggttgggacgtacttgggaacgacttaaatgatttcatatttgcgtaaaagtcggccgttttaatgtcgacaccttcttgatacacttttccatctataataaccggaatcggcacgacatgaatatcgttgtccgcgacctcttgcggtgtcaaatagctcgtgctgtcagtaacaacagcaatcttcatgacttacacctacttcttatttaaataataacaaatatcatagcataaaactaagttatactctaccttcgaccgtttggaaagtcatggctcgagaattcggctaactgacttgtttaaccgattgagcagaatccggagaaggttttgttcatcttgtggccatttgtcaaaaacttctgcttcaaactgttgataatccgcattaatcttggtcaatgccgctgttcctgccggcgtgaccgtgtaaacaagttggcggcggtcacgaccaatcgcttccttactcaaacgttcttttttgactaggctagccagttgccgacttaatgtagatgtatcaagctgcatggctgtcgccaatttttcttgcgtattggcccctgctgccaactggatcagcagttgccattccgcaacggtgattccttgggccttagtaatttttttcaacatggcagtttgcaacttagcggtttccgctaaggccgttaaacttgacttcatgacagttcattcctctcaacaataattcacattggtccattgtgacttgatttaccccgcctgatgattaaaaacgtgctaattttttagactcaaaaaaactcaactgagctttgctgacgcaagcacgcttcagcgtaaactggctgatccagtgcgattccatcgtaattagcacgctttaaccatcacttatgcgaatagcagcacccacaatgaatacatttgtattatacaatatagagtgtgtaattacgactactttttatttaaaataccgttaaagtagtttttgcatataacatttttagattcaaagcgttcatccgctaattgcttgtttgacaactagcagcgtcgacgcctaactttatgcgtcagcgtggggcgctaacttgtttttacctgttcaaaaacggtatactagtacccggttaactgtatttttacagtgataacgaatatcttagaaagcgagtgatcacatgtcctttgatggtttatttacccatgccatggtcaccgaattacgccaaacactagttggcggccgtatttcaaaaattaatcagccataccaaaacgagttgattctgaccattcgtgccaaccggaagaatcacccagttctactatcggctgacccgacgtacccgcggattcagacaacacaaatcccttacgttaatccggccgtgccgacgaacttcgcaatgatgatgcgtaaatatttacaaggtgccatcgtgaccgatgtgtcgcaggtcgccaacgaccgggttgtgcacctgaccgtgacgacccgtaacgaactcggtgatgccgagacattgacgttgattattgaaatcatggcacgacatagtaacgtgatcctagttgataatcagactggtaagatcattgacgtcatcaagcatgtcggtgcggatcagaatcgctaccgattacttctaccaggcgcgacctacatcgagccccccaagcaagacaaacaagacccatttacaccgaatactgattttcacaccttagtcacggattaccccaacgaagacgtgttggcaaaacaattgcagcagcattatcaaggattcggccgtgatagcgcacaacagttagctgccgacttgcatcagcctggcgaccttgatcaccattatctggcctttttggcacagtttgatcagccgcaggcgacgttgatcaccttaccaaatcataagaccatgtttgccgcgggaccgtttgaccattttggcaaagccacgcgccagttcgactcattgagcagtctgcttgatttttattatgcagacgcagcccaacgggaacgagttcaacaacaagccggcaatctgattcgggtggtcaaaaataacctgaagaagaatcgtaataagctcaaaaagttggaaaaaaccttagctaacaccaagcaggccgatgagctgcggttaaaaggtgaaatcttaacgacctatctacatgaagtcaaacgtgggatgactgagatcactttaccagactattatcacgataacgcgccgttaaagattcaactatctaatcagctctcgccttcccggaacgcgcagaagtatttttcgcgttatcagaagcaaaaaaatgccgttggcttcgttggtgagcagatcagcttgacccaagctgaaattgattatctggacaatatccagacccaaatcgagcttgctagtcccgctgacatcaccgaaattcgtgaagaattgacgcaacaaggctacttaaagcaacacaagactaagaaaaagcaacgcagttcacgtaaaccgagtcaaccccaggaatttactgcgagtgacgggacgccgatctttgtcggtaaaaacaaccggcaaaacgatcagttaacattgaaaacggcccgtaagagtgactattggctgcatacacaaaaaatcccaggctcacacgtcatcattcattcagatgatcctagtgaccaaacgctcacagaagccgcgaatctcgccgcatacttctcaaaagcccgcgattcagcaaccgttccggtcgattacgtccaagttcgccgaattcgcaagcccaatggtgccaaacctggctttgtgatctatgaaggtcagaaaacattgtacgtttctcccaatgctgagcttgttgaacaactgacaccgcacgcgtaaactggttttaagagtacgcagtgatcaatcattaaccaacaaaatcgcgcgtccaagataaaatttctggacgcgcgatttttagtacttactggcagtgcttcaaacggtaacggttcaaacttcccgccgccgaaagaatagcaggcctaacactaagaataaaataatgtatgcaagattgccccaaaacaactggacatccgtgagattggtaattttactcagcgtcggtaatcccaactgggctgaaaagttgaacatgttgagtgggttccatttgagccacgtatacttccgaataagtgcgatcatgggaatattaaccattcccagaacaaagtatccgatgattccgaccgcgactgccgcaccagaactcttgaaaagagcagcaattagcagcactagacttagcagtaaccacgtattgagaaattcaccaccaacgcccgccaaccaatcatgccaaaacttggcccgcgtaaagatcgcaaatttatcatttactaagcagactttaagtaagatggcaaacagactgctaccgacatacaacaatagactgtaggttaacagcacgagccacttactaaccaaaacgagtggtcgtgaataacgctgcgttaacacgtgcttgatcgtcccaaattgaaattccatcgtgatcatcgtggccgccgctgctaccataaagaagacgatgaactgctgcgcttcaaaattagcggcaaacatggttttggcgggaaaaatcgtcggcttgatccgcgccaaaatcgcaaagatcagcgctatggtagccaatatcagtccacaccaaatcgtggacttcttcttaaatagttttgtgagttcttgtcgatataacgtcatcatcagtaccactccctaggcgctggttgtcgccagtaattttaaaatcgtactttccaaatcagccgcctcatgccgaacatccctgaccgtcagtccgtgactagtcagaacatggagcacatctgctacctgatggtccggtgctaagtggactttcacaaccgtgtcggcaactacttgatagccggccgccaccaaaaccgctttcgcctgaccgtcatgatcagttttcacagtgacaaaatgatcggtcgtcgttaacagtgctgtcatcgttgttttctcaataattttaccgtgatcgataatgactaaatcgtctgctaacttttgcaattcactgagaatgtgactagaaatcaaaaacgtgacgcccacctgtttttgcttcaagataaaatcgcgtaactccttagtaccttgtggatccaaaccattcatcggttcgtccaaaatcactagttgcggccgattcaaaaaggccagggcgacaccaagcttttgtttcatccccaatgaataatgacgcgctttttgatggatatagtcggtcatgtttagtgcggacaccaccgccgccaatcgcgcttgggcatcgggcccgtccgcaaacaaacgcaagttgtcccaaccgctcatatacggataaagactcggatactcgattagtgaccccaccgtcgccaagatgggatgatgatcgaatcgcatcgattcacctgcgatttgaatctcaccatccgtgctaagtagccctaaaattgctttcataattgtcgtttttccagcgccattcgcgcccaccaggcccacgatccgtccctgggtgcattcaaaactaacgtcacgcaaaactggctggtggccgtaacttttattcagatgtttaactgttaaaattgcatcggccatttaaatcccctctctttcaagatggcaaacgttctcataagctgtcgacacgttgcgtccctccttaaacgataagtaaccctgcctaggaaagattaccattcggacgttactgaattatagctcgctattcatttaaatgttggttttctcgggcgcacaccagtattttggtacttttaacccccaccacgcgaaacgacgattaactaaccaatcaacgtcatcatttttgtcacgttagggctaagccacacacccacttaaacgcactagttgtgcgcatgaatcaaaaacaggtgaacactagatcggccacattgccaacctagtgttcacctatttttcgcttttgaaatgaaatttttggcgccattccgggattagctcaggtcaataaaccagatgatccagcacggtccagtccgggtaggtctgatcgcttgggtcaaaccgcccggataacaacactgcctttgcttttaaaaccaacggtgacgcattagcttcagtcaacgcatgcaacggcacccgtgatgctccatgcgaatcttgaccatcaaagttagcgacatgttcagccagttgcccagttgtccgggtcactcggtaaaagaccgccagatgttggttcatccgccactgcttgaactgccagggataccgaaaactcgtgatacccaattgcgtcaattcagtcgggattaacccggtttcttcttgaatctcacggcgaatcgcggcaagtaagggctcaccatcggccaaactgccacctggtaagtcgtagcgattcgtatagggaccaccaaactttttagtaacgaccaacgcatgctcatcgccaataatcccataaacaccaaatgcacggtgataagtttccattgtcccacgtcctttcacgtttaaacagcgtcgttaagcgtaagcgctagctatcttggtgtcaaggcaaacctaagcgtttactgtaacggtaaacatatcagatgattgtaagtttactattttagtaaacattaattcatcgattgtgtttacaaatacagtaaacagtcttataatcagtaacattggaggtagcctcatggacttaactagtttaacgattgatgatttaaaacgcggctggcatcaaacagccactgcccggtattgtaattactgtgatgctagctgggaaacgactacagcggcggccacgatcgaacaacacttaacgatcgtccatggtggtatccagtcaccactgattcacttagcgagtcgctacaatactttaaccactaaacagcaaaatttactgactgcttttgcgactggcatcaaggatgccgacttggctaaacaatttcaattagcggcggccacgattcgacatcaaaaatttacatttcgtgaaaaagccaaacaagctaaattgtacctggccatctatcaatccgtctttgagagtggtcagacgcccaatgatttgattgtcctgccagaacaacctggaattattgatgaccgctttgcgattactgaagacgaagcggtccaaacattgaagcagtacttcaactttgatcatgacccactacaattgaagcggtggcccaaaaagcaaaagacgatcgtcacaattctaacgcggattattgatgaaattccgatgaaccggccaatcaatgaagacgagctcaaccactatttacgaccgatttattttgattacaccacgctgcgtcgttacctgatcgactacggcttcttaaagcgtaccgtcgatggccggcaatactggcgcacaactactaaggaggactgaaccatgcaaccagtcgaaaagcatcgcttacaacaaaaatacaaacttgccccaacttattacggcgtcattcaaattaccaacgaacgcaatcataaaatttggattgacacagtgcccaatttacacaaccgctgggccttttatcaactaaatcttaataaaaacttttaccggtccaacccgttacaggctgattggaatcaacaaactgccgctgacttttcatatcaaattctgtggcaaaaggaaacgaccgatgttactaatatgcgtgccacgctcaaagcactcaaaaccaaatggctgcacgatttacaaccattcgatgaccatggctataatcggcgccctaaagattggaaggaaaactaaatgaccaccactaaaccaaacatgcacgccgttgctattaatcctgcagcctggccgcgccaaacttatttttactatttcaccaagatagcccccagcggttttagtctcacggtaaatatggatattaccgccaccctagcttggactaaagcccaccacgttaaattcaacgcggtatatctatacctagtgagtcgcttgttgaccacacatcccgaaatgcgcatcggctatttgaacgatcaactggtgacctttgacgtgttacatccgtcttatacgatcttacacgctgaccggacaatggctaatttatggacgacttacgacaccgattttgaaacgttctatcaacactatttagcagaccaagctgaatttagtgcacttccagggcccatgccgaaaacaccacaaacacctaatctggttaatatcggctgtcttccaggagtccactttagtagctacacgcccctcccattcaaaccactagatagtttctttccaatttttcaggctggccagtttaagaaggacgctgacaaaacaatcatgccgctaagcattacggtcaatcatgccaccattgatggcgatcatctcagtcgtttttttaatgaactccagtcatgttgggaacaaccaacacaatacttagcctaaccatatagtcaaggcccgttatgtgcatttgttatccagcttaaacaccgctcgtcaggtctttttttgaagcgaatgagtcactagcttaatcagtgttatttaccggtgtttgttcgctcatcagattgcgcctttcttcaagcaaccacaccgtaaccgctgtccaagtagtgccggccctcgccagtacaattctaagaaattcttatgctagccttatgaaaacgcagtagttgagtctgcttcaaatgggtaaactaaagacattaattaagaaaggaactgatgtctatgcgtcattcacaagtcttaacgatcacggtgaaacaaccgcggcctcggagtgctgatccagctgtcatttatagagtcgatcgccatccttactggcattggaacctaatgaactaataaaaacgaaccgtgcactgaatcgtagtgggctcaaatgcgcggtattaaaaacaatcccgttcgatcagccgtgtgggccacctgattgaacgggattatttttggttgcaagctctgcgggtatccggtacactgaagccatcaatgaatggaggaaatgccaatggctgagtaccttgacgctgacctagctgttttgacaccatatctggaaaagctgggtgcaacaccccatcgcgcccaactgattaccttgctcaactgggtacacacgacttttccacaactcaaggcacgggtcgcctggaatcaaccgatgtttactgaccacgacacatttatcattgggttcagtaccgccaaggatcatctgaacattgcacttgaatcacatactttggatagctatcggaacgcgatcacggctgctggtgataaaacaaccaagatgttatggcaagttgctttcgatgcgccaatcaatcacaagctacttgcagaaatcattcaatataatatgactactaaacaaaccatgacgaccttttggcgcccttgatgcgtcagcgttcacgaccccgctttcatgcctgaatccgagtcgtgagcgctttttaatgcttaaactcagactgagtgtcaacgcacttaaatctagttgacataattttaatttttatcagttgcagccaaattaatgattttttcaaatgtgaagcggcccgcgtcatactggtacttgatgactgcacagttatgtaacacgatgccttgccgctcaatttcgtccattgaaagccattgccgcaaaaacatgaagctagccccaccgtgactgaccgccaacacctgatgatgatccggacgtgccatcaccgccgtcaacgttttgacaacgcggtcttgtacctgcaaatcactttcgccaccgtactgacagaaaaagtcaccatgactgcggcgcacggggtccggttttggatttaacacttccgactcaccttcgaaaacgccaaaattccactctttgataccctttaaacgctcataaggttgcttggtcactaattctaacgtgtcactagctcgttcctgcgttgagctgtacgcatgatcaaacgtaatcccttgcgcctgaaaatacgcacccacgcgttgggcatccgcaattcctttgggggttagcggcgagtcacacgccccctgaatcttcttcagccgattaaaaagtgtttcaccatgccgcatcatatataatgtctttgccaatttaactaacctgcctttaatttgtctttagataagcataccataaatgaaagcgctatttaaagcgtcctatacattggccagttagagcctacttttgcctacgaacgcgcaaaaaagcacaaccagattttagtctggctgtgctttaaatagcgatattgatcaaaagctcagactaaaaatccgtatcttcatttccctgattcaacgctgtcaacgccgcctttaacgtgtcgccatgtgcaatcaccgtgccggtagcatggcccggttcaccggtggcttccacttcatcataaatttgtaaatgattgtagggaaatgtattcgcctgaacatagactggctttagccggttaacatccggatagtcgtacatcaccttagtcagtgcttcgcctaattttacgtgaagtaataagcgggtcacgctcgacccactggccttactgattaacgccatcgtagcaatgctcatcggttcaatcgtagcaagttgcaaagccgtatcagcaattgctaaccgaactgtatagagcccgggcgcacccatggcgagcactcgttgcttgatttcagcgtgtaaagctgtaattgcctgattttccgccttatcacgaatcggaaatacttggaccgcaccacggacattgccacgcaaattatttcccgcaataatttcacttaccccaaaaattgtcacatcggtgccgtccgtaatcacctcgacggcgggcgaatcgttggtcttgatctgctcgcgcggcaagctattgttgatttggatcacttggtagccatcctgtactaacttctggcccagccggtaatcatgataggtggtaaaaacgatcaacggcttttcaatcgctaagacgtttaaaatatccgaatactgtttaggttcaacgtaacgttttttggccaatcgcggagtcatcgccacactattagggttagcgttgatcaaaacaggctcataatcagcctttttcaagtagaacaacagttgtgagaccaaatagtcgttcccatggttggttccgatccggttagcacccgtgccaatgacaacgactcgccgaccagtagacggttgactttcgttatcaaattcgtacgtggagtaataagtactcgtctgctcagtaaattccccggcagtcggttcgacctccttaaaagtcggttgaatttcattttccaacgcaaagttgcgaaccttagccacatccgtttgccaggcagcggccgcatcttcatcggtaaagccaaaatatttggctcggcccagcgcgtggacgtcaaacggccgttcacgcaaggctcgttcaatttctaaaatatgactcagtttataaaagtaaaaagcatcaatcttggttagctcggctaattcatcgatttgataaccacgattcagggcttcaagtaaaatcagcatgcgcccagcttgcggatgaatcaaccgttggatcagttcaccctccgaatagttctggggtcgattagcaatcacgtgatagcgagattcgtccgtagaccgcaaccccttcaacaaggcttcttccgttgaacgaccaataccgatcactgagcctgtcgattccgtcacggtgtctagttgatgactaactttcttcaacacattaaacggccaaactggtatccggcaaacaatatgatctaaaacgggttcaattaaagctgtttgtttacggtaggctccgggcagtttgacctctgccaaacttatcccgaccattagattaccaacaacttgtgctaacggatactcggttgcccgcgcggctaacgccatcgtccgatcaaagtacggtgtcactttaatcacgtaatagttttgcgtggtcggatcaagtgcaaattgaacgtgacaagagccggtcaagtgtaacttgcgcatgatcttgagtgtcgctgagcgaaactgttggtattcttgatccgtaatcgtttgcgttggggcaaaaacgattgaatcagcggagtgaatcccaactggatcaaaattttccatcccactgactagtagcgcggtgtccttctgatcacggacggctacaaattcgagttctttatagccgacgatactctgttcgacaatacattgtttggtccctgaaactttgaatcccattgctagtgcccgttgcagttcgtcttcatcttcacatagttggcgactcgcttcgattcggggtgcgacagacttgacgatcactggaaaaccgacgtggcgcaccacggccatcgcctcagtcgtgctagccacaacttgtgaggcaatcacgggttcacccatatctttcaaccggttgctcatcagcgctgggttgacgatcatgtcgaccacgtcttgatcccactgtagcaacttcacgtgattattttttaacacattgttgcgaatcaacccttgaattagggtgactgtttggacgccaccaagtgaaggaatgaggccatcaggctgttcagtttcaataattttggatagtgcggcgacagtcagtggttccaaataaaccttgtcagcaaaccgattttcagccgccacggagtaagcattgttatcgacgaggacaacagcaatgcccagacgccgaattgccgcaccgatttgggtcaccgccgcgtcgtgttgtccctctcggccaatgtcattatgcccagcgccaataatcaacactttttgtaaggcttgattgttcaccagattggcccccttgcttgttgcatcgactcaacaaattcatcaaaaatatcgcgcgtttcagtcggaccaggagcgccatctgggaaaaattgcactgaaaacgctggaaagtcccgtagacgcagtccttgaatcgtcccatcgatcaagtcaacaaatgtcgtgattaacttattacgatcaacagtatccgcatctaccgcgaacccctggccctgagctgcataaataatttggttcgtaatcacttcgcggattgggtggttagccccatgatgttcaggtgataatttcataatttgagcgccattggccatcgcaaatagttcgtggcccagtccgatggcaaacagtggcacccgattttgaatgttcttgatcatctcagtcacactgactggtaagtcctgcggtttgccgggcccagtcgatagaatgacgccgtctggatctaagtttaaaatttcctcagtcgttgccgtataaggtaagaccgtgacgttacaagcacgcttactaagttcgcgcaaaatcccgtgtttgaggccaaagtcgatgaccacgacattgagccccgtccccggattaggaaatggtttcggtgttgcgaccgctgccacctgttgattagtcagcacggtcgcacccaattgatcaaaggcatgggcatctgcaacgtctacgatactggctttcatcgggccacttgctcggagttgcttcgctaagtgccgtgtatcaatatggctgatgccaggaatattttgttgctttaaatattgatccagtgaccagcgccgctgccggttggtcgaaatgctagcgacatcccgaacaacgacccccttaacggtcggtaaaattgattcgtagctatcgtggttgatcccatagctcccaatggttggctgcgtaaaagcaacgatttggttatgataaatttgattagtaataatttcttgatagcccgtcatactcgtgttgacgacgatttctccggtagaaaccgctggcgagccaaagccttcacctaaataggcgctgccatcttcaagaatcaaatagcgatctgccattgcgatcccttctcatctgtttgactttgtcgtactagttaataatttcaataccatcgtgaccgtcgatttcattgaccgtcactttgatgcgttcttgacgcgcggtgggaatgttgcgaccaataaaatcagcgcgaatcggcaattcgcggtgaccacgatcgactagcaccgccaaggcaatgctctggggccgaccgccacccattaatgcgtctaaagccgcgcgaattgttcggccggtaaatagaacatcatcgactaaaatgacccgcttatccgccaccgaaaacgttaactgatagtccgttgaaagccgtgcttgatccagcggctgatcatcacgaaatgccgtgatgtctaactcgccaactggaatcgcagtaccttcaagctgttgtaattgggctgcaatccgctgcgcaatatagacgccgcgggttttaacgcccactaagacgacatttttaatgcctttgttctgttcgataatttcataggtgatccgggtcaatgcccgtttcatcgccattgaatcaacaacttttttttgcataattgcctcccaatttgtggttatcgcttttttgagcaacccgtacgacaaagaaagacggccggacaaggtgtcacggccgtcgacgaaaagttattgttaacggtttgcctttcagtctcgcagggccggattaaaggacgctcattactgttagattaatgattcccatcggttttgtcaagcttagccaaggttgtcgtaaagattggtggtagtggtgcttcaaaggtcaataagtcacccgttacggggtgcttgaatcccaataatttggcgtgtaaaaattgaccgtgccccttaatcgtctttttggggccgtacaggggatcgcccaccagcggatgtccaatagattgtaaatgaacgcggatttgatgcgtacggccagtctccagccggcaactaatcaaagtatagtgctgataacgtttcagtactttaaaatgggtgactgctggtcgcccggtcttaacgatggcttgctttttgcgatccttcggtgaccgaccgagtggcgcattaattgtccccgtatcctctttaatcactccgtgaacgagtgcgacgtattctcgtaagttagttttcgccttcagctgagccgctaacgattggtgagcccggtcattctttgcgaccatcaataatccggacgtatctttatcgatgcgatgaacgattcctggccgaaattcaccgttgatcgtcgacaacggactatgatacagcaaggcattcaccaaggtatggttagggtgcccaggggctggatgcacgaccatcccctgaggtttattgacaaccaagacgtcatcgtcttcataaacaatgtctaatggaatgttttctggctcaatcgttgtttgttgaaccgtctgtgcggcaacgacaatttcgtcacctggtttgacgtgatacttgctcgcctcgagctgaccattgaccgtcacctgatccgttttgatcagcttatcaacttgcgaccgcgtccagaccgactgtagtgccgctaacactttatccaagcgccctgtttggtcagtaatcgtgaattgttgttccgtggtcgctcctgccacgttatcagctccctgtaacttatttttcaaaactatcatcccgcagcacgccgatcaagataaaaatgacgcccacggttaaacatgaatccgcaaaattaaaaattggaaaattaataaaatcaagttggaacatatcgacgacgtacccaatacgtaaccggtcaatgaaattccccaaagttcccgcaatcatcagtgaaataccaacctcatatagccatttgccacgtaagcgccacagcaagtagcccatcacgatcaaggcaatcactgaaatcaagtagaagaaccacatcttgccttctaagatactccaagcagccccgttattatgtaaatttgtgagtgataataacccggtaacaatactcgtactggcacccaacgcaatatgactcacaatcgctgctttgataacttggtcaataatgaccagcgctaccattaaaattaaatagatccacatattctgtcctcacatttcgctaagctgtgtttaattataccaaaagacgtcgtccttgtacgaaactccggcaggaaaagcgcggtttttattgcagacttaataactaagcacctttcgagtattcccccaaaagcatcggcatctggttaaccaccccccagttgaagcaacgagcctgatgattggttgcaccgctcaactgctaagcgagttagtcatcatcggtagctcacaaattaaacgtgtgtgattgattcgctgtcgcagtcttccaaaaacagcgcaaataaaaagccgacccccactggcatcgacttatcggtcaagctttagaacaaacctgagatttttccatcatcactaatgtccatatcgagtgcggccggatgttttggcagtcctggcatcgtcaacacgttcccggtcaaagcgacaatgaaacccgcacctaacttcggcacaaattcacgaacattaattgtaaatccggttggtgctccgagacgtttgggatcatcgctcaatgagtattgcgtcttcgccatgcagactggcaaatgatcccacccttgcttagcaaacgttctcaattggcgctgagctttcgctgaatattcgacattggctccaccatacgtcttagtgacaatatcgttgattttcgtcttaagatccgcatccgctggtgataacggttgaaaatgacttggctgagcacataaatcaaccactgcggcagctaagtcggttgccccgtcacccccacgaccccagacatcagccaagactgcatcgactccaagatcggcacaatagtctttgacggcatggatttcggcgtcagtatcggccgtaaattcgttgatggccaccacgactggcaccccataacgttgcatggcatggatatgatgtcctaaattagccgcaccggctttcaaggccgccacattttcggttgccaaatcttgcaaagccacgccaccatgtaactttaaagcccgaatcgtcgccacgattaccacggcattgggcgcttgtccgaccgctggcacgttaatatccatgaatttctgaccacccaaatcagcaccgaagcccgcctcggttaccgtatagtcggctagattcaatccagcttgcgtggcaagtacactgttacaaccatgcgcgatattggcgaacggaccaccatgaactagtgctggggtatgcgccagggtttgaactaaatttggacgtaacgcgtctttcaaaagtaacgtgatcgcgccaccgacgttcaaatcagcaactgtcactggttgacggtcatgtgtgtagccaattacaattcgattaacacgttgtttcaagtccgcaatattttctgaaagacagagaatggccatcagttcactcgcgacggtaatgtcaaacccatcttcacgaggtacacccgacgttgcaccaccaaggccaatcaccgtatgccggagcgcccgatcattaatatccaacgcgcgcttccattgaattcgacgctgatcgatacccaactggttaccttgttgaatatggttgtcaattaaggccgcgagcgtgttgttcgcagccgtcagggcatgcatgtcgccggtgaagtgcaaattgatatcttccattggaatcacttgtgagtacccgccaccagtggcgccacccttcatccccataactggtcctaatgaaggttcccgcaatgcaatcatcgttgacttaccaatcttagtcaacgcgtcacctaacccaatagtcacggttgactttccctcaccagcaggcgtcgggttaatcgacgttactaaaataaggttgcgttgagttttcttaaccggtaacggtaatttgagtttagccttcgtgctcccatattggtcgatctggtcaaccgtcaagcccgctttagccgcaatcgccgtaatcggttctggtgtcacttgctgtgcaatttcaatatccttcatcaattctccgcccttctgtttttacttactccattataacaatcttcctgaaattatgaacattatttgtatattgattgtttttattcgtatctatcgactagttgctaggtcaatcaactgattgcgcgcctttttcaacatcaaaaaccgatattgattaccatcgatttgaactttcaacccaccgcgtatcgggacgatcaattcgagttgatcacggggaatcacaagccaagaatggttcaagaccgtgctaaaaataatgaggttatgattgattgttacgcgccgcaagctgatttgaatcgcgaccaaggcaataaagagcgccgcaatgacgagtaaccaccacttaaacttcaagatttctagccacaaaataatccccgccatcaatactagtgccgtccacgaccagacgatcacacttgacgctagcattggttggtatttaaaggtatgcttatcgttattcacagtacaaaattcctttcacattggagtgagtttgatgcaattatatacggatgccgcgaccacacccgataatcagcgcagtgccgcgggaatcttaattattgatcagggccaacaacaccaattcaaacaggtcttgccagacagtgataatcataccgcagaatttcttgccgccattgctggctttaaaactttattagattcttatggtccgcaagtcagcgtctttttctatacggatagtcaaatcgtcgccgaaagtgtcgccaagggttacagcaaaactttcagtgtcgagctggcgactttgctgcacctgcaagaccagtgccaattagtaatcacccagtggattgccgaaagtgataaccatggcgcccatcaattagcacaacaaggcttacatcttagtgactaatcagccggggccaaataagtttcaattggtcgttgatactggtcccagttatgagcaccagtttgaacataatcggctaacaacttaccaatcatgggtcctgttgttaaaccagatgaacctaacccgctagctaccaaaatatgtgggttatccggaattggaccgaagaacggcgcaaagtcacgcgtgtaggcacgcgtacccacttttacctgcgtaatttgatccttagtcaggttggcatcaagtttgagcccgctagcaaagagatcatcttcaaccagacttgaaacctgcaaatcgtagccctgatcattttcgtgcgtcgccccgacgaccaatttgctgcgcgtaaagggaataaagtctcgttcaccttcaggcatgagcactggaacatcgtcagcccaagtctcaggcagctgcatttcaatcaactgccctttttgtggccgaacatcagcaacaatcttcattggcaacaataacggctttagccacgccccgactgctaaaatcaacgtgtcatagctttgctgaccattaaccgtcaatagttggccctggtcacctaaacgtaccttacctttatgacggaccaggttccgcttttcagcgtatttcagtaaattatgtgcaaacttatcgccatcgacccgcgcaccaccactcacaaacacaccgggttggggcgccgttagcagtgggatccgttcttggacttcttcagcagttaatttctcaatcgttcccatctggggtgccgcttgccggcgctttagagctaaatcgtatagcgcctgcagatcatctggatcggcacgagtcacaatcgttcctgcttgttgataaacagaatagcccatttgcgtgtccgcaacaatttccggatacaaagcagccccggccttagcgagttgataccaacgctgattacgacgtttggataaccaaggtgaaataatccctgctgaattcttagtcgcttgaccaataccttcatcataaatcgtgacgttcaggtcagggttctggcttaaatagtacgccgtgaccgccccaacaatgccactaccaataatcgttacttgtttttgcattttccaacgcctccacaaccaatctgctttcattttagcatactcgaatttgttgcgggtggctgattcagttggattaaagtcagaccattggtagatgttgctggtactagctttgcagcgattaatttaataccgtggactggctctttgccccctatgactgggacagagcaatcaatagttgttgccggacaaaattttcgttcgtccagtgtaaataatgctgacctggtgcatgaactaggtgaccaagctggcaccacggtgattgttggtacgccgtcaagcgttggtcagtgactaaaacttggattggcagcgtcagtacccgcttttcagcggttcgaagcgtcgttactaattgtggtaagcattgcgcttcagtcagaatactcgggttcgcgtaagctgctaaatcaatacgggcattggcaacacgttctgccagtaggtttaaaggattaacttctgctaagagttgctgaagtgtcaaagtttgtcgctgttgtactagttgcggatagttttcaataaaagattggacgtttgcaagaagttgtggtgccatcgcggcatagggtggttcaagcaaaactaagccacaaacattatctaagtgctgctgggcatataagaatgcgtaactagcgcctaaactgtggcccaccaataataagttgctcacgtgttcatggtgaaccacatcctcaagattggctaaaatatgcaggacagtgcgcaccatttgactatgaatgctacggcccacgccaatcgtgtcgatggcaagtaatcccacctgacttggcaatcgtgccattaaatgcttaaaattataatcagtggcgtcccagccaaacgccggtaagcacatcaacgtcggctgttgtggtcccgccggtcggtactgatagtacacttgtcccaattccgtcattaattgattcatgattacttgcctcccacaatgacagacatcgtaagtagttccaaatgcttttttattacagataaaacacagctttacaatcagtcatgcatagtctagtccacaactgatcagtagaaaatggtttttaaccgcttcgttaaatcaactgaccattaaaaaagttacaagatttaaataatcgtcacattttgaccatattttcgttttacacttattaatatgcacgactatattgttttaaaggacttttgccatgttagttattgtttggattcttttagttttattgttaggactcatgggttggttggaataccacaatcttcagcatccggtcatccagccagctaaaaccctggcgccgcgcgcacagctccaattgcaacatcaagtgcggcaacacgtgaccgatcaagcaccacgattgaaatggttatattatggaatggcagcttgctggtggctcggtgttatcagtttactagtcagttgctacttggtcagcgcaaaattaaccctgttgatttttccgattcggagtgttgtcacaagcatcgccttaatgatcgttggcattatcttgctaatgattcccgccttagtgtggccgacgcaaagttatgattacttgattggtcactcaactcaagaccatcattggcagctagccgataccgccacgtttgaacactatcgtcgctttcagatttggttggttttggcattagacgtcttcatcctgattggttggattagttgggcctaccgggtcagcaccgttcccatggtcactattgagtacctactaatggtggtggcaatcgccgtaccagttgtggcattgatcacgctgttagcacaactgccatacttacatcaaaaccgatacttgattccggtcagcgggcgctttggcacccagcattatcatgcgaatcaggcactcatgcaacaacaaccggacttaaagtcacggctaattatcgttaatgttgttcggattattggttacgcgttggggttgtatgctttatggttgttatatgccaacattcttgcaccggcctttacggtcgataccagtatcgtttaccccgcagcggcgtttgccatcatcggattgttaatcgtgttaacagcgggcggtgtgtggcttccccgtttctatgattacttgcaattattagataacaagaccttgacgttcaaattggccggtagcgaccgcttccgtcgttttcgttttcatttgtattacttcaagttggcattcagtattttatggatcgttatctgggcattgatcatcggttatatttattactttggctaggtacgctcaccaataatacgcaaaacggtactcaaactaatctgagtaccgttttttagtgtcattttatgagacttgccagcgaggccaacttgagcgccaaaggactcaaaataagtgtcgccattgcggcgcaagagccattactgttatattactgcgttttgaagagcgcaacaaagtcagcttgcgcgctcgcagcttcaaacgttcgcttggacagtgtcgtcacctgccgatcattgagccacagcacttggtaatctgtaaaagcatgaaggtcgcgaacgtcatgtgtaatcatcaagtaggttcgctcaggatgggcttgcatgacctgaaacaacaactgcacgttttcccgatcgaccgctgctgttggttcatccaaaacaatcaattcgcgatcaacttgtaagaacagcaataactgaactaatttgcgttggcccccagaaagctgaccataatgctgatcccacaacggggccaagaattgataagcttgggtatcaataagttgttggagctgttcagttgtcaatcgtagtcgtccgtgctcgatgcccaaaaccagttgggcaacgtcccgcacacgaattgaagacagtaacgggagttgttggttcaaataaatggctgctttaggtaggtctaattcaccttgtgccggccgcaaaccagtgatgatatcagccagcgtcgtttttccagcgccattttgaccaatcaaaaaattgacaccgggactttttaattgaaaactcacgtccttgaagaacggttgcccatttcttgaaaagtaatatgctaagtgctcaacacgcatcattataagccctccgttggcagaatcttaatgtgccgatagctaaatccgccgataaccaataatacaatcagactcagaagataagtcgtcataaagtggctgacggggcccacgctgatcatcgcaaaaacattggtaactaagtaaatgggactaaccaggttgagtaatgggttattggcagacactgccagcatgttactcaacataaaggtacctacgacgacgatcagcgccagtgcatttccaatcatatcgacagttttacgtcggagtgccaaggcaatcaagggtaagccaaaacaagtgactggtagatacgtaagcaacacagtcaaccataagcgacctagcaacgataaaaaggccaacttgaaagtaatcgcgctcaacagggccaccaacaataaagtcatcaaaattatacccaagctgaccagcgcttgactgacaagaaaaactgcagggctaaccaccaaggttcgatattgtttgagataaccctgctcgcgaagaatggctacattgctggcagtcgttagacaattggaaaaaatcatccaaccaatgtagggcacgacttgagccgtataagttgtcagcgataaaggtttaaagaaagcgctactgacattcatgattaaaaagacaagtggcaaacagatcgtgtaaattaacaccccgggagtatcccgaatgaccttaaaaaaatactgcgtgtagacccccacttgaacactatatttgtgcatcaccatcacaccccttttgttaatctaattgttttattatatgtttatcatttatcaaaaagcaagtattcttataccaggcatgtaagtatggccaatttacaaagtttttgagcttgctaaacgtctttaattgcaaaaggtagtctaaaaatgactaaacgtcaccgttcgagcctgcgcatcaatccggacatccgcccccaatggcgtactgagcatggggactgtatggcagctatcgtagtcgtaaataattggtaattggcgatcccccagcacctcctgtaagatatcgattggcaaccgcccgctgccttgatcatcgtacaacgcgtgttttcccaaaataatgccagagatttgatcaaaaacaccagccaacgctaacattacgaaatttttttccagcgttgctgcagttttctcggcatcttcaataaataaaagctcgttaccagttaattttggaaaataaggtgagttaaagaagccgtacatggtgttcaagttcccaccgatcaaacggccagccaaaacgggggtcgccgtataatgccaagtatttgcgtgcatgtgtttcggatgttcaaaggtctcccaattgatcgcttcatccgtccactgtgccggtgccggttcggttacggcctgccccggtgctgcgcggtagactgtcagaaaattttgccaagtagttgtcacgatctctgactctaaggcgccaagtgaggctactaaggccggtccgtaaatcacacgacagttaggcgcgtgcgtttgcaccgccaataacacggccgtcgcatcggagtaaccaacaattgttttgggatgctgattgagatactcgtaatcgagcattgctagaaccgaatttgcgtttgtcccaccaatcgttgccatcaagatgtccagcgaatcatcatgaattaacgcgttgatttcggccgcccgttctttgatggaaccagcacggtaactatcccgtcgtcccgtcaaattaccggcaactaaggtcactccttgggttgccaagaaccgtcgtgcgcgagcataacggtttggcgataatgccgtaatcggcgttgatgcagaaaatgtcccaattttcattgtattcccaccccacaagattaaaatataattaaaataagtgtagcactttttaatcttaacgtacttccaatcgacgtatttcctcaaaaaaacgactttcagctaataacttgctgaaagtcgtttagtaatcaactggctatgctcgttttgagcgacttaattgacttattgtgtgaccacgtttgagcggttggctgaaacgtaattccctttattcgttaaataatagcgtgagccacccgaccgtgagtaaaccttcgttactttaattcgatcaccagcggcgtggtaagcgtgtcgattagacttaacaaagtttgaagatttataggtgtagagtcccactttagccttgatccagccactggaaggtactgattcatagtaccaatgatcagatttggagaccttcgccgtgatataaccaccactcaccttaattcgatagaaattcccacttttaaccaatttaccactgtagatgccaccctttttcaaggttttacccgtcgaggttgtcaaattaacatctttgaacaaagtgctcttttcacgaagttgatataatccgtgttggccgacccaatagccggtgacgtcctgtgataagacccatttattcagaccacttaagtaaaccagctgtttggaacgactcttagtgactgacttggttgctgtgaccttgtagtattttttcttagcgctactgggcacttttgtgccgtcataatagctcgacgccccattattgaggtacacatgttgccctttcgtataactgctgtaggcatacgtcgtgctagttgaactggtcgacgatgatgtcgaagtcccggaagtccaccagcttaacgggtggtatgtcgtcacggaagcactgtcatacaaactgttatcaacatattgtcctagcgaagataaataatagctactggaatattgccacaatgagaacgaaatcgtcggcttcgaggagtaatttgcaatccactgggcatcaaaactttgccgtgccgtgttggcgtatgtggttgcaaatgactggtacgaataaaaaatcaacttcttgctcgttaacgaccgcatctcagtataccaagccttgacagccgcgttggccgccgtgctactcatggaagtcgtttcaaaatccaagacgtagaacttcgtgttcttatttgcgcgttgatagaacttatctgcctcggctttggcagtcgcggtactcgtaaaggtcgcatagtcataggacccgaacggaacaccatatttcacatagagactctcattagaggtgtggtagagatcctcataactgctcccatattgcacccggttgatgacaaaatcagcctgactcttcaaactttgaacctcggtactcgttaactgaccttgccactctgagatatccggcaccgccgcgtgtgcctgaacgactccggtaccacctaaaaaacaacccacgagcagcagtatcaaccgccactttttctgcatgaccaaattactcgccttcccatcattagtttgatatgtacgtttactgcacaccttatcctaccgataaaatgtgcagataagttctcaaactgattgcagtcgctttacaatttgtttacattataaactaatgcaggaaagtgtgatttactagtaaaatgattcatgtggaaacttttctaatcgatataggccttcatcatccgggtagattcctccaggcttaggtcgatacccgaagtgttggtaaaataagtgcgcagtcacggacgctggaatttctacacggtgggcatgactgaaatagacatcctgttcaagggtatgcagaatttgacgcccaccacccatgccttgaacctccggatcaacaaaaatcgtgaacagactgtactcacctgggcgcccccagtatgacccaatcgccccggtcgcaacgagttgctgctgaaaataaccgacataaaagtgcgtcgcagcagctttttggcatagccaagccggtgtcatctgggtaatgagccgatccaagtatgctttgggatagtcaccctgattactcgtcagtaatgtgcgcgcaatcagtgccgccgctgctggcgcatccgtagttttaaaacgtcgaatttgtaattgcatatgacaactcctctcgtattgcactattctttgctcgttgcaatgaacaacgaatacctttttgatcgtctgccgataccaatttaacaataaccacttaagcttccacaaaccaaggttctaaaatttttaacgtagcttgctcaaaatcgatacacacttgcgccccatatggaagtgccgttcgcggaaaagcgtgaccaaaattaatattgtacagaattggcaatttcaaatcggctgtctcatcgatcaaaatttggcggtattcctgataataatgctcattctgcggcttacctacaatcacggcggctacgtttgtcaaaatctcagcttgtcgcattcgttgcagcatccgcttgaacaaatctggctgcggctgttcgtcactcgtttcgataaacagaatttttccgcgccattcggctgcacatggaatcagtctgaactgttccgcaacttgccgttcgtctggataacgggtcgtggtcaataaatcataaaagctgtccagacaaccaccaagtagcgtcccactgattgtcccgtgaccacgtaacacttcgtaatggtgcatttcggtgtgggtcatgcgccgtgttccctgcgccgattcactgaaatttgttcgttcgtcataccacacaggactgctaataatgcttgtctgctgaggattttcaaagtaacgctgccaagtcttcgtggtatacggcaacatcgtcggccctaattcggccaagtcgcttaagaaattggggccataaaaagtttgcagtccaagctgataaaacatcaaatgattgatcgtcgtatctgaaaagcctgtaaacagtttaggcgaccgccgaaccgccgtcttaaactgctcatcagccatcaaaaatggcacggttcgatacgtatcatcaccgccaattgccgccacaactccacggatacttgggtctaagaaagccgtcttcaaatcggcggctcttaattcagggcgttgctgtaaaatcagtcgccctttcaaagcattcggcatcatgactgggacgagccctagttggcgcatccgttttagcccccgattcaattgatgttgctgcgtgagttctccgagcgtgccgctcgaaagactgacgacagccacgtgatcaccaacgtgcaatggtgctggttttaacatattctcaccctttcctaatttaatttaaaattaattttatcatcattatataatattttaaattgttatttggtttttattcattttcaatgtaaccaacgactaaataggtcactgagtccgctgctctgcatgactcagtgacccgtcgccctattgtagccaatcttttatgtcaaccaagcgaatcttatgcgtacccgctgaccatcgttctggctgtgccttaaccattgtcagcaactctgttagtgactcggaaccaacaatcaactgttgcagtaattcagaaatcagtggggaacgtggttgcgcaccaactaataaacaatgttcaccttcaaaggctaacacgtcacctcccgcccgtaaacggccaaacgggcggtgcaacttgacggtacccaaaatcagcaagccaccttgttcaaataacgttttcaacaaccaataatcgagtttaaagtggttagaccgttgtcgtaaatcggccggcaatgctttagctaccggtataatcgttttgaaattccgactatactgatgccacgattgagcccagtcctcacgctcacagataaatcgccggggtaatgtcaattgacctgcataatcacaaacttttttaatagccggatcactcattattgacggactggcttcaaaaataggacgcaattgtcgtatcagttcaataaactccgctagataatcggcaaagcctggcgttgctaaattaatcaaaattcgcttagcgacgcaataagtcaccgcaagtcaccgcatcctgatacgtcaccttggcgtgctcaatggcatcttgataggctgtcataatatcaaacagtcgtgggttggtataatctaaagttgtcgaaccagcatgtttataataattataaaatggttgttgcacataggcgactcgctcacagtaactcaacatgtccagcaaaatatctaaatcctcgtagaccatccgctggtaacgatatttctgccaacacgaacgtgcatataatttatttccggaataagcattatttagaccgtatttaagataagtcgcaattgccacgtgctcagtcgcatctggcaagctcagcagactagttgtgcggtgagtcgccgcgtagattttacgaacatcacaaacgacgatttgggcatgactacgctcagccgttgctactaaggtcgcatacatcgtcggttcgacccaatcatcagcatcgacaaaacctaaatagcggccatgcgcggcggtaatccccgcattacgtgcaggtccctgtccttggttacgttgatggataacccgaaataggtgcggccagcgcgcacaatattggtcacaaattgtagccgtgccgtccgtactaccatcatcaacaataatgacttctaaggccgctaatgtctgtttttttaatgaggtcaaacaacgccttaaccagtgctcctcattatacgcagccacaataacagaaacttgaacttgcatactgattcccccaacactccaaatgatttcgcttacattatgacacacatgcttcgcatatcacagcacggatccatgatagggataatcatgcgcagtcgtggtctgatactctcgtaaatcgtcgatacgttctgctaaattaaaatgaactgctgaaagcccatcaaactgagtcatccggtcagtaacagcggtgaaggaccactgggcaaagatcatgttgtcagttgctgaccacaaccgctgaatcgaccacgccgttacccgttgaactcttaattgatgttcaatccaggcttgaacttccgctaatgatagatatgctggtccatagcattcttgataataacaatcgaccgcaaatattcttggtaacgcttcaaaatcacgagtgacccacatcgcaaaatattgctggacttttgcttttcggtcccgaagtagtgccgtttcgatttcggtcatttataacaccttccgttttaagattactttttagaggccgtaattctagttaataaacaggcgattaccattattttaacatcactaacaattaacaagaccaaatattgactaaacaagtctatcagttgtattcagcagtcatttctggcacagttaacttaatcataatattaataaagtgagccgataaatatgatcaaagttactaaccgacactttcaagatgtgcctgcgctggaagttgttactacaacccatttagaccaaccgctgccactagtgattttttaccacggttggcagtccaataaagaactcgtcttgacccaagcacgtaaactggctcgcaagaatttacgagtcgtcttgcccgatgccatgaatcacggtgaacgacaccaaatcgttagccagattccttcatttactttttggaacagtatccaaggtaatcttggcgaattcgagctaattgtgaattactaccgggagcgcaaactcattttgaatgagcagattggtgttggcggttactcaatgggtggcatgacgaccggggctttattgacccatcatcctgaaattaaagcagccacaatcattatggggacccctaacctgaacgcgtacgcccaactagtccgcaagcatgcgcaggcccatgcttattacattcccagtgatttagccctattgacgagttggctagatcactatgatcttaacctgcaaccggaaaccatcaatcatcggccacttttattttggcatggtactgaggatgaacggattccttattcacagtctcgtaatttctttgaccgcgtgcataccgccccgtatgctgaacaagtggcatttatcacgggttatcaagccaaacatctggtcaaagtgcctctgatgaacaaagttgctaatttcttcgattattatttaaattaattatcaaaggctcaaccatggttaacgttagccttaaaagagcgtgcttagtcggtcacccgattaaacacgctcttttaaggctactcaaactatctgtcacacattgtaatgatcgttattgtcagctacaagttctttgaatttcttatttgccaagcacaaccggcgcctatagctgaaatcaatgctgtactaaacatgactgtttgaaagccaattgcattcatcgcgggtacccgactacccactgtaaacaccaccacagcaattgccgtgccagccgcacctccaagtaaccgaaaaacgttgtaaattccggctgccttaccgataactgccggtgacactccccccaaaactgcatgctgtaacgcggggcccgccattgacaatcccatcccagcaattgccagcggagcaatcatcataacataagccgcatggttggcaactagataaccaagcatgaaatacccaaatgtttgagataatagcccgataactgccacaatcgcttccccgtagaggtccacagctttgccagcaaatggcgcaactaatactagtgtcccagtccaaggtaataaggacaatcctgcctcccacgcattatcatgctgaacaacttgtaagaattggggtaaaaagaaaacgactccgtacatcgcggcatataataaaaaagtcgccacattttccatcgtaaaaatacgctttttaaaaagcgttaacggcattaacggtgcaacgacatgttgctgtcgcttgataaaccaagtgcctgcaactaagccaattatcaggccaacgaacggaccaattccattaatactagtcgaactggcagctaaggcccaaatgattgcggtcatcgctaacattgaaagacctgcgtccgttaaattaattggtgttgctaccccggtactttctggtaaatagaaccgggataatcctatgacaatcaggccaagtggcacattgatccaaaaaatccactgccaggttaatttagctacaattagaccacccagagccggcccgacaatcagtgccagtccaccgataccgctccagattcctaaagctttcccacgcttcgcaactggaactgcagccgttaaaatagccattgacatcggtgtcatgacggaggccccaatacctgcaatgacacgtgccactatcaataatggcattcgattggctaatgcacaaaacactgaacccagcgtaaaaactaaaatgccgagattataaacccggcggcgtccaaagcgatcacctaatgcaacgcccacaagtaacgttgctgcaatcgcgacattgtaagcgttgagggcccactgtaaactggcctccgagatgtcgaaatcaattttaattgctgttgacgccgttgtcacaatcattgagtccatcattgccataaaaaagcctaatgaagttaacgctaataaccagccaaactgtcgctgtcgattttccatgttttccgccccattatcatttattcagacttaccaatgctgaataagcctactcacaaagtttaaatctactatgtcaatctttttcttagatttagttgggtggccacctacaatagttcaaatatttttgaactattacagcgtaccatcccactaacgattcggcaacaaaaaaataccagttcaaaagaccaatcggcacttaagaactggtattagtcagaatcacagttgaagaccgcccaaaatactcagcaatttaaaggctttgataaaaatgggtaacatagtgatcaaaagttttggggttcaacatgacgtatttttcacgtgcaacttttttgacggttattaatcctgctttttccagcaatttaaaatgatatgaaccagcggttttactaatccccattgcttgtccgacttgcccacaagtaacggcctgatcctgcagcttcaaatacttaacaatgttcagtctaaccacgtcagccagcactttaaatactaatagctgctgggaatcaacttcagaccgcggtatttcatttgccaatatttttcacctacttttaccaacaaaggtcgcttgcttattccgtccgtgctggccgaattcgtttgccccaatattggaaataatctgtccgtaacgcaccgttatagagtttccggcgtttcgtggctttttgtccatagaagtcttcaaattctaagtcactggtcaagatatacttgctccaacttggcaatttactgtaaacttggcccatttgccgatagagaatccggacactatctcgatcgcttagccgctccccatatggtgggttcgcaattaggaccccgttgatcttgtcagtcgtaaagtctttgacagccagttgtttgaaatgaatgtcatgcaacagcccggcttcccgcgcattcagcttggcgatatcaatcattttaccgtcaatatcatacccactaatatccagctcagtgtcgtaatcggctaaactatcagcttcgtctctcaattgttgactcaggccagcgggaacccagtcccacttttcgcacgcaaatgcgcggttgaaccccggggcaatgttgcgcgccagtaaagcggcttcgattggaatcgtccccgaaccacaaactggatcaacaaatggattatccggataccacttagctagcatcactaaggcagcggccatgttttcttttaagggtgcgccccccttttcgactcggtaaccccgtttgaataaactagagccagttgtatccagcgttaacaacacgtgatccttattaatagccacttctaatgggaacaaagcgcctgtctccggaaggtgcccgctccgatgataagtatcggctaactgattaacgatcgcctttttgacgatagactgcacgtcgggaacactgtggagtttagagttgcgcgatttaccttcaactggaaattcagcgtccatcggcaataactggtcccatggcaatgcgagagtcttttcaaacaactcatcgaacgtataagcatcaaattcaccaacgatgatcttgattcgatcagccgttcgtaaccacaagttggtccgcaaaatatctttgatcgttccgttaaatcgaacccggccattttcagtttgaacttgataccctaaatctcgtaattcacgccccactaatgcttcaattccgctagcggcggtggcaattaatctaaattcttgcatagtttcctcctgcgacgcctgttctgtaggcgtatcttgttgagtaaatatttccactaaattggtttcctcacctagtttagcataagttgctagtttgctaactgatcgaataaaaaaactgggacaaaagcgaacttttgtcccagtctcctgtctaaatgtaaattcctgtaggccatgttttgtacctagttaaagtacagggtctgttaactaggcggtaatcatctatctcgagattactaatctccccccacatttagttcagttccttatgtgaagcgcccctaccgtagtttgggttgcccgctcgtggggtttaccgcgttccaactcaaccgtttccaattgagtatcgtcactgtggcacttttcaggaatactcgggcatagccgaagccttagccgttttttccgccgttaccgataaatcggtaccccggcttattttttcaccgagcacgaacactacaagcatcgcagcttgtgcgagcatggaccttcctcagccgacataagccgaccgcgattacccagaatttacatcgaatcacaattatagacggtgtgattcattttgattattatctaattgggcaccaaagacatgacgttccaagttagacaaacgtttcagaatatccatattcgtcaccgtactagtcggttgagaagatggactggttgcaccgacagcgacttgcttggtaagctcgtcaaccttggcccgtaaccgttcattttcatctgaaagttgttggttatctttagtaaatgactcatagtccttaatgacattatctaagaagccgtccacgtcggcaggatcataaccccgcatctttggcttaaactctttttgaaggatgtctttgggagtaaaattacgtttagccatatttaaaaacacctcattgttattcgcgcgatacccattcggcatccgcattacttaaaacattgtagcagactttattcaaaattaaaaccattattctgtttttctgcatattcattggcactttcctgtaaccagtcgaagtcgatcagggtcaatgggtacggatgagtgtcactaaagttccgaatcaaatcatagtcatacgtgggtttcccggggttatctggatcatataccagagtggccgcatccgtatgggtaaccataaattcttggtaattttttaattgttgcggattttcatacggttgtttactgactggtgcatgaaaatcgacttgggccagcaaagtctgtaatttagcttggttattttcattccagcgcccaccaaattcaccatatggtaacatcattgccactttcaattctggatatgtctttttgagcgttaaccctacttccgctgtccactgttcaataccgagctgaccacccgttatcagccaatccataccatcctcgatctgcgtcgttaagtaattagttaacgcaaacttaataacttttagtttatcatcctgatcaccaaagacattcaactcgtaactccggtaaccactaagccacaaccggctcataaaaaagtctcctttctgtcactaaatcggtctaaatcagttaaaaactcacagatatttcacattccctattagttaatggtaaaatgtaacattattaggaggttgattaatgtgacgattcgctatccaaacggtcaagtttatcgccaacccggcccaactaaatcgaaatcttccaaatttgccaacgtcaattttggcgatcgtggaatgagcttggaacaagaaatcaatgatagtaacgcctattatcttgaaaataatatcgcagttattcataaaaagccaacgcccattcaaatcgttaaagtcgattatcccaaacgcagcgccgctgtaatccgcgaagcttattttaaacaggcttctactactgattataacggtgtctatcgggggaagtatttagattttgaggccaaggagaccaagaacaaaacggcttttccgctaaaaaactttcatgagcatcaaattaagcacatgcgccagtgcttagctcaaagcggaatctgttttgttatcattcggtttgcgagtttggggcgcctatttttgttaacagccagcgacttatttacttattgggatcatcaaggagatggtggtcgcaagtcaattccactgacggatattgaacatttagccgcggagctacattatcaaatcaatccacgcattccctatttggatgcgcttgatcatattattgatgagacctcatcaattcattaaaggagaacatcatggcaggtaacaatgaacagaactcacgggttgctcgcagaaaaagccaacctaaaccacctaagaaacactggtttcggcggattattttatccttagctgcactgtttgtcatcggggtactcgctggtctagcacttttcttctactatgcgcagacggcaccaacagtcaaacagagtgaccttgtcaatacggggaccgctaagatttatgaccagaacgacaagtatttgacctctttgggaactaacgaccacgaatacgttaagtctagtaatatcccatccacacttaagaatgccgtcgtctcaatcgaagatcgccgtttttacaagcataagggggtcgattattaccggattcttggggctgcagtcggcaacttaaaaggtagctcacttgggatgcaaggtgggagtaccttgaccatgcaactcgttaaacttgcggtcttttccaccagtacttcggatcgaaatttgaaagtcaaagcgcaggaagcctggattgcgcttaatcttgaaaaacattacagtaaatctcagattctggaattttacatcaataaggtctatatgggtaacgggatttatggtatggggactgccgccaagtattattacggtaagtcattaaaagatctgagccttagtcaactcgcactgctcgcaggtatgccgcaatcaccaacctactacgacccgacgacttatccatcatacgcaactagccgccgtaatctggtgctggaagcgatgtacgataacaaggtcatctccaagagtcaggaaactgctgctgaaaaagtcagtgtcaagacgggcttaactagttcgggacgttcaagcctagcgaagcatgaaaagacaaataaaatcttggatgcttacctgaacgaagtccgtcaagacctcctcaaaaaaggttataatttaaccgatggcgagaaagtttatacgaacattgacatggatgcccagaaacggctttatgacattgccaacacgtctcaatacgtcaactatcctaataatggaaaacagactttccaattaggggtatcggttgttgactcatacactggcaaggtctcagctatgattggtggtcggaaaaccggtaatgtcacgtacggaaccaaccgagctgtctggacatcacgctcaaacgcttcgacgatgaaaccgattctcgattatggaccagccattgaatatttgaattggccaacttacaagtcgttgtctgatacgaaatacaaatatcccgggactaacatttccgtgcatgactttgacaataattacttgggcaatatgacgatgcgtgaagcactggttcaatcacggaacatcccagcaattcgggccttacaagccgttggtaaaagccgagccaaaacctttgccaataaccttgggatgaacctcaaaaccgttaactatgccaacgggatcggtgctggtgtttccaccttacaagttgccggtgcctacgctgcgttcgccaacggtggtgtttatcataagccatactacatccgtaaagtgactacttctgatggcgttacgacatcgtatactagcactggtaagcgcgccatgaagaaatcaacggcatacatgattactgatatgctgaaaggggtcatcaatagttctactgggacggcgacaaccgctaagatcagcggcgtttaccaagctggtaagactggtactgacaactatgcttctcagtataaaaacaaagtaccatccgatgccgtcgttgactcatggatggccggttacacgaagaattattcggtcgccgtttggactggctatgataagtccaccgaagctggtggttatctagatacctccaacgaaaagatttcacaacaaatttatcgcgccatgatgaattaccttcaacagtattcaccaaactctgattggaccaaaccaagctcagttggcacgactaagaagaacggtatcgaagaactttacgttgttggtcacctcttctccagtagtgaagcctcgtcaggaaccgctagttcagctagctctagttcaacaacaacgggtagttcaagcaccagcacagaagcaagtagtcgtagttcggaaagtagcagtagtagttccgaagctgcttcttcctcaagtagcgccgaaagttcatcttctgaatctagttcagaaagtagcagtagttcggaagccagttcaagctccgaagcaagttccgaagcgacttcatcggaaacaccgaccgctgataccaataacacgactgaaggacaataagaatcacccaagaccactgaattcgattcagtggtctttttttatgtgcactgttttaccgaaataacacacaaagtttacataaactaaactcaaaatcaacgttaacacggcgaattaccactacaatacaaagtaacttaataaactgagcaaaccaattaagacaaaggagttgcatatcgtggttgccattaagctacacgaattatccaaaagttttcaaggtccggtaatcaatcaactcagtctgacgattcctgatcaacaaatcacggcattaattggcccgtccggttccggcaaatcaacgctcttaaacatgattgcgggtctcacgacacctgacagtggtcaaatttcatttgataatcagcccatttttgacgccgcgactcattggaatcagccccctgcccagcggcacttggcgatggtttttcaagactttgccctgtggccgcacatgacggtccaagaaaatgtcgctttcgctttagaaaagcatctgaccaagccggaattgactgctcaagtcaactgggccctcgaacaagttagtctgattgacttccgacatcgttatccacgtgaactttctggcgggcaacagcaacgggtcgcccttgcacgggcactagcgacccaaccggatttgattttattcgacgaagctttaagtgcgcttgaccccgaactgcgcacacggcttcaattagaaattcgcgccctgattcacgaccagcatctgacggccatctttgtaactcacgaccgtccagaagccttgcaagttgccgaccacctcgtattactgcaagggggcaacgtggtgcagacgggcacaccagcacagctgtaccaacagccaaaatctcaatttgtcgccaattttatgggcacccttaatcagatcaacgcgcaccaggccattcgcccggaatatgtcgcagtcagtcaaacgggtactcagcagcccacttaccaaggcttggtgcagcgttcaacctttatgggcgatcattttgatacttacgttcaagtcggcgcctatgattggcacgtcaagacccagctaccctataccactgcaccgatcacattaagcatcgatccacatcaaatactaactttttaggagttgactcacatgtctaaagcagcaattatcacattatccacgctcggcgtgctcgcaattggcacgtcgctttatgttaatcaacatcagaaaaaaacgttaaccgccaatgcgcaaaccagtcaacaagtcttaacagtatacgctgctggacctaaacccctttctgatcaaatcatccacggttttgaagccaaaactggcattaaagtcaaaagttttgacggcacgaccgggaaaattttaagtaaggtcaagaccgagcaaggcaatccccaagctgatgtgctgattttagcttcaatggccgctggcgtcgatttacaaaagaatggccagctattaacctatcagccttctcaagctaaacacctgaataaacaatttaaagatactagccaccagttgatcaattacagtgcttcggcagtcggcatcacctacaatacgcagcacatcaaatcggcaccgacagactggtctgacttgacaaccactccgtatcgcaatcaagtgaccattccggacccccaaacctctggttctagcttggacttcattaacgcttatcaaatgaaacacggtacgcaactacttaaagcccttcaagaaaacggtgccgatatcgggggtgctaacaaggaagtactcgatgcagtcatcactggccaaaaaatcgccgtctttggtggggtcgattacatgagtctaacagctattaaaaaaggcgaaaaaattggtttcgtttatcctaagagtgggactttggtcaatccacgaccggcgatgattttgaaggctagtcgtcatcaagccgctgccaaacaatttattgactatctcttatcagctaaagttcaaagacaaattcaaaaaagtaacttaattccgggtaccacgagcactttgaccgatccacgcaatggcgaagccatcaaagcctacacggtcaattggaccagtgccaacgcggccctgactaaaaacgttgtcgcattcaatcaggtctttagccaatgagtaatcatcaaatccgcttgtccttatcaatcatcaccagttgcttgttggcaactctgattatcggcccgttagtcgccctgattggtcaaacactagtcgggcaatcgccaagccagctatggtcacaactgacgcagccaaccaaccgtgtgagcattcaacacagtctgttcctcagtgggggcacggtcgtcgggacaaccctgctagccacccctttggcatggatcatgacgcacacccgtttaacaaagctcgcctggttgcattggctcttgttagtgccattcatgacaccaccatatattaacgcgatgggctggttatatttctttcaaccacacggattactggctcagcttaatccgagttggcaccaccaatttcagtggctattttcaccgttcgggatggtcattatcatgagtctgcatttgtatcccgtggcatacttaggcttacgcgcagccctcatgcaattcaaccagcgctggcttcaagcggccgaagttcatggggtcaacacctggcaacgactagtgcgaatcacattaccaatcatgttagtcccatacttagctgtatggattttagtctttaccaaaaccttggctgaatttggaacgccagccacctttggtcggagcatccacttcgaagttctgacgactacgattcaaaaggacctcaaccagtggcccttagatttccaaaacggggtactcaccggcaccctcctactgaccattgccctgattgcctggggtatccagcaatggttgttacgccggccagctgttaagttcaccggacaacggtcagcgtcacaatatcggcagcttggagtgacaacattagcaggcactttcgtcaccctagtcatcagtattgctattgtcctgccattcagtgccatcgtgctccaatcgctactcaaacaacgcagtcttggttggagtccgtctaatttgacacttgtacactatatagacctcttacgctttgatagtcctgcctggcaggccattgttacgaccgtcggattggcattactgattagcagtctcaatgtgatcgttggtttattcttgagcgttgggagtttaacaaaacgttttcccaagtggctgcgacagttatgtcataccttgggcgcattgccactcgcaattccaaacgtcgtcttagcattgagcttaatgatgctcttttcacaggtgctggcgttcaccaaattatacggcaccctaaccatcctcctgatcgcggatgtcaccttatttctaccaacaacggtgcaatacttgacgaccgccctcaaggcctttgactcggaattgctggctagcgcacgcatcttcgaacctagtttcggccgcattatcctaaaaattgcacttccgattctatggcccgcgctactcaacagctttgtgatggctttcattgccacgagtcgtgaattagtcgttgccctattgttactgccttccggtatgacgaccgtttcaacatttatctatcaatcgttcgaacaagatgaagcggccgccggtatggccctagcggtattaacggtagcactgacattcattggactgattgcagctaatcacctgcaatcagctactaagccagtacgccagccaaacggcatcagttggcactcaaatcggtaatcgtcagtagcggaaaacgactttgttttttcgtcatcgcctatcccaaactaaaaaggctggtcgcacgagcgtcaatgttgacgtcgtgtgaccagcttcaatcatcactgacaagttatttagaatcatcggccgaaacatcaccggtttgttcaacctcttcagcttcatcattcggcatgttaacaacggtgacgttagcctccgtattacgaacaacatacgctgtcgttgaacctaagaacaggcgagaaatcgcattagtcccagagcgaccaatcacgatcaaatcaatattttgagccttgggaacatcgaccgcaattgtcactttgggtaccccagtttgccgaattgtttcggcgtgcaactgatgggctgcaacttgatcctgggcccgctccaacagtttcttactctgggcttgatcaaaactcatcatatctggcgccgcactcgtaaaaacatctggactgtagacgccaaatcgattaacatcgatgacattcaataaaaataactgggagtcaaaaaccttcgctaaggcaatcgcatgttcaagtgcataataagcattatcggaaccatctaatgggactaggattcgtttatacatggttgagacctcctgataagttcaatgagttacaacatttattatcataatcataacttatctataatcatccagcacccaatatgcttattaattgtcaaaataagatagcggtttattgatgttaatcttagtaccgtaatatttttgcttgatatacttttgaatatccgcccgatggtaaagtttaactagtttaagataactagcacgatgctcgttcttagcggccgttgctaagatattaacattatccctagtactcttattcagactttcgtggaaaatcgaatcccgtaaaacgtgtaaatgtccttccaaagcaaccgtattcgaaatcaaaactgcatcgacacttttaatgatccggggaccagtagtatcatcgatctgtttgaatttcagatgacggggattgcttgtaatatccttcactgaacctaagacaccaaaattagctgccagtttgatcaggcccgctttttggagcagtaacaagcctcgcgaagcttgtgagggattgtcagcaattgcaatcgtagcgccatccggaatttcatcaacgctttgatattttttggagtagattcccattggttccaaataagtcgttcctaacgccgccaacttggccttgggattctgctgattataagtttggtaatatgaccaggactgaaaggcgttcacatcaacgttaccgtccaccgtggccttgttcagctgaacaccatccgtgatttgtttaaccttaatcgttaagcccatctttttggcatcttggcttttagcaatgtgctgccagacttcatagtccgatcccattgatccgaccgtaatcgtggcactctgttgtgtacgggccgaataactcgttatttcatgtaatcccacacaaataccaacaattgcagcaataccaatcaaccaccatgctaatcgtttcatcggctaattccccctttattaatgatgtgtgacgctcttaacgagccaatcaccaaacagctgtacagcaaagactaagatcaaaatgatgatcattgcgacaaacgtcacgtcgttttcaaagcgagcgtaaccaatactgattgcaatatcacccaagccgcccgcaccgatcgcaccagccatcgtcgtcagaccaatcaggctaatcaccgtcacgattgagacgcgaatcaaatcaggtagtccctctttcaaataaacccgaaaaataattgcaatgggactagatcccatggactgagcagcctcaacgattccttggtcaacatcgagtaacgcattttgcacttgccgggcataaaaaggaaaaataccaaaaactagtgggactaacgatgccgtggtccccaccgttgttccgattaaatagctggtcaacggcgaaattacggccaacagaataataaatggcaccgaacggagtaagttggttagcttgtctaacacttgatacgaggggccatcagctaaaatgccatggggctgtgtcaccactaacagtacccctaaacccaaccccagtattcctgcaaccagcgcggaaactgcggtcatatagagggtctctaacgttgcttgaataaattcagctttcatttgtaagacattcggaattaatgctgtcattagtccaccattcccttcacaacttcttcattgataatgcgagtgtggacaccttgagccgacatattagtgaccgccacattgaaggccgttaaatcccccgtaataatcgcaatcatgtcaccaacattttgaccatcgatctggtcgatattggcaaacaaaatgttaacgtcgacccccagcgtctgcgataactgcgagacaattccctgctttgttgattgaccaaagaatttgaacgcaatcagctcttggtccgctgctaattcactcaatttaatcgttttcgtgattcgctgaatggcggcccgaacattggtagatgtttccacaaaatcaacggtcagaggtgctttgggggctgtaaaaacctcagcaacggggccccgctcaataatccgcccatcagccataacggcgacatgatgacaaatactcttgatgacttgcatttcatgcgtaatgaggacaatggtaatccctagctcgcgattgacccgttgtagcaactcaagaattgccgccgtggtctttggatcaagcgcactagttgcttcatcagaaatcaagatttgcgggtcagtgactagtgcccgtgcgattgccacccgttgtttctgcccaccagataatttatctgggtaggtctgcgcatagtccgttaacccaacgagcttcagtagccgtaatgctttggcgcgtcggtcctgtttactaattttttgacccaataatggataaataacgtttcccaacacggtccgtgattgcatcaagttgaagtgttgaaaaatcatcccaacgtgtttcctggcttgacgtaatgcagctggcgatagcgtttgtaaggcctggccattgacgactacctggcccgttgtcggtgactgtaataaattgatcacccgtaccaaggtacttttgccagcgccggaatatccaataatgccataaatatcacccgtctggatctgtagattgacatcttgaaccgcgtgaacgacttggtgcccgtcgtcaaaagtcactgcgatgtcttttaaatcaatgattgcctctgtcatagtctgcttcctcccattaaaaaacgcccatcgtctctaatctgattatcagattaaggacgaatggacgtttttccgtgttaccaccttacttcaaatgaccctcacaggccaccgcacttcaagtaccgccactgaaaattcttagcgagactctaaccgcataacgggcgtagccgtcaacgcttaaccccgtcagctcagcgttgaaacttgcattataagaccatcttcaacgttgcgaaatggctacctcgcaccaaccggcagttctctaaggcattccaacaacggctactcatcttagacgtatttattaatatatttacttggttgtttacagtattgcgctattttaatgagaagtcaacatttaattataaccattttttaatttatagtggtgcccactgattttggtccaatgatgtgcatcccaccggcttaccaggacaggaaatcctggtggtcctgttttaacctcagtacgctgcgccaatgacgtgggcaaacgccattgatatgaaacaacgactaacccatcccgaaacaaagtggtagcgacgcctcgcacaggcaatcgccaccactttatttaaaatcagttttccccgataagcttttcagcacagtgtttaagactggtcttcacctaatttgaataacggaatcttcggaccagcatttgcgcccgtctggtgttgtggttgcggagcggaattcaagcgttgctcaatactgcgttggcgctctgcttccacctgggcagccgtttttaagttacgcttctgccagttcaacagaattcggtccatatacgtcaagttatagacttgacgcagaactgcttcccgcaatgccaattcgataacttccggttcataatggtcttcgtcgaaccacttactaatactttccatttcgatcggtgataagtcacggccaaattccgtctgaattgcccgaaaaaccttttgccgactgttttcactcgtggcttgttccgaagcttgagtgctaactggctgctttttgagcgcaactgctaacttatcatacaggccgtcaaaattataacggtcatgaattttttggtcatcagccgtgatcgattcaatcgtcagcaattttttggctaacatttcatgtagccgctgaaaaacggcatttgtcgattcacctaaactcttggcaattaccgcagcatctgggaattgattaccctgatcaattaaccgtttgaactgcaaataaaccaataattcatcgtttgtgaccccaatttcacgatagtgggccaataatgcgttcgcaatggtcgtttgaccatcattcactaacgcggcagctaaggactccatctcgttatcatcctttcactattaagagcgtgagactaggtcccacgctcttaataaaaataaccttcaattaaagtttacgggtaaatccggttcaacaaccgtgggaacggaattgtctcccgcacgtgatcttcggccgtaatccaagtcaagaatcgctcgagtcccaaaccaaaaccagcatgaggaacactaccatacttacgtaaatctaagtaccaagcatagtcgtctggatttaagccggcttgtttgatctggtcaagtaagtaattgtaatcagttgctcgttctgacccgccaataatctcaccatagccttctggggctaataaatccgcacaaatcaccacgtcgtcccgggttggatgcggcttcatataaaatggcttgatggctttcgggtaattcaaaacgaagacgggttgatcgaagtgatcagccaagaaggtttcttctggtgaaccaaaatcaacaccccaatccacgtcaaagtcattttctttcaacaattcaatggcttcatcgtaactgattcgtggataaggtaacttggtgtacttcttcaacgtttcaacatcacgacctaaaatgtcgagtgcgtattgacaatgatcaatcacaccttgaacaagaaaggcaatataacgttcttgaacttccaaactttgttcttgatgcatgaaagccatttctggttcaatcatccagaactcaattaaatgccgccgagtcttggacttttcagcccggaatgttgggccaaaagtaaagacctttccgtaggccaaagctccggcttcggcgtataactgaccactctgtgataagtaggcatcccgatcaaaatattcagtatggaacaattcagttgtcccttcaggtgcactcccagtcaaaattggtgagtccatcttaatgaaaccttcttgattaaaaaattcatacgttccgcgaatgacttcattacgaatgttcatgattgcccatggccgcttagaacgtaaccatagatgccggtgatctagtaagaagtccaccccatgttccttaggcgtaattgggtattcttcactttcaccaacgactacaatgtcttcaacttcgatttcataaccgaactttgaacgactgtcttcatgaatcacacccgtaatccacatactggcttcttgcttaacttccttagcgagttcaaaaacttcttcgctaacttggctcttaacaacgacaccttggaaaaaggcggagccatcacgtaattgtaggaaggcaatcttaccacttgaacgtttattagtgagccaagccccaatctttactttttcgtcgacatggtccttagcatcgataatgttgatctgttgcaccatttacttacatcctccaattactttgcttgttcagcaattttttctgtcataaatttttgtaaccgtcgatgggcctctcgcaaggaatcgatatcagttgcatagcttaaccgtaaacaaccgggcatgccaaacgcctctccaggcactaaaccgacatgggcttctaataacactgccgtcacaaaggccggtgcatctgcatagcctgttaaacgcaatgcttccgtaatatctgggaacaagtaaaaggctcccgctggtttgccagcaggcatcttaaacccaggtaaacgctcgatcagtgggtatagttcgtttaaccgcgcttcaaagccctgacgcatcgtttcaacagatgattggtcaccactaaaagcttcaatcgcagcatattgtgatacggcggctgggttgctagcagcgtgacctaacacgacccccatcttagccatgatggtttgtggcccggcagcatatccgatacgccaaccagtcatggaataggcttttgaaaccccattgatcaaaaccacgtgatccatattagcatcatctaattctaacacggatgtaaattcattaccgttatataataacttttcataaatttcatccgcaattaccaaaacgtcgtgttcaacggcccaattcacgatcgccgtcaattctgcacggctgaaaaccagaccggatggattctgtggcgaattcaagactaaggccttcgtcttaggcgtccgctgcgcttccaaatcagcagtggtaaaccgcaactgttcatcggtgctaacttcgactggcacaccaccagctaatttaacttgctccgaatagctgacccagtatgggactggtaataacacttcatcgtcgggattcagaataacttggaataacgtaaacaacgccatttttgcgccatccgttacgacgatctgattaggatcaaaatggtagtgatggtcagcctcaattcgctgactgatggcttgttttaaagctggtaatccagttgccggtgtgtagaaactcgcttgaccattttgaatactatcaatggctgcttgcttaatgttatccggggtctgaaaatccggttcaccgattcctaaattgataacgtcaacgccgtccgccatcatttgcttggcagtcgcactgatcttcaatgtcgctgacggttgaacctgcattactttacgcgataattccatgtacatccgcactcctttaaccttaaatgttaataattgatttcagctggtttccattagaatactgcaaaatttcataacataaattctttttctggttcaagtacgtaatttcccacacgaccgtcccatcatacttcccaagcgtcgctttgataaccttgctaggattgcgtttagaccagacctttttcaaggctttcgtacgtgaaatcccagcggactgtttgataacggtcgttttatgatgtttattcgcgttaattaacgcgtataccggaacatttttactcgacgttcccgtaacgacgtaataactactggtgccattgtactgtgaaaaggccgtcgtggtctttagcttgcccttgctgacggccagactatacgccgtcttctgggcttggtgcattggccgttgtgcggcccataacgtgccatagaccgccacgataatagctaaaatgacgaccagaataatcataatgagtcgctcagggcgccttctacgttgaactcgcatatgctcttcctttcaaaaacagataaattaattatagcaaatttaactgattgcggaatggtttcttacttagttttgaaaaaactttgaagttcctgcgtaatcatcgtcaatgaaccggttgcgggcggcaacgttttcggtaaagctttaagaatcgtctgcccgtatcgtttcgtcatcaaacggtcatcgagaatcaccgctgcccctcggtcttcatccgtccgaatcaaccggccgattccctgacgtaacttcaatgccgctttcggtaacgcttcgttatagaacggattgagttgtgcttgccttagttgttgataacgggccttggttgtcgtctggtcgggcgattcaaacggtaattgcgtgacgatcaacaattccaactgttcttgtggcaagtcgatcccctcccagaaactaccggcacccaggagaatggcatcgtccccctgcataaagcgccgaagcagcttttcacgactaccattgacgccttgagccaaaatttcgcgatcaccaggtagatccgtttgatgcaaactgtaaaagactgcttcaatcatattcagtgaattgaacaagaccaacgtttgcttaggcgctgccatcacgatgtcgtgaatcgcatgcgtcaagtatgccacgcgctgcttgccactgggtgcttccgccgcagtagcatccgtagcgacgaatagccgtgcctggtgttctaaatcaaacggtgttgataatcggtgatgcttagccgttgcttggtcaatatccaattgcgaataaacgtactgagatttcccagtggcaaatagcgtggcaccagttaatagtggcgcactgaagtaaggatatagttgcgtcttaaaatacccttgcgtatcgatcaagctacccgcgagcgtgaggctgccgcgatcatgccattgattaaggctcacccagaagacccgttgttcccgcgaagctggcactaaccacgtttgtaataactcatagccctgacggagatgttgaagacgattgtcaaagtcgtcgaggacgtgttgttcactaggcaagatttgcgattgatcatgttgatactgctcatttaattgttgaaactgtaaaaaacagttttcgatggccgtttgtaattgtttgatcagcggattgtgggccgcaaagaaatcagtcaactgatccgtggtgattcctaattcagcaggctgattgccgcccttttgtgctggtacaaacgttctagctagcgccgcctgcagttgttgcaggtgtaggtcagtatcattcaatgaattatctaataatttcagacgataatcggcctgtggttgttccgcgaacagtgcccgtaaatttagactatgttccgtgtcaatgcgactgatcaagctgtggcaggtcgccatgtagccattgaaatcaaaggtctgccgtgagtcacgaacgacaccatctgccagatgctgggcctcatcaagaaccagcagtggccgctcttgacggctacccaattgggccacgtggcgcatcaggtaggcatgattggtaatgataaaagtcgcttgcgcggtcaattgatcccgaaagcgtaagaaatcttctttaaaaaacgggtcatcagctttcaacgaggccacgccatgatgggcgatttcgctaaagtacggcgcttgatacgtgctcaagtgcaattcatccagatcaccagtcgttgtcatcgtcaaccacactagcacgcgcaacttcaataattgcgtttgcttcgaatgttcatgcaacgccaagccacgggcaaaccggtttaaatcaacgtaatgctgattacccttaatcacaaccgccgtcacaggattaggcaacaactgattcaacaacgccacgccctgatcacgtaactgcgtctgtaagaccgtcgtcgccgtgctaacgaccacctgttgaccatcctgtgccaagtaggcaagtggcagcaaatacccgagtgttttacccgttccggtcggtgcttcaatcaacaatggtacttgttcagcagactgttttgagtagtgccgataaatctggttcatcatccgggcctgttgtggccgataagtcaagcgatcaccaaagatatgctgcttttgtgcttttgtcaacggatagcgtgccgctttacgacccgcggcttgctgtggcaatcgctgtttacgcagagcgagcccgtttttgatcactaagtcagttggtaactgctgtggatgttgtttgccctgttgaaaggcgtatgcaaacaagtcagccgtttcacgtggtaactccggtgctaattgcaccatttgttgtaacgtgatcaatggtaagtgtgcgagccgctgttgtaacgtgataaacaaatgggccgtagcaattgcatcactatccgcagaatgcggatgattatggtcaatcgcaagcaagtgactcaagtcccgcaaccgaaaactcgaagcagtcggtaacagaatttggctaagagacacagtgtcaacggcctgaattggtagttctggataaccgacacgctgcaattctgaattgataaatggcaggtcaaagttcacgttgtgggcgacaaaaacagtcccttgtaataagctgtataccgtaccagccagatcatcaaagggtggtgctttgcgcacccgtgcattgctgatccccgttaaattctcgataacggccggaaccgttgttaacggattaacgtccgtggcaaatgtattaattattttattattcttaacaaacgcgcaaccgatttgaataatccggtcgccgtccttcacactagttccagtagtttcaatatcaactaccgcataagttgtgtttggtttcatggtcatttccccaagttatggattgtaaagatgttcattagattggttaccgcttgaatccgtcatcaacactaacgctgatgttcgaccaactaatcgatctttatggcatatcacgtgcgatgtgtttgtaatcagactgaaggctggtccaagtagcgctacacttggtctcgaccactaactttaacggttcgtcggtcagcccaacttagctgagttcaacctactaaactgtgccagtgacacaagtcgtcctgatgacgcaagccgcttggctcatcctccacaccgatcgtcacacatacgtcacgtcgatcattgtaaattatagcatattcggcgtagggaactcagcccgaccaactcttaagccaaattcgtcagtctgaggacaacgggcagagactggtcaagagtatgattgagcaacgataaagttcatgaaagtgtctcggcgtacatctgccataacacagtcagctgagtacgcgcgcttgaatagccggcactgctacccaaaatttactttcctaattagtgaattctgggccacgtagtccgtcacaagcagctcaacttctttttcatcattatcggactgatttctaatcatttactaattttaacatagtaatcgatcttcgtctgccgttgataaccagtctgtccatacgcccctcacgtgaatgatttaatttaattaaattgttactttccaaaccagtttaacttacatttcaactgaattcagcgcgttcgccggggttagcatggcaaaagaagtgctaataaggtattatgaagctattattaatctacttacagaaaggcagcgacacgattgaaagatctagctaccggtactagtcatgccaaaattattttaattggcgagcatggtgtggtttacggacaacccgccattgccttaccgatttcgaccatccaaatgcaggccattattcaccgccgtgatgcagcgcagacggtcaaaagccgttacttcaacggcgactttaagatgatgtctgccaacttaggcggtattcagacgctcattagaaccttgcttgcacgttttgatgcccccgagcagggcttcgatattcacatcacgagcgatattccctctgaacgcggaatggggtcctcagccgcagcggccgtggccgtaacgcgggctttttatgatttcttcgaccgaccactctcccaccaagaattattggccactgccaatgtggcggaaagttacacgcatggtcaacccagcggcctagacgttgcgacggccagtgccaaaagtcccgtctggtttgtcaagggtcgtgagaactttccgattccggtaaagcttcccggctatttagtcatcgcggacacgggtattaaaagtcagaccaaagttgcagtggcgaccgttcgcaacttactaatggttgagggcgcgacgattcaagcacgcattgatgacttgggccgattgactcgtcagacccgaaccgcgcttgaagatggtgacatgggggccctggcaacagccctgaatggtgcgcaagatgacttacgttccatgggtgtcagtcatcctgcccttgaacaactactcgcagtggctcgccaaaatggtgcactcgctgccaaattaaccggtagtggtcagggcggttgcttgatcgcgctcgctccggaagccagcatcgccaaccaattatcacaaaaattggccgcagccggtgcgactgcgacttgggtcgaaccacttttgtgcgatgactaattttaattttggaggaaaagacatagtgaaaaccgttacggcaaaggcccatactaacattgcgttagttaaatattgggggaaaaaagatgcggcgctgatgctaccacaaaatgggagtatttcgctgacccttgatcacttctatacccagaccagtgtgaccttcgatgagcatctcgatactgaccaaatttactttaaccatcaacacttacccacgggcaaatcagcacgaatcagccagttcctcgaccttattcgccagcgcagtggtcaaaccaactatgcaacggtcaaaactgaaaatcatgtgccgacctcagctggcttagcctcttccgcctccggattcgcggccttagcaggggctgctagtcgtgcggctggcttacaactagatgcggctgatctatcacgactagcacgccgtggctcaggttctgcgacccgctcaatttttggcggttttgtcgaatggcatgccggccatgatgatcagagttcttacgcggaagtcttacaagacccggtcgattgggacattcaaatgatcgccgttgttttgaaggccaccaaaaagccaatcagctcaacggacggcatggcacgggtcgtcgcgacatccccctactatccagcttggatcaccacggctgagacggacttgaagcgaatgcgccaagccattgccgatcgtgatctcactactgttggccaaattgctgaaacgaacgcaatgcgaatgcacgcgcttaatttgagcgctgaacccgcctttaactacttcaccgcggatacactgacggctattcaagcagtcaacgacttgcgttcacacgggataaactgttattatactttggacgctggcccaaacgtcaaaatcatttgtgcgggtcaagataccgacaccattatgaccgggttacaacaacattttgacgctgatcaattaatcgtcgctaaaccaggtccaggtatcacgataacggaaaaataattcagtttaatttaaaatgatcagcgatggtcatgaaaggatatgatggcatgataacggtgaaagcccctggaaaactctacattgccggtgaatacgccgtagtggaaagtggttatccagcaattattgttgcactagatcaatttgtgacggcaacgatttcacctagcgaaacgattgggagcatcgtttctgagcagtatcaagaaaactcaatcgtctggcgacgtcagggagacgcgatggtttttgataatcgtgacaatcccttccattatattttagcagcgatcaatctcactgaaagttacgcccatgaattagggcgtgaacttggtgtttatcatctcggtatcaatagcgaactcgatagtgctgatggtaaaaaatacggtctcggctcttcagcagcagtgaccgtggcaaccgtcaaagcactatgtcagttttaccatttaccgatggataaaaataaactgttcaaattagccgcgattgcccatctatccgtgcaaggcaatggttcgcttggtgacattgctgccagcatctatggtggctggatcgcctaccattcattcgatcggcaatggttacacctacaacaagctcagtcaagcttaagtgatttgttgacaatgccgtggcccgacctaaaaatcgagttactgacccctccagcagccttacgtttgatgattggttggacgggttcaccggcctccacatcacacttagtcgataaagtggctttagtcaaggcgaagcaacgcagcgaataccagacctttctaaaagccagcaaagcttgtctaaaacgtatgatcactggttttcatcacagtgacttgcacgtgattcaaaccgagttgcgaacgaatcgtcaactacttcagaaattgggcgatttcagtcacgtgacgattgaaacacccctgctgcagcgtatgattcaactcgccgaaagtgctggcgcggccgcaaagacttcgggcgctggtggtggtgactgtgggatcgttttgattgatcaaaccatcgacccacgaccattattaactgcgtgggctcacgatggtatcgaacaacttaacttaaacgtgcatacggttcaggataccgttttaccaaattcttaagcagtttattgacgagcctggcagccttgccggactcgttttcagattctaaattaattggaggtggcaccgtgccacaaagtcaacaatctcatcggaaagatgaacatgtttcgttagctgaaaagtattttcatggcgaacaagccaatgcctttgaccaggtccggattcgccacgacgcgttgccggaaactgccgtggccgacgtcgatttagccaccaccgttggccagtggcattgggacagccccctctacattgaagcgatgactgggggctcacagcgaacgggcgaaatcaacgctcgtttaggccgcatcgctgcagcttgtggcttaccgattgcgaccggctctcaaagtgtcgccatcaaagatccccaagtagcccccacttttgccacgatgcgtgaccacaatccgaacgggctgatctttggcaatcttggtgccggccacccgttatctgcggcccaaacagcgattgcaatgctccaggccgatgcgctcgagctccatctcaatgtcgttcaagaaatcgtcatgccagaaggcgatcgtgactttcattggctaactaacatttcggacttagtccaagccttaacggtaccagtgatcgtcaaagaagtgggctttggtatttcccgccccacgatgcaacagctctacgctgccggcgtacgctacctagatttaggcggtcacggtgggactaactttgtcgacattgagaatcgccgacgtgctaaccgcgatatggcctaccttcacgactttggcctcaccacggttgagtccttgctaggcgttcagaaccgaccggatgatctcacggtcttagctgctggtggcgttcgacagccactcgacatcttaaaagcgttgatgttaggcgctgacgcggtcggcatggctggcaccgtgctacacgctttactccatcatacggacgacgaagtcattgcgatgctgacggattggcagtcgcaattaaaacgcctatttgcactcgtcggcgtaacgcgtgttgatcaattcaaaagtagccgtattcaggacaagattctgttatcacctgaacttgttaactacaagcaatcgattaaagattaaaacaaagcgtgtcatcacaaactacggaatgtcattctatacttgtgatgacgcgtttttgttataaccaagtacaccaaaaaagcagtgtgcccctatggcaagcactgctttttgatcgtggtaaagaaaataatttccatcatctattgattgctattttgacacgtattggtagcggttcacgtacgtccgtggctgaccagcccgtagaacaacatcgccaaagccatgatgattaatagcatccggcaaggtttgcaattccacggccagcgcatggtagtcccctaaacgatacgactgcgttcgttcgggattagcggtaaagataactaaaccattgcgatccgtgttgatgagcagtcgcccgtgagtcgttgccaacacgccagcgggttcatcctggtggtcaagcacatagcaatcatcgtattccgtcctgccagtttcttggatcaatcgatcgagctgcgattgaatcgttggctgctcacgaaagtcatacgctggtgacgggacgtagaagacgccggtcggaaccttctcgtgattcgtatgaactagcttggtcgagttgatacgtaattgctggggattaatcagtgcggcctgaccatcaagattaaagtaaacgtgacaggtcggattgaataacgtatcagcagtggtcaccccgtgatagctgatttgaacctcatcatcggccgttaacgtatagcttacagttaccgtcaagtcgcctggaaaaccatcgtcagcgctcgctagcgttgtcgtcaatgtgacagtgtcgccatcaggatcaaaacgagctcgaaaattatgcgtttgtaagccatgattgccaccgtgtagcaaatgctggccgttatttggtggtaagtgatacgtctgcccattcaaggaaaacgtcgcgttaccgattcggccagcaactcgacccactgttttgccgacttgataaggcgtctcgatataatccgccaagttatcaaagtgaagcactaatgagtgtggctggcggtcgacctgcacttcgaagtcataccacgttgccgcataactcaacacttttagtttgctatgatggatattttcaatcgtgtataaatagactgactcgccttgatacacaccaaatggtactgcagaaatcgtacgcctcattcccttcgatcagtgcggattgaactagttctgtgtcaatgtttgcgtggtaccatccacttgaacatcaatcggttccccggcaatcaacttcaaagtcgtcccatcgtgatcaaccgtgacttcaataatccgatcacggaagacctgacggaaagaatacttcgtccattgttttggtaagaacggccggtaactcagttgtccatcatgaacacgcatgccagcaaatccttggaccatcgcaatccaaccaccagtcattgaggtgatgtgaagaccgtcgaccgtatcattattgtaattgtcaagatcaagccgtgccgtccggttatagaaagccacagccttgtcttcatagtgtaagtcagcagctaacacggcatggatggctggtgacaagcttgattcgtgaaccgtcatcggttcgtagaaatcaaaattgtgtttcaattgtgtctttgagaaatcatcaataaagtcatacatcacttgtaacacatcaccttgcttgatataaggtgaccgtaagatgtggtcccatgaccaatgctgattaattggtaactggtcagctggaattgcggaaacgggcgttaaatccttatccagataaccatcatgttgaacaaagatatccagatccttgtcatatggtaaatacatccgatcaacgatatcttgccagtgggcacgttcttcagcagtcacgtttaaggccgctgcttggtcgtcactaacctgatctaaaatttcaagcgtgtacttcaacgtccattgcgccaaataattggtattaaagttattatcaacgttgttttcatattcatctgggccagtgaccccatgaatcatgtactgctgattacgtttgctgaagtgcacccggtctgcccagaaacgagaaatctccgtcaacactttactgccttcatgtaagacgtatgatgtatcaccggtataacgcgtgtagttataaatagcaaaggcaatgtcgccgttacgatggatttcctcgaaagtgatttcccactcgttgtggcattcaatcccattgaaggtcaccattgggaacaatgccccatcaagcccttgttgacgagcattatgataggcaccatccaactgcttataacgatacatcagtaagttgcgggtaacttctggtttggtaatccccaggtaaactggaacggcaaatgcttccgtatcccaataagtcgcaccaccatacttttcaccagtaaagccctttggtccaatattcaaccgtggatcatcaccataataagtactaaagagttcaaacaaattgaaacgcatgccttgttgggcctcggtatcgccttcaatttgaatatctgattgttgccaccgatcggcccagcccgcttcatgggccgccaataaatcatcgaaagattgggcgctgaccgtatctgtcagacgttgaagtgcagtcataatggcatcatcagtcggataatcccgcgacgtaaccacgacgacccgcttttcaaaactaacgctggccccagcttctaacgtaccgaagtagcgatcaaccgtggctgtatcagtcacttcggccgctttatgggttaaactcgttacataactaacttgcatcccagaggtaaactgtggggtcccaaaatcatttggtaccgtctgagcaattaaccgatcatccgtaacttcgtggacgttccagaaatgttcatcgtagttcgcatcttcgttcttaacgtcagcatccagtgcggaagcaacttttaattccaccgcttgatcgctcaagttttcaaacgtcaccttctgaaccgaaagttctttttgcgcaacactcaagaaacgctcaaaggtcacgcgaacccgttgaccatcttgatcaacgataaatgatcgtgtcaaagtcccgtgttgcatatccaaatcaagtttaaaatcgctgaagttggcagttgccaagtcgatcttagtcccattgagtttgaaattgattttgatgaaattgacggcgttgataaccttgccaaagtattctggatagccattcttccaccagccaacccgggtcttgtctggataccagacaccgccaagataaataccgggaagcgtatccccagtataatcttcttcaaagaagccgcgcatgcccatgtaaccatttcctagactagtcattgattcttgcagccgtttgttttctggtttgaaatcagtcgtcaagacatgccatggattaacatcaaaaattcgtttcataagttaattcctcctagtttttgtacgtttctttgatcaaaccaactgtgcccgcacctactgcaaggacgatcccagcaaagatgaacatgttggcttgtgaattgccaaataatggatataatgcaaagctcaataaggacgcaacaatttgtggcaggcagattgagccgttaaagagacccaagtaagtccccatgtgttcgccagataaggcgttggttaccatcgtcaatggatacgtattcattgcggcccaggccatcccaaccagaataaatgagacgacaagtgctgattgactgtgaatgaagaaaattgagaagaagccaattgcaccaagtaataaactcaaagcataaccaagtttatgccgattattcggaaccttggctaaaacatatgaccaaacaaccgcggcaacggactgaacagcagataagatcccgtaccagttaccagcggcttggtagcctgcagaactggcattagtggtgtgccaaacgttggcagccattgcaccggttgagtatgtccataagtattgaaatgccatccagcagaagaattgaactaaggctactaaccagaaaacctttggtgctttcttcaagagtgccaaccagttaccaccagatttattagcgctttcatcaatgccgtgatacttcgcgtaagttacgggatcatattcccgcacccgggcaatcgtgataatcgttgaaaccactaagattgctgctccaatataaaatgaccagatcactgaattgggaataacacctttactagccgtattggcgaccccgaacaaggtcaacaggaatgggaagattgccgcaatgacggcaccagtattcaacaagaagctttgaatcccataggcgtaactcttttggtcatcgttgaccatatccccgaccatcatcttgaaaggttgcattgcgacgttagacgataaatcaagaaatgccacggtaatcgcaccaaaaactaaggccgccatggaagcgtaaccaaatccaaacgagccagaattgggtagtagtaacatcacgattgccgcaacgactgttcccagaatcaagtaaggtaaccgtcgcccgcctaaacgtggggcccatgttcggtcggataaactcccaatgatcggttgaacgatcaaaccagcaaggggtggcaagatgaaaaaccagccaaggttatttggatccgcgcctaaagtttggaagatccggctcatctgtgagctctgaagtgtaaatgccatttgaacaccgagaaaacctagactcatcatccaaatcttattggatgacagtttcggtaatccggccgttgttttagatgtttctttcacaataaagcctcccaaaaataatatcaatcgcttgagtacaagttagattataaaaccgcttccaaaattatgcaagcgtttgcgtgaaattgcatgaaggcgttttacttattgacatccgtgcctatttggcatgaaatcggctaatatcaagggttcaaatagtattagctgatacatcgattcatataaaattcacatataattcataaaaaagtcattatattgtatactgttgcatgaacaaatagatgcaggcgctgaaacgttgcgtgccgttgcactaataaaccgctccagccgacggatatcattttgtaaataaataataattttcaataatcgattgtaaatcagcatcgctttccattacccgacactaattattcagttttaaaacgccaatacgccattttctgtcgaatattggcgcaaaaaaatcgtgtgttcaggccgacttagcataaacacacgattccgaataattcagttattaatccgcattggcaatctttgcaaagccatcttgtaaatccgtattttgtgaactagtgaagttaaacgttgtggcagtggcactgtcttgcgagaccagaacgtctggcgaaccattatggaaaacatacagatacgtaattacgccactagacgcgttcggatcagtggccgcggcaacgacttggtacttcgcatcggtatcagcagccgtcgtccacttgagcttgactgtgtcaccattgaccgtaatcttatcttggtactgattgtttttgatgtctgaaggtaaattcaactcaccaatagttaccgactgtccatcataagtcccctcgtacgattggttcatggtatcttgccatgacgacataaacgaggctaactcgctcgacttggttgtcgaccacaatgccgtctgagttgccgtactagcagatgccttggacgatgatgacgactcggctttttccgatgtagcagtgcgcgacgaagatttggccgtcgttgttgccgtcgaattactctgacgctgatgtcccagccagtaatagccaccaccaagtgccacggctaataccacgatcaaaataacccaagacagttttgacgttgaacgtggttgcgcattttgacgcgcatgttgcgctgaacgggtgccaggttcaggtgcagtcggtgcagccgaaatcgatgtactggcgctcggtgcttctgaagcagccgttgacgacgtggattgagtagcagaacttacagctgacgccggtgttggttgcgctgaactggctgggataatcagccgcgcaccacaattttcacaaaataacgcgtcaatatcattctttttcccacaatttgggcaatacataaactcttcctccaatatcacgattgattgggtccatttgaccatcaacttgcgtagatcgttcccccgattttaccacggatcgaatgattcatgacggccgctgctcatcacctgttcagcgtcaatcgcacgcggacgttatgacttagtcaatatcatgtcaggttagagcgtcgcgttttcagaggtcgccaagaaccgtaagcccttaggaaagaaatttttaaccgtcttggcgacgatttttccaaacccaactggcaacccatcacaagttaagacccgaaaaccagctacaggcgcacttgtcaattcaaatgtctcaccatggacatacaatgcccactgttcacgcgttatttcagttttgggtaaggacaaatcatcactcgctaaggctaacgcgtaacttggttcaaaccgtttcttcttaaacgttcccaataaaatcccggggcgaaagaccttgagctttcgcgtaacgggcatcatcgctggcacgccgtataactgatcaccatgtgcctgtaacacgagctgtggtaaaccggccattgcttgtttttttaaaaagtccgtccatagctgccgttgcgtggcgtttaactgttcgcgaaccacttttttgtccttgcccaccgtcgtgccatgatagaccaatttggcaataaagtgaccctcaccgcgcatcaagtgcggaaataaccgggccgctttagccagttcaggattgccatccgcccattccggctttgcatcgaccatcccagccgtcttggccagtggctccagctcaaactcaggataagtttttaacagccaggccatcatctgttcgtcctcttccggtgcaaaggtacaggtcgaataaatcaaatgtccacccggacgcaacatcttgaccgcttccgtcaaaatctcccgttggcgttcagcacacgccgctggatagtcgggcgtccaatactgaactgcgtcatgatccttacgaaacatcccttcacccgaacacggcgcatccaccaagatccggtcaaaaaagcctggcaattccttggcaagggcggcgggtgtatcgttggtaatcactgtattgcgggcgccgtagcgttccacattatcgccaagggcggtcacccgttgccgattgatctcatttgtcacgagtagaccagtctgacgcaaatagcttaacagatgcgtcgttttgccacccggtgccgcacataagtctaacactcgttcaccaggttctggttttgcaaactcgccaacggtcatggcacttggttcttgactgtagacggcaccagccaagtgttccagcgcattgccgttcaccttgccataatacccaattgggctatacggaacgggtgctgtcatcttggcgcgcatcgtggccgtcaaagtcttgttcggattaacccgaaaccctttttcaacagggccatcgaaagctgccaaaaaagcgggcgcttgatcgcctagtagtcgttgatatttttgaataaattctgctggtaattgcacccaaatttcctcctcaattaaaaagcatcctcaattagattaccacattttgccccgactgtaaggtagcaaagattcgcaattaggtgggatttatgctaaattaaattaattaactgccggaaatatgggagatgtttgttgaatatggaaagaaaactaattgcgttagacttagacggaaccactttgaatgctgaatccaaactcaattcagcgacgatccaaacgatgcaacgactacaagcagcgggtcacattgttagcattattactggtcgctcatatcagggttcacaagcaatctatgaccagctgcgtctcaaaagcccaatgatcaactttaacggttctctgggccatttacctcaccaaacatgggcctcagaatatcagttcacgatcaacaaagcgattgtcttagcactcgttaaatatcgcgaacaattggggatcaatgaaattattgcagaaaataaaaacagtaccatgacagcgggtcaagatttgattgctggtcaattcttcccagagattgctgacagcccccgacttacaccagatacgttgactcgtaatccgaattccctcgtcttgctagtccagcttgatcggcgggctgccatcattgactggatcactgaacgctttggcgatcaagttgacgttggtgtttggggcggcccgaatgccatcctcgagattacctccaaaggcgtccacaaagccaagggtgtcgcctacttagcggattactttcaaatttcacggcgcaatatcatcgcctttggtgacgaacataacgacctcgagatgttagcatacgcgggtctcggtgtggcaatggccaatggtactgacaagatcaaagcaacggctgacgatgtaacggcctataataatgatcaaaacggtgttgctcgttacttgaacgattattttgcgattgcggaataatcgttcagatgcaagtagtcgacagttgtatcttaagttgctgactgcgcatcactattaattttcggactttacactagctcgtaatcaccactcaaaaatggcacttccagataaaattcaattctggaagtgccattttagttgttgttcaactatcaagggattgcgttagctaagttcagtcacgctcttcaacggtcgaatcagccaccttcgaagctgatttagccgcagtatcagtcttagacagacgtttttcagccaaatatgagtgacgcataccatagctaaagtagatcactaagccgacgatgaaccacacgcccgcgtataattttgcctggatatctaagcccataaaaacgaacagtgcgcctagaaaggcaatagctggtaaaactggatagaacggcatcttaaaggctggtaccgcaatatcaacaccttcacgacgccgcaaagcatagattcccagcgagacaaacatgaaggcaatcagggttcccgctgaaatcaattgggccagaaaagcaaacgggcaaaacgccccaatgataatagcaacgattgttaacacaagtagcgcgttattaggttgattatgatgtaacttgccaagccacttaggtaacataccatcacgcccaaaggaataaattagccgtgaccctgctaaagtcatcccaatcagcgcagtaaacattcccagcacggcaatggcctgaataacactggcaacaatcggatggccagcttgtcgtaatgcccagccgactggttcagcgttattagcatatgatgaatatttgaacataccgactaagaccaaagcaacagccacaaagagtaccaccgcaatgacgagtgaaccaagaattcctcgtggcattgttttgccaggattcttagcttccgctgaattagcggcaatcgaatcaaacccaatataagctaagaaaatcatcgataccccggcataaattccttgccagcccccaaaagcactaccatcagcgtttaaatgatacttggggataaacgggacgtagttttgcacgtggatcgccgtcgcacccacgacgataaacgtgagtacggctaacactttcaacaccactaacacgttttcgacccgggaggccttactgattccacgtgagagcagtaacgagaccagcgcaatcaccaagacggcaatcaggtcgaccacaccaccatcagtcccaaacgtatttgacaaagctttcggtagagttagtcctaatggtgacaagagcccccgcagattggcggacagtcctgaaccgacgaatgccaacgcaataaagtactccgcaagcaacgcccaaccagcgatccaaccaaagaattcaccgaacattacgttgatccacgaataagcagaaccggcaaacggcatcgccgccgccatttcagcataagcaaatgcaaccaggccggcaacgacggctgcgacgatgaatgagaagactaccgcagggcccgcatggttcgcagccaccactccgggtaatgtaaaaattgacgttgaaacaatcgtccccacccctaaagccaagaagtccttgaccgtcaatactcgagctaggtgagaatctttgtcttcatatatgcttggatcttcctttaaagttaaccgttttaataaccgttgcatcaaaatcctccttattttaccaaccaatcttgccttggggccgtttaaccaggccctgttcagcagcagccattgcctcatctaatacggttaacgcagtatctaattgcgtcttcgtgatgactagtggtggttggaaccgcaaaatatttcctttgagcgttatcatgacgacaccccgttcaaaagcggcataaatgacgtcactggcaaaatcaggatcaggttgctgactctgccggtctgtcaccaattcaatgcccccgttcagcccgtacatccgtacctgcccaattttaggatggcgttgttgaagcgctaaaaactgttccttggcatagcggccataattggcggaacgggcaaccaactgttcatctgctagaacgtcgattgtcgccagcgccgccgcacaacaaaccggattggccgccgtcgtaaaggtgtgcgccggcgctgctagactctccatcacttcacggcgaccgatcactgcactaagtggtaatcccgaagccagtgatttgccaacggacattaagtccgggcggattcccgggaagttttgaatgctccacatcttcccggttcgtcccatcccttgattgacctcgtcgacggcaaataagataccgtgctggtgacaaaaatcatagactaattggacatactctgctggtgccttgcggataccgccatcaccttgaatcggttcaataatgacgcacgcggtttcctccgctggtaagtatgagtcaaatggtgccttgaacgcttcaaaatagcgtaatgcaagttcatgttccgtctcatgcggcaacgtacgataacaatcaggatacgggacgtgcacgatcccaggtagtaacggtcccatcttacggaccatattcaggctaactcctgagagtgacattgagccatacgttgaaccatgataggcatccgtataggcgactatgtattgtcggttagtataggcccgtgcaaatttaataatggcatcattggcatccgaaccagagttaccaaaaaccacctcattatcagtgccgggagctgattttgccagtcgctcagccaatcgttgttccggttgatgatgaaaatatgctggcgtgtaatgaatcaacttggctgcctgttcctgaatggccttaacaacgcgagggtgcgtatggcccacgttaatggccgaagcactggctaacaaatcgatgtattggttgccatcaacatcggtaagcatggccccgtgagcatggtcaataactaaatcatagtaattgattcgtgccgccgtcgccatataatggtcttcacgttcaataagttgctgatccaaacgatggttttgactaatcattcgcaagcctccattaatttaataagacttattttaatcatattttaatttatatgcaagtccttgcgcccatatttttgtttacaaatacccgtctttaccagcatagccctagctttagcgttaatcaattttttaattaataagatgtaaattaaaaaaatcaccggttcattcaaccaattgctaacagcgaatcaacaagctaggatcattttaaattgtgaacgcgaccaccaaacttgccttgctggtcgccatcattttcctcagctcacctgctgcgcgcgaggtccgtggcgtgctagtgcacgttgggaatgggcgctcccacattgaacgacaccgctcagtgccacataagcggtaagaaaaaacgattatcatccgtcccctatcaagggtcagacaacaatcgtttgtttactcagtctcacttggccttaggttttaagtaagcggctaggccccaacagactagccctaagacggtcgttgccaccagcaaacgcaagctttctagatttagcccccgtacggaccaaggatggtaagtttgcatcatagtaggcaccgtggcggcctgcgctaattcgcagccggtcagccaacccgtgaaactcgcaatgatgattgccaacacgcggcaacgtgttaacgatctgattccgtcgtacttgacttgtaactgatagcgtgttttcatcgaaaaatcactccctcgtgaattcgcgacctcgcggcaatttgattagcctgaatataacacgtgagcatcgtgccccccaaccgtcaagtaccattcacaaagtatctttacagtaagtaactttcatcacgccgctttacattgtgaatgtaatcgtcgtcccccgggtcatcacgggctgctcgggtgctggtaacattcccgcttgaccagctttaagccgctgagctgctaagtgcgtaacggccgcatactgagtcgttgtgattggcaccgagcagattcgctttgttcgtgactgctcaaattgataccactgtgcggcacgtaatggcactggatgccgctgtaaatcccccacatgaattttaaacgttgattgacgggtcacaattggggctggtagccagacccaccgtgttattgcttgtcccatctcaccaccaccgtttcgaatttgttaccgttattatagcatagcaaaacggaccgctgcgccccattaagggcatccaacggtccgaaaattcaatgttgttttttgtagcctgatttttctaaacgtttaacttgattttgtaaatgatcgaccttcgtcgtcaacgtgtcaattttaatcagtagttgtcgcagctcgtcatcatgctgtggttcctcgatcgtgacattctgactggcttgcgttgtgaagaagtcagtaatcgtactcgttaacaaaccaataaaaccaattccaccgaacatcagcccgaccgcgatcactttgccaacggcagtatggggcgtatcgtcaccataacccacggtagtcgccgttgtgatggcccaccacagtgaatctgacaggctttgatgctcgaaaacggaaaagagcaacgcactaagaacaataatcgcaatactaattgaaaacaggtagataaacccggtgctatagataaagcggtgaaaatcgtgcgtccacttaccatccagtccgagcttccagaacaaatggtgatattggaccatccgtgccaaacgcccaagtcgaaagagtgcaaacaccgggtgcatgggaataatccccatcaaatcgaacgctgaatgaatgagaaaagtcttccgatctcgagaacgaattaggcgcacaaagtagtccaccgcaaacatgactaataagccgttactgatgcgggtttcaacgtgccaatcaccgatatgaaacgataataggatcacgttaactgctgaccagagtgtcaaaagtgtgacaattaagtgatacaccgcaattcttcgttgctgtcgctgttctgtttccatcctgcttacccctattttataaactggtaataatatagtccactttcataaaaataaccacgataagtgcgaaaaattaagtgagctttactaattcgttacaaccaagtccctaaaacaaatagcactgggtatagaatgaagaacagcgaggcactcttgaccgtcgtaataaacgtcttctttttatcttgcacctcaaagaacgggcgcataccttgccacataattggtagtaagagtacgacccaaatcgtaacaatgggtgctagtcccagtaagacgttcacgagcggccaaatgccaccaataattaaaaacgcttgaatcagccgtaccgaacctggcttaccaaggtagtaggccaaggtgtagcgatgattcaaaatatcttcatcacggtccgctgtgttattagccagttgtaggcaaaagaaaatcagggtcagtggtaaacatagtaagaaagtcgtcccaacgatcgaccaagtcaacggatgctgtccatacgtcgatacgaccacacaggtcaattcaattaaaaatgcaattgctaacgccacgaccgtctcacacagcggggtcgcgttgattggatagggcccagctgtgtaaaaaataccaatcacatagccaactaatccaaggacgagcactaaccacccagtccgcatgacaagccagattccgggaatcaatgaaatcaggtacaatcccaatgctaagcggccgacacccgctacgggtaactgcaagcgaccaatcggattcgtcttctgcgcatagccttcccgatcacgagcatgccgataatcataataattatcagaaacattgacggctaaatcaaaaataaatacgctaactaaacacagcgtcacgttaagccaattcaccgtacctaagtgatattgcgcaatggcgcttccgagaacaaaccacatgatattaagtggtgccgtataaatttctgtcagctcatagaatactggccaagttagccattttttaaacattttaacaactcccccaccggttatttaaatcgttaattatctattgggaccttattgaccatcgtcaccgtcgaagactttaactatcaaattttaacaaacttcacgcctaacgcaagcaaagcggatagatttaacaaaaaaattaggaccagtatgcaaccggtcacttggaaatcccacgccacatgctggcacccctgctagccatcttcagaccagcgtaatgacttcatagcagccattaacatccttcaatgataagtataccgtaactaataaattcatactgcccattttagcactgatcctagtcaaacgttgacacaagcccttcgacgacagcagcagacccaaaaaagcatttcaagagcctaactcttgaaatgctttttggtgactaatctacttggttttctccggcactgagagtgggaggtccagccgtgttaagtcagcatagctttcacgctgcacaacaagttgactatgtccctgttcacaaaaaacaacggcaggtcgtggattccgattgtagttgctagccatcgaataaccgtatgcaccagtatctaggaccgctaacacgtcgcctggtgcagtggccggtaattgctgattccagatcaacatatcacctgactcacagtatttaccagcaatcgaggctacctgttcagctggtaaggccggattcttggctaataccgcttcatacttggcctgatataaagctggccgaatattatcacccatacctccatcaacagacaaatacttccgaatgcccggaatatccttctcatcgccaatcgtatacagggtcattccagcggtagcgactaacgagcgtccaggctcgatccagatttctaacattggaacttgtttggctgcagtttgcgcgcgcgtttccttaataattgcatcgacaaaatcggttggctgtagcggatgatcttcggcagtgtacttcacgccaaagccaccccccacattcataatctgtgggtaaaaatcaagttcgcgttgccagcgagcaaactcactaacgagcttatcaacaatcatcttaaaaccattcacttcaaaaatctgtgacccaatgtgacaatgaatcccgaccagtttcaaatatggtgcggcttgcgcggctttgatagcctggtctgcttgcccactgtccaaatcaaatccaaacttagaatcggcctgaccagttgaaatgtaatcatgcgtatgcgctgagatccctggggcaatccgcaacataatcgtggtcggctgttgccgttgcgtcgtcaacgtcgtcagttgtcgtagttcaccgaaattatcgaccacgatggtaccaacaccggcatctaaggccatggttagctcggccagtgacttgttattaccgtgaaacgagacggcggccattgggaaatctgcttgttgggcggtatacaattcaccaccagaaaccacatcacaatgaatgtgttcttgggcgatcaattgatacatcgcgaccgttgcaaacgccttactagcataactgatttgatagtccacgtggttttcttcaaaaacttgcttgaatgctgcgatttcggcacgaatttcaccggtatcatagacatatagcggtgtttgatatttttttgcaagggtcaatgtatcgacgcccccgaccattaaatggtgcgccgaatttaatgcatccgtcttaatttgttcgttcacagtttaacctaccttctaaacttttaaaaaaagccggccacgtcatattcgaccggtccggcaatgaacaacctattctgcttcttcgtcgctctttaagacaccaccaacactatagcgatttttctgcatctcacttaaaatcacgtgaatgtgttctgctggtgcaccggtattcttgctgaccgcgtcagtaacatctttcaccaagtttttaagttgttcttgtgaacgaccagcaattagatcaatgtgtacgattggcatgaggccacgctcctatcttaattcactattttcgaatgttttaatcttactttaatcttttctattttgcaagccacgacgttgttgatttaacggttcttttctaatgcccagcacgctgaccaattaaggctaccttgcaaaactaatcagaagcacaaaccgaaaacccccattgatgactaaacatgctaaaattaatttaacaaaaatgattatgccacgataccgccattgactgctcgtaccgtggagaaagaaggccccatatgttgactcatcagtttaatccttattccgcctgcactagtatcctagtgggtaaaaatgccagcgcggatggttcgaccatgattggccgtaatgaagattcacgcgccgcttgggcgaaaaaaatgattatccacgcgcaccgcgaattcgaagaaccacagaccttcaagtctcaggatcaaactcatccctttaccatgaccctgccaaagattcgtgcgaaatacacagccacccctgaatggactgccgaatatggcctgttcgaggaggatggcattaacgagtacggcgtggcaatgagtgctactgaaagtgcttactgtaatacacgcgtactggctgctgacccgtatgttaaggacggcatcggtgaagaagcaatggtcactgtcaccttaccgtacattcattctgctcgtgaaggcgttgaacgtctcgggcatattattgaagaacacggcacctacgaaactaacgggattctttttagtgatgtcaacgaagtttggtacatggaaactggtgctggtcattactgggtcgcacaacgaatcccggatgatgcctatgcagtcgttgctaaccagcttgcaatccaagaaatcgactttagtgaccatgacaattatctttatgctaaagacattcgtaattttgtattagacaatcagttagcttcaatggacaatggactgaatttccgggaagtcttcggtacggccgacctttctgatcgatattacaacacgcctcgcgtttggtatggtcaaagatgctttacaccaagtgtcacccagacgcctgagtcgtttgacttaccgttcattcaacgggcggatggcttaattcatattgaccaagtccaaggctacttagcgtcccattatcaaggcacaccgtttgatcccgtcggccagggcactgctacggagaaacatcagtatcggcccatcagtctcgccaagacgcaagaatcacacgtcttacaattgcgaccggaccttcccgtcacgctgagcgagattcactggctggcgatgggtgtagccgctgaaagtgtctacgttccattctatgccggtgctacgaccactccagcagcttatcaagttgctacagaaaaatacgatgctacctcagcatactggattttcaagcacgtcggtatcctagtcgacgcccactaccatgaactacacggggaattacaaacagtacaaaaggaattggcgattcaacttggtcaccacattattgtcacggatcagcaagttgccgctttgactggcgacgaactcgctatggcactgaccaaagccaatcaaaaagccgctgaccaggccttgaacacaatgcaagctctcgccgctgacctgattactaaaagcaccgatatgtcaccgttgaattacgatactgatttaaacctataaatcacaccccctatccgtttttgagggcaaccattattgatgtggcgcggctttcggactggtcaaaatgcgcttagttccgttactatccaaataaaactcggtgcacgccgttaacctggcaatggtgtattttttcttagaaaccatcagcatgattatttctaagggaggttaccattgatgaccacgttaaagtatctacgccatagtatcctaattgcgtgttttttaaacttgatttttgccctgactcattgggccggcattgccagcgaccatctgttgatcgctacaaattacgggctcagcgccctgattattttaatggttttgttgaacacgatcgttttgacacatcatccgacaatcatgctcccccagcgacaacaaatttggctgatcaactttgctgccctactgattgcctttctgaccgagtggttatgagcattgtgcatattggttgcgttttgtcatcacttatcgcaaactaaggttaattcttatattaggaggcgctttttatgagtgatgttaacaagaagttcgatagcaagaaggaccagttgagcggcaaggccaaagaagtcgaaggtaaagtaaccggggaccgtgcacgtgaagcccagggcaaaacacaatccttaatgggcaaagctaaggacaaattagctgacgcagaagaaactgttaagggcgtcgtggatgaagctaaggataaaatgaagaagaaatctgacgattaaaatttgtcgtgggcacggcgcaaacggatggtgatcaaaatcaccatccgtttttttatgattacgccacttcaaatgagagcccccatcggcgcacacaaaaacaacttcgagtaagctagtacctcgaagtcacctgtggggctgtttagggtgatgtttaacattttttgatgccgagcgtaacagccaggctgtcaattggcactgttcaattgtgttttgaccgtcgaacccgtgcccactgaaccacgaacatcattatcagaacgacggcaattgcaccgattgcggctggtatcacagtcattccggctaactcaggccccatcggccccagcacaccttcaccaatgagtgccccaagaacgccagcaataatgtgaccgatccaaccccgcgattgactggggctcatgatagcacctgcaaaagcaccaaccgccgcgccaacaatcattacccataaccaatgcatgctgtcatcccctttttagcggcggtgtttgaactgccgcacttctcgaaacacagtcaatcctaattgcccaattgcaatcaatagtgacaatttaccccaaaaaccaggggtctgtcgtttaattttagccattacggacacctccatcttttgataacgctaacaagtgctacttcaacaaatccttttatgcctaatcacaattactgcggctgaagcgcctgggcagcaacggttccgatcacaataagtatcatcgccccgctcacgactggcaacaacgtcattccagcaactgttggcccgaaccatccaaaagacagctggccaccaagtgcaccgaataagcctgcgattaaattaattgtcgtttgacgccgaccatgtgcgcctaccgcatttgcaacgatacctattgttagtcctaatatcgcaacacctatccatcccattgtgaacacactccatcccgatattgtgtgattaaaattatcataactataatatttatattgagcaatcaaaatgctcattgacccgactaattcagtaatgatgcatatcatttccagtcaaactagtgttcaagctatactgagactatcaaaagcttactagggtccgtcttaaaactacttaagtaagatgcaaattgaggcaatgtagaccgtagccagataaacatgagcgagcttatcataacgcgttgcaat

SEQ ID NO: 6 - DNA, 192390 bp, synthetic construct
  source 1..192390: mol_type = other DNA; note = Lactobacillus plantarum PDG8 - Contig 6
aaatggcatgaccccgaaagaatttcggaatcatgccattctaaaaactgcatagctattttaattatttgaactgtctacttgactcggagcagtccccgcattagtcgtagcggtgtttttggttttattaagcttcataatccgtcaaatcagccaagaagcgttgaatcaccgcaagttctgctggtgagtagtgttcatgaaggagcgtgattgcttgatgattgcgggttgcatgcatcttatcatgatagcgggccagcttacgaccactcggcgttaagcggtagaagatctttttgtgatcatcgggttgctggaatgagccaattaagccctgcgttacgagtcgtttggctgcccgggtcacaccacctcgagtgacgccgaggttagtggctaagtcgatgcccgtttgtggaccggcctctagttcagataataaatgtaggccaacgatggaaatatccggcaacaggcggcgtagattggcttcggtgatatgctgctgtaaccatttctgttcaccagtagtggaagcacgcttggttcgaatcgttttgagctgcgttagaattgtctgttccgtggatattgacatcgattgatcccccttagatagttgtgcgtcacggcgactggttctcgtggtgattagcgtgcaattatcaattaatcattaacttttattactattattataccggttttaaaattcaccggcgagtttttctgctgctacctgtgcggcagtgatggcctgttctcgctgttctggaaattggtccaatccttcaatgaagatggttcggtaatcctgaatcccatacagttgcatcatgccacggaggtaggggtcgcctgcttcaacctggttgtgttgatcaggttggtgatagtagccacccgcagcctgaatgtgtaagacgtgtttgtcgggtaataagccgaccgggccgttgaccgtgtacttaaaagttttacgggcgactgcggttaagtctaagtattgtttgagttcggctggaagaaagtgattgtacattggattaacgaagacgatcttgtcggctgctagaaattcagctagccaggcggcgtgacggctaagtagttcagcttccactgacgttagttcttcaccgtatttttgtttacgccaagcttctaaggttgtgtcgttcaaagcgggaacgccgtcctgataaagatcgcgtgtcgtaatctcatcgttcggatgggtttgctgatacgcagttttaaaactcgctgcaacggtcagtgaaagataaaaaattccccacacattcgaaaatgcgtggggaatttaaaggatgcacgattaattttgattaaccaatgctactagcactaggttggagcgactttacgggtaaatacggtgcaacatacgtggaaacggaatggtttcgcgaacgtgatcttgcaaagtgatccaagccagaaaacgttccagacccataccgaaaccggagtgcggcaccgaaccatatttgcgtaaatcgagataccactcgtaatcctgcaagtcttgaccgctggctagtaaccgttccttcaagtagtcataatccgttgagcgttcggaaccgccgatgatttcgccgtaaccttcaggtgctaacaggtcagctgcaatgacgacatcatcgcgcgtcgggtgtgcctgcatgtaaaaggccttgattgctttgggatagtttaagacaaagactggttggtcaaagtgttctgccaaaaatgtctcttccggtgagccaaagtcgacaccccagtcgacgtcaaagccgttcgcttggagtagtgtaatagcatcgtcgtacgaaactcgcggaaatgggagcttggtgtacttttgcaacgtcgcaacatcgcggtccaaaacggccagttcgtgggggcaatggtcaatcacggcttgaacgaggtaggccaccaattgttcttggacttccagactttcatcttgatgcatccaggccatttcaggttcaagttgccagaattctgttaagtggcgacgagtcttggatttttcggcccgaaaagttggtccaaacgtgaagattttgccgaacgccattgcgccagcttcaccgtataactggccggattgtgataaataggcgtcctgaccaaagtaatcagttttgaataattcagtcgtcccttcaggagcggaaccggtcaaaatcggcgcgtcaatcttaataaaaccgcggtcattgaagaactcataaacggctcgaatgacctcgttgcgaatccgcataattgcgttgggacgcgatgaccgtagccaaagatggcgatgatccaacaggaaatcaataccatggtccttgggcgtgatcgggtagtcgtgactagtcccaaccacttcaaattgtgagatggcaagctcgtagccaaagggggaacgggtatctgcatgaatcgtgccggtgacccagaggctagtttcttgcgcgaggtcggtcagttgtgcaaaagctgtttcaccgagctcgtttttgagagctactccttgaaaagttgctgtgccatcgcgtaattgaagaaaggcaattttgccgctagaacgcttattactgagccacaccccaattttaacttgttcattgacatggtcagcggcgttgataatactaatggtttccatgatattgatcactccttcttgttggattttaaatcagattaaagtaaatgaatgttatgttcggtacattggtcgatcatggcttgtggccacaaggcagcttgtacttcaccgacatgggctttgccaagtaataacatgcagagccgtgattgaccaatcccgccaccgatcgtgtaagggacgtccgcgttcaagatcatttggtggtatggcaagctaagccgatcttcggcgtccacgtctttaagttgtttcttcattgattcagcatcgacccggattcccatacttgagatttcgatagcttggtctaatggttcataccagaagaggatatcaccgttcaacttccagtcatcatagtcgggggcgcggccatcgtgacgttcgccggaatcaagcttccagccaatttgcattaagaagacacagccgagtttcttgcaaatggcgttttcgcgttcgcgcggcgtcatgtcagggtacatgtcttcgagctcttgtgtggttaaaaagtgaatttcgtctggtaagtggtgaacggcctgtgggaacttgtaccaaacttcgtgttccatgtgcttgatcactttaaagatttgacgtaccgtggctttcaaagtttcaacggttcgttcttccttactgatcactttttcccaatcccattgatcgacgtaggcggagtggtagttgtctaaatcttcatccttacgaatagcgttcatgttcgtgtagagaccttcatgcatgtcaaaaccgtagcgctttaaagcgacccgtttccacttagcaagtgagtgaacgatttcgatttgttcatcacccatgtcttgcatagtgaaggagacaggcttttcgacaccatttaagttatcgttcagaccagttttcttttcaacgaacatcggtgctgaaagccgagataagtttagttgcttcccaaattcatcttggaacgtttcacgaatgtaacgaatggcctgttgggtttctttaacggataatttaggatcgtaatcctttggaataattaaatgcatatgcgtggtctcctttaaaataagttcagattttagttacaggataaaagaaaagagccttccatcccttgaattatcaagggacgaaagactctttcgcggtaccacccaagttgtttaccttacagtaaaccagctttaaaatagtgtacaaacatacaccaccgatggtaacgtaccggttaacggctaatcctactttaacgaggttatttcagttagcaactaagaaagtgtttttcggattagtcaagttctggtcgggtttccactcactcccgattcactggcaggttgactaatcgtactcctctttcctccgtttttatcttgtgacatttatattagcacgattctggtatttgtaaaccactaaattaaaaataaattagtttagtctcatgaattcaccataaaaatcttagctaaaaccgcaagctaacgggcttaattaatcgttcaaattataacgtaatttcattttttcagaaccggcaatgaccatatcgccgagtaatttagtttgtaacttcatcgcggtatcggccaattgttggttagccgtttcaagataggccgtgacgtcttggtggttagccaagtcagcgtcggtatcattctcgattttacggtaagcactcatggcttcgagttcgtaactattccgcatatccacgtaaaagtcgtagtcggtgtcacccaaaagggcggttgtacagcttaaccagtacatgtggttgagattaaaggtgccgtccgcatctttgtagctagctggcgtgtcattgacatttgcatagaatggtacgaccgtgttgaaggtattggcaccaaaggctaaccagtgaataccggcaacagcagcggggacgttgttgcgaatctgtaagatgtgcacatcgtggttacggttgatcccgattggccggaaaagagttttgtcagcttcagagccacttccgtaaacatcgtatttcgtgttttcaaagtgagaactcaaaacgaacttgacgtcttcgatagaaatcttacggttagcatggcagatgaatggtaagtcttgttccattggatcttgtacaacgtccggcgtgaagtatttctgaccgaaccaagcccgggggttgttgtaaaccgtatctttgattgaagcactcccaaagatatgccgcaagttgacacggtcaaagtcaggattcaagtggtaatcttcaatcaattgttcaaggtcagctgaagctaaggtatcatcagcgttaaaatcgaaatcgtcaatattcatgcggttcggagcaaccacgtaagcatcgtcaggaatacgtttagcagcccagtggtgaccaccaatggtttctaaccaccagatttcgtcttgatcagaaaaagcgataccgtttggttcgtaagtcccgtattgttcaagcagggcacctagacgagtaacgccttccttggcgctgtgaatgtatggtaatactagggtgcaaaggtcttcttcaccaattccgccggcaacgaagggatcgattcccaagatacgcgagttcgtggtgatggtttcggttgcggacatggcgatgttctcactgttgatccctgctgctggccaggtcccattggtcaagattgagttgggaattgaagtataccgtaagggattgtcaggtaagtcgacttcgaccttactaatgacggactgatagtgccggggttgatctgcgggattgaccacaactaatcgttcggggtctagggcttcgtgaccatcatcgtttcgtgaaataatggtcgagccatcgattgaggcttttttaccgacgagaatcgtggtacatgaacctttaatacgtttttccatgatattaaaacactccttttaagctattaatatcattatacgctttctgagcgggtcgcgatagaacgggcttttttgagaatataattaatcccgctaatactaaaaccggtggccgccgcaatttcacggtaagtcttgccacgtgcccgtaactggtgaacttgcgcgtggctggcatgttgtggtgtggggctaggcgtctggattgacggaaccatcgctggcaccgtagctggtagtgcgaccggtgcaggcggtgtagtgattaccggcgtttggtgagttagttcagcaagcttaaccatgactaattcagttgtctgaacatcccaaatggcgttatgctggtgtggattactgatattaaagagtgcggctaagccatttaatggcagatcatggctaccgaccttatggttgccacgattgatcaaggtattcgtataggcttgggcatcaaaaatcgtgaccgggcgactgactagctgctgttcggtgggggtcaattgctgataatactgagttagtaataatcgaatgtgtttcatgtcctgtgtctgatcccaaaaaacgagggggagttgtggctggataacttgctggataaatgcttttagaatcgtcaaggggtcgccttgtgcctcgtaagcgacggtcgttaagccagttgctgataaaccggccaactttttgtcaggtaaaaagttaggatcatcgaagtaacgattgaaaaaaagcgctgtctgcgtatgatgggaaaaaccgatggcactgagctggaagatactagcccgtaattcgggtgattcgatgatgtgccaactgacggctttagcggagccattacgacgaaagcgagtgccgaactcgcagtcgatgattacgtaagcggtcggacattcactcagttccgttggtgaaggtaggatcgtgggttggcttagtacactggccggctgcgcagggggaaactggtatcccagcgtcgccagaaattgaacggtatcctgcccgagctggttattggttactttagcgaccttcttttcagttaagacaatttctttgcgcatcacgaataaaatatgatagcgctgctgttcatcacagataatttcggtcacgttgccggcaaggctgtattctgaagcgagtgctaattgatggtccttttgaatacggtaaacgggatggttgacaaagtatagacaattcaagttatttgagatcttacgctcaagtaaggttaggttcgttggcatcatcgacaacagctcctctgatctaagtacttatattttagcggctttgtacattagctggctagtgtttgcactgcagatcgaaccatgaatttggtaatcacgaattggtgcctggtgttatagtgaccgtagagtgctagttgtgcgtcaggttggagttggtaaaataaagtcaacgcatgcttgacgatgatgcaattgatgggcgtaggttcggtcgcctttaatggcgtgacttgtaagtacaacataaaggggtccaactttaatatcttgcttttatttaaatacttaacggttagattttctgactgcatgctaatcacctcaatactagtatacgaacatacgttcttgaatgcaagcaaaataactgcgttaacaaatttattttaagatgagcactaggtgcactggactgattcgaaataatttattaaaaatcgcaacgaatcaggcaagtcacggggaaaaagctacaaaaaattgagaactcttggtatgatgaatagtagtgaatgagaggaggccgagtcatggatcgaggacgacgcgcaacgctggaagaacgaattgcgatcgtaaagtatacgctggaccattgcaacgattatcgagaagccgctaagcattttaatgtttcgtatccacaagtctatacatgggtacgaaaatatcgacaacacggcatggaaggtttggtggatcaccgtggccgacccaagcaaggctaagtcagcattgtacatataaactgtgtgggcgagtgccctttgatggccaatctgacatggtcgtttaatcgatatcggtctctttaaagtgtccgttcctataaaatcaatagggacgggcacttttcggtattttgatagttttcgtggcgcaagtgcgacttaacgtacctagtgattaccggggcgcgttcttgtcatgggccggtattctcggtagaatgagagtattaattcaaagagggagtttacgtgtgatgattgacttagcggcggcacagcaagtattaaagaccacgttcggatatgatgaattccgaccggggcaaaaagcagtgattgaacaagtgttggccggtgaaaacaccctagcgattatgccgactgggggtggtaaatcattatgttaccaaatcccagcgttactttttcaggggctgaccgtcgttgtctcaccattgatttctttaatgaaagatcaggtagacgcgttaaatgataatggcatcgcggcgacttttattaacagttcactggatttccaagagattaacgaacggctccaagaactacgggcgggggattataccttactttacgtggcacccgagcggttagattcggattactttattcaagcgctgggccggttgcccattcaactgttagcaattgatgaggcccactgtatttcacagtgggggcacgattttcgccctagttatttagcgctcagcacggcgatcgaacaattgccgacccatccgcaagttctagctttaacggcgacggcaactgagcaagttgctgcggatatttgcggccgcttagcgatcgatccacaacatgaagtgaatactggttttgcccgcgataacttggatttgacggtggtcaaggaccaagacacggaccgttacattttagattatttgaaagttaatcatggtgaagccgggattatttacgccagcacccgtaaagaagtgatgcgtctgacgagtttgttgcaaaagcatgatattaaggccacgccgtaccacgctgggctagatgatgcggttcggcggcaaaaccaagaggatttcttgtacgaccgtgttgacgtcatggtggcaaccaacgcgtttggaatgggcattgataagagtaacgtgcgttttgtgattcacgctcaggtccccggaactttggaagcttattatcaggaagccggtcgggctggccgggatgggttacctagtgaagcgattttgatttttcgaccggttgatattcaacttcagcacttctttattgatgagtcggagatggatacggagcaccgacacctggcgtatcagaagctacaggtgatgacacggtatgcgaatacccagggctgtttacaacagtttatcttgaaatactttggtgaaaaatccgcgccgtgtggtcggtgtagtaattgtactgatcagcgggagtcacaggatatcaccacggcagctcaacaagtcttatcgtgcgtcgttaggcttcattcccggttcggtaaaggggtcgtggcccaggtattgacgggcgctaataatcaacgggtccgcgaatcgaacctcaatacgttgtcgacgtacgggttgatgtccgggcagcgacagaagagtgtcgtggaactgatcgattttttgactgcgagcggttatttgcagtcggtgggtggtcagtatccaacgctgacagtctcagcgagtggagtggccgtgcttaaaggaacgaccacggtacaccgaaagacggcccaaaaggtgcagcagacggtgccagagaacagtgccctcttcgaacaattgcggacacttcggcgccaattggcggaagaacagggcgtaccaccatttgtgattttttctgaccggacgcttcattcgatgtgtgacctgatgccagaagacgacgcagctttcttaacggtcaaaggggtcgggaccagcaaacttgaaaagtatggtgaaacctttatggcgacgattcgagcggcagctcatgcggaatcagcaactagcaccgatgaggaaaccgattagatggctgattggtaaactacgagatgaaatggagtaacacgtatggaatttacttggcaacaccagggacaaccaatggcaatgaaacgattcttgacgacgcatgccatcagtatgcgaacaatcaaggcaatcaagcatggcaccggcgcgtttcttgtcaataatcaagttcaaacgggcgttattaccattcatgatggcgatattgcgggaattcaactaccagacgaggcaccggatacagcggtagtcgtcagcgaacaaccaatccaaattgagtatgaagatgctaattggctcgttcttaataaaccagccgggttaaccagcgtgccggggcctagtaatcggaccgatacgttggtcaatcgaatcaagggttatttgatagccagtcatgccagtaatcaacgaccgcacctgatcacgcggttggaccgggatacgagtggccttgtgttagttgctaaacatcgggtggcgcaggggatgctgacagagccccgaattgcggcgcaattagtgaagacgtatcaagcttggatcgaagggaccattacgccggctagtggcacaattgatcgcccgattggccgggtggctgacagtcctcggcgagtggtcactacggcgggccaacgtgccattacgacgtatcaagtggaggcggaccaattgcagcataacgtgagtcggttacggttggaacttgtgactggacggacgcatcaaattcgggttcatctaacggcgcttgggcaccccttattaggtgatacgctgtatggcggtaacttggcgtggattcaacggcaagccttacacgccgctagtttacagttctttgaccccttttcggaacagactttacactttgaggcggcattgccagctgatctgcaagccttgaatcacgactaagttcagtttaggatcagtgaccatccggatgaatggttaataaaaatcggcactgctagaatgcgttgaacattctggcagtgccgatttttggttggcaaccgtctaaaatcaagctaacgtttagcgggtaagttgcaggcccgcgttatcctgaaggctgcggtgactattgaatgaggcgctagtgcttacgactgactaagtggcgcgttatcagccgttagcgtcgcaaaagttgcctgtaattgctgtaatggtgcggttaacgtgagaaaataaatatgctcgaccccgttactacgcatatcaatgaccccagcttcacgcattaagcgtagatgatgtgaaacggcggggcgtgaaatattgaccaaggcggtaatatcagtaacgttgagaccattatcactgttccccagagcaatgataatctgacgccgaattttttcggcgaaaatattaattagtgtggcactttcaataagtgccgtttcggattgttgaaaattagccatggtgactgcgtcctttcaaattcaatttacacttaaggactaactccccccatcggcagtacgctgaattagttgttaagtgttggtatgacagctcgatgttcaagttctggtgaaatagttgcagccaagaaaactttaagtctacaagttgtcagttagactaattgttattggaacgttcgtacttatgtataattaaagcaagtcgttaatcgattgtcaaacctttttgttaaaagtaagtactattagcgggcttaacaattgttgttcgtttgataaccatatttttatgttgaaatgcgttaaaataaaaatagcttttgaatgaatgatgggagtggaaaatgtgaaagtcttaggaatattaggtgcgcatcgcgctgatggcgtgactgcccagctactgcaatccgtcttaaagggggccgcggccagcgctgacacggaactagtcaacctcaacgattatgagttgcgaccagatcacgatagtcaaccgaatgctgacttagacgcgctggaagcaaaattaatggcggcggatgtctgggtattagctgcaccaacctatttggggagcttatcgggggtaatgaaaaacttctgtgactgttttcgggggcggatcgcacggtttaattccgtgggtgaagcagtacctgatcgctttaagaacaagcattatgtgacgatcacggattgttacgcgggtggtattgaaaattatttgaccggcgtgactgacgcaacgtttaaaacacttgataaatttttgacgatgggtggtctcatcaaattacgggagattgtcgtaactaaaacgtggggtatgcaaaccatcacagctgctaagcaagcagaatgtgaacgggtcggcgcgcgggctgcacataaaaaggaaagggatgacagtacggtgaaacggtatattcaattattcttcatgattgcggtgatggcactactaacaatgggaatcgaagcggggattcaacaattgattccgctgaacaatttttgggcctactacggcgtctttgtcgtcgtcttttatgttcttttagcaatgattttacatttcttcactgttgttaaacaccggcgtcgttaagggatacggcatgtgcattcagcaacaacgacattaaaattcaattgattagcaagctgggcttggcgtcttaatcgccggaggtcagcttgttttgctataataagaacaattacgaagtaccagcgattatttcagtgtccacgcgtataattaatatggtatcgtcgaattagaaaatgaggacacttggtactggttgccaggcgtatgaaccataattaaaacatgttaaattagatgaatttttatttggcagcatgctgtgattggtttcggttttggcgcatccaagctgccggtttttgaatctaactttgtcaaaaactaatcattggtcatgcccaaaaatgtgttattgatttcaaaattaattttgttaaataaaggctgtcaatcaaggtacgaggaggaatagcatgcaagtttttggacaatttattgcaacagtcggttggctaggattggcactagtcgccagcgaactaggtgcgacgttaatccattggctcggtcagtgggtcggatttcgattaattggtgctcgaattgtccggattaccggttttcgacttcaattaagtcgggttcgtggtcattggaaattagaacgaccgctgacgcgtcatccacatatcgtggcagcaccctcggcggatgccaaacggttcaatcacgccatttattgttttggcggtggcctgttcaacttactgacggtcatgctcagtttaataactctgaatcaatttaagtttagtttcgatttatggttgtttgcgttcattatttggatctgggtcaatacgttgaaagccgcccaattattaccaatgaacttgcacggttatcccacggcgggacaggaatttcggcaggcacgcgaatcaacggcggcgatgaccgccgcgtatgtcactgcgtgtgctgcggccgttaaggttcagaccggtagtgtccgtgaccttgatgcgagtatgattgttatgccgcgcgatggtggcaatcggaattatttagtcgtccggcaagcatggttgattctggaatggggacttcaacatgggctggacacctccgaactgttagcggggttgagtcgcttggagccaagtttcaatacgttgccgccagctgatttggcgaagtatttagatgcaacattgtactggaacttggtcaccaatcatcgtgacccccagatcatagcctggtatcaagatgatggtgttcaacagttattacgtcgctaccaacctttggctcattataagttaactgccgtttatgaatggcgggtccatcagcagcccgaacaggccctagaattgattgaaaagggactaaaaattgctcagcgcctccacgatgaggaagaaattgcttggctgaaagctttacgcgttcaagtaacggcctagattaccgtagaaacttagattctgttaaagattgccagaatcgaagtttgtattggaaaatgggtggtaaactggtgaccattgaagtgaaaaaaggtgaaaatgtgaaacagcgaatcaagcaacggtgggggttgtggttaacactgctggtgattgttttaggactaatcggggttggattgacccgggttaatgcgggactttatcagcagacagttgcacaagtgacccacgtgcagactaagagtcgaagcacgacgacggatgaatttgaaaataaggatgcgacagtgacacagttggtaacggtccgggtgctcaataaggcacatcgtggtcgaacttaccagatcaagaatacgtatacgcgctcgggcgcaatggatcagacgtatcacgtccgtaatcaagttttcttacggattcctagtgatcatagtagtgcagtgacgattcaggggttaaaacgagataccgccttggcgtttgtcgcgtggttagccctagcactgctcttgttaatcatgcgtttcagtggtctgatggcctttttgagtgtcgcgctcaacgctgtactattttatgccgccattcagatcgatttagctactaatggtggccacatttacctgctctttggcgtattggccgtaatcttcgccgtgctcacactgttgctagtgctcggttttagtcgtcaaatgttagtaacattgggcgcgactgtggttggcacgggactggctgtcattattagtctgatcgtctttgcggtgacccatgagcgtggtgtgacttatgaatcgatgcagtacgtgacgcaggtgccccgaccgctatttttagtcgaaacagttctcggttcactcggagcagtcatggatgaatcaacagatattgttgcttcattgtttcaattgaaaacggagcgcccggacattgcaccacgacaagtatttaagtcgggtattcaaattggccggtctattatgggacccttgatcaacgtgctatttttgattttcatggcggatactttcgcgatgactttgctctatttccgtaacggtaatagctggggttacacttttacaatgaatatgtcgttggggatggtccaaagtttgatttctggtatcggtatcgttttagcgattccagtagccagttggttagccagtcgattgatgcctaaggcggtgatggcatgaacacgattaccgttttaggattgatcttactaggattgatgacattaattggtggtaagactggagcgacggcctttttgagtttgttatttaactttggattgttgtttttagccgttgttttgatttcatggggctttccagcaatgggggtgtcgttggtcattgggacaatcatcttggccttcacgattttctttggggaggacaacgaagtggcggccaagccagcttatattgcagcattgattgttatggtcattttagtgctgattatttttcccgttgaaaattggatcatggcgcagggctttagtttagaagatagtgaagatctggaaggtatgtcgttagccattggggtctcctttattggcgtagcagtaactgaagcaattttaagtacactaggggccattgcggaagctgctattgcgattgcggctggtctgagtgaaattctggcgcagcatccgcagttgccaactaagcgactctatatcgatggtatcagtattggtaagcagattatcgggacgacttttaataccttgtttttcggcttttttggtggcttcttggcgctatttatctggtttgcgggcttacattattccttcgggagtgttatcaataataaaatatttgttgcggaagtattaatggtattattctcgttaattggcgttatcctggtagttcccgtcacgacgtgggtgatgacgattcaacatcggcaacaaattaagcacaacgattgacgatgaccgcgggatttgctacggttgagaaaacagttgggagcgttgtgatgatggaaattcgaacggcacaaccgcaagatagtgctcaaattgcaccattgattgcgatgatttaccgtgatatggaaatgccagtcttaaaaaatgttagcgaggccgacctattggcaatgttgactgagttgtatcagcgaccggccaatttagatgggttagcgcagacttttgtggcggtcatggctcacaaaatcgtcggtgtcgcgtttgggcacttagcgaagaatgaagtcgctgtaaacgatttgttgcggacgacttcaggtcatcatgcggggtttgaggcaccactggaattaggtggtgagacccggccgaatgagtggtatttaagcatgttggcagttgatccgcaagctcagggccacggagttggtagtgccttactagaagcattaccaggactcgttggtcaactgggggccacgaaactgagtttaaacgttgatgatggcaatccccgagcagctaagttataccaccggcatggttttgtcccggatggtcagctcatgattggcacacatccgtaccagcacttggttaagcctttatcataataactgaaatatcgtggtgtgtttcttagaccacggtatttttttacgtcattatggcactgaagacttttctattgagcatgacacagttagaattaaactattgaacggattaggaaggtgaacgtgccatgcagatctatttcattcgtcacggtcgaacacaatataacttagaacaccgatttcaaggtggacgagcagattccccgctggttgctagcggaatcgatggggcaaaggccgctggtgattacttaagcaccacccaattttcagcagtatatagcagtccgcagcaacgagcgctggatacggcgaaatacattgtggctgccaatcagtggcaaccgccgattcaaatcgacgatggcttgcgtgagtttgattttggtgattgggacggcaaacaggaagcggaagtacagccgcagtcctacgcccaagttatttttactaaacctgccgaataccgaccggaactagctggcggtggcgaaagttatgcggattttgtcacccgaacgacttcgacgctacatcgtttgattgatcaagttggggtagctagcacgcaaccactattaatcgtatcgcacggtctggtgacgacgatgactgtcaaggcgttaatgggtgtccccgtagcagaattacgagcaccttttgtggtcgatgggcaagttatgaagacagtgggccacggtatcgtggataatgatagcctgacagtgttatcgacgacggataatcagcattttgaactgacgacttggaatgaaaccgggtacttgaagtaaatggctgagtaataatatgaaaaactagtattgtgatgcaacgaaatattgcagacaatactagtttttttattagttacataatgacgttactaagcaagaaagtcagttgcttctagtacccgtacacaagcgtcatgcttaatgtgccgctgagcaacggaaagatatcctgattggagatcacgatgatacaagattaattcattactattttgattagcgcacagtaagtaatgattatctttgctcaggctaaagtcacgagggaatacgccttcagttttaatttgttgaattttttccaactggcgaccattatcaagaatttgataaacggtgagtgagttgtgcccgcggtttgagacatataggaagcgttcgtcagcagataaacggatggccgctgaaccattgtgtccgacatagccttctggaatgtttgaatagtcatttaaccaagtgattcgaccagtatcgtggtcgtattcagcaactgcgacacgactggcaacttcaccgagtacgtaaatataatttgatttttgagcgatggcaatttgacgaggcccaaaaccgggtttggtatcgaagtcagtgacgagcgttaactcaccattgtccgcaacatcgtaaacaaatagtttgtcgcagccaaggccacaaacaatcaagcggccatcgggtaataggcgggtaaagtgaatatgagcgtggccttgttctacttcgggaccggagccttcaataggatagttatgctgactagtaatgtgccattgattatcaagtttaaacgtgtgcacagcgttggtattgtagttggcagcaaagataatgcgacgctgtgcgtctaggtagacgtatgaggggacggtatagctcagttcattccaaaagtaacgattagtactggcgtcataagcttcgtatgcgggtgtaacacctttctgtacgagcattttagtatcaatcagttttccttcgctttgggtggtatcgatgataccaacgccaccggtattctcattcttggtcagaacagtcactaatttatggttggacttattgctgtcgaaattgaagaatgctggattatccaacttaacatatggctcaatcgatacgattttggcttcgtctgtgtctaaagttgccacgtagataccctcagattgattgttgggtgtgtaattgtcactggtgtagccaccaattaagaatttgtctagcatgattatggcttcctttcaatctactgtaaataattgtgattttgcaatggtttccggtgtcagttcttggcctagtcctgggtgatcagggaccttgaagacgccgttttctggttgatagtcgtgaatacaagttcgacgatcattttcgttaagtgcacgttgatattgctcatgaatgacgaaattagaaatagctgcctcagtctgtagtgctgctgccgtggcaatcggactgccacaaacatgaatctgtgcattgatgtcgtaaatctctgccatatcacagatttttttagcttctgagataccgccacaaaggcataaatctggctgaacaactttaatagcacgcttctcaaataattcacgaaatccccagcgtgtaaagacccgttcaccagcggcaattgggatgttgacgtgttgagcaatttccagcgtgttgtctggatttagcggactaaccggttcttcgtaataccagatgcgtaatggttccagcaactggccaatttgaattgcagcggttgtgtcagtattggcgtgcatatcgataataatatctaaatcatcaccaccagcatcacgcattgctttcacacggtcataagtagtttgcattacttgagttgtcagcggaccagttgtgtgccagttgcccccgccatcagcttgattgctgaaaataatgggatcgaatttcagtgcatcgtatccttcattcattactttacgtgtaacttcggcatagtcctcgggagtaagtagtcgttctttttcaatgtgcgctccccaattatattgtagttggcttgcatatgttctcagatggtcgttggttttaccgcctagtagttgataaattggtgtttggtagtatttccccttaatgtcccagagtgcaatatcaattgcactgatggcagcatttacggctacgccaccagcaaggccccagtaggtcgtagtttgtaattgatgccagattttttcaatattcaagggattttccccaataatgacatgacaaaaatcttgtagcattcctaaaccaccacgccagcctttaccgtaagctagtccagcttcaccgaaaccggagataccagtatctgtatttaatcgaaggacaattggcgaccaatcttccgttgaccccttagagttaccactgaaactaggatcagtacttgggacttgcataacatcggcactgataattttcatgaaaaagcctcctatgaaattagctgatttgtaaagcgctttcaatgattagtatagatactttgtgaatcttgttacagagattaaacggacgtcaggggaactaatagttactgtaatatcgaaaaagacatcgttagaataaagttatcgatatagtctaggttgaaaatgaaggaataatggctgtgagaaatctttttttgaaagtaaaagtgaaaataatcacaaaaaatgagggtgatttgaatgccaattttaattattgcgctaggggttgcaattctagtttttctaattgttaaattgaaactgaacacatttgtttcgttggtgactgtttcgttagttgttggactattgttaggaatacccattggaaaaattaatacagttattgaagatggcattggtagtcagcttggtagtttagccattgtttttggattgggtgcaatgctgggacgtttaattgcagattctggagcggggttccggattgccatggtactaagtagaaaatttggtcgacggtgcattgaatgggcagtagtgcttgcttcattcattattggcctggcgttgttcttcgaagtcggtctggttgttctattaccgattatcttcgtgattgccaatgagttaaatattgccatgttgtatttagcgattcctatggccgctgctttgaatgttgcgcatgccttcttgccaccgcatccggcgcctgttgcaattgcttcaatttttaatgtgcctttaggccatgtgttagcattaggtgtactagcagcaataccaacggtcatcgtcgctggaccactgtacaatcatttcttgcatcgtatttatccaactgtttatcgagtgaaaagtgttagtaaagttatgggacagtatcattctttcgagttagcggagacacctaattttggtgttagtgtcgttacagcaacaatgccaatcatcttaattgttgttgcaacgatttcaaagtacctgttgccatcgagcagtgcgattagccgaattgtccagtttattggttcaccggataatgccatgttaattgcgctattgtgtgcagtttatctgttaggattaaagcgacaggttccgatgaagaaaattgggaagtcaatgcgaactgctattgagcaaattgcaatgatgctcttcattattggtggtggtggggcatttaagcaagttttggttactggcggtgttgcgaaatatgtggccacactatttgtttcagtccattggtcaccaataatcgcggcatgggtaatgactgcggtactgagagcttgtattggttccacaacggtagccgcgctgaccggagcagggctggcggtaccactgctgcagtcttctagtgttaatgccgctttgatggttttagcagttggtgcgggatcagtattttgtgaccatgtcaacggtgctggtttttggatgattaagcaatactttgatttgagtttgaaagagacactgttaacttggacgccactgactatgttaatgtcagtggttggtctcggatgtgtgctcgtgttatcattattcttttagagtcagtaattatgaaccttaagtaagtcgattgtgtctcggatagacagcaatcgactttttgattttgtatgtccccagaatgagcaataattctggaagcaaaggtagaccagaaaccgcactataaatactgctttgggaaatattagaatcctggtagcttgagaagcttcacaattaatgataaatcgggttagtgtcgctgacccaagtagctccatatttggaataatgcagagcattgagcttgatttctcattcaagattagtaaaactcttaaatacggatatgcaaatgtgggtgtttttggtgttgtaaggcgacgttaagaatggcagatctttaaccgtggctaaatcctgaaataatgctagcctcaaaagtggggtgtgtgcatagttacagactgcaaagcattatatgttgttggtacatcattattaatgttaataagatatgtcgatggtatgtcgtaaacggcctgagagctaataaaaccccacctagcatgtaattgttaggtggggctaatttgatgactgaagttaagcgttaaacaacacctaacaactgccatacgggaacacagcacaacagtccaacgatattaatgaccatgtaacctagggatgaagaagccaatgatcctttcgaagccattgaattattaacggcagcagatccaattagaaatggggcgtccatatacgataacaaccagatattgacgctagttgtaacaataaatacaatcacggccggattgaaaggtgttgtttggaaaaatggcaataatgcaatgataattaaggtcccagtggaaatgagcgagacgaccacaaacttgcagatatagatgatgattggtaaaacaattacggtaatccaaatattacctaaaatcgggctgattactggctttaggatgacccgcaaccaagaagttaagccaacagtctgcatcacatttcctaaggccatgacggtaccgataaagatgattgtgttccaacttaaacgtgtcttgaagtcatttggtgtcaaaactttggttgcaacgagcacgctgacacctactaatgccgtgacggcagctgggatattgactgtggattccaaaatccagaagacgattgcaacaagaataacggcaccggtaattttttcatctcgtgacattggtcccaaatctgtgagttgttgattgatgaacgacttggaaaccgtttgatcatttcgtggcttgaacagccaacgcaataagaagtagccaccaactagcgcaataatcgtccagggcagcatcattacgaaccagtttccccaagttaatactgactgaaatttattgggcaacagtcctttgaaagcataattttgagcagtagcacttagaaaactggcttccattaccaggaatccccagatagcggctaagaatagtcccgaactacctttactcatcggtttgtatcctagcgcattactgattccttgcgcgattggtgtactcattgcagttttggggtgtgcacttggaatcattggtgaaataattgttccggcagtaaagagtgctaaagtttgaccactgaagtttgcaggaaaccaggacatgatttttagtgcaattctattaattagaccagttttggttgctgctgcgccaaggcccaatccaccaataataatccacatagtggtggttgaaaaaatattaaaggcggttggaaagtcggtggcgcctaaaataacccatgacgaaagcattaacaaaccagttgcaaaacttggaataacgttaaaaatccaaaaaatattggcagtaactagcgaggccaaaacaatcatgcctgcatgtgtaagtccatgcggggttgggataacaaatgtgatgactaatcccaaagcgatgccgattaaccctgcaatccatttagtatgtttcataatgcttacctaccttagttggcaaaaacgtcagggttaactggaaattgtggtaacttaccatttgaaaagtcgataattgcttgggcagcaccgatgccaagtgcggcgttagcctccttggttgttccagcaatatggcttgtcaaaacggtatttttgctggtgaataatggattatctggcgcgggtggttcaggattgaatgaatcaattgctgcccctgcaagttgatcatgatttagtgcatctgcaagatctggttcgttgataatgccaccacgtgccgagttaatgatgtaggcagtcggtttcatgagtaataattctttggttgtaatcatattcttggtttcaggtgttaatggcatattgaccgataagaaatcagctaaggggtagatatcattcagttcagcatagagctttaccggtgaattcttgatgtaaggatcatagccgataacgtgcatgccaaatgcttcagctaaggtcactaattgctgaccgattttacctaaccccagaattgctagtgtcttaccgcgaagttcatgcccattaagctcataagtagtagaaaatccgggaagtgaggtaccgcttagctcagccttgtgtgttcgtaaagcattatcagatttattgatgcggcgactgagcagtaacatggtggtcatcacatattcagcgacagaaaatgcgttggctccgttaactttagcaactaacacatgttgcttggtagcggcatcgacatcaacgttattaatacctgtcccattacgagaaatgatcttcaattctttaccggcagcaattacatcggctgaaagctttgatgaccgcatgatcacggcataggcgtccttaattgcagctttcatagattcattgtcagtgtcaggagcgacttgaacatcaaagtggtttttagtcagtaattcaatacccgcatcgtcaattttttcacttaacaaaacttttttcatgattttttcctcccagatgtaattcattaagttaaccgcttacagttatattttagtgattaatttcactaaagcacagttactaaatggacagctggtgaacaaaatcgaccattgcatcgatgacgcgcgacaatggtcaattttgttataaaagatatgtgagtaattgatgtaagaccaggttatggttgttctttttgtaaaacagtgttgaagcgtatgtcgtgttaacgtcatcggcaattggtaggaacctaattagtgggtttttttgttgttctagtgtcaagaagggacttggatagaagccgattccttggtttgacgcaattagcatgtcgcgtaattcgagtgatgaaacgcgattgatttgatgttctgaaaaagtctgattgaacttttcaaaaaagattttcttcaagtagagtgaagcgtacgggctataatagagtacctctaagtctttgaggtcgccaagtgcaactgagtcagcttgtgcaagtttgtttagagaactgataccaactactaggtctcccttagctaattcaattcttgataaactagggtcggtcatatcattctgcatataatagtatggtgagacggctaggtctaatatgcccgtgtgaacaagttgctgtagtctttgaccactttcttgacgaaattcaagcttaattgttggatcggatttgagcaatggaatgagcattttttgggttgcaatttcttgattggaagatgaaaacccgattttaagccgcttttccttggtttgttgttctgattgaatccgaatcagttcatcgttgtaagtattaacgatatcctctgcagcaatgacaaattttgtaccggttggtgtcaggtcagtattgttatgacggcgaataaacaatttaacaccaagctcattttcaagttgatccatttgctttgagacggctcgtggagataagaatagcaattcagctgctgctttaaaactgccattctttgcaataaccaaaaatgtttttaatcgattaatttccataatgacttcctcctcgggctgaatattagtggcaagtgaacgtttggttcagcaagcgaacaatttggtactgttataattattgaccggaccatataataaagtcaataaatgattgttacagaaatcacaaaagaaggttattgaaatgagtattccaaaaattgttgatatgttggtttatccagttgctggttacgatagtatgctattgaacttaagtggcgcacatggtgcttttttcacccgtaatgtcgttatcttaaaagcagataacggtcaaattggggccggtgaagttccaggtggagaaaagattaccgagactttaaatgcggctaaagcgttagttatcaatgagtcgattggtaattataaatcagttttacaaaaaatcagacagaagttttcctatttagatcaagggggccgtggtaaccagacttttgatcaacgaattatggttcatgcgctgactgcaattgaaaccgcttttttagatttgctcggcaaacattttcacgttccggtagcagctcttttgggcgatggtcaacagcgcgaaaaagttggtgttttaggttatctattctgggttggtaatagtcagaagaccgacttaccgtatttacaagatgatgataattcgagtcaatggggaaagttacgtcgacaaccggtgatggatgcggatgctttagttaagcttgctaaagctgcatacgataagtatgggtttaagaccttcaaacttaagggtggtgtttttgacggtgaaaccgaagttgcggcaattaaggctttgcatcaagctttcccagacgcaaaattagatcttgatccaaatggtgcctggtcactcaaagaagccttacactacgctgatgaacttaaaggcattttgcactatattgaggatccttgcggtgcagaagcaggcttctctggccgtgaaattttatctgagtttcagcgcatcacgcacatgccgactgcgacaaatatggtagatactgattggcggcagatgtcacatgccattgcactgaacgccgtatcgattccgctagccgatccacatttttggacgatggaaggcgctgtacgggtcgcacagttatgtcatgaatttgatcttaactggggtgttcattcaaataatcattttgatatttcattggccatggttgcaaacgctgctgcggcagcgcctggaaatgtttatgatgttgacactcattggatttggcaggatggtcaaaacttaactcgtcatccttatgaaattaaggatggtcagttgacggtcccacggacaaacgaaggattaggtattgaggtcgatatggatgcaatcgaaaaagcacatcaactctatgtggataataatttaggcgctcgtgacgatgcgaaggctatgcaatatctgattccaaattggcaatttgatgctaaacgtccagcattagttcgctagatgcttgttcgatgtgttttataagaatcaagttgtgattaacaaaaacgatcgtcttactttaacttagtaagcgatcgtttttgttaatcattattgcgtatcgatatttgtagggtaactggtaattcagttttaccacagcccactaaaaatactagctgccgccacgccccaataatattcggaggtgcgggcggtttgggtgtagagtgtgttaattgcttggagtggttggtgcatgtgatcacgcatgacgcgcattgccatgccgttaactttagtggcaattaataaatagttaccgttcttgtcaagttccatagcatagcgaagtaagtcagcacgaacttgtgcgtcttgtttaacttcaggatcattataggcaacgtcgatttgttgcatcaaacgcttggttttatcatttttgttcacgttaatccccccatgccaagagtatagcacaagtctcagacttaaatgttagcttaacgcgaaaccgcccgcatttcggatagtaaaatgcggggcggtttttatcagtccgcttgttttttacatgtgatttctgcaacgtgatactggtgatttttgatatgccctggtcgctaaattaacgcggccgccatcacttgggccacatcttggctttgccaatactgatccactaatggtgcgaaagcgtggttcaagccctgatactgaataaacgtggtcgcagtatcggcagcggccaggcgttgtgcataagcccaagcttgtggtcggaagggatcaaactcgccgaccatgatcgtggttggtggtgtcattgtgaagttttcctggtgtagcggtgagatgagtggagaatgtgaatcaaagttctctggaacataataatccgtcatgatgctgtcaagttgccgaaagaggtcgtgatagttggtgagaatggcacgctgtgagtcaataatcggaaaggcggccaaatcccagagtggaccggcgtggtcagcatttggggcggtaactgggtacaacagcagttgttgattgatacgattgctaccgagttgttgattcagatttgttgcagccatgatgacgttagcgccagccgaatcgccagcaacggtaatcattgtttcagcgtcacgttgttccaaatattggaaaatcgcgagcccgtctaaaataccagcgggtgctggtgcttctggcgctaagctgtaatcgacattaagaatctcgcagtgacttttagctgcgaccagctttaaaaggaccgtattattgccgggaacaccgccataaaaggcaccaccgtggaagtagaccagtactgtgtgattaatgacattttgtggtgtcagccattcaacgctgaccgtgcgattcagagccgtaatatttcgactttgaactgtaaccgcatcaccaacagggtccgcgatggcgggggttaaactaccactgcggagcgccgctagatcattttcaaggatggctggttgtttgaaggccgttagtgtttgaaggacgtgcgggtcaaattgttcaccggcgatgtcgttgttaaatggtttaacaattttgacgacgccgttgacggttgtttgaatcgaattaattgttggcatcatattcaacatcctccttaggttcaactttagccgctgcgtcggccttgttggcttgtaattttttttcgtctaaccgatagaattgcatcatgaaaatcatcgcggctaataaaataatcggcatccaaataaaagcgagattaataaatgtaatggttcgtccggactgtacagctgccttggcattgaattgtccccatgcgagaaattgaccggctagaaaaccgccaattcccattcctaatttggcgccaatcattggtacggcagataagaatccggtttcatttaggcccagtactttcgttgagtagtcaacggtatctgatagcatcgcgaagacaatcgtgaacgtgatccccatcgcaatcaagaaaatgacggagccagcaattagtaggctcacactacgcatcttttcagcgattggcagcagtagttggccgataacgcccagtacgagtgaaaactgcaaaacgttacggttcttaaagcgttgtgataggaatggtacggacaggttcccgatgacggaaacaaagccaatccccaggaaaattggcgctaattcaggccgaccgtagacgtatttgataaagaagatcgctgaatttccccgtagcatccagaaggtttgtagcagaatgaacgagcaggctaataatagccatggtttgttgctagccgcacccttcaagctttgccagattgagagtgattcggctgactcagtggtaccgtctggattttgtgcaccgttagtttccttgagattgagaaaagcaaagatgaagagtcccatgataacgaggcctaagataatagcccagagggtgaaacctttcgactgattgcctttgccgagtaatttaaccattggcaaagtgatggccgccactgcactggtcccgatggttgtcatgaccatccgagcactcgctaacttggtccgctcaacgctatcatcagtcaagcttggtaaaatcgaagtaatgggcgtgttggcaccagaataaatcaggctaaagaaagtgtaagtgattgaaatgtagacgagtcgcattgtggtattgccgccaaatgatggaatcatgaatagcgacatggccagcaaccctaacggaatgccaaaccacacaaagtaggggcgcgattgtccatacttcgtgtgtgtatgatcaatcaaataaccataaatcaatgcatcaaacgcatcaatgaagcgcacgacgaagaacagcattcctgcaaaagcagctgagatgcccgcgaccgttgtgtaatagaacagtaagtaagtgctgaccatttgccaaataatattaccggccatgtcagtggaaccgtatgcaattcggcgtttccaagtttgaaaaattgacattataaatccccccaaacgaattaaatttaaactaacaatgataattaaccccttttatcaacataattatatttccaaattaggtgaattatcaaagataggcgatagtttggctggttaataatcgaaaggtgggtgcatcttttgtacaaacacgactgatgcctgttttgtagcgctggttgggagaaagccaaacaagcaaaaaacacccccagcaatggccaatcaaattagctgttgctgggggtgttaatggttaaagacgcgtgtcgcggatgtcaccaattgttaacagaaatagaattgaaaatagccttgtcggtcagttctgttttgaccattaatcaatggttggtttcagagctagtgctttagcggcttcttcactgtcatcaaagtgatgcttagtccggccgatgatttgataatcttcgtggcctttaccagcgattaaaacaacgtcgccgggttgtgctgcttcaatggccttggcgatggcaacgtggcggtcttcgtagacgggcacgtcggcgtttggcacgccggcaaccatgtcatttagaatcatggttgggtcttccgtccgaggattgtcagaagtaaagattggcttagtactgtgttcgacagcaattttagccatctttggccgtttcgtcttgtcgcgatcaccaccacagccgacgacgcaataaatatccttagtcgcgaaatcttgaatcgtttctagggcattcaataagccgtccggagtgtgtgagtagtcaacgatgacactgacacccgtgtgggaaggaacggattggaagcggcccttaacgccggtaaccttctccagtgacttaatgatttggtcttcggggatgccactagcgtaagctgcggcgaaggccgccagcatgttgtacacgttgaactggccaatcagttgcatcgtcacgtgggttacgtggccgaagacggagaggtcaaattcagtcccgtggctcttgatttcaacattttgtgcgttgatcatggcatctggtttgagtccaaatgttagtacgtgcgctgccgtatactgttcaaattcacggccaacgggatcatcggtgttcagaacagcgaccttattagttccgtcggcgctgtacttattgcccagttgtgcaaagagcatggccttggcttccgtgtacttagccattgttttgtggaaatccaaatggtcttgcgtcaagttcgtgaaaacggcgatgtcgtaatcaatcccccagacccgtccgagtacgagggcaattgaagaaacttccatggcgacagtttcaacaccggcatcccgcatggccgctagagtccgttgcgttgtgatggcgtcgggggtggtgttggcagttggcagtttttcatccttgattttgcgatacatggtcccaatcaggccggtggcttgctgctgatcacgatagatttgttcgatcaggtgggtgacagtggtcttaccattggtacccgtcaccccaatcatccgcatcttttgactaggcgcaccgtagaaaacgtcggcaagaattgccatagcgcgttcggtgttttcaacgtagatgaccggtacgttgacgtctaaaggttttgacgccacgatgatcttggccccttttccgatggcctgatcaacgaggtcgtgaccgtcgacgtgataaccaacgacggcaataaacatggcgccgggctgaacttcgcgggtatcctgcgtcagcatggtgacatcaaagtccgtggtcaaggcgggctgaacctgcttgaattttaaactattaattaattgacttgcttgcataatattagcgtccttttcaataaagttactgtttctagaatacatgcaaaccggataattgtcaccccaaatgagaattgaaattatgcttgtaatcgctcggtacatggtgtgctgctggttgaacgtgccatctccaggccaatctaggtcaacaaaaaagcccggcaattaagccggacttgcagggatggttattcgattcctaagaactcatcatgtaaggcgttcatggccgcttttaaatcggcttccttaacgagcacccagatggtcgtataactatcggtcgattgtaaaatatcgatatgttgtgcagctattgccgagacgatccgagcagtgacgccgggtgtcccagtgataccagcaccgacaacggaaactttagcacagttcgcaattgactgacaatggacgtgcgcgtcagtcagtagctgcttggcaacgtccgcgtcaccatcaaccaggttgaagacaacttggtgtggtgtaatgttaataaagtcaacactcaaaccgtgctgtgccatcaattggaaaatggcacttgaacttaacgtatcggtaggaacagtaaattgcgtcaaatcagtttggtgtgcaatccctgtcacggtacgataatgttcgatttgggtcgtggtccggtcagtgactaaagtccctaattcgtcgggttcctgataagttgaccgaatccgcatcggcacgtgagcttgttctgcaatttcaacagcacgcggatgaatgaccttagcaccttcatgggccatgttagcaagttcttcgtagctgatggccttaatgaagcgggcgtgggtgacgagtcgtggatcggcagtcatcatgccgttgacatcagtaaaaatatcaacacgttttgcttttaaagcggcgccgaggatggctgctgatgtatcggaaccaccacggccaatcgtagtaatgtggccgctctcagtagcaccttgaaaaccagttacgactaccacgtcggcgtcaataaaggcgtccgtgattggtttcggatcaacgcggagaatcttcgcattttgaaaatcgtcgttagtcacgatgccagcatcatgaccagtcatggccgtgacgtttaggccttgcttacgcgctaactcggtaaagacagcggtcgagatggtttccccaactgagaccaacatgtcgagttctcgattggttaagcgggagtgctcggccccaactaatccgagtaatgagtcggtggcgtaaggggcacctttccggccaattgctgagacaacgacaatgactttatcgccctgatcgacggcgtattgaacgtgctttaaagcttgaatacgggcggcttcgtccttgactgacgtgccaccgaacttttgaacaataatttccattgatctaaaactcctcgactttttccgcaacggcgttagcttcggggctatccatcaagtggtcagattcgacatagagtcggtgccacatcatgaaggtgaggaccgtccagagtttccgagaattatcccgaacgccggccttgtggtcatctaagagtttcaagaagtagtccttattgaagtattggtcagtttgcgaatcgttaatgatctgcttagcccagtcgtacatttcatctttgagccagaaccgaattggtactgggaaaccaagctttttacggtgaaggacgtgcgctggcacgatgtcttcgaccgctttacgaagaatgtactttgttgtgccgtgactaattcgaagatcagctggaatttcggctgctaagttatacacttcacggtcaacaaacggggtccgcagttccaaactgtgcgccatcgttgtccggtcggcgttatgcaacaagtcaccgtttaaccacgtgtgcatatcgatgaattgcatccgactgattggatcatagtcgacggattcatcatagagcggttgcgtgatggactggaacggatggttctgattgtaattcttgaagaaggcttgtttttcttgttcaccaaagataaaggcgttcccaacatagcgattttctaatggggtggtccctcgtagtaagaatgaccgaccacgcattccctctggcatcatgagtgcgatacgcttcaaggcaccattaatcggtttcgtgtagcggaacggtttcaatgattctggttcatgatagatggtgtagccaccgaagagttcgtcagcgccttcaccagtcaaacaaaccttaacgtgtttgaccgcttctttggctaagaaatactgcggcacagcggccgggtcagccaacggatcatccatgctccacacaaagtgcgggaaggccttcatgaaggcttcaggcgtaatcgtcatgctgtaattcttaacaccaagcttttcagcggtctcttgagcaacgtcaagttcactatacccttcacgttcgaaaccaacggagatcgtttcaaggcttgggttgaagttttttgcaatcgcgacgatgattgatgagtcgatcccgcctgaaaggaaagaaccaactggtacatcggaacgcatgtgaatcttaacggagtcaattaaggcatctttgatttttttggcatactcgtcttcagaacgttggaccggatggaattcacggtgataataccgatcgatccgtggcgcagaccccaactttttcgtcaaggagcaaccaggggcgagcattttgatttcttttgtgagtgtttctggttcaggaacaaattggaacgtcatgtaatcttgtaaggcatttttatcgaaggttttatcctttaaaatcttgtaaatggccttgctttcagaagcataatagaagtcatcaccactgatagcgtaatagaacggcttgatcccgaactgatcgcgcgcggcaaataacgttttttcttgtttatcccagatgacgaaagcaaacattccccgtaagtacttcgttgcgtcagcgtggtacttggcgtacatcgcaagaattacttcagaatcggagcttgttttgaattcgtagccttcttgtttgagttgttcacgtaattcaacgtagttataaatttccccgttaaatgtcatccagtaacgttcattatcataagatagtggttggtgaccaccggctaagtcaatgatacttaagcgccgaaaacccatggtaatgttgtcatcagcaaaataaccgtcatcatcgggtccccgatggacaatcattttagtcatttcgtggatggtctgatcgtaagctgcgttatccgctttagtccgatcagttaagcaaccagcaaaaccgcacatgtctgttcatctctcaatctttaaagtttagacagttcttatctactatatgtgtacagatggttcgttgttaatttacccgtttcattcacggatgtaaagcactctgaacaattataacggtttcttaccaatgtctgtcataattatgcttgacaatccgcgacgtacactttgactattatacttgctttaattcataagataaagcggagcgcgcagatggaacgctttcattgataaaaatttcatattgtgcgaaacgtccaattagttggatgccggttccttggcggagcggatttctactgactatttggttagttcgaattgaccgttattgacatgacacatttaggtgctgattgctggccttatggctgaaaaagtcacagaaaaatcccgcaaactcatgcacaaatttgcgggacgtttaagtgggaatattaaattagatgtgcccttgcgctctaagcccagccaactaggcgcaatacggccatggcaacgatgcctgttataacgacggctagtaaacttttggtgagcactcctgcaagaatggcaggaattgaggcataaatatttgggagattaaattctggccagtgtcccgcatggtaggtgagcagactttcaacaaaaatagcggtcataatggcaattggcacaaatgataaaaagctgattagccattgggggactgacagatttttaatgatggcaaacgggacaatgcgtgatagccaagtcacgaggccgcagagtaagatggtcacaaaaatgtaagtactcatttatggtccaccaccattccaaaaccgcaaccgagtagcgtcgcaaagatcaaagccaagttgcccgaacccaacgcatgagaaaatacatggcgagggccacaaatagtacgacccacaactgggtcggcaatgatttactgcgatccgtgatgatctgcaagtaaagtaaaccaatgaacataccaacaacggcgaaatccaagccgaactggttagggtcagtaatcaagttacctaaaaggcaccccaccactgtcgcggctgcccaaaccaagtaagccacaatgttagcagcgtgtaaccaactcgtttttaattgttgattggtctgattgagcttgttcatgctgagcgcgaaggtctcatcagttagtaacgatcccagtccgatattttgcaataacgactcttttttgaaatattgagcgactgacatgctcattaaaatcatgcgtgaattaatcaaaaaagtggataagacgattgccgaaatcggactacctgctaggagcatactgacgataataaattgtgcggaaccagcatagacgattagtgacatgagtagaacggcccaaactgataggtgactcgtgttggcgacaatgcccattgctaggccaacgccaatgtatccaaagacggtgggaatgacatctttgatgcccgcgcgaaaggttaaactagaatccataaatgtacgacctccgattcaataagtatgcgttaaccaacactaaatgggattatctgacaattagtgtggttcatgaaacaggataactatgtaggttaagtttgagtgcgtgttatgatgaaaaagcacgcttgatatccgccaatagtaaggtgacgaatgaggcaaaggcgggttaagaattagtttactactttcggtgaaaataatgaagaaaattatcattgacttttaatcgtgacgttacgaaattgttgcttgcatttcaaaagctgggggcgtaacataatcacattgattttttgaaaggacaaatggtgagagaaaatgactctggaacaattagcagcccatagcggggtcgctgctgataaaatcgtcgcctataccaatgccgggttattaccttgcaaggatgtcaacgcgcattttagcgccgatgatgaatattggctagatatggtcaattgcttcttagaaaatggctcatccgtcgaggatttgaaagatttaatgccactttgtgaacagtgtgcagctcaataaataagtaagttaagacaatcgcaccgattctactagaattggtgcgattgtttttttattactcatcgttattaaacaatcatgattaaaacgtgccgattcttaagttcaaaagcagccagcttagacccgctgggaaaagttcaagttagcgtaaatatgcttagattggttcgtcctacatcgacctccaggcatttctgccaattgccggaacgtggtgggcacagatttgagccgaaaaaccacgtctcaaatactggcctttcactaaccaagcacagaacgcttgctaagtgaactttcaccactgggcattgtcaaaaatgccttccagtcgggatagtattcgaatggcagacggtgaggtacccaacttttgatgaattggtcgttgcttttcataaacggtaattttgtcaatcaactgtcagactaaaaataatattgagatggctcactaatcctgaatcggtgtagtaggatttaatctcttgacagagtgcttaatgcacctagcgctttgtttaaacttccagcatcaaaatagtcagcgactaattgtaccaaattaggtggtcgttcatcagccattcgagcggtttcccgaccggaggggctgggtgacaatgctcagtagccaaattattcttagtcggaagtgggttgcttccggcttagaataagactcgtatttgagatgacgcgggttatgcgttagctcaaatcgacgtcggcttacgttccagcaattgtcacccagccccggaggtcgacataggacgcgcagcggctgacgaacaggaatccacctaatcggcacggtttaatcataattagtcctgattggtgttttggagcggacactattttttaaatgttcaatcggaatataaattaatttatatgggctagcaggattgagggactaacggtatacttattgaagcataaataccaaccaaaaaggatagtgaagcagggatgaaatcggggaagcaccgggtatcattattgatactgttatgtttgatggtggtcggtttagctggctgccataacaaggcgtattcgcagtcaatcgagaaggggttaaatgcggttgctgagaataaataccaaaaagcgctgacgtattttgataacgcgctagcgcagaagcccaaggatgaaaaggcacaggcgtaccgggatcaaacgcaggcctacttgacgaccacatcggagttgaaggccggaaaagttaaaacggcgctgacgacggttgataagggtgtcaagattacgaacggggcaacaagtttgacgaataagctgaaacagttgaaagtcaccgtaaccagtgattatcaggaatatcagcaattgtcagatgatgttaaagcacagttaaaggtgaagaacggcaactattcagcggacgtgctcaaacgttgcgcagccatcaactgggataaaaagccatatttgaaaccgttgaaggctaaggtaaaacagttattgactgcggcaaaaaaggccaagacgaatatgaaagttagtgcggctgaagcgaaacgagcagcggcgttacgtcggaagattgctgccgctaaaaacaagtggaacatggccgcattagacgatgtgcccgattggttcattttggcactttttgccgacgatagtgatgtggatgatgctgctgaagaattagatgacgaatatgccgatcaggccgacgataatgacgattattcggatcgggatgagcaaacgactgattcgaatgatgacacgaacgacaccgacgcggattcggctgatgacgattggagtgatcaagatacggattcgaatgacgataccgacgatgattccgatactaatagcgatgctgacagcgattcggattactcagaagatgatgacgatgaagattcgaatcgtgatgacgccgatgacagcgaaacccaatccgatgacgattacgatgatgatactgatagtgagtctgatgacgacgattatgatactgatgatcaatatgacgatgatgatgactacgatgacgccgagagcctactcaacccggcacctgttcaaccgtcagtggccgaccggctgtttgcgtcggctagttgttagtcgttcagcggtaaaatcaccaaagatcgtctgacagttttaataatgcagttatgggcgatataaaaacaagcgtccgcgttgattagatcaacgcggacgcttgttttcttacgtggagtttgttgccgaacatgtctgagtaccagttgctcacgggcaagcctttatcttagcgttgattaaggctgatgtttaaagcgagcgtaaatcgagctcattgttgaaaatccgatgactattaagaccatgatttgtaatacgccagtgggttgctgaatttgcctgacgataatgtaagtcagaatagccaagttgatcagccaaccaaatcgtcttatttgcttaattataaaatttttagggtctgttttactaagcatataaagtaaaagggcgatgatgatccaaaacaatcctgatgttgagtgatagtacacgtaatcattcctttagacgtctgactttctaatgacatcgtaacaatcaacttggtacgtgataatcgtatcatttgctcgaaagcatcaaaatcatgttttagtaaagatagtgtacattttcagaaaagaaacgtgaattttttgtaaaccaccggcataattaaccggcgcatcgattttgaataagtgtggtcttgacgctggggcgccggcgctagttttggcaagacgttagtgaaaggggggggacaagccatgatgatctttagacaacaaagaccccggcatgccggggtcttgtcagctatttttaattgttagttcaagttatttgctagctttaacggttttaagcatgctctgaatggcattggcttgatattgagcagccgctgctttttgaacttttgcgagttgcgctttgctcgttgtcgggttcttgaccattgcggccttgacctgattagtcacgtagactttagcacgcgcttttaatgtcgcttgctgttgcttcatcaatttactgaattgtttagcttgggttgtgctaagtacgacccagttcttattgatatagaagtagttggttcgcttgatcaactgtttgtcattgttggctaagccaaaccagaacttcatggcgttactcttataagtccaccgtgtcgtcttagtaactaacttaggtgtcgcggtcgtcgtcttaacttggttagcagtcttgacgctggctgtcgtatggctaacttttttctgattagtggtctttttataaatatagacccggtgcttgtcagcggtacccacactttgatagagcaataaatcaagttgcttgctactaccagcagactttaatgattgcgtggtggtcgtcgttgttttgaccatcccgtaatgttgaccatcattcttggagacgaagacgatcgaggtcactaagagtgccgcaaagataacggataggctgattcgtaatgtgttttggtgaacgtagataaatgataagaagagcgcgattgcgctaacaacgagtagtacgagaatcattagtcgttcacctccttagtgttcattactggcttaacggaatgctgcttgcctttcatgaagaacgcgacgacgagcccgacaactgagaagcccacggcaacccagaaagccgcgtggtaaccatttaaggttgcgttgaaatagctgttctgataaccaagtggattgctcttaatcaagctatgagctggttttgtggcgtccgtaacgtttgataagacggaagtcaagatggcagtcccaatggaactagcgatttgacgcgtcgtgttgttaacggcagtcccatgacccattagttcaacgggaagggcgttcatcccagcggtagttgccggcatcatgaccatggcaatcccaaacatccgaacggcatagagaaccacgatgtaaaccgttgcggtattacgagtaatgaaggcaaatggaatggtcccgattgtcagtaaaaacatccctaaaattgccaagcgtttggcaccaaaacggtcaaaggcccggccggtaattggactcataacccccatcattagggcaccagctaatagtgatagcccagattcaaaggcggagaaaccatgaataatttgcaggtaaagtggaataaccatttcggcccctaccatggccatgttagcaactgagctcaaaatagctgcaattgtgaactcggcatgcttgaagacccgtaattggaggaatggattttccatcgtcaattgacgccaaataaaaccaatgatgaagataacaccaataattaaagttgagagaaccacggttgacgtccagccattgtcaccaacggatgaaaagccgtatagtaagctcccaaaaccaatggtagaaagtaccaaggatgcaaagtctaattttggcttagacgtttccaagacgttggccatgaagaagaagccagcgattagaacgattgcgacgattggaacgatcaaaccaaataaatcacgccatgataagttgtcgataacccacccagataaggttggaccgatggctggggccaaaccgataacaattccggcagtccccatggcagccccacgcttatcagcagggaagatagatagcataatcgtttgaagtaatggcatggtgaccccgaccccaacggcttggatcaaacgcccagccaataagaagccaaagtttggtgctgtccaacagataatagtacccacttcgaaaatggccattgcggaaagatataaccatttagtggaaatccgtgaacttaaccacgcactaacgggaatcataatcccgttgactaacataaacccggttgttaaccattgcacggtcgacgttgtgatgtcgaaatctttcatcaacgttgggaaggcagtggttaaaatcgtttgattaagaacggtacaaaaagtaccaactaataaaactgcaatgagcaagccacggttataaggcttcccatgcgtatcaacaggagttgacaagtaaatcccttctctctaaaaaagtacgttgtctaatataatcggatttatcgactttgtcaacaaacttgacattaatattaaaaataatatactgagtattgaaaatgttagaaaagaggttgacccgtggataagcaagaagacggtgtattttttaagaaatttaaagaacagctgggtaagcatcaattcacaatcggaattagcgatttggcgaagatgaccggcgtctctcagacacagctacgttactgggaacagaaaaattatattcatagtcttaaagtgagtgagaagaataccacgcatcgttattcgtatggtatgctgatgcgtgttcattttatcaagatgatgttagacgagggttttacactggcagcggctgtcgagcgggccgatgggtataataaccaaatggaaatgatgcgcatctttatgatgacggcttttcaaggaatcgaagaacgggatggtcaccacatggtcaagttgggatattttgacgaagcgaagacacaacagctttattgttatattcaagatgagacgccacattatcgactttatcccgttaagtcagagcgctagcaaccttcagcttgtgtaaccgattaattaatgttaaatttaagttggtaaatgtcggtaagtcacttgggcatttaagtttcccgttcgtcaaccgatcttatggctgggttgaccgttgtcatgttggtcgtgttttgaagtttaactttgcaaaaggatttacaacggagcgcgaataagcgctgagagatgcctagctagaactaggtagtaatcgtgcataaaacaacgtgtaattgaaactagtagtagtcttcaatcgcccggtgatgatatttaccagaggtcccaagtgctgcgggaaagcttggggcttttttgtactttcgtacgttaaaacgtaatctatcagtgtggttatcaacaaaaaagagaccgagtatcaactcaatctctttaaataatctataagtacgcgtggtgcttgtctttcatttagtattaattctacttctatatgaaataatcacgagtagcgcgcgttaattaagtaggaattgttaagatgtcgcagtttgagcaaacttggcggctaaccattcattccatggtagtgctggattaccactagtaaagtattgttgatcgagtcgatcaatcaagttgacgtaggcggtaaatgaaaaactaacggtgtcactcaagcgctgagccttggtcatgtagcggccgtaagtaaggtgttcattgatgtctgtcatatagctggcaacatcatagttggacatcatttcaaggttgttagcgtcaaaaagtggtaagtagaatgcggcaaagtcttcaactgccttgtgctgcaaagaactatccaattgcgtaattgataattgagcatcatcattcacgatgcggttcctccttagttgaacaagcacgtttctaaattagtaaccaaattggttattttgcgctacaattaattatgtcacgattaggcaattatttcaaagctttgtcgttattagagactaggactggtgtctcaattgtagtaagatgttagaattatattagagagaatcagaagtaactatttagttgaggtgaagaatattcatgacccccatgaaggaagattacttaaaaattattttcgagcttggtggtacgaaaaaaaaggtgtcgaataagcaaattgccttaagtttagacatcgcggccggctctgtaacggagatggtcggtaaattagttcaggaaggcttggctaagcataccccgtatgctgggatttcgttaacaaagaaaggcattcgctacgctgaaacgttagttcgcaagcaccgaatctgggaagatttcttagttgataaattggattatgatttgccagacgtgcatacggaagcggaagtgctggagcatgtgaccagtgaacgactagtggattctttggaagcctttttaggcaatccgacgcattgcccgcatggtggcgcgattcccgataaggatggtcattatcaggaagacagtcatgtgagtttagcagatacgcaggatggcacaacggttacgattgagcgatttattgataatcatgatttattagtttatttgcatgatacaccgctcaagattggacagcaggtcacggttttaaagcacgatccatttgaaggtcctgttaccgtttccattcagaaaacgggcgaggaaatcccagttagctataaagcggcgcacaatgtctttgtaaagtaagcatgcggcacctatttccgaacaaacctgttaattgttagttagttattctgtttcatttatcatcacataaacatttcatggaaatcatggtgtttggctaccctttttagaaacaatatgctacaattgttcttgtagcttggttaggtaattttggtcagatcgtttcaataaactatccccatttgtaccgaatcatgatttacattattttatacgtgcaaaatgcactaggaggattttttattatggaacacggaacagttaaatggttcaacgctgataagggttttggttttatcactcgcgaaaacggtagcgatgtattcgtacatttctcagctatccaagaagacggcttcaagagtcttgatgaaggccaagctgtaaacttcgacgttgaagaaagcgatcgtggcccacaagcagttaacgttacaaaagcataattaacagcttaaatggcttaaaccggtgatgagaattaattctcatcaccggtttttttgtcgttttgcagcggatgcttaattatcgtaaataaggctttactaacagccagacattggctaaagtaagaatcattagagaatgtaattctgattattaaagggtgggatgacagtgacaaccgatgagatgattattgcgacttgcttgaaggctggtaaaatcatggtcgagaatggttcggagatttcgcgagtagatgatacgatgatgcggattgctcagaatgcgggggttgttgctgccaatacctacgtgacgattacgggtgtcatgatgtcgattcaaggacgtaatgcaacgcagattgccgcggttaaccagcgaacgatcgatcttgaaaaagtggcacaggtcaatcagttatcccgtgaatttgcggctacgaccattgatttaccaactttatatcaacggcttaatcagttagatgcagcttcgcgctcatttccgttgtggttgcagttggtcggtgcagccttagtcagtggccccttgatgattatgtttcgtcaggaaattgttaatacgtggccaactgttattattggaacattaggttacttggtcttttatctgcttaaccggtatcttaaaattaaatttttgagcgagttaacggcggcacttctaattgggtttggcgcggaatgggtgtgtcagattgggtggggaaccaatgtcaatgatattattatcgggtcgttgatgccactagtgcccggagtgccattaacaaacgccgtacgagatactctggctggtaatttcgtcagtgggcctgcacgtggcgtggaagcgatgctgagtgcggcagcactaggctttgggatcgccgttgtcattacattattttaagtacgggcactagcctgggtattcggagggatcatgatgggcacaattggacaattagtgctggcttacattgcggtactggggtttggcctgattattaatattccacatcaagcgttaaacgttgcgggctggattggtaccctaacgtggggtggctatttgattgttcaggcttttgatggtggggtcgtcttaggaagcttaattggctcggtcggtattggcgtcctcagcagcttagcagctcgctacaagaagatgcccgctattatcttcaatattccgagtttagtttcattcgtgcccggcagtcaggcttatcagatggtgcgtaactttgcgctgggtaattatcgtgaggcggtttcattcacgttgcaagtgattatgattactggtgcgattgcattgggattcttattagctgaattactcaaccggcttatcgcattttgtattcgccagtggcggttgcaccgattggagtcgtaacctaactgttggctgattagttgtgaatcgtgaacaaagtttgcggacgctaagactaagcgccataaataaattccgccaaaagtggtgggttagtgcgactaatttgccgtgtgccagcgttctgaatagttacgcgcttagattagttattacgactcgcattcaatacagaaaaaggcgccaactgaactgctctactaagcagttcagttggcgccctttttaattagttagctgagacatcgcaacaagtagtcacgactcttatcatcaaatcagatggttagttttggttagcaaatttttcgccggttgtcgcagcctttaaattaagggacttacgtaagacgttcgtgacccgttgcttttcagattgcgaaacaacttcgaaagactgaccatcaatcatcttaccagtaccctgggcgtgatcagagacgatattcttggttgcactacggtaattagtgacgatactagttaaattaccgaatgttaagtcagtccgtgtttgtttagcaagtgaatttaagaaatcttgtttaagcaagttggaagcactggcgctttctccgataatggcggtaattaattgccgttgccgctgttgccgaccatagtcgccgagtggatcatcataacgcatccgggagtaagccaaggctttggcaccattcatatgttctttttggcccttagtaaaggtgtagccttcgtaggtaaatgtccgaattggagtaatgtcaacgccaccgatttcatccacaacttttttcatgccacccatgttgatcagggcgtaatagtcgattggaacgttcaaccatttttgaacggtcttgatggtcgttccggcactaccataagcgtaggcagcgtttaacttagtcgggaagtcctgttcgaagccggagacagctacttcagaatcacgtggtaaactcatcagggtcgttgtcttagtcttggggttgatcgttgctaagatgatcgtatcggtccggcctttatagttccgcccgagggccccggtatcagttccgagtaataggatcgagacgggtttcttgccattcaatacggcgctcgtattccgactctttttaataccactactcttgaagacggtgtcggccgcattcttggcgttaaaataagttcgcgcggcaaaggccccggtcccaactaataacacggcaataatgattaaaacggtattgcgaacggggtgcttcttcttgggcccgttgccgttcccctgtgaattgtttccttgtgatttctcacgatgcatttctgagcgacttggcatgtcttccatgaactcttcctccaatggtaatagttattcatagtttagcattttttcgggtcagcgggaactgaatccacgtaagatttagcttgattaccgatgactgtcagataaatcataacctttttgttaataaaacgtgattaaaatgggaattctttgtttttttttaaggttccctgagagatattaatgattcgttcagtcgattaatagactatggtataattttgttaattttaatattaaatgggggttcttgttttgatgatcgataagtcgcgtagtcggccgatcaagtttgtcattggggtaattttatttgcctacttaagctattttattagtgacggcgcggttggtattgatttactagatgtggccttaacgtcgctggtccaaattagtaatagcggtatttggacggtattttataaggtgattgcttggttggcgtcacccggaatggacattttgtggatcgtcatcctggcgtttctaatgtacggatttaaatataagattcaagcgttctggacgctagcatatatggttggttcaatggcgttaggctttattgtcaagcacatcatcggccgagcgcgaccaattggtcatttagcgcaggataccggatatagttatcccagtggtcacgttttaggaaccttcgtgttggtcagcgtgattatcatgttgattgttcctgagttgccaagttatcgaatggcaatgatcgtcaagtgggtgagtgtcgtatggttagtattggtcattttctcacgtatttacttgaatgcacattatccaactgatacgattggggccgtgctattggcatggtcttggagtcaaatcatgcaatggttctacgttttctgggcaccaggattattgaaatggccgttgttttatcgttcatatttataaagacaattaacaaacttaaactaatctattatttagcaggcaaccgtgtcactaaataatagactcaaaataaaaaatcgtttgctttaatcgacactactcggctgattgcgagaaattgatcgaagcaaacgattttttgtttacatctataaaatattaactagcaacgactggtaatgaactaacgattatcagctagccattcaagtgctaatgttaaccagtgggcgacgtgcggctgattggcgtctggtttccatgctgtttgtgcattcgcaagggctagtccgtgtgggccatgtttaaagacgtgtagttcataaggaatcttagcagttgctaacgcagtcgcgtaggcaagcgtattggttgctggaacaattgggtcgtcagccgttgtccagataaaagtcggctgattatctgaattgacgtgttggtcagcggccagttcattcggcgttggtgtccaggtagccaaggtcgcgtcatccttgggaaaacctagcaatggactgatgactggatagccgagtaccacgttattcggctttaacatggcgggcgttacgtttaattcagttgccacgcgggtcgcccagtaatcgttatacagtgccacaatgtgaccacccacgctaaaaccagcaggcgtgatctgttgcggatcaatatgccattcggccgcgtgttgacgaagcaagttgactgctcgtcctaaatctaatacgggtgctaatccgagtggttgttgatcagtgagtagcgtatattccaagtaaaaggcctggtaaccgtgcccagcgaaagccatggcgagactctctgcttgcgccactggaatatgcgtgtatgagccgcccgggacgataataatggcgggtaagttcgtttggtgtgcgttcgtatccggttgatgcaaataaccggtcaattgcgcgcacgtcgctgttaatttttgcttaataacttgcatgcaatcacctcaatttgatatggttaacataactattataacgcaagtcaggtggaacagatatgggcatggttacggttacaactcggaatgagcaactcgagttacggccatttacgttggcagatacagaggattattatgacttagttcgtgatccgtcaattgcggcatcggcgggctttacgccagcgcacagcttagtggaatccgaattcttattgaaacagcaatcgaagttaccacagatttttgcgattgaactaacagcgatccaccgcgtgattggcagtgtggggttgtatgagcgcatgaggaatacgggcgaaccagcaactttagagatggatctcgggtatatgttgaacgctcgatattgggggcggggcattatgacggcagcagttgcacgtattttacgatacgggtttgaaacgcttcatttgcggcggatcacagccagttgtctagctaataatccggcgtctaagcgaatcttagagcatgctaattttcgacagtatgatgctgttcgccatccagattacgccccgtttggcgctggtcagacggagttattctttgattgtgtggaattaaacctttaggaggtgagttaatgcaactcgcaaaatcgtttgaacaggccgcctgcgtgttggtattgttggctacgcagcaacctgagattccgttgactgcggatgtcttgcacgagcgaattggtggttccgcttcgtatattcggaagattattcgtaaattagtagtggcaggactggtcacgtccaccagtggaaataacgggggtgtccacttggcacgctcacctgaggacatttcaattacagatgtggtcgcggccatcgaggggacgttgcagacctttccgaattatggttattttgaccgagtatttaaggacgttgaaccggtcgctcatgaagggacgaaagtggtcaacgggattttttcgcgagcggatcaattatggttagattttttagaccagcaaaaactggcgacgttgatcaagaaattattagttgttactcaaatcccagtgttggattggacgaattactcagatgataaaatggcccaattaaatgcgttgcttagtcggatgcgggcacataagtgagacgtcgtacaaactcgataaaaattgggagcggtttcgcttggtaaaccaatattgacgcgcttttgccaatcggggatcattttcaaaatgatacactttatttcacaaggctgaaaatgctgttattaaagcgttttttatggtattctaacaatgaatttcacaagatagaggggaacaacatgccagataagaaatattacggggccgatgcgatcgtcgacagccttgtaaaccacgacgttaagtacgtattcgggattccaggcgctaagatcgatcgggtctttgagcgcttggagcacccagtcaatccgaaaagtccgcggttgatcgtgacgcggcatgaacagaatgccgcgtttatcgctgccggaatcggtcggattactgggaaacctggtgtagtgatgacaacatctggccccggtgccagcaatttagccacggggctcgtaacggcaactgctgaaggtgacccagtcttggcaatttctggtcaagttcagcgtgctgacttgttacggttgacccaccaaagtatgaataacgcggcactatttaagccgattacaaagtacagtgcggaagttcaagaaccggaaaacatttcggaagtgctcgcaaacgcctaccaagaagccacagctgctaagcagggtgccagctttgttagtgtgccacaagatgtcactgattcgattgtacgcacacctgttattacaccaatccaggcacctaagttaggacctgctagcccggtcgaagccacgttattagcacaaaaaatcaaagcagctaagttgccggtcttgctagttgggatgcgggcttcttcaccagaagtgacgaaagcaattcggaacttggtggctgctgctaatctaccagttgtcgagactttccaagcggcaggcgtgatctcacgtgatttggaagccaaccatttcttcggtcgggtcgggttattccgtaaccaaccaggggatatgttactaaagaagtccgacttagtgattgcggtcggttatgacccgattgaatatgaaccccgcaactggaatgcggaaggcaaatcccgtatcgtggttatcgatgcaatgcgcgctgaaattgatcataatttccaaccggaaaccgaattgatcggtgatattgctcagacgttagactttttgttgccgtacatgaagggctatgatattagcgatagtgcgcgagcttacttgggtgaattacaagaacggcttcagacgcgtgatttcgtacctaatattgataagcagtccaagttaaatcatccgctgtcagtaattgcagccttacaacaacgggtcagtgatgacatgacagtgacggtcgatgtcggcagtcattatatctggatggcgcgtcactttcggagctatgaaccacggcacttgttgttcagtaatgggatgcaaacgctaggggtggccttaccttgggcaattgcagcggctttggttcgtccagatacgcaaatcgtatctgtctctggtgatggtggtttcctattttccgcccaagagctggaaacggctgttcgactgaagcaaaatatcgttcatttgatctggaatgatggcacctacgatatggttaaattccaagaagaaatgaagtatggtgaggatgcagcggtccactttggtccagttgattttgtgaagtatgctgaaagctttggtgcgactggcttgcgggtaaaccaacctgctgatttggaaaaagtgcttgatcaggcctttgccacggatggtccagttgtggtggatattccaattgattattctgataacaaggcgttaggtaagacaatgttaccagaccagttttattaaaattaccattagtgaccggttgtcaaaagatggtcggtcagatataatggttgagtatatcgaaagaagaggatgcggttaacaatagtagccggctggaagtgggtcaccacttatgaaggtcagtgaacggggcaaccgccgaaatcgatggatcagtgaccgattcatccgttgggtcttggttgaataaatcaaggactgtcgcagctagaatagttgcggggcgctatcgacgatgaaatcagcaattatgtcaatcaatctgattaaagtctttttgcgcacgttatcgtgaggcagagaggctttttattttgattgtgctaacctgaatcggtgtgaacacttttagatataaatcgatttttggaggttctgcaatggcagaaaaacaacatcaggaagtgcatcgttccttacagacgcggcatttatccatgattgcattaggtggtagtatcgggaccgggctgtttgtcgcgtccggttcggcaatttcaacggctgggccagggggagcattactggcctacgttggtattggagtgatggtttactttttaatgactagtctgggcgaaatggcaacttatttgcccgtttcaggttcgttttccacgtatgccactaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgttttgatttttacgatcaacgcgctgtcagtccggtcgtttggagaaactgagtactggctttcgctaattaaagtggtgaccgtgctcgtattcttggttatcggtgtcttgacgatcgtgggaatcatgggcggtcatgccactggcctcagtaactttacctataaaaaggcaccatttgttggtggaattccaacgattttgagtgtcttcgtggtcgctggtttttcgtttcaaggaaccgaattaattgggatcacggccggggagtcagcaacaccggagaaaagtattccggcggctattaaacaagttttctggcgtattttgttattttacattttagccattttcgtgattgcggcgattattccttatacgtcgaaagatcttctagggtcatcagcgagcgatattgccatcagtccgtttacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtcgggtcaatcgtcgtgggattccaatcatggcattattaggaacgacggtgatcggattactcacgttcttgtcgagtctattcggtgaacgaatttatattttcctcgtttcggccagtgggttaacgggctttatcgcttggctaggaatcgctatttcgcatctgcgtttccgtcgcgcgtttgttaagcagggtcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgtcaccatactaagatgattccactagacaaggttgatttgacacgcaaacggcaccatcaagattaagcacgcactttgatagtttgagtaaatgcggttgacactgggtcaatcgcattttttgacggcgagagttgggcctgtcaactcaaggcgcggtcgtatttttaggtgtcctgatttatgctgataacactgctcacaacagatggtcacggcggatcgttatgagcgggggcttgcacgattgtaatgatagcaagcggcaaattgagggtgcgctaatctgatatctatggtaatttgatagaatgagaatatggaatcattaaaaattcgcaaacttatccttaagaataggctagtcggctatgactatgctaagctgaaatgagaaaggcagcgagagagatgttaaagagaaatttgttaagaggtctagcattagtgtcattagcaggtgtcctggctggctgtggtgctagccagtcgacgtctaaagcgactagtagttctacgagtgctaagtcgacgaagacgcagaccaagcggcaacgactgattagtgccttaccgaaaggcgttaaatcgaccgatagcgacttagtggtcgtcaataagtggcataagcgcgctgagatgacatttaataagtcgagcgtggatggtattgaagtccgtagttctatcgtcaaaccattggaagcctttctagcgggggcaaaaaaagccggctatccagcaacaatcgtgtctgggtatcgctcagtcgcttatcaaaaagaggtttggtatcagtcgattcaaacctatgagaatcaaggaaaatcagccaaggaagccttaaagctgactaaagaatatgtcgcagttcctagtggtagtgagcatgaaactggtctcgcagcagatatcatgaacacgcactggtacagcactcatggtaatcaattattgtcatcatccgacaagaacaagggtcagcagtggttgattaatcacgcggcggactatggatttgtgttgcgctttactaaagatggtaagcagtcgaccgggattgactatgaatcttggcatttccgttacgttggtaaggcgagtgcggaattcatgactaagcacaatttgactctcgaacagtacgtcagtttgctgcaagctcgagaaaaggcggccaagtaataagctagccgtattattgatggccccaattaataccatttatggcgtacgttaggaattagctagcgtgcgcttttaaattgtcttcggtttagcaatgtgggttcgtctcaactgagtattatttggtcacgacacgttgtcacttgatcatgctggtcagaggccgcactcaaagctgaagtgccaccagcgccggcttgggtaacccagtgtgtgttagtgagttgcttggatcgctgactagtgcgtcgcagttgtggctggtgcgaagttttttactgaattaactcaccagatattgcattttaagacgtgggtgcgtacaatatgtagtgttgcttttagagataatcaaaattttgacgtgattaaaaggagagacgccccatgcttgtaatgtcaggaacaatcggtgccggcaagacgagtttaacgcagttagtggctaaccactttggttctaaagcgttttacgagtcagttgatgataatcccattttgccgttattttataaggatcctaagaagtacgccttcttattacaaatctattttttaaataaacggttagacagtattaaatcagcttttgctaacgatctggacgtcttagaccggtcgatttttgaagattcattattatttcatttgaatggtgatcttggccgggcgacgaataccgaagttgacatttatgattcattattagataacatgatgcaggaattgccagaagcgtctcatcaaaagagtcctgatttacttattcatatcaatatttcttttgatacgatgctcaaacgaatccaaaagcggggccgttcttacgaacaaattgatcaagatcctgatttatataaatattatcagactttgaatgaacgctatgacgactggtacgctaattatgatcatagcccgaagatgcagatcgacggggatcagctggactttgtcgccgatgcggatgcgcgtaaggaagtcattcggttgatcgacgaaaaagtggctagtttaggctagttgcctttttagaatcaatgttttatagtagacagtgaatattaaacacggcgcgtttttaagtagacgttcagagaaccggtgggtggtgtgaatcggtagtcgaaactccggcgcgacaatgtgggcaggtaatactgcacggcacggccgttatccgtttaagggtgggattaatcatgatcctgaacttgggtggtaccgcgaatcgcagtctcttcgtcccaattgggagaagagactgtttttatttacgattaaaagtgaaaaggagacgtcgttatgttagatgttaaaatgattcgtcaaaatccagattttgtaaaagaacagcttggtcatcggggcgttgctgcgagtgacatcgatgatttattggccgctgatgaaaagcgtcgtgaattgatcgccaagagcgaacaattgaagtcgacgcgtaaccaagtttcaggcgaaatttcacagaagaagcggaacaaggaagacgctagtgccgaaattgcagaaatgcaaaaggttagcgccgatgtgaagacgttggatgaagaacggcggacagtcgatgcccaagttcaggatatggctgcacatttaccaaacatgccccatcccgacgtaccagttagcttgaaagaagaagatgccgttgaattacgtcgaatcgggacaccacggcattttgactttacgccgaaagcacattgggatatcggtgaagatttaggcatcttagactttgaacgcggtgctaaggtttctggtagtcgtttcttatactacgtgggcgatggtgctaaactggaacgcgccgtttacaactttttcttagaccagcacgaagctgaagggtatacggaagttttgccgccatacatggtcactgatgaatctatgtacggtaccggccaatttcctaagttcaaggaagacgctttccggattacgacgcaagatttgacgttgattccaacggccgaggtgccattagtcaactattatcgtgatgaagttattccggctgaaaaattaccagtttactttacggccttatcaccagccttccgtgaagaagctggtagtgctggtcgtgatacgaaaggcttgattcgcttacaccaattcaataaggttgaaatggttaagttcacgaaaccagaagattcatgggatgaattagagaagttgaccaacaatgccgaatcattgctaaagaaacttgggttaccatatcacgttattacgttaacgactggtgacatgagcttcacagctgccatgacacatgacttggaagtttggttcccagaacaagacaagtaccgggaaatctcgagttgttcaaattgtactgatttccaagctcggcgggcgcacattcaatatcgcgatgacgatggcaaattgcaattcgttcatactttgaacgggagtggcttagctgtcggtcggaccgttgcggccattttggaaaactatcaaaatgaagatgggacggttacgattccggatgtattagttccatatatgcacggtaagacgaagattgaaaaacaaggttaattgagatgaagttagcgaactcgcagtgatgcgagttcgctttttttgcataattaatgagtattaaaaggaactgtcgattttaaaatgtgagtggaaataacggccgagttgactaaataattgcgggacgggcagaatgtcgggacaacatttcaggcgcaaaagggcgaaaaagctgggtttactgaaatttattcacctttttttgaaaatagggtttgctattttcggctaccgtgctataatatttcttgtcggaaaaatataacttgtttatccagtaaaaagtatatttatccatttatttgaaaaaagttgttgacaagtattcaacatgatgataaagttaaatagttgtcaaggcataccagtaagaactgtttgaaccggcaacaaggcatgattaacatcatgcgggtgtggcggaactggcagacgcgctagatttaggttctagtgtcttacgacgtgggggttcgagtcccttcacccgcacatgccgacttagctcagttggcagagcatctcactagtaatgaggaggtcggaggttcgaatcctctagtcggcatttacaatttaatagctttattatgcggaagtagttcagtggtagaacatcaccttgccatggtgggggtcgcgggttcgaatcccgtcttccgcttttaatttgccggggtggcggaattggcagacgcacaggacttaaaatcctgcggttagtgataaccgtaccggttcgatcccggtcctcggcattttaaataagcacccatagcgcaattggatagagtgtctgactacgaatcagaaggttgtaggttcgactcctactgggtgcattagtatcgggaaatagctcagcttggtagagcacctggtttgggaccagggggtcgcaggttcgaatcctgttttcccgatcgtttaacacagtcttagttaagtgctaaggctttttatttaattttctcgggaagtagctcagcttggtagagcactacgttcgggacgtaggggtcgcaggttcaaatcctgttttcccgattacggttaaaccaactaatccagtcatttggctggatttttttatggccttttttgtaagcaggggtgtttcaacggtcaggggacacttttgcgacgttactcactaagtcagccatgtgaagaatacggtggttgtgactcataatcccgacaaggcaacagccactgttagtcatgagctcggagaaattagtctcggaactgctgttcatcgttgtgataccagtgcccatcgcctgcaatgaggagtgactcaacttgacatattttaaataggtagttcaatgaatatggagacctaataatttaatcattatgaggttctaaacggttgaatcaattgaaagcaaacgttcggcgtgctatgctgtaacaaccgttaagcacatgctagtccgcggtttgggtgaaattctttgcttttttccattatcctcgtataataatagtcaatattagtcaaagataatgaaaagggtgaagcacatgcaaagtcaaaatatctcggatattattgaaaagtatttaaaaagtattttggcggactcggagcatgttgaaattcgacggtcagaaattgccgaccttttcaacgtggtaccctcacagattaattatgtgattaagacccggtttacgatccaaaatggttacttagttgaaagtaaacgtggcggtggtggttatattcgcattgagaaggttaatttggtcgatgatgctgatgtgttggacgccctcatacaggtgatcggcgattcaatcacacaacgagatgcttatgcggtcgtccaaagtttatacgaggacgacgtcttaaatcgtcgagaagcgcaattgattttagtggcgattgaccacgagacgttaggattaacggaccgggacttagaaaacagtctgcgggcccggataattatcggaatcttgaaccacttgcgttacgaaagctaaagaaagcgaggaatcgcaatggataacttatttacacctagtgccaaaagtgtgctggtactggcacaggaacaggccaaatatttcaagcatcaggcagttggtacggagcatttgctattagcattggccatcgaaaagaatggaattgctaataaggtgctacaacaatatgccgttagtgaagatgacattcgtgaagaaatcgaacggttcactggctatgggacgttgagcaatgttggcaaggatacttacttgccatattcaccaaaggccaaagaaattttgtccgttgccggtgatgaagcaaaacggctcggtgccaacaagattggaacggaacatttgttgttagcgatgctctctgatgaaagtatcctttcctcgcgaattttaatgaatttaaacttagatctaggtcagacgcgtaaagtcgttcttcgcaagctaggtgtcagtgacgccatgagtaagcgcaagggtaacgcggctaatcgcggtggcaagaagactgaaggaacgccaaccttggattctctggcgcgcgatttgacccaattagctagtgaacaagaaatggacccggtagtaggtcgttccaaggaagtcaaacgggtcattcagatcctgtcacggcggacgaagaataatccggtcttgattggtgaacctggggttgggaagactgcaatcgccgaaggtctagcccaaaagattgtggccggtgatgtgccaactgatatggcagataagcgtttgatgatgctcgatatgggatcgttagtcgctgggacaaagtatcgtggtgaattcgaagaccgcctgaaaaaagtgattgatgaaatttacaacgatggccatgtgatcttatttatcgatgaattgcataccttgattggtgccggtggtgctgaaggggctattgatgcctctaatattctgaaacccgcacttgcacgaggggaactccaaacgattggggcaaccactttaaatgagtatcaaaagtacattgaatctgacgctgcgttggaacggcgttttgcaacggtcatggtcaatgaaccgaccgaagacgaagccgttgaaatcttagatggactacggccacgctatgaagaacatcatcgggttacgattacggatgaagctgttgatcaagcagtcaagctatccagccggtatatcagtgatcgtttcttgcctgataaggccattgacttgatggatgaggcggcagctaaagtccgcatcgatcagatggatcaaccaacaaagctatccaagaaccaggacaagttagcgcaactgcgtgaggataaggaaacagcgatcgaagcacaagattttgaacaggccgctgatattcgtaagcaggagatgcaactgaagcaacgcctagatcgaatcgaagctgaccaagacgccgaagtgactgagggggcaacaccacactatgatttacaagtcacaggtgaggatattgctcaggtcgttgccgaatggaccggggttccgttaacgcaattgcaaaaatctgaaagtgaacgcttagttaacttggaaaagattttgcatgaacgggttgttggacagccagaagccgtatccgcagtggctcgtgctattcgccgtgcgcgcagcgggttgaaagatccgagtcggccaattggttcctttatgttcttaggaccaactggggttggtaagacggagctagcaaaagccttggcagcagcgatgttcgggtctgaagataatatgattcggatcgacatgtctgaatacatggaacgctattcgactagtcgtttgattggctcggcacctggttacgttggttatgacgagggcggtcagctgacagagaaggttcgccagaaaccatactcggtcgtgctatttgatgaagttgaaaaagctcatccggacgtctttaacattttgttacaagttttggatgacggctacttgacggattctaagggtcggaaggtagacttcagaaatacgattctgattatgacgtcgaaccttggggcaaccacacttcgtgatgaaaaatcagttggttttggtgcaactgataaggccaatgactacaatgcggttgctgcgacgattcgagcaacgttaaaacagacgttccgcccagaattcttaaaccggatcgacgaaacaatcgtcttccattcattgaataaggaagaattacacgaaatcgttaagttgatgtcacaagaaattgttgatcgagtggcccaacaaggtatcaagatcaaaatcactccggctgccattgacgtggttgcgaaggctggctttgaccctgagtacggagcacgaccaattcgacgggcattacagactgaaatcgaagatcggttgagtgaagaattattgaccggcgcgatcaaggtcgatgaccaagttacgattggtgctagcaagggtaccattacaattaatattaaaaaccagcctaaggcagatggtcgttcgaccgtttcctcaaagtaggcgcgattaaattaaagatgacgcttgaagtggtagtccacttcaggcgtcatcttttaggttcaatcggtattaagatgctacccactgaagtgaactgtaggatctgaggctggtggttcggtgctgattggtgtaaattataataggaaataaagtcaagaaagaagatgataacatggcgacacgagccgaacagatggcgaagacgcaccaggcgattttagacacagcccgggaactgtttttaagaaatgggtatgatgcgacaagtacgcgcgacattgcgaatgcgattggcattacgcagcccgcgctttatcaccattttaaagataaagaggtcatctttctggctgtcattacgacggtcggtgcggaaatcaaggctggcattgaagcgattcaagtccgtgcggattggtctccgttggatcaattaacagaagtctcgctattactaacgcataagcatccggctgatgtcttcacgttaattcattccagtttcaaagcattaacgcatgaacatattcgcgagttgggcggcatatttgttactgattatgtgaagccgattcaaaccgtttttgagcaacctgacatgcaactacatgtgggggtcacgccacagatggcgacgaatttctatatcaccagcttgagtccgctgtttaacagttttcatcaaatcggtgatcctcatgctgacgagcggacccgcgttcaaacccttttgaagatgatcttatacggggttgcgagtgaaccagaaaactaatggcggcagagaagtctactagttgacaactaacgttattcgatgtatattataacttgtctgtaaccgtgaactcgagcgaacgcgcaatctattgtctgtgcggctcgttaatataaatccaaaaatagtcaacttaagcgactatttttggtttttttatgcctaaaattcggtcaaaaacgcatttgtaacacaaatgtaatatttggctggaggtggcgggttccggaataataagaaggggtgaacaacttggccggacatttagtaaaatacggtaaacaccgtacccgtagaagttatgcacgtatcaaggaagttcttgatttgcctaacttgatcgaaatccagaccgattcttaccaatggttcttggatgaaggtctccgggaaatgtttgaagatattatgccgatcgacgatttcgcaggaaaactttcacttgaatttgtcgactatcaattattagaaccaaagtacaccgtcgaagaagctcgtgaacatgatgccaactactcggcaccattgcacgttaccctacgtttaactaaccatgaaactggtgaaattaagtcgcaagacgtattcttcggtgattttccattaatgactgaacaagggacgtttattatcaacggtgccgaacgggtcattgtttcacaattggttcgttcacccggcgtttacttcaatgaagaattagataaaaatgggcgtcctagctacggcacaacggttattcctaaccggggtgcttggttagaacttgaaactgacgccaagaatgtttcatacgtacggatcgaccgtacgcggaagattccattgacggaattagtccgggccttaggctatggttctgacgatgacattattgacatgttgggtgaaactgacagtttgatgttgacgttggaaaaggacgttcataagaacaccgacgactcccgggttgaagaatccttaaaagatatctacgaacggctacgtcctggtgaacctaagacggctgacagttcgcggagcctattgactgctcggttcttcgatccaaaacggtatgacttcgcaccagttggtcgctacaaggttaacaagaagttaagcatgaagacgcgcttaatggaccaaacgttagctgagacattagctgatcctgatactggtgaagttattgcgcaaaaggatacggtcattgacaagaatgtcatggctaaactatccccatacttggaacgtgacgactttaagacggttacttacacaccatctgacgaagccgttgttacgaatccaatggtcttacaagttgttaaggtttattcacaaaacgaccctgaaaaggttgtgaacgtgattggtaatggcaacattgatttgaagttcaagcacattgtgcctgctgatatcattgcttccattaattacttcttcaacttgcaagaaggtcttggctcaaccgatgatattgatcacttgggtaaccggcggattcgttccgtgggtgaattattgcaaaaccaattccggattgggttatcccggatggaacgggttgtgcgtgaacggatgtcgattcaagatgctgcgacggtaacgccacaacaattgattaacattcgcccagtggttgcttcaattaaggaattctttgggtcatcacaattgtcacaattcatggaccaaaccaaccccttaggtgaattaacgcataagcggcgtttatcagccttaggacctggtggtttgactcgtgatcgggccggatatgaagttcgtgacgtgcactatacccactacggtcggatgtgcccaatcgaaacgcctgaaggccctaacattggtttgatcaacagtttgtcttcttatgcgaaggtcaaccgttacggcttcatcgaaacgccataccggcgtgtcgattggacaacgcataaggttaccgataagatcgactacttagcagccgatgaagaagaccaatttgtgattgcacaagccaactctccattgaatgatgatggttctttcgttgaagacactgttttagctcgtaacaaggaagaaaacttggaaacgccaatcgaaaatgtcgattacatggacgtttcgcctaaacaagtggttgccgtcgcaacggcatgtattcctttcttggaaaacgatgactctaaccgtgctttgatgggtgccaacatgcaacgacaagcggtgccgttacttgatcctcacgcgccattaattgggactgggattgaatataaagctgcacatgactcagggattgccttgatttgtcgtcatgaaggaacggttgaatacgttgatgctcgcgaagttcgcgttcgtcgcgatgatggttcattagacacttacaagttaatgaaattccgtcgttctaacggtggtaagaactataaccaacggccaatcgttaaagttggcgatcacgttgataacgatgaagtcttagccgatggtccagcaatggaaggtggggaattagcccttgggcaaaacccattagttgctttcatgacctggaatggttataacttcgaagatgccatcattattaatgaacgtttagtccgtgaagacgtctacacgtcaattcatattgaagaatatgaatcagaagcacgtgacaccaagcttggacctgaagaaatgactcgtgaaattcctaacgtcggggaagatgcattgaagaaccttgacgaagacgggattatccggattggggccgaagttaaagacggtgacatcttggttggtaaggtaacgcctaaaggggttacggaattgtcagctgaagaacggcttctccatgcgatctttggtgaaaaggcgcgtgaagttcgggatacgtcactccgggttcctcatggtggcggcggtatcatccaggacgttaagatcttcactcgtgaaaacggtgatgaattatctcctggcgttaacatgatggttcgggtctacatcgcacaaaagcggaagatccaagttggtgacaagatggccggtcggcatggtaacaaagggacggtttcaatcgtggttcctgaagaagacatgccgtacatgcctgatgggacaccaatcgatatcatgttaagcccaatgggtgtgccttctcgtatgaatatcgggcaagtgctcgaattgcatttggggatggctgctcggaagttaggaattcacatggcaacgcctgtctttgatggtgctcaagatacagatatttgggaagccattcgtgaagctggggttgattcagatgccaagtcgatcgtctatgatggtcggactggtgaaccgttcgataagcgggtcgctgttggggtcatgcactacatgaagcttagtcacatggttgacgataagatccatgctcgttcaatcggaccttactctttggttacgcaacaaccacttggtgggaaagcgcaatttgggggccaacgtttcggtgaaatggaagtttgggccttggaagcttatggtgcagcttataccttgcaggaaatcttgacttacaagtccgatgacgttgttggtcgggttaagacctatgaagcaatcgttaagggcgaaccaattccaaagcctggcgtaccggaatcattccgcgtgttggttaaggaattgcaagcactcggtcttgacatgaaagtcttggattctgaagacaaagaaatcgaattgcgggacatggatgatgatgacgatgaagttgtcaatgtcgatgcactcagcaagtttaaacaacaacaagatgagaaggctgcggacaaggccgcaaaagctgacgccgctaagccttctgaaacaaccaacgctcagcaagataatcaataaaaagggaggtcggtcctttgatcgatgtcaacaagtttgaaagcatgcaaatcggtctggcatccccagacaagattcgcagctggtcatatggcgaagtcaaaaagccagaaaccattaactaccggacattgaaacctgaaaaagacggtctgtttgacgaacggatttttggtcctactaaggattgggaatgtgcttgtggtaaatacaaacggattcgttataagggtattgtctgtgaccgttgtggggtcgaagtgactcgtagtaaagtccgtcgtgaacggatgggtcatatcgaacttgccgcaccagttactcacatctggtactttaagggaattcctagccggatgggcttagtcttagacatgagtccccgggcacttgaagaaatcatttacttcgcttcatacgtcgttatcgaatctggtaatacgccacttgaaaagaagcaattactttctgaacgtgaataccgtgagaagaaggctcaatatggtaacgaatttgaagctgccatgggtgccgaagccatcaaacggttattgaataacgtggatcttgaaaaagaggcacgtgatttaaaggaaactctgaaggatgcttctggtcagaagcggacccgggccgttcggcggcttgatatcatcgaagctttcgtgacatctggtaacgaaccagcttggatggtaatggacgcaattccggttattcccccggacttacggccaatggttcaattggaaggtggtcgttttgccacctctgacttgaacgacttgtaccggcgggttatcaaccgtaataaccggttgaaacgcttgttggacttaaatgcacctgggattatcgtgcaaaacgaaaagcggatgttgcaagaagccgttgatgcgttgatcgataatggtcgtcgtggccgtcccgttgctggtcctggtaaccggccattgaagtctctttcacacatgttgaaagggaagcaagggcggttccgtcaaaacttacttggtaagcgggttgactattctggtcgttcggttatcgatgttgggcctttcttgaagatgaaccaaatgggcttaccacgtcaaatggcgttggaattgttcaaaccgtttatcatgaaggaattggttaaacgtgaattagcttctaacatcaagaatgctaagcgaaagatcgaacatgctgatgacgatgtctggggtgtgttggaagacgttatcaaggaacatcctgttctcttgaaccgcgcccctacgcttcaccgtttagggattcaagctttcgaacccgtcttggttagtggtaaagcgatgcggctccatccattggcttgtgaagcttacaacgccgatttcgatggggaccaaatggctattcacgtcccactttcagatgaagcccaagctgaagcacggctcttaatgttagctgcccaccatattttggcgcctaaggacgggaaacctgttgttacgccatctcaagatatggttatcggtaactactacttgacgactgaagaaatcggtcgtgaaggcgaaggtatgatcttcaaggacttgaatgaagctcaaaaggcttaccaatcaggttatgtacatttgcatagccgggtcggcattcaggtctcatcaatgcctgacaagccattcacggacgatcagaagcaagcagtcttagtcacgacggttggtaaggcaatcttcaacaacattttgcctggcaagttcccttacttgaacgaaccaactaacgataacttgattgctggtacaccggacaagtatttcttgaagcctggtgaagatattcatcaattcttggatgcccaggaaatcattccaccattcaagaagggcttcttggccgacattatcgctgaagtttacaagcaatatcacgtgacagcaacgtcactcttgcttgaccggatgaaggacttaggttacaacatttcaactaagtctggtttgacggttggggttgccgatattactggtttgaaagaaaaaccagcaattatcgccgaagcccataaacaagttaatacgatttcaaaacagttccgtcgtggtttaattactgatgacgaacgttatgaacgggtcattggtgtctggaacgacgctaaggaccaaatccaacaaaaactgattgaaagtttcaacgcggataacccaatctttatgatgagtgattctggtgcgcgtggtaacatttcaaactttactcagttagctgggatgcgtggtttgatggctgcccctaacggtaagatcatggaattaccaatcctttcaaacttccgtgaaggtttgtctgtcttggaaatgttcatttcaacccacggtgctcgtaaagggatgaccgatacggcgcttaagactgccaactcaggttacttgactcggcgtctggttgatgtggctcaagatgttatcgttcgtgaaaaggattgtgggactgaccgtgggttgcggattcacgcaatcatggaaggtaacgaagtcatcgaaccgttgtatgaccggatcttaggtcgttacacgatgaagactgtctttgatcctgaaacgcatgatgaaattgtcggtaacaacgtcttgatcgacgaagacttagctcataaaatcgttgatgctggtgtaacggaagttacgatccgttctgcatttacttgcaacactaagcatggggtttgtgaacattgctacggccgtaacatggctactggtgatgaagttgaagttggtgaagctgttgggacagttgccgcacagtctatcggtgaacccggtactcagctgaccatgcggaacttccataccggtggtgttgccggggatgatattacccaagggttgcctcgtgtgcaagaaattgtggaatcacggaatcctaaagggcgtgccgaaatctcagaagttactgggacggttgaattaattgaagaaaatccagcggaacggacgaaggaagttacggttaagggtgaaactgatacccggacttacacgttgccgttaacagcacggatggcggttagtgaaggcgactttattcaccgtggtgctgcgttgaacattgggtcgatcgatcctaagcaattgattcaagtacgtgatgtcttatcaactgaaaactacttgctccgtgaagttcaaaaggtttatcggatgcaaggggttgaaattggcgataagcacgttgaaatcatgattcggcaaatgttacggaaggttcgggtcatggatccgggcgataccgacgtcttgcctgggacgttaatggatattgcagacttcaaggacgagaactacaagaccttgattgctggtggtattcctgcaacgtcacggccagtcattcttgggattactaaagccgctcttgaaacgaatagtttcttgtcagctgcttcattccaggaaacgacacgggtcttaactgatgctgctattcgtggtaagaacgatccactgatcgggcttaaggaaaatgttatcattggtaagatcattcctgctgggactggtatgccggtttaccgtcatatcaaaccaaaggaagttggcaacgtggctgatggggtttactcaatcagcgaccttgaaaaacaaatgcaagaacaagatgctagcaagtaattgctaagtaactaaaaagggcggccattgtggtcgtcctttttgtatgcacgattgtaggtaggctatctggggcgttcggcgatgaaggttaatcttcagggggggaagactaactgagcctcgctggaaaagttcaagtttgtgtaaacttgcttagttagtgtgtcctgcactgcgctccaggcatttctgttaattgctggactgccgtgccttaatactatattggtgaaacgtgttcagattggaatgagactttcggttagctaacactaatcctcagtctcagcccgtctaaaccgcacactcttgtagtgctaagaaacgtcttccgctcgggatggtgttcgaatggtgggcacgtgcgtacgcaacttttgacggattagtcgttacttttttgagaccggaatcttatcaggtaactttcaggttaataatagaattgtgagctgtccccgatttctaaatcaccatattactactgagggtcagaacaactgatacgatattaacgcttgtttaaagttccaagtagtaaacaattcgacgacaaattgtaccagttgagtggtcgttcatccgaacaggacgcgcactgactaacaagcaataatcggacgtactagaacattgcaattatagctcgctatgcgagacccgtgagttgggtgaccatgatgaagctccaactgatgaagggcacgaatggtaagcgatggcgtggggcactgatgataaaaccaactaatgcggcaacggccgcaatggcgagacaggtcaacagtgtgtcggctggaatgatgaaaacaagcatgagtagaacgtcaacatcgccgagaccaaaggtggcagttagccgggccagcaagtataacccgactagtaaggcaagtacgaggtagagactgatcgtcaggggtggccgttgttgccataagcccagtccggctggaagaagtaatgtcagcgggtagacttcaaaagtgagataatcagtaagactattgaaatcaataccaagtaaccaatcagaagtggcagcgtcaatgacaatgacgcactgctagaagctagtagactaccacaaagtaattcaatcagactggaacggaggctgataggagtgcgacaatcatagcactgtccccgttgaagtagaatgccgagtaatggtatcagttgccagaaccgtaattgatgccggcagtgtggacaccttgatcgttgagtgctaatgagtatgtgtccgttgctgatgcgttccgccatacaggtcacgaatgagcccagacagaggccaataataaaaagactgctggttaacatggaaggaccacctttcatcactagttacgcaatgtaaagcaccactattttttcaggacatttattgacaacttcggcatgtcatgatagtctagtaaaggtgctttttgcagacagattcctgtatcaggaatacagacatgctgactggtcggctaagcgcacaattaccatgctccaggcattcttttttactcaaaaaagaaccacctggatgtgtggacttaaaaaacagatatttggaaggaggacactttagaacatgccaacaattaatcaattaattcgcaaaggccgtaagtctaaagtatcaaaatcaaatgccccagcgttaaactttgggtataacagttacaagaaggttgcaactaataacccagcgccacaaaagcgtggggttgctactcgtgtcggtaccatgactcctaagaagcctaactcggctttacggaagtatgcccgtgtacgtttatctaacttaatcgaagttacagcttacattcctggtattggtcataacctccaagaacatagcgttgtcttaattcgtggtggtcgtgttaaggatttacctggtgttcgttaccatgttatccgtggtgctttggatactgctggtgtcgaagatcgtcgccaaagccgttccaagtatggtaccaagaagccaaagaaataataaggaggtaagttaaatgccaagaaaaggtgcacctgcaaaacgcgaagttttagcagatccaatgtataactctaaattagtaacgcgtttaattaaccacttaatgttagatggtaagcgcggtaccgcatcaactattttgtatgatgcttttgatcaaatcaaagaacaaactggtaacgatcctttggaagtcttcgaagaagctatgaagaacgttatgccagtacttgaagttaaggcccgccgtgttggtggttctaactaccaagttccaatcgaagttcgcccagatcgtaagacgactcttggccttcgttggatcgttcaatatgctcgctcacgtggcgaacacactatgtccgaccggttagctcgtgaaatcatggatgctgctaacaatactggtgcttcagttaagaagcgtgaagatactcaccggatggctgaagccaaccgtgccttcgcccattatcgttggtaatatttccgtgagatggttaaaggtcgcctttaactaatcacaaaaaggtgactattatatgcgcgcatatagtagtcattttttgaaataaactttatactgttaattccatttatattgagaggagtaacacattttctaatggctaatacacgagaattctcactcgataagacccgtaatattggtattatggcccatatcgatgctggtaagaccacgactactgaacggatcttgtactacactggtaaaattcacaaaattggtgaaacccatgatggtgcttcacaaatggactggatggcccaagaacaagaacgtgggatcaccattacctctgctgccacgactgcacagtggaagaaccaccggattaacatcatcgataccccagggcacgttgacttcactgttgaagttgaacgttcacttcgggttttagatggtgcgatcgccgtattggatgcccaatcaggtgttgaacctcaaactgaaacagtttggcgtcaagcatcaacgtataacgttccccggatcgttttcgttaacaagatggacaagattggtgcggacttcaagtactctgtaagcacgatccatgatcgtttacaagctaacgcccacgccatccaattaccaattggtgccgaagataatttcgaaggggtcattgacttaatcgaaatgaaggctgacctttatgatgaagatcaacttggtactgaatgggatacggttgacgttcctgatgaatacaaagaagaagcccaagctgcacgtgatgacttaatcgaagccttagctgacatcgatgacggcatcatggaaaagtaccttggcggtgaagaaatcagcaaagaagaaattaaggctgctatccgtaaaggaacgttagcacttgaattcttcccagtattagctggttcagccttcaagaacaagggtgttcaaatgttaatggatgccgttgtggactacttaccatcaccacttgatgttaagccatacaaggctactgatcctgaaactgaagaagaagttgacttgattgccggtgatgataagccattcgctgccttagcatttaaggttgctactgacccattcgttggtcgtttgactttcatccgggtataccaaggtactttggaatctggttcatatgtcttgaacgccactaaggacaaacgtgaacgggttggtcgtttacttcaaatgcattctaaccaacggaaagaaatcccagaagttttctctggtgatatcgccgctgcaattggtttgaagaacacgactactggtgactcattgacttcgattgaccatccatatcacttggaatcaatggaattccctgacccagttatccaggttgccgttgaacctaagactaaggctgaccaagataagatgaacgttgccttacaaaagctttctgaagaagatcctactttcaaggctgaaactaaccctgaaactggtgaaactttgatcgccgggatgggtgaattgcatttggatatcatcgttgaccggatgcggcgtgaatttaatgttgaagccactgttggtgcgcctcaagtttcataccgtgaaacctttactaagagcactcaagttcaaggtaagtttgttcaccaatctggtggtaaaggtcaatatggggatgtttgggttgaatttacacctaacgaagaaggtaaaggcttcgaattcgaagatgccatcgtcggtggggttgttcctcgtgaatacattccttcagttgaacaaggtttgaaggaagctatggctaacggtgtgttagctggttatcctttggttgacgttaaggctaagctctatgatggttcttaccatgatgtcgattctagtgaagcagccttcaagattgccgcatcattagcattgcggaatgccgttaagactgctggccctgttatccttgaacctatcatgaaggttgatatcgttgccccagaagattacttaggtgatgttatgggtcacgttactgctcgtcgtggtaacatcgaaggtatggaagaacgtgggaatgcccaagaagttcatgcatacgttcctttggctgaaatgtttggttatgcaaccacattacgttcagctactcaaggtcgtgggactttcacaatgacctttgatcattacgaaaaggtaccaaagtcagttcaagaagatatcatcaagaagaatggcggcactcctgccaaataagcttgattgataataagaaggacgttcagcttcggctggacgttctttttttacataaatttctggtcgaactaaatgtgattactgctcgtcgtaagacaacgtggcacatcaattgaagcggcttgggataagtttggccgtcactggcattgggtacggctgtgacgagcacagtgctgctcaggactatgtcatcgcgcaagggtacaaccgcgcaacaagggtcgcactagttaagttactagccgctgcgaccataaaactggcagccataatattaagggtgcgagactcatagcataataaggagaacgcggacaacatcgcattttttgtatcggagatgaccacttgagttgacggttgtcagtggccacggccaaggtgctgacggtcggtgataagtagatgacaatataatagaaggtagatgaacaagaacgtgggtcagtgtgacggcgccgtcagatgtaggagcggttgaattaagcgtgttgaagtccgattaaatgactccagacaaaaatgtatgacgctgaacgcgggtcttgttcctgagaaagtgttaatgcaatctagtaggtgtccacatgatcgtggccggtcggcagtgagaaatgtaaagcgctcaccaaaaagaaattaggcgcaaacgctattaattggatggaatttgtgttacattaattgagctggttcaaaaaggtaacacggtttacaacgatggttataaaaaaagtgcgaaaacacttgctattacagagcttttcatttattatagattgtgcttggtatttagaaggggataactatatctccatcatcaagtagtcgtagttagctttgatgtgaaaggttgcgacacgcccggccacattgtcatgggacgtggcggtaattttcacggagctagtcttattttcaaaatagacgaaggaggtcacaacaatggcaaagcaaaaaattcgtattcgcttaaaggcatacgaacaccgcattcttgatcagtcagctgacaagattgtcgaaacggcaaagagaactggtgctactatttcaggtcctattccattgcctactgaacggactatttataccgttctacgttcaccacataagtttaaggactcacgtgaacaattcgaaatgcggactcacaagcggttaatcgatatcgttaacccaacgcctaagacggtcgactcattaatgaagttagacttgcctagcggtgtagatattgaaatcaagctttaatttactaaactaaaatcaattaattggaggtgtactcatgaccactaaaggaatcttagggaaaaaggtaggaatgacgcaagtcttcactgaaagcggcgaattagttcccgttacagttgttgaagttcaacctaacgttgtgttgcaagttaagaccgttgaaaatgacggttacgaagcaatccaattaggtgttgacgacaaacgcgaagtcttgacgaacaaacctgctcaaggtcatgcagcaaaagcaaaaacgactcctaagcgcttcattcgtgaaattcgtaatgttgagcttggagattacacagtaggtgacgaagtcaaagcggatattttcgcagctggcgacgccgttgacgttacgggtatcactaaaggtcatggttaccaaggtaatatccataaggacggccaaagtcgtggaccaatggctcacggttctcgttaccatcgtcgtcctggttcaatgggtgccatcatcaaccgggtattcaaaggtaagaaattaccaggccggatgggtaatcaccaacgtacgatgcaaaacttacaaatcgttcgtgccgacgttgaaaacaacgttttattaattaaagggaatgtccctggcgccaacaagtcatttgtaacagttaaaacatctgttaagagtaaataaggaaggaggacataatacatgactagcgtagcattatttaaacaagacggtacgcaaaatggtgacgttactttgaacgacgctgtgtttggtgttgaaccaaacgaaaacgtggtttttgatgccatcttgatgcaacgtgcatcaatgcgtcaaggaactcacgcagttaagaaccgtagtgctcgtcgcggtggtggtcgtaaaccatggcgtcaaaagggtactggtcgtgcgcgtcaaggttctatccgttcaccacaatggcgtaaaggtgggattgtcttcggaccaacccctcgttcatacagttacaaattacctaagaaggttatgcgcttagctttgaagtctgtcctttcacaaaaggtcttagacaacagcttagttgcagttgatagcttagctttcgacgcaccaaagactaaggattttgtaaatgtattaaacaacctcaacgtcgataccaagactcttgttttggttgaagaggacaatgaaaaggctgctttggcaggtcgtaacttaccaaatgttaagatccttaaagccaaaggtgttaacgtcttagatgtcgctaatagtgacaaattagtcgttacccaaaaagccctcgatcaattagaggaggcgctcgcataatggaagcacgcgatgtaattttacgtcctgtagttactgaatcatcaatggctgacttggacgacaagcgctacacatttgatgtcaacgtacaggcaacgaaaacccaagttaaaaaagcaatcgaagaaatcttcgatgttaaagtcgttaaagtgaacgttatgaacgttaaaggaaaacttaagcgccaaggtcgttacgccggctacactaagaagcgtcgtaaggctattgttaccttaagttctgattctaacgaaatcaagttgttcaacgacgatcaacaataaatctaatttaggaggtaactctagtgggtattaagaagtataaaccaaccactaacggccgtcgtaatatgactgcttcagatttctctgaaatcactaagacgaagcctgaaaagtcattattagactcacaaagtcacactgccggtcgtaacagttatggtcacattactgttcgtcatcgtggcggcggtcataagcaacaataccgtttggttgactttaagcggattaaggatgaagttccagcaaccgttaaggcaatcgaatatgatcctaaccggacagctaacattgcattattagtttacgctgacggtgtgaaatcatatatcttagcaccaaaaggtttggaagttggtatgcaagttcaatcaggtgccgaagccgacatcaaggttggtaacgcattaccattaactaacatccctgttggtactgttattcacaacattgaattgaagccaggtaagggtggccaattagctcgctctgctggtacttcagcacaattactgggtaaggaaggcaagtacgcaattgttcgtttgtcttctggtgaagttcgtttagtattattaactagccgtgctactattggtactgttggtaatgaacaacacgaattaatcaactcaggtaaagccggtcgtacacgttggcaaggtaagcgcccaactgttcgtgggtctgtaatgaaccctaacgatcaccctcatggtggtggtgaaggtaaagcaccaatcggtcatccatctccaatgtctccatggggtaagaagacgcttggtaagaagactcggaacaagaaggctcgttcaaacaagcttatcgttcgtggtcgccgtccaggcaaacactaataaaatttgaatttactgtagttatcgagaggaggtcacacgatgggtcgtagtttaaagaagggacctttcgcagatgcgcatttattaaagaaaatcgatgcacaatctgattctgacaagaaatctgtcatcaagacgtggtcacgtcgttcaacaattttcccaagttttatcgggtacacaatcgctgtttatgatggtcgcaagcatgtcccagtttacatccaagacgacatggtcggtcataagttaggtgaatttgtaccaacacggacgttccatggtcatggaactgacgataagaaaacgaagtaatagttaggaggatataaagaatggctgaacaagtaacatctgcacgtgcaactgcaaaaactgttcgtattgccgctcgtaaggtccgcctagttgtcgatcttatcagaggtaaaagtgttgccgaagccttagcaatcttgaagttcactccacggggtgcttctccagtagtagaaaaagttttactttctgctgttgctaacgctgaaaataactttgacttagatcgcgaagatttggtcgtaagcgaagcttttgttaacgaaggaccaaccttaaaacggttccgtccacgggcaaagggttctgcttcaccaatcaacaagcggactagccacattacgatcacagttactgaaaaataggagggataacgcgtgggtcaaaaagtaaatccaaccggattacgtgtaggaatcattcgcgactgggaagcaaaatggtacgctgaaaaagattttgctgcctacttgaacgaagatttacgcatccgtaagtatatcgaacaacgacttgccgacgcttccgtctccaccgttgaaatcgaacgcgctgcaaaccgcgtaaacatttcaatccataccgcaaaaccagggatggttattggtaagggtggttctgaagttgaagctcttcgtaaagaattaaacaatttaactggtaagcgagtacacatcaacatcatcgaaatcaagaagcctgatttagatgctaaattagttggtgaaagtattgcgcgtcaattggaaggccgggttgctttccgtcgtgcgatgcgtggtgctatgcaacgtacaatgcgttccggtgctaagggtattaagacacaagttgctggccgtttaaacggtgccgacatgtctcgtgttgaagcatactcagatggtacggttccattgcatacgcttcgtgctgacatcgactattcatgggtcgaagcacggacgacttacggtaaattaggtgttaagacctggatctaccgtggcgaaatcttgccagaaaagaaatctgctaaaggaggaaactaaacatgctggtacctaaacgggttaagtatcgtcgtgttcatcgtggtaaaatgcgcggtgaagctaaaggcggtaaaacagttgcttttggtgattacggtttacaaaccctcgaatcacactggatcagcaaccggcagattgaagctgcccgtgttgctatgaaccgttacatgaagcgtggcggtaaggtatggattaagattttccctcacaagtcctacactgaaaaaggtgtcggtgtccggatgggtaatgggaaaggtactcctgcaggttgggtagcaccagttaaacgtaacaagattatgtttgaagttgctggtgttccagaagaagttgcacgcgaagctttacgcttggctggaactaaattacctgttaaaactaagattgttaagcgtgaggaagtaggtggcgaatcagatgaaggctaaggaaattaaagcattgtccactactgaaatgctcgaaaaagaaaagtcttacaaagacgaacttttcaacttgcgttttcaattggccactggtcagcttgaaaacaccgctcgtttaaaacaagttcgtaagaacattgcgcgtattaaaactgcgttgcgtgaacaagagttaaacaagtagagtataaaggaggcaatcacgaatgagtgaagatactcgtaatagccgtaaggttatccaaggacgcgttgtttctgacaagatggacaaaaccattgttgttattgtcgaaacttacaagaaccatccggtatacggcaaacgtgttcgttattcaaagaaattcaaggctcatgatgaaaagaatgaagccaaaactggcgatatcgtcaagatcatggaaactcgtcctctatcagctactaagcgtttccgcttaattgaagttgttcaaaaagctgttattatctagattattagctgaataaaattacatgaagggaggacacttactgtgatccaacaagaaagtcgtttaaaagttgctgacaactccggtgcccgtgaaatccttactattaaggtattaggtggctctggtcgtaaaactgctaacattggtgatgtcattgttgctacggttaaacaagcaacacccggtggtgttgtcaaagctcatgatgtcgttaaagctgtgatcgtccggactaagtctggtgttcaccgtgctgacggttcatacatcaagtttgatgaaaatgctgcagttattattcgtgatgacaagactccacaaggtactcgtatctttggacctgtcgctcgtgaattacgtgataaggacttcatgcgtattgtttcattagcgccagaagtactctagtcacacaccgtaaataaggaggtgcgcaacctaatgttgattaaaactggtgataaagttcgagtaatcagcggtaaggatcgtggtcaagaaggtactgttaaaaaggttatctctgccaagaaccggatcgttgttgaaggtgttaacaagatcaagaaacaccaaaaaccaacgaacgttaacccacaaggcggtatcgtggacatcgaagcaccaatcgatgcttctaacgttatgtaccttgacccatcaaccaacgaacctacacgtttaggtgttcgtcgtgaagatggcaagcgtgtccgttacgctaaaaagtctggtaaagacttagaaaactaagactgactgaaaggaggaagcaagtttcatggaaaaccgtttaaaagctcaatatgaaaaagaaatcgttccagcattagttgacaagttcaattacacttcagtaatgcaagtgcctaagctggctaagatcgttttgaacatgggtgttggtgatgcagttaccaacgctaaaaacttagacgaagcagttgaagaattaactttgatctccggtcaaaaaccattggttacccgggcaaagaaatctatcgctggtttccgtcttcgtgaaggtatggcaattggtgccaaggttgacttacgtggcgaacgtatgtatgacttcttggacaagttgatcaatgtttcattaccacgtgttcgtgacttccatggtgtaagtactcgttcatttgatggtcgcggtaactacacattgggtgtccgtgaacaattgatcttcccagaaatcaactatgataatgttaaccgtgttcgcggtttagacattgtaatcgttacgacagctgatagtgatgaagaatcacgtgagttgttaactcaatttggcatgccatttgctaaataaccgaagggggttaatcgaagttggctaaaaaatcacaaattgctaaacaaaagcgcggtgctaagtttaacgtacaaaactacacccgttgtgaacgttgtggtcgtccacattcagtttaccgtaaattccacttgtgccgtatctgcttacgcgacctggcccacaaaggtcaaatccctggtatgaaaaaggccagctggtaaaaacaaacccaagttaaaggaggttaaactttcatgatgactgatccaatcgcagatttcttgactcgtatccgtaacgctaacatggtacgccacgattcactagaagttcctgcatcaaaaatcaaacgcaacattgctgaaattttaaagaatgaaggttttgttcgcgacgttgaatacatcgatgatgacaaacagggcatcatccgcgtcttcttgaagtatggtaaggacaacgaacgtgtaatcagtggcttgaagcgtatttcaaagccaggtttacgttcatacgtcaaggctgatgctgttcctaaggttttaaacggtttagggattgctatcatctcaacttcagaaggtgtcattactgataaagaagctcgcgccaagaagcttggcggcgaagtattagcttacgtttggtaatcattaattaagacgggaggtgcaagtaagtgagtcgtattggttataaagtaattgaactacctgctggggtagaagtatcacaagctggtgaagtcgttacggttaagggtcctaagggtactttaacgcggaacatcgccagtgatattacgatgacggttgaaggcaacgaagttaaattcactcgtccatctgatgactacaagatgaaggcattacacggtactacccgtgcaaatgttaacaacatggttgaaggggttactaagggctttactaagaaccttcaattggtcggtgttggttaccgtgcccaattgcaaggcaagaagttagtattaagcgttggttactcacaccctgttgaatttgcaacgcctgaaaacttgactgttgaagttcctgataacacgcatatcaatatttctggtattggtaagcaagctgttggtgactttgctgccgaagttcgggccgttcgttcacctgaaccttacaaaggtaaagggattcgttacgtcgatgaatatgttcgtcgtaaggaaggtaagactggtaaataatgcagcgtaaagctgtccatactaatatatagaggtgactattgtgatttccaaaccagataaaaacaaaacacgtcaacgtcgtcacgcacgtgttcgcggtaagatttctgggactgctgagcgcccacgcttaaatgtttatcgttcaaacaaaaacatctacgctcaagttattgatgatgtagagggtgtaacgctcgcaagtgcctcaactttagatagcgaagttaaaggtaacaacaagactgaaaaggctgcatctgtcggtgaagttgttgctaagcgtgctgctgaaaagaaaatcgttgacgtcgttttcgatcgtggcggttacttatatcatggtcgggttcaagctttggctgaagccgctcgtgaaaacggacttaaattctaacaaaggaggaataataccatatgactttcattgatccatcaaaattagatcttgacgataatgttgttgccattaaccggattaccaaagttgttaaaggtggtcgtcgcctacgttttgctgcattagtaatcgttggggaccacaagggacacgttggtttcggtactggtaaggctcaagaagttccagaagcaattcggaaagcttccgaagctgctaaaaagaacttgatcactgtaccaatggttggtaccaccattcctcatgaagcacttggtgtttacggtggtggccgcatcatgcttaagccagccgttgaaggttctggtgttgccgctggtggcgccgttcgtgccgtcatggaattagccggtgtggatgatgttactagtaaacgattaggctcaaacacccccgttaacgttgttcgtgcaacgttcgaaggcttaaagagcttaaagactgctgaacaagtcgctgctttacgtggcgtttcagccgaacatttagctgaatagggaggacaaacaacatggctcaattaaagatcactttagtacgcagtgctgctcaccgtcttcctaagcaacgtaaaatcgttaaggaattaggtttgggtcggattaatagttccgttgttaaacctgatgacgcagcaactcgcggtcaaattttccacatcgcacacttagtcgatgtcgaaatcatcaagtaattcaaattttcaaagaggaggtgcctactaaatgaagttacatgaattaacacctagtgaaggttcacgtttttcacgtcgtcgaattggtcgtggtgactcaagtggccaaggtaagacttctggtcgtggccaaaaaggtcaaaaggcgcgtggtaaagttcgtgtcggtttcgaaggtggccaaatgccattgtaccgtcggattcctaagcgtggatttactaacattaaccgtaaagaatatgcggttgttaaccttgacggcttaaaccgttttgatgatggtgccgaagttacaccagaatcattaaaggaagctggcttagttaagaagagttctgctgttaaagttcttggtaatggtaaactcaacaaaaagttaacagttaaggcaagcaagttctctgcaacggcggttgcagccattgaagctgctggcggtaaaactgaggtgatctaatttgctgactaccatgaagaacgctctcaaagttaaggatattcggaataaacttctgttcacgttgggcgttttgattgtatttcgtcttggctcttatatcacagttcctggagttaatgcacaggcacttcagtcggtggcatcttcagggctgataagtatgttgaatacattcagtggtggcggtttaacaaattattccatccttgctatgggggtatccccttacattactgcacaaatcatcgttcaattgttacaaatggacattgttcctaagtttgttgaatggggcaaacaaggtgaagttggtcgacgcaagcttaatcaagcgacccgttggttaacgatcgtcttggcctttgttcagtcgattgggattacggctggttttaactctttgagtcaactcaagctcgttaacaatccaagtatttcgacttacctgaccattggggtgatcctcactggtggggcaatgttgacgacttggatgggtgatatgattacggatcgaggaatcggtaatggggtttccattattatcttcgccgggatcattgcccgtatgccaacatcgatttatcaaatttatcaagaacagttcgttaatgtttcacagagcgactggtggaagagtggcttgtttgttgttgggttagccttgcttgtgctgatcatcgttatgtttgtaacgtgggtcgaacaagctaatgaccgaattccaattcaatacactcgtcgtgcagctggtgcacctgacagtagttacctaccattaaaggtgaacgttgccggggttattcctgttattttcgcgagttccttcattgcaacgccccaaacgattttgctaggattccaatccagtcatggtgacgaaacctggtataccgttttgagtaatatcttcaatatgcagtcgacgactggtgctattctttacaccattctgatcgtgctcttcacgttcttctatgcgtttgttcaggtcaatcctgaaaagctctctaagaacttacaaaagcaaggcagctatattcctggtgtttggccaggtaaggatactcaagattgggtttcaaaattgttaatgcgactaagtacggtcggtgccctctaccttgggttgatttccttgattccattattagcttctgatatttggggtctcgatgaatcaatcggtttaggtgggacgagtttactaatcgttgttggggttgcccttgaaacaattcgtcaaattaaaggattgatgatgaaacgtgactatgtcggtttcattcgttaatcagcgaatgtgttggggagactcaacacatttgtgcattcaggaggaaaaaacatgtcaacaatgaacctgattttaatgggattaccgggtgccggtaagggtactcaagcacagaagattcttgaagattttgatattccacatatctcgaccggagatatcttccgtgcagccattaagaacgaaacgaagatgggcttggaagccaagaagtatattgatgcaggtaacttagtaccagacgaagtcactaacggcatcgtccgtgatcggttagctgaagcggatactaaaaatggtttcctattagatggttacccacgtaacatcgatcaagctcatgctttgaaacaaatcggtgaagaactcaataagccacttgatggggtcatcaacattcatgttgaacccgcagtacttgttgaacgactttccggtcggtttatctgccggacttgcggtgcaacttaccataagttgtacaacaagcctaaggtagaaggaacctgtgatgtgtgtggcggtcatgatttctatcaacgtgatgatgacaagccagcaaccgttaagaatcggttagacgtgaacattaagttgaacacgccattaattgattattacggtcaagaaaagttactctacaatgtcgacggtgatcgcgacattgatgatgtctacaaagatatcaagaaaattcttgataacctgtaaaccaggttccttcagcagcgacgtttgcttttcaaaggtcgttgtgataaaattattcaggtttagccgttgactgatttaatatttttttaatgttatgattagacaatgactggttcagtaatggaccaaatacgtggtagcacggaatctgataataaggagggacagtacttggcaaaggaagacgtcatcgaaattcaaggaaccattaaagaaacgttgccgaacgcaatgtttaaggttgaacttgaaaacggcgctgaaatcttggcacacgtatcaggtaagattcggatgcattacattcgaattctgcctggtgacaaggttacagttgaaatgtcaccttatgatttaactaagggccggattacctaccgtttcaagtaggctcggtctacgtaccttataggaggtaaaaaactcatgaaagtaagaccatctgtaaagccaatgtgcgaacactgcaaagttattcgtcgtaaaggccgcgtgatgattatctgctctgctaatccaaagcataagcaacgccaaggtaaataatttaattaagttggaggtgaaatattaatggctcgtattgaagggattgacttaccacgtgacaagcgtattgtcattggtttgacttatatctacggtatcggtaacacttctgcacagaagatccttgctgaagccggcgtttcagaagacgttcgtgtacgtgatttaactcctgaccaggaagacaaaatccgtgccgttgtcgatggctacaaaactgaaggtgacttacgtcgtgaagtcagcttaaacatcaagttattgcaagaaatcggttcataccgtggcatgcgtcatcgtcgtggtttaccagttcgtggtcaacacacgaagaacaatgctcgtactcgtaagggtaaaaaggtcagcatcgctggacgtaaaaaataataataaaggaggttttcgaattttatggcaactagaaagacaacccgtcgtcgtcgggtaaagaagaacattgaatctggtgtggctcacatccattcaacgttcaacaacacacttgttatgatcactgatatgcaagggaacgccattgcatggtcatcagctggttcattaggtttcaaaggtagtcgtaagtcaacaccttttgctgctcaaatggctgcagaagctgctgctaaggcatcaatggaacatggtatgaagactgttgaagtcgctgttaagggtcctggttcaggccgtgaagccgctatccgtgctttacaagctactggtttggaagttagcgcaattcgcgatgttacgccagtgcctcacaatggttctcgtcctccaaagcgtcgtcgtgtttaatctgtgacgttcattttgagggcaaacttcattttgtacgcacaactactaaacaccacgcgttttgaaaggggtaaaagataagaatgattgaatttgaaaaacctaacattcataaaattgatgaaaacgacaactatggtaagtttgttgtagaaccgcttgaacgcggttatggtacaactttagggaattcacttcgtcggattcttctttcttctttacctggcgctgctgttactagtattcaaattgatggtgttcttcatgaattttcaacgattgagggcgtaacggaagacgttacagcaattatcttgaatgttaagaagattgcacttaagttggaatcagacgaaaccaagacgttggaaatcgacgttaagggtcctgctaacgttactgccggtgatatcattggcgatgcggacgtagaagtcttgaatccagacttaccaatttgtaccgtagcagacggggcacacttccatatgcgtatgaccgcaaatactggtcgtggttatgtttccgctgaggataacaaacatcgtgaagatgacatgccaattggcgttttagctgttgattcattgtattctccaatcgaacgtgtcaactatcaagttgaaaacacgcgggttggtcaacgtgatgatttcgataagttaaccttagacgtttggacaaatggttcaatcactccaagtgaagccattagtctatcagccaaaatcctgactgatcacctttcaatcttcgtaaatctcaccgatgaagctaaaaacactgacgtgatggtcgagaaggaagaaacgcataaggaaaagatgttagaaatgacgattgaagagttagatctctccgtccgttcatacaattgcttgaagcgtgctggcatcaacacggtccaagaattaactaacaaaactgaagctgatatgatgaaggttcgcaaccttggacgcaagtcactcgaggaagttaaggcaaaattagctgaccttgggttatcattacgcaaagaagactaatacaagggaggatatccgttcatgagttaccgtaaattacaacgtacaagttcacaacgtcgtgccttattacgcgatttgacaacgtcattgatcgttaacggcaagatcgaaacgaccgaagcccgtgctaaggaagttcgttcaactgctgacaaaatgatctctttggccaagaagggtgatttaagcgcccgtcggaaggctgccgcattcatgcgggacgtcgttgccgatgttaaggaagatggcgacaacgtggctgtacaaactgcattgcaaaagctatttagtgacttaggtcctcaatatgctgaccgcaatggtggttacacacgaatttacaagactatgcctcgtcgtggcgacggtgcacaaatggttgtcttggaactcgttgactagttaagattgttttacggatcactgggactgatgattgacgggcgttatgatggtggctactggcaaaatagtagctaagtctagttcggaagttatttatggttagacatagatggcatatcgcagttctaagtgattttttttggtgctagttacgagcaaccgctgatttagggattgattccctaaatcagcggttttttgttggaatggataggtgtttttaatactcgtgatgacaacggtttgttatttgcagattatgacctgttgaatcgggaaagtggatatagtggtctcaggtactgactgtgaagatgaagcacatgggcgtttagctgtgtctgggcgacaaaaaaggtatcaaacaggatgcttgataccttagtcgattgattactagttaattatgccggtccaacagccgtttggttagactaatcagatccgtcttcgcaggctggtctggaagtttacgcatgattgccagcgcgtcttgagtgtacttggtagcgagttcttgggcttgcaccacaccgccggcattgatgacaagtcgttgtacttcctggcgctgagtgtccgaaattgccccctgtagtcgcatcagcggcaataaatcgtgcttagcttctgtctgtaaggcaaaaatcaacggcgaggtgtagacaccttcagcaacgtcttcgaggatgggtttgcccgtttcctgactgacttcttgatagtctaaaatatcgtcaagaatttggaaggccatcccaattgcgagacctgctttacgagcgcgctgggcgaaatgactactttgaccagattcataagcacctagaaaacaactcagtgcgaataactcggcggtcttaccttgaatttgttgcaagtattctgccatggtaatgtcaaggtggtagtggcggtccttttgttggacctcgcccactagaatcttttccatgttctcagagttcatctggatgcttttgaaactgcttgaatagtgcgctagaatcttgaataccacaacgaataggtagtcgcccgcatacacagcagtatctttaccaaaacgttcttgaatcgtgacatggtgccgacgtagtgcagcatcgtcaacaatgtcatcatggatcagcgtagcggtatggagcgtttctaatgacgccgctaaggccaccatccgttgccgatcagttgttgtaaattgtgagaataggaggcagtatgccgggcgtaagagcttaccaccaccatgaatcatttctaaaatcgcgtcattgatgtcggcatcttgaatattgatgttcgccgtcatcagctgcatcacttgttgcagctccggttgtagtgccgggtaatcacgccaaattgggtgtaattgtgttgccgattgcatatgggttactcctttgtttgatctggatggtgttctcgattgaatttgagatagcgtaagatcgtgacgtgggtgaacaagtagttggcggcgattccgagagcacttcccgctgctagtccaataatcgaaagcactggcaagtagagcatgaccgtccacgtctgtgcaataagactcgcgaccaatagctgaccaacattatgcataacgccaccagttgctgaaattccaataatactaacgcgtttaggccctaattgtttgaccaacagcatggcaaacaggctgagaaaggcgcccccaaaactatacagaaaggttgataaagtgccacctaggagggccgttaaaatcaaacggagccaggttagggttatcacgtcagttaatgataatgtatagattgcaacaatggtaatcagattggctaaaccaagcttggcacctggggcaaaggcaaacgggaatggaatcatccgttcaaggatgccgatgatcacgccttgtgcaaccagtaacgcgatataaatattacgatgagttttgtttgatcgttcaaatgaattattcatattctactccgtaactaaaccattaccgccagatttgacttgaccgttgctggccttaatttcaaccaagagtttgtggggcaaacaaacaatcgtttgaccaggtttatgaatccagcctcggcggacacatacttggtcagaacagttggctttcgtaatcgcaacgcgcttaggtttaaatgtgatcgtgttgtagtgcccatggttatcgcgataggtgaagtgcttagtcgttttcagattcgtaatattgacacgcttcaagacggtcccattatgtgagaccacggcgttatacgtggtttcactgctcgtggcctttcgcttagccactagtgccgcatgttcagcttgttgtttttgctggtatgaaaaaatcgctagtggggtgaacgataaaataattagcgcaacaataataataatatcaaacggcttgatcatatccccataacgtttgaatgtccggatcattgtccgtaatttacgcatcgttaaccctccaattcaatgaaataaaaaatggttcaaggggggaaaaacaacccttgaaccatcgggaaaggatttaattaattataacgcatctagcgggttttaacaccgtcgtaatgagaacgaacgttgccgtaccaccagtgtccaaggtgtttttgcatccacggaacgacccagtagtctaacccaaatgtccgtccggaaccgttcattaaggcgagggcaacaaagatcatccaaatgttgacccagtagaacatgccagataagcagaagacgacaactaagccaatggtgactgcgttagcaaaccaagtaaagagtccgaagaaaatacataatgcaatgacgatttcaacacaagtcatgaatttctggaagaagagggccatttgcatgttcggaatgaagaccttggtaattgattcgaaccaatgtggcattttgtcaaagaccatcaggggttctttaccgtacatgtatgaaagactgaagacacccttagcggctttagcggttgacgtggcagtttcagaagcaccactggttgcagcggctttagttgcttgagaggcaccactggttgcggccacggtaatccattcgaatggtaaccgtaacttgtcagtgaaccaggattcagatccctgaactttagtccagcagtcccataaccacatggcaccatagaagaaccgcagtggcacactccagagtacgttaccagcccgtgagacccaaccgcggaagacgttacggttattacgagtccggaagaattcgtgcatgaagtactggaataggtagtaacctgagaaaatctgaacgtagtacatccagttgatggcgtgttttaaaagcacggcaataaaaccagagacgttccacttctctaaaacttgtgcaacggcatatttggaaccaattgagtcgacggatgcttgataagcgcccttaaatggcttgatcgtaacgtcagtctggtcaacgttcttaataataccttcgacggccttagctgcggtttcttcagccccttgaacgatttgtgggactggccgtggttggtcaggttcttggtagctggttgaatcaccggctaagaagatattgttacaatccttagcttgcatgaattcattggccatcaagcgaccaccgcgggggttagtttcaatgccgaactttttaacgatactattagcacgaacaccggctgtccagattaacgtgtaggttggaattggatccttgccttttaagttaacatggtcttcacagacttcggtaatcatggagttcgtcatgattttgacaccatgtttttccatgtacttagcggccttaccggcttgcgtccggttgagcatgttaataatagtcggcgctgcttcgaccaattggagcgtgatttcacttggatcgagcttgttgtctcgagccaaaacatcacgatattcgattaattcaccaatcagttcagaaccagtaaaaccagaaccacagactgtaaaggtcaacatggctttgcgcttagcagggtcgagctccgccgccccccgccgaataattgcagataagtgagcacgcaatgccatcgcttgttcgaaggaccacaattcgaagccgtgttccttaacaccgggagtcccaaagtcattggattccccacccaaactaattaaaagttgatcatattgataacttccgtgttcggtagtaactgtttgtgcctttttgtcgatgcccgtcacggtatcggtcacgagacgaacgttttttcgccgtgcgaacaaccgttgcaaatcatattggatatgctcaggttccacccgttcggtagcaacttcatgtaattcagtcatatacgtgaagtatgaatgccggtcaatcaacgtaatctcgacgtctgcattttttttgaaatgcttagacagtttcttggttgcgtaaacaccagcaaaccccgcaccgacaacgacaatatttttctttgccattgcgtaacaactcccttgaataatagtgtaaaaagataattccactaataattataacgataatgtaagcggttgtctatggattatgggaaagaatgcataaactatcacattatctaagccgcgaaaatagtggcatcgaggtttgaacggaaaacgttgtcaataccgctattattaggctaaaatatcatttttttaatggaatgggattgactattaccagtttaaacgttaagattaatgtgaattttcatacaaaaaggttaggagtgggatatcatgaaattcaaatcagttattacgggtgcttcagttgttgcaatttcagctttagctttagcaggttgtggcagcagttcttcaagttctagctcgagttcatccaagaagagttcatcttcaagctcatcagctaagacaactaaggttgctaaattaaccgctggcagcaaaatgaaagcgggtacttataaccttgaagaagaaaattattcacatggttatcggaccaagatgagtatcacagttaataacaacggtaaaatcactaagtccagttatgaccaagtgaacaagaacggcaagtccaaagttgatgatacttcatataacaaacaaatgaagaagatcgctgggactaaccccaagacttacatgcctaagttaaacaagacgctgacgggctctgccgctactggtaacgtgggctccattgatgttgtgactggtgcgactgaatcatcaaagaccttccaaaactacacacaacaattagttcaagctgcccaagcgggtaacaagtcgaccattaagattgacaatggtgccaagatgaaagatggtacctacaagttgaacgaaaagaactactcacacggttacaaagttactttcgcaatcacggtcaaggataataagattacgaagtctgaatataaccaagtgaacaagaatggcaagtccaaagttgacgatgcagcttacaacaagcaaatgaagaaggttgctaagactaaccctaagacttatcaaccagctttgaacaagtcattagttaagagtagtgatccaactaaggttgacgttgtcacgggtgccactgaatcttctaacacctttattatgtacgcggaacaattacaaaacgcggcacaaaagggtgacaccaacacgattactgttgacaacatgattttctctgaataagcaatttaattattagattcttttgaggcctgaggcgcatgctgagggccttttgtttttaattgaacaaccacaaaagtttgtcactcagttgggcacgactttgagcaagctaaatccatacatggatattggtttaaaaaataatagtggcggtgaatgttaagtgcaaaatggctgtggtaatacaaacccgaccgtcgagttgtaccgtttgctgtaggtgcgctgatgtcagactagcgtagaaaagcttggatgacgcgcaaacagtctcaccggatgaatcaagactttggtataatgacaattgaaattaaaaataggggaagtattggaatgaagctaaaaaaatgggttcgaattggattaattgttgcaatgatcgtgccattgacggcgtgtgggacgagtacgagtcgcaaaaatgctgctagtagccgacccaaaccaactaaggtcgtcaagacgccgatcgaggatacccagttcatgatgggcacagttgtcacgttgcggatttataataagggtaaggataacgtgttagctggggcgtttaagctgttgaaaacggaagctaaggaaattacggtcaatcaaaaaggatctgaaattgataagatcaacgccgctgccggtaaaaagccagtggctgtcagcaaggatatctacccaatgatcaaagcagcttactattatagtaagaattcagacgaatcctttgatttagccattggtccgatcacatcactctggcatattggattttccgatgccaaggtgcccactcaacaagaaattgataagaacgttaagctggtagactacaaaaaagttaaattaaatgacaagaaacggaccgtttatctagaagaaaagggaatgcaactagaccttggtgggattgccaagggttacatgaccgatcaagtgaagacgtacttattaaatcatggggtttcaacggccattattgacctcggtggtaatatttatgttctgggtgacagccctaaaggaacgaagtcaggtaactggacagtcggtatccaagatccaaaagcgtcacggggtacggccattggctcactacctgctaagaataagtcaatcgttacttctgggatctatgaacgctatttgaagaagaatggtaaagtttacagtcatttgatggacccacaaacaggggcaccttatcaaaacaatttgatgggcgtttccatcatctcgaagaagtcggtggatggcgatgcactatcgacggccacctttgacaaaggcctcaaaggcgggatgaagtacattaatggtaaagcggatcaaggtattggggccatttttattaccaaggataaaaaagtatacgtctccaataacttgaagaagcagttcacgctgtttggcgatgctggttacaaatacgggccagccactgatttaaagtaagattggacgtgaagttcagttactacaagttccgtcagatatgttatgataataaccatgaattttaaggaaatgagggacaatggtgagtccgattattgacgttaaacatttagattatcgttacccgcaacaagctacggatcagttaacgttacacgatatttcatttacggtcatgccgggtgaatgggtcgccattgtcggccataacggttctggtaagtcgaccttggccaagaatttaaacggactgttagcaccagcggccggaacgattacggttgatggtcaagtattatctgaagaaaccgtttgggacattcggcgcaaaattgggatggttttccaaaacccagataaccaattcgttggggcaaccgttgccgatgatgttgcgtttagccttgaaaaccagggcgtgccgcgtcctgagatgctaacgcgggtacaggcggctctagaacaagtcaacatgcaggattttgcgacacgtgaaccggcacgtttgtcaggtggtcaaaaacaacgggtggcgctggctggtatgatagcggcgcggcctcagattttgattctggacgaagcgacgtcaatgttggatccccgtggtcgtcaggaagtattgacgacgattcgcgatatgaaggctaattcagcgttaacggtcttgtcaattacgcatgatattgacgaagcggccagcgctaatcgggtcttagtgatcaatgacggtgaggttaaggaagaggggactccagcggaaatttttcagcatggagaagccttaattaagatgggattggacatgccatatgctgagcgcttaaaagcagcgctaaagcggcagggtgttcaagtgcccgcacagtatttaacagagaaaggaatggcggactggttatggcaattacgttcaaacaagtagattttacttaccaaccgggtacgccgttcgaaactaaggcgttaactgatattaacgtcaccattcccaccggctcttatacggctttgattggtcatacggggagtggtaagtctacacttttacagcatttgaacgccttactcaaaccgactagtggaacggtcacgattggtgaacgggtcattacgccaacgacgagtaataaggacttgaagcgattgcggcaacacgtgggcatcgtctttcagtttccagaaagtcagttgtttgaagaaacggtggccaaagacattgcgttcgggccccagaactttggggctagcgaagcggatgctttgaaaactgcggctgaaatgttggctttagttgggttagacgagtcgttactgacgcggtcaccgtttgacctctctggtggacagatgcggcgagtggccattgcgggggtccttgcgatgcagccacaagtcctagtcttggatgaaccgactgccggattggaccctcagggccgtttagatatgatggagatgtttgcccgtttgcgtcatgaacgtgatttgaccgtggtactagtgacccatcagatggatgatgttgctaattacgcggataatgtaatcgtgatggatcgtggacaaatcgtcaaaacggggacgcctcgtgagatcttcaaagatcctgcgtggctaactgcccatcaactgggcttaccgaaaacaacggcctttgcgcatacactccaaaagcaaggctggcaatttgatgagtggccgttgaccgaggacgaattagcagcagccatcgtccaacagttgccaccgaacgcgatgggggaggtggccgctcatgatgaataaattgatctttggtcgctacattccgggagactccgtggttcaccatatggacccccgggcgaaactgttattgagtttttatttcattgggattatttttattgccaataactgggcgacctatgccttgctatttgtctttacattggccgctatttacctatccggtgtgaaatggtcgttcttcatcaacggtgtcaaaccgctgatttggttgattttattcaccgtcatcctgcaagtgttgtttagtgcaagtggcgggcacgtttactttcaatggggcatcattacaatcagccaacttggattgatcaacggggtctatattttttgccggttcgtgttgattatttttatgtcaacgctgttaactctaacaacgccgccactggaattgtcggatgccatcgagtatatcttgatgccgctcaaagcggtccgttttccagtctatgaagtggcactgatgttgtcgattgccttacgctttgtgccaacgttgatggacgaaacggaaaaaattatgaatgcacaacgggcccggggggtcgactttggtgagggcaatatctttcaacaaatgcgtgccgtagttccgctgctgattccgctgtttgtcagctcattcaaccgggctgaggatttagcaacggcaatggaagcacgtggctatcaaggcggcgagggtcgcagtaagtaccggattcttaagtggcaccaacgtgatacgtgggctaccggatgctttgcgatcttgaccgttgcattgattttcttgcgtgcataaatgaagactgattaacgtgggcgtcgcactgatggcgacccacgtttttaactggagggatattgtgaccacgcggtataaagtagttttagcatatgacggcaccaattttgcgggctttcaacgccagccacaccagcgaactgtcgagcaggtcgtcactaaggcggtcaataagatggcgaaagatcccgttgaaccgattgtgatctacggcgcgggccgaacggatgctggtgtgcatgcgtttggacagacgttgcattttgacttgccgtacgaaattaatccagaaggggttcggcgcggcctgaacagcatgttaccgatggatacaatcgtaaaggccgtttccattgtgccgaatgattttcacgcgcgttatgatacggtcggtaagcggtactggtatcgggcctatcaaaatgaatttgtagatccatttaaacggcactatacggggcattttaagttcgctgcggatatcgaccgaattcagcaagccatcggtgacttagaaggacggcacgatttctcgaccttcgttgcgtccggttcacaagcacatgaccatgttcgtgagatctattcagccaaagcgtgggccttgccggatgaacgcgaaattcagtttgaattttgcggtagtggttttttatataaccaggttcgaatcatggtggctgttttgatggaaattggtcagggccggcgcgcagttgactgtattccagcgttactagcggctaaggaccgtgagcaagcgcggggaacggctcccgcggctggactttatatgaaaaaagtgtattatgaacaaaatgaattacaagctgatttgataaagtattgacttctgaggcgaaattaggtagactagtcgttggtattgtttgccccacgataagccccggaaatcttattgagtgtcaaacaaacacagaaaatggaggaacacaacgtgcgtacaacatatatggctaaaccaggtgaaattgatcgtaaatggtatgtagttgatgcaaccgatgtacctttgggtcgtctttcaactgtcgtcgcatcaatcttgcgtggtaagaacaaacctacctttacccctaacgtggatactggtgataacgttatcgttattaatgcaagcaaggtcgctttaactgggaagaaagcagaacggaagatttattatcatcatactgcttatgctggtggtttaaaggaacggactgccggtgacttcttggcaaaggaacctactaaattgattgaaacttcagttaagggtatgcttcctcacaactctttaggccacaagatgggcttgaagttgcatgtttatgctggtgcagaacatacgcaacaagcacaaaagcctgaagttttggacatcactaacttaatctaaggaggaaactacattggctcaagtacaatatcgcggcacaggccgtcgtaaagattcagtagcccgcgtacgcttagtaccaggtactggtaaaattgttatgaatgacaaatctgttgaagattacattccatttgcagatattcgcaaggaattgttacaaccattcgaagtaactgaaacaactgatcaatatgatgttttagttaacgttaatggtggtggcttccatggtcaagccggcgcaactcgtcatgggatcgctcgggcattgctcgaagttgacccagatttccgtactcctttgaagcgcgcgggtctcttaactcgtgatgctcgtatgaaggaacgtaagaagccaggtttgaagaaagcccggaaagcttcacaattctcaaaacgttaatattatccaaaaacgttgttttatcaacattttctggctatatgagaaagcacctgtctatggacgggtgctttttttttggttgagtgagaaaaaaaccacaaaaaaaccatatgacgtggctcaacgagataaataacccatttgggcaggttttatttgatactaattggttcgaatatagcccgccttgaaacaaactaagcaagtaacgctcggttacttaaaaatggattgggccattgacggctcaatccattttaattactgacgtttagttttaccaaaagagaagacggcaacgcaaccgaggccggtatggctagtgatggtcggcccaatgtgttcgagcaaaatttcagcatcaggaaccttggctaaaatcttttcacgaacggtttgggcggcttcctgagcgtcgctagtggcaatgataatgcgcggcttggtctgatcacgtaaatcggctagtgtgttgttaactagtgtggtcagtgaccggcgccgtgagcgcaccttttgtactggacgcaagtggccgagtgggtcgacgtccatgactggcttgatctgtaagagtgatccaaccgtcgcggaggtccgtgagacccggccgccgtgataaaggtaatttaagtcatcaacggtgaaccattggtgataatagaggcggttttcagtcagccaatccgccaattgggcgatcggcataccagcatcgcgcttgtcaatggcatctagtagcatcaggccttcaccgcagcaggctgctcgggaatccacgaggtagatctcggcatctggctggtcttgtaaaagcatggccttggcctgttgcgcattattgaaggtcccacttaagcctgatgaaaagccgaggtataggattggcgtatgtgcctgaacgtacggcttgaaaaattcaataaactggccgatattaatctgagcagtagaaggcatcacaccgttaccaatccgatgataaaagtcagtcaagtcaaagtggtgacccaaatcgtccgcgtattcctggtcgtcaatcgtgacgttcattgaaacaaaatcgacatgcttgtctttaagtagttgataaggtaaatcaacggttgaatctgttaatagctgatacatagttttctcccttaattgtacttactgttacattgtacgcttatttgggcggccatggaaaattaatacatgctgtatttttacgtacagcagtaatttacggtaacaactagttggttgtcgcaatcctggtagcagcgtgaatgctgatcaggaaattgaactgggcatgtcagtaaatactggacgcatcggaaggtcagttatgggttaactgcaataatggcgtagtgactaggaccgtgcttttcagtcatggtgatgaggttcgacgactaatttgcctattcaatgaggcgctgtaagttgattgaaatcagccgatcaatggcgtgattttgctgctggcggtagggggtggccccggtttcataaaggagttgcgcctggtgatgatgaacgctgatctgttcgagttgcggaggcaatcgaagaatcgcgataccggtggtcagttggtgctgttgaattaattggctgcgcttgaatagcagtaagtgtgaggcgctggggccgtatgactgtgataacaagacgtagtggtcatagaaggccattccttgaatattgggtgggagcttgccgtgccagtcactaactgcctttggtaaaatggcgtgactcgtggtcattctgtatggcgtgccggcgctcgtcagtggatagcgggcaaccaaggtggtctgtccaggtttgaactggccgacataaagggcctgatggtgataggtcagtagtgaagcattgctcagtgttggcagtgaccagcgttgctgatagtgaacggcaatggaagtggtcgggtcgaagtgccgtaatgcggccagactaacgctcacgatagccccatgaccgtggcgatgactgcacaaccaaatccgctggtggtgagggtcataagctagaccacccacatgtggtttaccatgcaataagacagtgttgcataattgatgtcggaaacgatcctgtacatataggacagattgggttcgaccagtggcatcgtaagcggtggttagacgataacgaccggcaataacaacgccctgtggaatcatcattgtcgtcgtcgtgagttgtttagtgacgaggtctctagtcagggtggcttgtagtcctggctgaatggtggtgccttgcaacataccgattgggtcgaattttgctagtttaaccagatccggatactgacggatggtttgataaaattcggttggtgaaaaaacagcttgggtggctgttctttgaagggtggttggtgggtacggtagtgtcggtcgtacgcgactagctagaccgccgaggggatggacccaaattaacaagcccgtgattagtcctgtataaaaatgataggtataacggtgcatcgcgggtccctcctctagtttaagtgtcttcaatatagcatggaaagacaggccgcttagcggatagtgaaaggttagttaaggaaagaaactgagtggggcataattaaaaaattaacgttttgcacatctgtttttaattatatttacataaaacattgaattttctaattaggaatcggataatgaacgtgttcaagctgtttagcaatctgaataaagtgtgatatcccggtgctcgccaagttaggcgagtgctggctgtcaaaaacggaggaaaatataacgatgcgaattagtgcggaaacggaacgacaatttttagaagcagtttttaaggcccaacggtttagtgccaaggatggggcactgctggcagacaccctggtcgatgcagatttacgtggaatctcgtcacatggtatccagcggctggcttggtatacgcggatgatcaaggatcataccttggaaccgacgcatcaaccgaagattttgaatgaaacacctaccagtctattgatcgatgcgaaccagagcatgggccagattgcgtcggcgtttacgatgaataaactgattgaaaagactaagcaactcggtgtttcattagcggttatccgcaattcgaatcactttggaacggcgggctattattcgcgcatggcttgcaaagcgggtttgatcggtatttcaacgactaatacgcggccgttggtggtgccgacgaatgcgacagaagcttttttgggttccaacgcattagcttttacttttccagccgacccgcatcctttcgtttttgacggcgcgactgcggtggtttcaagcgggaagattcaagtgctggccaaaaaaggtgcacagattccgggtgattgggcggttgatgagcatcgtcaagtcttgcatgatgcgcagacggtggaggataacttgactaaaattgcgttttctgagaatcgtcctggtggtggggtcctgaccctaggtggccagcaggaagtcaattcaaattacaaaggctttggcaactcactaattattgagttactcacgggaattttagcgcaagggtcgctgtcggctgatacgaacaccggtaagcatgactttagtcagttcttcatgacgattaatcccgccttatttggcgatcccgaggtgttgaaggccaacgtgacgactatgtttgaccgtattcggcatttgaagcatctaccaggtactaagatcatgataccaggtgaccgggaataccggcactatgatgaaaatttggtgcagggcgtcagtattgatccacagacgttgacggaaatgcagcaagttggtgctgaatttggagtggcagtccccgcagccttgaaagcgtagtttggtgtagttgcggcaattattgtgactaaaatggggatcacataaactgatgatagtgtggctggaatctgctctggatgctggcgacactatttttggttatcacgattatgtgcggtggtgaagaccagctagctggttgggaatagatggcggttcagacaattgacgagcggcgacggttagttatacggaacattgttgaaattgtaatcgaaaataaccgtttgtcagtcgttcgttgtgagaagtttagcgttggagtgcggcttttagattttaatgatttgcctggcggtggattataagttaagtcagtgcaagctactggctaaaaatattttcagaaagtggcagggaaccattttaatatctgtaaaatgatttgacacgcaaacttgctgatttaccagtatttattagcagttagcgaggatgatgacgactagcaaatcgagggtggaccaacatgtttttgttgattaatagaaaaagtttgcaaaaaccatttgacaattctattgattagccgtatattttaagtcagcaaatacacattataaattaaggagattttaatcatgacgattaataccaatttacaattgaattcgtattattattactggtttacttagtgccttggcatccactgcgaggcacgccctcgcaacggatgtgaccagtaaattttggaatgattaaaatttatggaaaagtcatatcagtgttgtgaacaaccactgtgtgacttttctgcttctgagtagcggtgtttttcgggcaccctgcgaagaattagtggactcacagttggtgtaactgtgagtcttttttattagccaaaatgagagggagcgaagttaatgcaagcatttgatgaaattgatgaattagcggtgaataatctacgagtactgagtgcggaaatgattgaacgggccggttctggtcatccaggattgccactcggcgcggctccaatgatgtgggcactgtggagccgacaattacgggtcgatccacagcagtctcaatgggctaatcgcgatcgctttgtcttatcagccggacacgggtcggcgttgttgtacagtctgctacatgtgagtggcttcaacgtgacaatgggcgagttacaacgttttcgtcaattcggcagtcacacgccaggccaccctgaactgggaatcgtggatggtgtggaagccacgaccggtccactgggacaggggttagggatggcggtgggcatggccctggctgaacggcaactagcggctcagttctccgaggcaccgcagttggtggatcactatacttatgcgttagtcggtgatggtgatttgatggaaggcgtctcccacgaagccgccagctttgccggtaatcaacaattgcaaaaattaattgtattgtacgacgataacgctgtttcgcttgatggccccaccagccggtcgtttcgtaccgatgtgaaccagcacttcgctagttatggttgggatacacaaacggtaggtgatggcaatgatttaacggcgattaatgccgccattgagcgtgccaaacacagttcacgtccaagcctgatcgctgttaaaacgacgattggatttggcgcaccacaagcgggtacgaatgcggtgcatggcaatccgttgggaacggccggtttaactagtttgcggcaacaattagggtggcaagccgcgccatttacggtaatgccggccgttgctaaacgcgcacagcaactaatcttgcaacgtggtcagcgtgcacattgccggtggcagtcacaacgagaggctttaccacaagccgtacaacaccgtttcgaacaacagctcagtatgcgtctgccagttgacttagccaccagtttaccgatctttgatgaaggcgcccaagcttcgcggatcacgagtcataccgtcattcagaagctagctgctcagttaccaggattagtcgggggcgcggctgatttagccagttcgaataagacgaccattgagcaggatcaattgtcgactccggtgaccccggatcagcgcaacgttgcctttggtgtccgggagtttggtatgggcaccattttgaatgggatgactttacacggtggcttgcgggtctttggtggcaccttccttgtcttttccgattacacgcgtgcggctattcgattggcggcgatgatgaagttaccagtcacttacgttttcacgcatgactcgattgcagtcggcgaggacggtccgactcatcagccaattgaacagctaatgagtttacgattgattccgaatctaacggtgatccggcccgctgacccgaatgaaacggtcgcagcttggtggcaagccatcaacgcgacggatcatccaaccgtgctcgtcttgacccgtcagaatttggcagtgctatccggatctaagactaaggccatgactggtgtggctcgtggcggttatgttctctcaccgcagcgtggccgccagccaatgggaatcttgattgcaagcgggtcagaagttgctttagctcttcaggcccaggcgaaactagctacgttaggtgaagatgtcagtgtcgtttcaatgccgtcgatggaaaactttgcgcgccaatcaacgaattaccaagctcaggtcttgccacctcaaattcggcggcgagttgcagtcgaaatgggcgcaacatctggctgggaacgttacgttgggttagatggggcggtactaggcttggaccactttggcgccagtggagcggccgaccaagtattagccgctaaccagttcacggtagcagacctagtgcggacgtatcaacaaacgcacgtggatcttggtcaacaattgcgagtcatttagaaaggaagttagttaaagcatgattgatggacaaacggcactctttggatttatcgcgcaccccgcacggcacagtcgctcaccgcgaatgcataatttgagttttgactactgggggctaaatgcgcgctacttggcgtttgatgtggcaccggatggattggctgatacgcttgctggaattcgtagcatgggtatcgcgggggtgaacctttcaatgccatacaaacaagccgttgtaccgctactagatggtttgacagtgcgagcgcaacggattcaagcggtcaatacgattaagaatgaagctggcaagctgattggtgacagcacggacggcgctggagtttttcaggatctcttacatcaaggtctgaacttggttgataagcacgtcatggttttaggcgcgggaggcgcaggtaaggcaatcattgcggcggctttagattatggtgtcgcgagtgtaacggtctttaaacgcaacaacgtacgctacgccggtgttcagcactggttggagcaactcagtaccacgacttcggtaccactccggctctgtgcctatgaagatcaagtacggatgcagcaagttgctcgtaccagcgatttgatcattaacgcgaccaatatcggcatgacgactgctggaacgccattaccaatctcaattatccagcaattagtcccacaacagacggtctatgatatgatttaccaaccgcttgaaacgacttttttgcgcttagcgcgtcagcaggggtgcgccacatataatggcttggggatgttaatttggcaaggtgccttggcttttgagttttggactggtaagcagatgccagttcaacaggtccgccaagatatgttagccagtattcaagcgactccgccgattacggcgcaggcttaggccttaacttttgagaattgattagtaggaggaaattattatgattattatattaaaaccagcaaccgctacggctatgcaggcaaagttagtgagtcaatttggtgcggatcacgagatcttcacgcacaataatcgaattgcaattcaaggattgcgtccagaagcacttcccgcggatgtgcaagcagccagtgaatcaatcttgacggcagttcccgcagcggtccaaagcagccgtctctttcacccagaagatacgattattaagacgccacacagtgtgattggcggtaatcaattcgtcatgatggctggcccgtgttcagtcgaaagcgctgaacacgtggaccagatggccgcggttgccaagcagggtggtgcgacgattgttcgtggcggagcattcaagccacggacgtcaccttacagcttccaaggcctcggggagacgggactccaatacttacggacggcggctgataaacatggccttgatatgattaccgaagtgatggatgatgaacacgtggcgatggtggcgaaatacacggatatttttcaaattggtgcacgcaatatgcaaaatttctcgttgcttaaagccgttggacagacccaaattccggttgcattaaagcgaggaatgtcggcaacaatcgacgatgtgctcaatgcagctgaatacattgcagctggtggtaatcatcagatcatgcttttggagcggggaattcgaacgtttgataataagtacacacgcaacacgtttgacttaggtgcagtgccagtcttgcaatcgttgacacattacccagtcatcgttgatccgagtcacgcggtcggtacctgggaactcgtgaccccgatggcgatggcaggtgtagcagctggcgccagtggcatgatcgttgaaattcatgaccagccaacgcaagctttatccgatgggccgcaagcgttaaaacccgcgacgtacttaaaaatggcgcaacaggctttccagttacatgatctgatgcaaacgtgggcgtaggatgtgcctatgacaaacattgaagtcaagacgcgagttaaacagtatcagatcaagatcatgattgacagtttacatcatctaggaacgttggtaactaaggtatggtgtgcccgtcaagtagcggtggtaacggataccaatgtgggcccgtactatgcgaagctggtaactgatgaactgacggcggctggattcaaggtgcgtgtgatgacggttccagccggtgaggcgagcaaaagttggtcacaagtccagtcgttaatcgatcagctgagtgccgcccattttagccgcagtgacggtgtcatcgctcttggtggcggggtggttggtgacttagcagggtttgtcgcttcgatttatatgcgcggtattgccttgattcaagtaccgacatcattattagcgcaagtcgatagttcggtgggcggtaagaccgcgattgacttaccaactggcaaaaacttagtgggcagtttttaccaaccagatttagtcgtcattgatccggcaattctggtgacgttaccgccgcggatgctcgcagaaggttatggcgaaatcgttaagtgcgcagcattagttggcggtgatttttggcaatccttgcagcaaattaccagtgtggcagcgattttaccagcagcaccagatttaattgcagctagtgtggcgttcaaagcgcgcgtcgttatggcggatgaacatgaacagggtcagcggcaattattgaattttggtcatacgattggtcacgcagtcgaactattggctgacggtcaactaatgcatggggaagcggtagcgattggtctagtacaggtttgtcggttgtttgcagcacatgggttagcgccgactagtttaacgtcgacgctcaaggcacgcttaatggcggtagggttgcccacggaattaccgccgatagcgccgcaagccgtggccgcagtgatgcaacacgacaaaaaagtgcacggtacagcgctgacctgggtctacttatcggcggttgggcaaccccacctgtatcccatagcggtcacggacttggcgacttggatgggtgacttgtggtcggtgtcgtgattagacgtaagtttacaatatgcttcagttcgacacatgacggttagccgggtgggatctgaaaatttgagggagcatcagaacttttgacgtccaggttctgatggacttacatggtagattaacaatcggctttccaagtaatagttggaaagccgattgttattggttagggcgtgatgtttgtatgatcaagtcgttagtcaggagtaagttcacattgtgcgcgttaattttcatgaagcatgcattaaaatatgccagtcttgagtttaaaaagccagtttagggtcaccggcaaaagttctgatttgcgtaaacttgctcggctagatcgtccttcccccagaaatgggcactcagcccggagtcgggaaatacgtgaatgagtgtctgaacctgtcaaatggtatagttgaaaaacaactagtttaccaatagcctaaaagtttcatccagagtgtgccaccaacgcctcatactaatagatagaaaccaccaaggcacagattcagacgccaccattcggactgcgttatgtaacctgatccgaacataatcgaggcgggaccgttggcgtaatgggtggtcgaactgaaaatggcaccgtcaaagcctaatagtagggctgctagcattgggggggcgccggctgaaattgccacacccaagaaggcgccgtacatggcggagacgtgagcagtggcgccggcaaacaggtagtggctgtaaaagtaaacgagcatcaaagctgccaagacccatagccaactgattccttgcagggcctggcccatagtttgtgaaagccatggaataaagccaagactgttcagtttgccagccataaaaataagaattgaaaaccaaacgagtgtgttccaagccccagtttcatgtaataagtcgtcaacggataatacaccggttaataagagcaaagtgacggctatgaaggccactaaggtcgcgtctagcccagtgagactagctgagatccaaagaaagagggccaacataaaaataccgcccatgagtttttcggccaaagtcatggcccccatctgctcaagttcgttggcagcccacgcatgcgcgttgggtgtatccttaatttctggcggatagagccaataaataatagctggaacgctaattaagcaaataagaccaggtaatagagcggcgagtaaccagtccatccatgtgatgtgaatctgcattgcttgggccaaggccacggcaacgagatttggtgccatcgcggtcatgaataagccactggtggcaatattaccatggaaagctgacataatgagaaaactaccaaccttacgctgcgtaccgttttgtgggtcagagccgtatgctttagctaaagattcaataattgggaagacgattccaccggcgcgggcggtattgctaggcgtggccggactagtgacgagatcgacaccaatcagcgcgtaggctaatccaagggtctttttaccaaataatttgacgaagaccagcgcgactcgtcgccctagccccgtttttacgaagcctcgtgataggaagtaagccattgcaatcatccaaaccgtgttatcaccaaagccggccatggcatccgtcatcgaggtaacaccaagtaagacaccaagtgtgagaccaataattgcgacaccggcaataggtaacggctgggtaatgcaaccaatgatagtgccaacaaagagagccagcatgtgccatgctaatagactgagccccgcgggacgaaatggcgcgctcagccaaataatcaaaccaattatcagcggccatgtaagttgctggtagttgacggattgtaatttggtcatcgaaaacgaccacctttctagtcaaacgttaaaatcgtctcacggtgactgctgaaactagtcagcaaatgatgctaatccggacacgatttctaaattagaattaatgcaaccctaatgtcatttttgctgcccgtgacattttatcaagcgaccaggccggttcccagacaaggttgatgagtatctgatcgatacccgcgacggtcattaatgcgtttttgatatggtcattcaaatagcctgtcagtggacagcccatgatggtcagtgtcatggtaacggtgcagagctttaggtcagcatcgtaagcaacatcgtagatcaaaccgaggtcaacaatgttcacaccaagttcaggatcaatcacggtattcagagcggctaaagcttgggtttttaaagtagattgtgtatccatactaatcatgagaaagactcctttagaccaacagcctaagcagggtgatccgcttaggctgttaatggtcggttatttaatgaatttaacttgttcgttgatttttttaatctcagcttctttacgttcgttgaagatgaccttgttcttttcaaacaagttgtcgccattcgtatcgatggagacaattaacggaccgaagtctttgacctcacacgcccagagtgtttcgggcattccgaggtctttccactgggcatcaacaatcttattgacgtgcagggcggcataaacagcattgccagcggggtaaacgaggtgtaaggcgtgatatttcttgcaggcccgttcggttcccggtcccatgccgcctttaccaacgattagtttgacacgggtttgttttacgaattcttcttcaaatttttccatccgcatactagtcgttggcccgactgcgaccatttcgtacttgtcatggccgagatctttaatgatcgggccagcgtggagaattgctcggtctgtcacgttaacgggtaggggacgatgttcttcgacgagccgccgatgggcaacatcccgacaggttgttagtgagccattcaagtagacgatgtcgccgatacgaatgtccttaatatcgtcatcagaaattggggtggttaagtggtaagttttcatgataattcgactcctttgttcagtggtaagtcatagtttagatctgcgtcaaagttgataagtccgcgccggtgtgaccagcagccggtactaacagcgacgccaattgttgatgggtgtcgggcggtattctcgacattgacacccattactgacttttgaccgccaaacccctgtggtcccaggccaatgtgattgatgccgtcttctaataagtgttcgagtttggcagcattagcgtttggattttcactatcgacgcgccgcattaaagctaatttagaattaagcgcagccgtttcaacggatgtggcgacgccgacaccgacgagtaaaggtgggcaagcgttaatgccgaagctcgtcatgcgatccatcacgaaacggacgacgccttcgtaaccttcaccaggcatcaggactttggcagccccgggtaatgtgcagccaccgccggccatgtacacgtacattgagatgtcagtgccattaccatcaacttgcagaaaaatcgaggggatgccgtcaccaatgttcataccggtattgtattcgtcaaatgtctgaacagcattatgtcggagtggcgctttttttgtcccacgataaacggcgtctttcaaaatttgattgagttcgcctaatagtgggaactgcgcgccgcatttaatgaagaattgtaacgcaccggtatcttggcaacttgggcgtttaagtttattggcaagtaattggttttccatcatcgtgtcgtagacgagcttttggagtggatcgacttcgatcttactgagttcttcgagtttggcagtcacatcatctggtagtcgatgactgatgagcgcaatataatcggccaaaatgtcgcgcatccgttggcccttagttgataatgttggttcggtatagtcgtatgtcattgtatccatgctggtttcctcctatcaatttacagctacattgtaagtaactgtgtgatacaaaactaaccgctactcgccgagttatgccaggtattggattgtgaaagtgatggtaagcggacaggtagccggttaaaaatgacaaaaaaataccaaggccttctgacgagtgatgccgtcgtaccttggtatgacccaatatttgatcaaaatatcggtaagttcagttgttcgtaatcacaaaaattgttatgccattaattattgattaagcaatgtttttaattgcgcgatcttttgtttgagtgcctgatattcttgaaaatgtagtttatacatgcaactttcacaagcactgagttgatcagtacttgtgagttgggcccagtgcttgagttgcttttggacaatggtagtttgtgtgggagtgagcggttgcttgaactggtcatattcaggacgttgcccgtgtgacaaatgttgacggtaactggaaggtgtctgaccaaaatgcttcttaaacattagattgaaggacttgacctcctgaaccccattggctaaggctagatcggcgactcttgtggttgggttttccagatcgtagatggcgtgttgtagtcggcagcgggttagatattcgtaaaaattcaggccgagttccgctttgaagatgcgtgagagataggctggtgaatagtgactgatttttgccgcttcgtttaaggtaattggtcgatcgtaagcctggttaatgtaatcaatgacccggtttagtgaactctgcgtcttgggttggggataagtcatcgtgattccagtatcaaagaaatcgtgatgtagcaggttcgccaattgaaagtacagggcgttcaagtcaaaaattggccagtcctgctgatgtaatcctagatagagttgtgccagaatttggcgaatcgtttggtagtcacggtgttggggcgtcgtcacgctgttgagtagaaaagcacctgaactgaggtcgatgccctgactagtgtagaaatcgggcagaatatgtaaacggagcgcgatacattctggggtcaaggcaaaggtggcatggccgcgattggcattgatcaagatgaggtcatttgcgtgtaattgatgacgcgtcccgtcaacattcacttcgacggtaccttgcaataaccataagagttcgatttgcggatgccagttgtagtggtaactaccaatcatgtatgttaataagtcaaattggacggttggagtggattgaaaatgctgactaggtatcatgacagtgtcctccttaggaataactttgattagctctagcttacacgttcagaagatgcttgaacagcagtcgacaaaagaatacaaagaaaaatgacaaaaattgactagtatcagttatgatggaaatataagtaatggtaactgaatgttggttgtggtcacgcttaatcaagactgaaagtgacccaggcacatcatcgttgttagactaaggatgaaatggtggagaaatagtggatacgaagataattgtcaatcatgcgctacgagcgcttttatacgaagtgacggtcaaccctaagcccgggctggtcgacccgttgtcggcgggtccccatccagacatgaacgcttttatgtttattgatagtgctttgagtctagccccctactttaatgcttgtgcagcggcgggcgtcgcgtatacggctgtcgatttgacgggtttgttcaagcaaattcggggcattggtgttcaagcggaacaaaccatgtttgcggcgaccaagggcgtgaatacccataaaggggcggtgttctcactgggcgtgctagtgacagcggcggcgtatcagttgcagcaccccgacgtcgacttagcaacgattgtgcgcacaatgctggcggggttaacggcaaatgattttaatgatttaaacacgaaggatccaacgaccttaactgctggagaacgtcaatacttaacatatggcatcaagggaattcgtggtgaagccgaggcgggttatccgaccgtgatgcaagtggcactacccgcattgaggcgtagtcgtggcacgattaatcagcggttattagacacactgatggcgattgtccaggcgacggtcgataccaatctggtaaaacgggcacacgacccacacgtcattgactgggtccacgaccaagcacaccgctacttcgatttagggggaagccgcagtgaagctggaatggcgtttttacgcgaattgaatcagatttttgtcgaccataactatagtttaggtggctcggccgatttgttgattttgacgatttttattggatttcagacagatatattagcttaataatgagtgtcgtgattgtaggtgacgacacttttttaataccaaatattaatggaaattaaatgacgattgcaatgcttagttgatgagtggtcagtgctttttagtggtgatggcatcgaaagtcgtttcagtaggttctggattaagcttttagtatgttggttgtaacgccttggttaagtaaaaatagtattagaatgaacgaaaatttaataccgattataaaaaagttaactgtacctaacaattatttgcattagcgttaattatcagttatgcttatgacgatgtagaaaaccgactaccgcgatgaacggaggaaatgtgatgttaaaagtacaaaacctcaccgtggcatacagtgacacaccagtctttactgatgttgccgttaactttaacgccggcaaaattactggaatcattggtcccaacggtgcgggaaaatcaacgatgatcaaagcaatgcttggtctgatcaaatcccaaacgggaaccgtcgaatatgaaggtcgtgcgctaaaacaatttcaaaaacagattgcatatgtcgagcaacgtaaagatctcgacttaacctttccaatcaatgtttttgacgtcgttttgactgggacctatggcaaactcggacttttccgcgaaccaagcaaggcggatcgtcagcgttgccaagatgcacttgagcaacttgagttagctgatttagcacagcgccaaattagtcagctttctggaggacaattacaacgggtctttgtggctcgagccttagtccaagaagccgatatcattattcttgatgaacctttcgtcggcattgatttacagagtgagacggctatcatgacgatcttgcatcagtggcgtgatgccggcaaaatgattattgtcgtgcatcatgatttgaacaaagtttcacgttactttgatgatctcgtgattttaaatcacggtatcgttgattatggtcccgtggacgcggtctacacacccgcaaacattgaacggacgtttagtgctgatctttcggccgtcctgtttacgaaggaggaaacgcgatgatgcaatcaattacgacctttatggctgctttggggaagtatgatttcttacaaagtgcgctaattacggctattatggtcggggtcatgtcaggaattattggtagttttattattttacggggcatgtcgatgatgggcgaagccatctcgcatgccgttttacctggtgttgcggtagcttatatgctcggtatcaacgtcctaattggtgcttcggtttttggaattctagccgctagcttgatcggattcgttgcgagccgtagtaagattaagactgacacctcaattgggattgtcttcagtgcgttttacgcactcggttttatcctaatttcattagctgaaagttcgacgaacttgcaccacatcttattcggtaacatcctcgctgtgagtgatactgatatgatgacgacgacggtcgtgttaggactagtgattttattcgtggtcttcttctacaaggaattactgattacgtcatttgatccgacctttgcgaagacttatggtctcaaggtccaactgttacattacgcgttaatgctggtcttaacgctagtgaccgtttcagcgctacaaaccgtcgggatcattttagtggtcgcgatgttgattacaccggctgcgacggcctttctatggacagaacgactggcagtcatgcttggactgtcagccttaattggggtcttgtcctcagtggtgggcttatatctcagctacacgttgaactgggcttctggtccggccatcgtgctagtagcggctattttcttcggtatttctttcatcatctcacctaagcaggccttgttgccgacgctttggaaagggcaagcagcagcgcgacgggtgacagcatgaaaacgaaattaattgcactgattggagtcatcgcgatggttaccgggatggcagtatttctgaatcaacgccagcaaagtgccaaagcgacgaccactagtgccaaaatccgggtcgtaagtacgaactcgattctagatgatatggtgaaaaatgtgggtgggcagtacgtccaaaattacagtattgtgaagcgcggcactgacccgcatgagtatgaaccacggcccactgatattgcggcaactgccgaagctgacgtgattttttataatggcttaaaccttgaaactggcggtaatggctggtttaaaaagttagtgacggcttccaaaaaggactttgaccacgatgtttttgcggccagtaagggaattaaggtcaaatatttaacgacgaacgttaatgagccggacccccatgcttggttagatctcgccaacgggattcaatatgtcaagaacatcaaccggacgttgcaggccaaggatcctaagcacgccgctgtttatcaaaagaatacggatcgctacgtggtaaaactaacaaaactgcatgagagcgctcaaaccaaattcaagcagatcccgacgagtcaacgattattagtgacatccgaaggcgcctttaagtatttctcggcggcctaccatgtgcccgctgcttatatttgggaagtgaatacggaatcgcaaggcacgccagctcagatgcggacggcgttgaagaaaattgaaggaacccaggttcgaagtttgtttgtcgaatcatccgtatcaccgaaatcgatgaataagctttcacaggagacgggaatccccgttgctagtacgatttttaccgattcgctggcagctaaaggcaagccgggtgatacgtactactcaatgttgaagtggaatcttgataagatttatgctgggctgactcggtcgtagtacttgggcctataattcggttgtgttgatgtcatgtgatataagtttgttctaaaaaggaccgtggaagttaaatcttccacggtcctttctttattttgaactgctagtttagtcttccgattcgaatgacaattccgtcattgatagttccagatcatcaagtacgtcgttttcactcagaaattgttcccaggcagccggtgtttgttcgcgggtatgggggacgattttatcatgaatattggcaatcacatcatcgagcatcttatccgcttgccgggcgatttcagcatcgttatagcggcgtgctggcgcccggtcctcattttttcgattcagaaaatcggttgctttctccataaaaatggtaataacttgggagttgtttgcgagatagtcttttaaagtttcattatccaatgtattagtcctctctagtttgagtcgtacttctaatataccacgctaatcaggttttaactgtttcaagatcggttggcgggtaaaaagttttgtaacttgcgcagatgtttcgaattgacgccaatcaggcaatttaaacgcaggattgtaaccgcttacgaaaatgatttcacaagccgacactttagaaatagttcacaatcaaaataattttaaatgctgctacgcaggcgttttaaacaacaattatatttaaatttttcaaaaaaataatttatttttaaaaaattagcaaaaatgaaagcatttgcgttataatacttgtgagttaagtaactaagtagttggaaccacatgtgcagcacacatttttgatgaaagaaggatattgacatggataagaagcaacgcaaagtcgtaattgttggtgatggctcggtgggttcatcatttgccttttcattggtccaaaattgcgccctagatgaactcgttatcgttgacttggttaaaacgcacgcagagggggacgttaaggatttggaagatgttgccgcctttacgaatgcgaccaacattcataccggtgaatatgcggatgcgcgtgatgctgacatcgttgtcattacggctggtgtgcctcgtaagcctggtgagagtcgtttagatttgattaaccgcaatacgaagattctggaatccatcgtcaaaccagtggttgcgagtggttttaatggttgcttcgttatctcaagtaatcccgtcgatattttgacttcgatgacgcaacgtttatccggttttccacggcatcgggtcattggtaccgggacttccttggatacggcgcggttacgggtcgccttggctcagaagttgaatgttgccaccactgcagttgatgctgcggtacttggagaacatggtgatagttccatcgttaattttgatgaaattatgatcaatgctcagcccttaaagacggtcacaacggtcgatgatcagttcaaagctgaaatcgagcaagctgttcgtggtaaaggtggtcaaatcattagtcagaagggggccacgttctatggggtcgccgttagtttgatgcaaatctgccgagcaattttgaacgatgaaaatgctgagttgattgtctccgccgctttgtctggtcaatatggcattaacgatttgtacttggggtcacccgccattattaatcgcaacgggctccaaaaagtgatcgaagctgagctatcagatgatgagcgtgcccggatgcaacatttcgcagccaagatgctgaccatgatgaatgtggcatcataaaaatgatgagtaagtatgaggaggaattgagatgacactaaataaggtcaagtatcgtgattttattgcaccgttattggtgggcctgatcatttggttaagtagtcctatcaaaccagccagtgtttcgatgaacgcatggcatattctggcaatttttgtggcaaccattattggttgtattacgcggccgttaccaatcgccggggtcgcaatcattgggttgacactaaccgtgttattgggcatcgtgcctatggatacagcggttgccggatttgggagcagtacggtatggatgattgcgatggcgtattttatgtcacgtggtttcatcaatactggtttaggtcgacgtgtcgcgttggtatttgtacggctgtttgggaaacgaacgttgggtttggcatacgcactgattggcgtcgatttagtaacagcacccgcaacgccaagtaatacggcccgtgctggtgggattgtttatccaatcattcagtcgttagctgaaacgtttggctctgatcccaaggatggcacacaaagtaaaatcggttcattcttagtgttcgcagaatttcacggtgatttaatcaccagtacgatgttcatgacggcgatggcgcctaacttagttgctgtcacgttagccaagagtttacacatcacgttatcgtggatgcaatggttcttagccgggattgtcccaggacttatttgtttattggttgtgccatatttaatttataaaatgtatccaccagaaattaaagatacgcccaatgccaagcaatgggcggatgatgagctggcaaagatgggtaagatgagtcttccagaaaaaatcatgggtggcgtcttcttgctagccttagtcttatggatgttatccagctttatcggtctcgaagcttcattagttgcctttatggccgtctccttgctactcgttgctggggttctatcggtagatgacgtgctacacgaaactggtgcttggaataccttggtgtggttctcaattttgatcttcatggctaatgagttgaacaaactcggctttattccatggttgtctggcgcgattggtggtgccttgaaaggcttcagttggggcattgttttagcggcactcgtcttgttctacttctacagtcactacttgtttgctagtgggactgcccacgtttccgcaatgtacggtgccttacttggggtcgcggtttccgcgggagcgccagcaacctttgctgcactgatacttggctttactggttcgatcttcgcttcgacgacgcattatgcgaacggcccggcgagtgttctcttcggttctggatatgttactcagggaaaatggtggcagttaaactttattttaggtctcttctacctagtcgtttggggtggcattggcgccctctggatgaaagtgattggtatttggtagtctgattttaagcataaaaacaggtaccaagctgccggcaacggtcagcgttggtacctgttttcgaagaagcggattatttggatagtggtgtggcttgatcttcttggagaacccgattcgcgacggcttcatcaatgatgatgtcagtgagtaattgtccgcggagggcgccaagtaaggcttcgctcttgaacttacttttgatgatgccgaaacgacgcggcactttgagaatggcgggcattttagcgccaaagagtttgtcgtggtcggcgttcagaatgtgaccattgatgtcgtatggccgaccgtataacaggccgaccaccgcctgcggatcagcgccacccagaatggcttggcgatgttgatgccagacgggaatcgagtcaatggatgctaaggtgccaattccggcaaatagcatgtccattcggtcaaagttactgatggccggtgtaatggctggttcttgagccaatgcttggtgtgcttgatcattaaacaagtagagtggtgccgggatggtgacgtactgtgcgccgaacttagcggcggctttttgaactaacggtgttgagccgttcgctgcgttcgttttcaggttatcacccataaactgggtgaacagtaagtcatcacgagtgctcgtttgaaaattatcgatgacgctaaggacagtgccaccccatgccaccccaatcacgttactttgaataatctggcgctggattgtttcggcggcaaactcgattacgtggcgttcatcgtcactcgtggtatccgcgtctttgataatataaatatgttcaattggaaaacgatgcttaaatttagcctccagctcactatttcgttcgatgggggtgttaatgttaattttgactaggccggttgccatggcttcgtctaagtattttgaaattagataacgactgacttggtatttctttgaaatttcagcgatgttgattttggataagtaataatcatgtgcaattccaatcaacaggcggcgatgattcatatcgtccatatcgatgacctctttatcaacctaagatttaaaattttaaaactcgtttataatattttaagtttattataccagaaaagctgactttttaaaaattataaaaatccaatctaaatttgatgtttttaaaaaatggtcgtacactggggataacaaagtgaacggtattattttgagaagagaaggcagatattgatggtagaacaagatgagattttaaagttgcacgccgcccatacgggggttttggacattcattcagaccttgcagtgaccgataaggctgatttaggtaaagcatatacacctggtgttgcggtgatttccaagctgattgcggcgcatccggaattaaaggcaaaatacacgatgagtggtaaattagtagcgttgatcacggatgggtcagcagtactgggcctcggcaatattggtcccgcgggtggtttgccggtcgtagaaggtaaggcactcctatacaagaacctcgcagggattaatgcgattccgctggcgttaaatcaggtcagcgtgccagcaatggtggcgacaatcaaaaacatgtcgctctcatttgcgggcattcatctggaagatattacggcgcctaagtgttttgaactagaagcggccttgaaagatgagcttgatattccggtttatcatgacgatcaggaaggcaccgcaattgtcgtgttggcgggactgatcaatgccgctcacgtagtcggtaagtccttacggcagatgcgcatcgttgtcaacggcgtcggcgcatccgggttagctacagctcggttattagcagcggtcggtgtcaaacaactgaccttggtcgatgtttacggggtcgttacagcggatgatcagcggtacaaccagtatcaacggaatcttgccaaacagttgggaacacctgcacaactaaaggggcaaccactggcgaaggtcatggccgaccaggacatcttcattggcttgtcagacgccaacgtcttatcagcaggggccgtccacttgatgaatcatgatccaatcgtctttgcactcgctaatccagtgccagaaatcaatccagcagtagctgagaaggctggggccacagtcattgcaacaggttctagccagtatccaaaccaggtcaataatattctggctttcccggggatcttcaagggcttactcacaaatggggtcaagcaagttgataatgcgttgcagatccaagtggctcaggctttggctaagaccgtgtcgaacccaactgcgacgacgattgtgccgagcgtctttgattcacaagtggtaccgaacgtgacggcggccgttgcagcgtacgcgcaagcacagcattaatcataggaggttgtctgatggcagcacaagttgttgaaatgcaattaaataatccgcacgagcatgcccagtggcaacaattcttaacgtcattagggattactaattttagcccgcaagaggttgaacatattgatgtgaccttaggattgatcgaggatggccaacttgttgggaccggatcgttagctggcaacgtgcttaaatatgtgggtgtctgtaataagaatagtcagccgggggcccggtttaatcaaatcgtgagtgcactggtcaatcggctgtttcaagcacagatctttcatatgatggtatttaccaaggccaagtattcagcgagttttcaacacgtaggctttaaagaattagctcattcggatgaagcggccgtattagaaaacggcgcaccggatatgacggattttgtcaaacagttgccgatgattcccaaccaagcacaacagcgtgtcagcgcgattgtcatgaatgcgaacccgtttacgcggggacaccgctatttagtggaacaagccgcggcggtcagtgatttagtttacgtcttcgtcgttgcgacagatgcgagtctattccgtacggccgagcgcgttaagctggttcaacaagggacagccgacttggccaacgttcgggtcgtcagcgggcaggactatctcgtgagtgcagcgacctttccagcctacttcttggattcagcggcgagcgcaattgaggcgcagacgacgttggacgcccggatctttaagcagcaacttgcaccagcactgcacattacgacccggttcgttggtagtgaaccgacgtcgcggacgactgcgatttataaccgagttttgcagcgtgaattaccaccggcagttgctgtacgagtgatatcgcgaacgacggtggctaatcaaccaatttcggcgcggactgttcggcaacggattcaaagcggcaacttaactgagttaaaccaactggtaccggcaacaacggcccagtttataaaaaataacctaacaacattacaagcgcgaattcagaaaggaatgaaaattgatggaaattaagacaacggcagtcgccggaaccttggaatcatctgatattcaaattatgttaatggcgggagacaacggcattcaaatcgaccttgaatcagatgttatcaaacagttcggggcacaaataaagcacgtgatcacgacgacgcttcaacaattgaatatcgataatgtgaaggtgcgcgctgtcgataaaggggcgttggactgcgtcattaaagcgcggactattacggcagcacaacgggcgttagaaaccacgacaccagcatgggaggtattataatggctgaaaatgaagaacgcttacggcggacaatgatgtttgtacctggtaataatccagccatggtgaaggatgccgggatttacggtgcggactcgatcatgtttgacttggaagatgccgtctcaatggctgaaaaggacgcggcccgggtgctggtttacgaagcgttaaaaacgcaggactatggcaaggctgaattggtcgtccggatcaatggcttagacaccaagtattacgctgatgatgtcaaagcgatggtcaaggctggtattgacgttatccgtttaccaaaagtcgaatcggctgccatgattcaaacgttggaaaaggatgtcgcggcagctgaagctgaatttgatattccagtcggtacgactcatttgatggccgcaattgaaagcgctaagggcgtgcttaatgccccggcaatcgcggcagcctcggatcaaatgattgggattgccttgtcagcagaagattatacgacggacatgaagacccaccgttatcctgatggcgcggaactggaatttgcccgtaacatggtgcttcatgctgctcgtgccgctggaatcgccgcgttcgatacggtctttacaaacatggccgatcccgatggcttctaccgtgagacgcggcatattcatcaattaggatttgacggtaaatcattggtcaaccctcgacagattgcaatggtcaattcagtctatgaaccaaccaaggatgaagttattaaggcccaaaaagtcatcgccgcgattgaggaagcccggatcaagggttctggtgttatttccatgaatggccaaatggtagaccggcccgttgttttgcgggctcaacgtgtgatgagcttagccaaagtttccaacttactcgacgaggagggcaattacattgaaaaatagtgtagaccgcgaattaccagcagaattaatgacgaagttaaattaccaaggttttgagtcaactgaaatcggacatcctgaaattcaacgggtggcccccaaagttcacgtttcaacaggggacaacaaagtcgttgattccgttgctgacgtggtaaaagccactgtcaaagatggtatgacgatttcatttcaccaccattttcgtaatggggatttcgtcttcaatcaagtgatgcgggccattattgatgccggtattaaagatttgaccttggcgccatcctccttaacgggcgtgatgaacgatatggtgatcgaagcaattaaggccggaacgattacgaatattactagctcggggatgcggggctctcttggggacttcgtttcacacggtggtttaaagaaccccgtaatcttccgttctcatggtaatcgggcccgggccattgaacatggtgatattaaaattgatgtcgcctttctaggtgtgccgaatgctgaccgactaggaaatgcgaacgggatggctggtaaagcagtctttggttccttaggttacgccctgatggatgcgcaatacgccaaccaagttgtcttattgaccgataatattgtggcttatccaaatacaccggcctcaattaaacagacacaagtcgattacgtcgtgcaagtcgaccaagttggtgaccctgacaagattggttcaggtgcgacgcgcttcaccaaggacccaaaggaattgaagattgcccagaccgttaatgatgtgatcgtgaactcaccatactttaaaaacggcttctcattccaaactggttccggcggtgctgcgttggctgtcactcggtacttgcggcaagcaatgctcgataatcaaatcaaagcatcgtttgcacttggtggtattacgaaaccaaccactgatttgctcgaagaagggttagttgataaagtcatggatgttcaagactttgacaaaggggcggcagcatcgatgcacgccaatcctaatcaacaagaaattgacgcatcatggtacgctgaccctgataataaaggagcgatggttgatcaattggatgttgccattctgagtgcgttggaaattgatacgcacttcaatgtcaacgtcatgtccggttcggatggcgtgattcgtggcgccattggtggacatcaagacgcggctacggccaaactgaccattatctctgcaccacttgtccgtggtcggttagcgacgattgtgccagaagtaacaaccgttgtaacgccgggggactccattgacgttgttgtgacggaatacgggattgcaatcaacccgcggcgtcaagacctagttaaagcactcagtcatgtcccaggtgtgccggtctatacgattgaagaattacaacaattagccgaaaagaaagtcggccaaccccaaccacttgaatttacagatcgcaccgttgccttgattgaatatcgcgatggcacgattattgatacgattaaagcggtgaaggactaaagtatattgatgacaaaaatgaccttgcttggcaaattgctagctaggtcattttttgtatgacgaattgtcaaatcaagcgcaactttgtcccgaagaaaacttcaaatggactcttccagcctaagaccttacgtggtcggtgatttaaatccctgacaaacttgtcgatatcttgatcagtcagttggtctaggtcggttcctttggggaaatactcacggataagtccgttggtattctcattggttccccgttgctgaggcgcatgaggatctggaaaatagactgggatacttagctcttgactaacttcgcggtatcctgcgaattcagttccacgatccggcgtaagcgtccgaactcgtttgggcgtcacggtatgcaagaggtcaatcatcgcttgtgtgacgttcttggcgtttactttgggaacccgctgagataataaataccgagatttgcggtccaccaaggttaccagggccgaacgcccggttttaccgcgaacggtatcactttcccaatgaccaaaccagcttcgattctcacatgaaacaggtcgttcatgaacggaagggacgtcgttaaatcgtccccgacgttccttaatggttcccttgacctttcgggttttaccacggtgacggagcttacgggcaaagccatgagcctcgtgattcttacgtttgatgcctaaattatcacgttcaatcccacgataaatggtgttataactgacatgccattcactgttttcgtggactaaacgaccggaaatttgttccggggaccactgacgttgaacaatacagtgaaaaacaaaatcccgtaacttcaaatcagttagaagcctaggacgtcggctttttagccgccgtccctgatagttctcttgggctttgacggccgagtatgccttacgaccaccattgcgcttgatttcgcgcgatacggtggctttggaacacccaattttctccgcaataacttgataggtatcgtttaaagtgacgcccaacagtatgcattctcggtcttttaaggtaagatggttgtacggactcatagcctaggatctcctttagatgattgttgtggtgacttcattttataggactcaggctatgagttcttttttatttttttcttacttgttgcacttcaattgtaaattcgtcacttcagaagtatctgagatactttcaaactcatttatcagtgcctgatcggcagaaaattggtgcccctgtctgtactcctcaaaattgctaagcgaaattcctaatctctgaattattttgatcattgtggtatatggcaaatctttataaccgtgctcgacctcacctatggaacgtcgtgttgttatattttttgctaattcaagttgagacattcctttgtttttccgtaacatatgaatcatttctcctgtattcatgaattcacacctaattttaatattttgtgcgagttttgcacaaagttcacagtatcattgaactatgaaataaaatgaatataaatacgtattaggagggaatttttaatgaagattagacatatacgacgatattattcttttttagcctatttaccgatgcttggaattatgacgttaagctggattgttggtggataatcttatgaaaagcaaaaacgtgtattgggagctactgaagtataaatactgcaaaatgtttttgcgcttttttcaatagtgctcctttattaaatatgataatgattagttataaatatactctttgaggagaatataaagatgacattaaagaaattttttgctatgctgattttgaccactatgatactttcacttagtgtattttcaagttttgatggtttttcagaaagtataggtgaaatacatgcacaggcagccaagtataagagagttgcacctaagcctaagggaaaatggaaacttaggaaaaaattcaaaaaactgttaaaataacaaaaaagttaaagaagtctgggtctgcagcaatcatgacttacgtagtacaggcgcttgcgtccaaatatggcggacaagcaatttggatgttcgggggtacattttttgggagctattttcctgcaggaaatacttatttaactgcgtgggcgtataagcgcgctaacaagtatgtagtacaatataaaacagttattcatatttatacgaataaatctaggaaacacattcgtaaaaaggcttcacgtattcagtcgtttgtaaagaaatataaggtggttagggtggattaattatggatcaatacccaaattttaagctatttattgataaatatttaccatggctagccgttattggctttgttgtgacagttagtgttaatggcaatgtttggttgtattttatgtcggtgctgattgtatttgttgtgattgcaattattgacttgctgtttaagtattggaaccacgccaaaattttaggtatcatgattgttcttttagtacttggactatggttgaatcgctaagaaaataccaggattagtgtctgacgcggcattttcaatggatttataaagaggcattgtgcttttctgaaatgccatggctagcatcaataaggggcttctgtcaaccagtgtcgatgaagttatatctagaatccaattcatttatgaattggattcttttttgaagtgcgcccggcatgggtgataactaggcggtgtaagtccgctgtgggccgtagtagtcggaaccacgagttgagggcaagggcgttcgccgtgagacggagtctgaaggaagcctaagacaaaataccgaaccgatgtacaagaagtggctacaaggctgattagactggatgaagttgcttcacaaactgaagtcctacactacttgaagtcgaagttagtaaagccaacggttgcatggtatgaaagctatcattcttacccggggaggcctgtcggataagctcccaacaaggacgccgatatgggtttacaggagtaaactagtcagccgaggtcatagtaatctgccgtatggcagatgaaggactgaacaataataattctcaccgatactggaggtgttggtagtgcgaagattgcagaaaacagaacaagctgaccgccaagggatgaatagtctggaagacaaagagtatcttggggcgcatcgtactactaacggtgaaagtacggcgcaggatggcattcaatttgtagaccgggtccttccttgcaagtagtaatctgaacctagcgtttaagcgtgttcggaggaataagggcgtagctggaattgacggcatgaccgttgaccaactggccgaatatatttacaagaaccgggaagaactcctagagagtttacgtaatggaatatatcggccgcaaccagtcagacgggtagagataccaaaactcgatggctcaaccagaaaactgggagtacctacagttgttgatcgtatgatccaataagctgtggtacaggtgctttcgccgatatacgaacaagtattttccgacaatagctatggattccgaccaggtcggagtgcgcatgacgcgattcaaagtgtcaccgaactctacaatcaaggctaccactatgtggtagacctcgatttaaaggcatactttgatacggttaaccacgacttactaatgaacttcatcaaacaacgagtaactgatccatggctactccacctaattcggcgcttcctaacaagcggggtcatgaatggcgagctgtttcgaaagacgacgaagggaacaccacaaggtgggaacctgtcgccgctactggccaatatttatctcaacgagttggacaagctattgacccagcggggccaccgatttgtgcgctatgccgatgactgtaatatttatgccagaagtaagcgagcgggagaacgagtcttacgcaatgtcacaatctttcttgaaattaagttgaaactaacaattaactgtcataaaacgacggttggctcaccactccgactaaagtttctaggatttacgctcggtgtagaccgtaatggggcatatgcacgaccgcacaaggtcgtgaaacagcgaatcaaacaagcccttaagataatgactgggcgaagtcgtggaattagttggttaatgttgatgaagaaaattaaacagaaaatgcgaggatggctacagtactatgggattggcaagatgaagacgtttattcaacaactggaccaatggttgcgaagtaggattagacagttgatatggaaacggtggaagaaaatcaaaacccgatatcgtgagctaattaagctaggaatgacaccggaacaggccaagactaatgccaatacccgcaagggatattggcgaattgcccataataaaacactaacctatacgtatacaaatcaaaagctggagcgtcttggactaataaacctgtccaagacactccagcaaatacagagtgcttaaattattgaaccgccgtatacggaaccgtacgtacggtggtgtgagaggtcggtaattgaaataatcaattacctcctactcgattgcaaccgaatttgataaaaaagttttactagttaaccatacgtcgttcttttgatttgcctgatttcatctcttttcaactatgactcgatattttgtggtttggtatatttaggtctacaaataagaaaaagtgacaattatgagtaaaattaagcaagaggaataaataagaacatgtgaaaaaataaacatttttatctagaactcattctaagcaatctttgtatgctaatatactgatacataaacctcataactaatacttatagctaaaactgagtttgactatagctatatgggggcgctaaactaggattataaactaaatgttatttttttcacacacttagtaagcgcttaccaacacattaattggaggttatcaacatgacagaatatcgagttgaatcagatactttaggcgaagttaaaattcctgcgaacgccttatggggtgctcagacagaacggagtcgccataactttccgactggtacgaagatgccgttggaaatgattcgggcattacttcaaattaagcgggccgcagcgattgcgaataaagaagttgaagcaatgactgctgaaaaagctgatttaatcgtggctgccattgataagttattagcgctcgacgatgaagatttgcgtaaggactttccgctggttgtttaccaaactggttcggggacgcaaacgaatatgaacgttaatgaagtggtcgcacacatggctggtaagatcaatcctgatattgaaatcttgccgaacgacgatgttaaccatggtcaaagctctaacgatatcttcccaacggcgatgaacattacggccgcagttgccgtggataagctgattgccgcagcggaacacttattagcggaattgaagatcaaacaaaagaagtactggcgggtagtaaagatcggccggacccatcttcaagatgcaacgccattaacttttggccaagaagtgagtggttgggccagtgcgattgaacatgatattgcctacttaaaacagttgaatccaacgttaggcgagcttgcaatgggtgggaccgccgttgggactggtctaaatgctgcccctcattttgctgaaaatattgctgcggcgatgagcaaattgtatgggattgaatttacggctgattccaataagttctatggtttggcccatcattctggcttaaacgtggttcacggggccatcaagaccctagcagccgatttgatgaagattgccaatgatgtgcggttcttggcaagcggtccacgggccggttatgacgaattaaacattccggctaacgaacccggctcatcaatcatgcctgggaaagttaacccaacccaagctgaagccatcactatggcagcggtacgagttatggggaatgacgtggtcgtcgatttagcttctagccaaggtaattttgaaatgaacgtttacaagaccgttttgattgatgccttccttgaatctgctgaattgttagctggaacgattaccggcttcactgaccgaatgattgctggtttgacggtcaaccaagaccggatggcagagttagtcgacagttccttgatgacggttacggcattgtcaccacatattggctatcatgatagtgcgatgattgctcaagcagctgaaaaagcggggacgacattgcgtgaagcagccatcaagtctggcaaagtaaccgcggaacaattcgatgaatggatggttccactggatatgacgaatattgatgattaagctaaaataagtattgatcggcgttgaaccgttaacgtggatcaaggtggcacgggtcattgttcctagacttggaatggtggcccgtgtccagttaacgacaataataaatgagattttggttccatcctggggaataccccggacgaattgagaggagaagtggcaatcaatggctgaaaagtttacatttacaccaaccgccttagcggatctaaaaccgaactatgacgtagtgattattggatcggggggcgcgggtttgactgcggcaatccaggcacatgaattgggcctgaacccggttattttagaaaaaatgccgaaaatcggtggtaacaccacccgggcttcatccggtatgaatgcggcggagacgaatgtccaattgcatcaccatattgttgatagttttggcgatttctacggcgaaacccttaaaggtggtggcggtatgaataaccaagcactgttgaaattcttcacggaacacagtgcgctcgcaattgactggttagcagaccacggcattaagttggatgatttgacgattactggtgggatgagtgtgatgcggactcatcggccaagttccatggctcccattggtggtttcttagtcactgagttgttgaaacaagtggcggctgaccagttaccactcttcacagatgtcaaagtcgatgaactactcgtcgaagccggcaaaattagtggcgtcaaggcaacaaccccagatggagctgtcacgattacggctggagccgtcttgttagcaaccggtggcttcggtgcgaataagaccttgttaggccagtatcgtgatgatcttaaaaactatcagacgaccaatcagccgggcgcgactggagatgggattctgttggcacaagctattggggctaagttggttgatatggaccaagtccaagttcatccgacggtccaacaagatacagatcatgcttatttaatcggtgaagcggttcggggcgaaggtgcgattttggtcgataaccagggggctcgtttcgtcaatgaactcgacacgcgtaagaacgtgacggccgctatcgaccaactgggtggtactggtgcctacttgatctttgaccgcggtattcgtgaccgggtcaaagcggttgaattctatgatcacattggcctggtaaagactgggactgacttggaagcactggcgactgcgaccggcttagacgctgcgacgcttaaacagacggtggctgactggaatcaggcagtcgctaaccataatgatgcggcctttaaccggacgactgggatggatcgcgatattgcggcgggaccgttctactcaattcacattgcgccagctgttcactacacgatgggtgggattgccattaatccagcaacccaagtgttgaatcaggacgaacgaccaattgccggcctgtttgcagccggtgaagtggtcggcggtctccacggcaataaccggattggtggtaactcaatcgctgaaacggtaatctttggccgtcaagccggacaacagatgttcaaatatttacaataagttattttgactaacccaaatcaatagtccatgcacttgagtaatcggtgcgtgggctatttttgatttgggctgtagttagagaccaaagaaattagtttaaaaatcgactaatttcggttaagctggaaatataacaaacatataggaagaaagtgacaagcatggcgacgatttttacaaccggtgaaccgcaaacaatcacggcaatgctagcagcccgtgatcaacgggtcgcgtatcagcaacagttgacagcgactaacccccgggccacgattgcggcaattaagttgaatattccgggaccgattaagaataacgctgcactacgacggttgtttttggccggtgtccagcggtttgaagctgagttgtcgacatacacggtggcagctgattggaatcatccggcgggtaatgagcggttcttgattctgacgactgactttgcgactagcaaacggctggcggtcgcttttgaagaacacgatccgttaggtcgcttatatgatattgatatcttacaagcgggttcacagcgcgcgctgtcgcggacggatttggggctgccgaagcgtcgttgcttattatgtcaccgtgaagccaaggattgcgcgcgttcacggcggcattcagtggctgagctacagcaaaagattgcggcgatgtatatgaaggaatttggtgagcgcggatgaatacacgtgatttagattattttcgggcgttagttgattgccaaaattatacgatggtcgccaagcagtttgcggtttcacaaccggcagtgactcaagcaattcatcgattggaaaaagagtttgcagtcaaattggtgattcaagaccgtcgccatcaacagacaaatattacccgggccggtcagctgctttacaagaatgcacgccagatccaggcgagtttgcaacttgctcatcgcgaaattcagagtacgttacagactgatattcgttttggcttaccaccaattattggcactttatatttccctcaaattgcggaaaagttacttcagaacgggttactgcaacagttaaaaataacggaaacgggctcagatgagctattgcgtaagttagtgcatggtgagatcaacatcgcgttattagggtcctacttaccatttgatttgccgacagttagtgcggttcacttaggggcacggccattcagtattatcgtgagtcctcaaaatagtttggcgaaacaagccgccgttagttttaaggatctcggtcaggcacagttcattggattagatggcaaatacgtgcacccacaagccttccgagcctattgtgactttgccggggtacatccagaagttatctaccggacccccgatatctcatgggtcaaagccttagttaaagccaacttgggcattagcttactggttcgtgatgtggttaaagcggatgatggcgtcgtatgtttggaaatcaaagatcaattgccggtcagcttcaatatctcggtggtcacacgggctgggtacttaccaaccactgatgaacaacggtttattgatcaattacttaaaatgaagatttaaacgtcgcgactgagccatctgtctaagtgaacagcacgattccttgagtggttcaacttttactttgagattgacgtgtcttcacgattgtttcatttggatatatcgcaatttgtcttgattacgaaaactgcaccaccctcacagactattctgtaagggtggtgcagttttgcttaatcggtctgatcagtgtcaaccgctaatgtttcgtgcaaaatggtcagtagctgttgctgcacgggggtcagaatatgggttgttcggtagacgatgcttgtgatgaattcagggggttcaatgtccatcaagtccagtcgtacgacgtcagtacggtagtgatcgacgattttggtaaagaaaccgatgccgacattttcaccaatcaatttcattaaaacgtgggtatcgttggaacgaaagacgatgttggggcgaaagtgattccggcgcgtgagtttgttgaaggccgtattatggatgaaattactattaaagaaaacaaatttttcacgtcgtagttcgttaaagtagacccgtttacgttgtgctaacggatgttgtttggacacgtagatacagaagggctgacggtcaaattcttcggcaatcaacgtttggtaagcgagcggctccaccgaaccaagtagggtcatgtcaacgcgaccgtcccgcacagcgttacgtagccaaatcgagcccccctcaatggtttcgagaccggctaatagcccttccgcggccaatcgggcaccgatttttggaaaataatggttttcaataattggcggtaatcctaaaatcagtcgattttgggatagattgtcgatttcttggtgggcgaggcgtaactcatgtaaaacgattttagcgtgttcagcaagttgcgccccgctagcagtgacgtgtaacgtatttttaacacggtcacgaatcacgagtggtgccccgaattcagactccaggcgtttgattgcggtggtcacagttggttggctcacaccgaatgttttcgcaacttttgaaaaatttttttgagaaattaattcatcgaaataagctaagtcttttgtgttcatttttattcctttctaaatcagcttttgtagcgaccttatttaatatatttatatcatatcatagttttgactataacattttactggcgttacagtattacttgtaaattgataggacgtttttcctagcaatgaaaattgatgaaaatgtaaattaattaggaggccgcagtaatgacaaaaactgcaagtgaaattttaaataacccattcttaaataaaggcactgcctttaccaaagaggaacgtcaagcacttggtttgacggggacgttaccaagcaaggttcaaacaattgatgaacaggcgacgcaagcttatgcccaattcaagagcaagcccagtcgtttggaacaacggattttcttaatgaatctctttaacgaaaaccggacactattcttccatttgatggatgaacacgtggttgaatttatgccaatcgtttatgatcccgtcgttgccgattccattgaacaatataatgaattgttcttggacccacaaaatgcggcctttgtttccgtagatgcacctgaagatattgaagcaactttgaagaatgcagcggacggccgtgatattcggttagtcgttgttacggatgctgaaggtattcttggtatgggtgactggggtgttaacggtgttgatattgccattggtaaattaatggtttacaccgccgctgccggcattgacccatcacaagtactgccagttagcatcgatgctggaacaaacaaccagaaattattagatgatccattgtatcttggtaaccggcacaagcgtgtttccggcgaacaatactatgatgtgatcgacaagttcgttgctgctgaacaacaattattcccagattcattgttacactttgaagatttcggtcgcgacaatgctcaagtaatcttggacaagtacaaggatcaaatcgcaacctttaacgatgatatccaaggaaccgggatggttgttttagctggtatcttaggcgcattgaacatttcaaaggaaagcatcaaggaccaaaaaatcttatcatttggtgccggaacggccggtatgggaattgccaaccaaatcttggatgaattgatgcaagctggtttaacagaagaagaagctaaacaacacttctacgctgttgataagcaaggtttactatttgacgacacggaaagtttaaccccagcccaaaaagccttcacgcgcaaacggagtgaatttagcaacgccgacgaattaaccaacttggaagccgttgttaaagccgttcacccaaccgttatgattgggacatcgactcagcctggtacctttactgaaagcatcattaaggaaatggcggcgcacacggaacggccaatcatcttcccactttctaacccaaccaagttagcggaagctaaagcggaagacttaatcaaatggactgacggccgggccttagttgcgactgggattccagctgatgatgttgaatacaaaggtgtcacttaccaaatcggtcaaggaaacaacgccttgatgtaccctggtttaggatttggtttgattgcttcaacagccaaggtgctgaacgctgaaaccttgtcagcagcctgccacgcattaggtggaatcgttgatacgtcgaagccgggtgccgcagtattgccaccagttgcgaaaattactgaattttcacaaaaattagctgaagtcgtggcacaaagtgttatcgatcagaagctcaacaaagaaccaattgcagatgctaaacaagcggttgctgatatgaagtgggtcccagaataccgggccatcagcaaatagtgtcggtaaaataagagaattgtaagagggtataagagcacatgggagttttatggaattcaattcaaagcgtcttagttgtcgttttgatcatgatattaggtttcgtcctacgacgagcaggttggtttgatgataagtttgctggaacaatttccaaatttatcaaaaatatcgctttgccagcatcgattttcgtatctgtgctgagccgactaactcgtgggcaattaggatcatttgcaggttacttggcatatgcatttctagccgtgattattggctacttgattgcctttgcgctagttaaaattatgcgggtccgtccaggtcgtaaggggattttcatcaatgcgatcgtcaacgccaacacgattttcattgggttacctttgaacattgcgttgttcggtgacaagagtatgacgtatttccttgtttactatattgttaataccgtttcgacatgggcatttggggtcttcttgatttcaaacgacgacccgacgaaatctaaggaaaagacgcataacaagattgattggaagaaagtcattccaatgccattggttggtttcttagttgcattaattttcttactgctaaatattccaatcatgaaggtatcatttgtcagttcaacgttgacttacgttggaaacttagtaacaccactttccttgatttatatcgggatcgtgttagccgacgctggtctgaagagtattcgctttgaccgtgatacgattgttgcgttgattggtcgcttcatcttgtcaccaatcatcatgattcttgtcttgatggttgctggtaatctcggtgcaagtttcccaaccttagcatcgcaaaccttgattgttcaatcagcaacgccaatgctagccgtgttaccaatcttggctaacgaagcacatggtgacgtggaatacgccactaacatcgtgacaacgagtaccgtgttgttcatcgtggttgtgccagtcttgatgaccttgatccaatatatttaaagtttatttagaagtattccggttgaaagagacgggatgcttctttttttgatcaaaactgcttgagttgaacccgattaaaatatgttaaaggttaaaattaaggtcgatcagtcgaattatttcagctgaccgaccttaatcttttacgaaaggagtgcttgaagacacaagcttgtggcgattgcgtttaaacagatgaatatgatagaaacaaatttaagtcgtaacccataataatgcggttaaattaaaattagtgaatcttatggattattaataaatttgtttaaaataaccaatgctgtaaagtgctgccttgaaaggattcaattaggaattgattgaaattgttagatttacttgactaattgcacaaaaattaatagaattaacaacgttgcattattaagatttagattaggaggcgtaccggatgaaagcatcacaacgattgctggttaaaaaatcagtcaatccagctaattttaataagggtggcctcgaaaagacgttgagcgcatttagtttaaccatgatgggtgttggcgcaatcgtgggttctgggatttttatcaccccgggaattatcgccgctaagtatgccggtccggctgccatgctctcatttgtgattgctgcggtcgtgtgttcgctggccgcattatgttacgctgaattttcttcaaccattcccttggcggggagtgcttatacttacgtttataccgtttttggggaattcttagcgtggattcttggttggtctctgatctcagaatatttattcgcggtatcttcggtggcggtaagttggtcatcgtactttcagaatttaatgagcggctttggcctaaaactaccaacatttctgaccgccgcagctggtactgccggtgtcagtggtgctggattcaacttaattgcttttgtcgtggttttggctgtctcactgttattggtcggtgggttacaagagtcaacacgggtcaattcaattatggtaatcgttaagattctagtgattgttcttttcattggcgtggcaattttctttgtgaaacctgccaattatcatccgttcatgccccatggtgttagcggactggtcaaaggcgcgtcgttagcattctacgcgtatattgggtttgatgcggtgtcgactgcttcagaagaagtgaaaaatcctaagcgtaatatgccaatcggaattgtcggttcgttagtcgtagcatcgattttatacgtggcaatggccgccgttctggtcggggtcgtgcattacagtaagcttaacgtgggtgatcccgtggcgtatgccttagccgtcattcatcaaaactgggcggcggggattgtgtcactgggtgccgttgtcggtatgacgaccgttttgattgtcatgttatatggtgggacccggttactgtttgcgattagccgagatgggttgttaccaaaagtctttcggacggtcagtccccacaccaaagtgccggttaagagtacttggatttttggcattattgccagtgtatttgcggctgtgattccattagataaaattgcggagttagtcaatattggaacgctatttgcattcgctatggtgtccatcggtgttgtcttcctgcgtcgacacgaaacgctacaacaaatcaatagttcatttaaagtaccattttatccagtgttaccagttgtctcgttcctcgcatgtgtctacctgatgcttaatttgcaggcatttacgtggcatatgtttggtatttggctggttattggcatcgtgatttactttgcctatagttatcggcactcccgtattcgagcagggttacgtgccaaagaatcaaaatcgtaattaatagtgggtgcttaccggggcgggtaagcacccattcttttcgcggctactaagctttgagatatgctataattaagcgcataattcataaggtaaagagagttgaggtggctgatgatgcagagacgttcaaacgcctatcatatcagtgtattagcggtactaatggcaatcgtgatcattcagaatattgttccgttttttgggtacattccattaccaggattgagtattacgacaattcacgtgacggttatcctggccgccgtggtcttgggaccgcgtgatggggcaattattgggggcgcatggggaattattgcgtggatacgggcgttcgtcgcaccgacgagtcccttagcaccaatcgtatttaccaatccattgatttcggtgataccccggattctcgtcggtttgatagccggttgggtctttatttggtttcagaagcggcatcaaaaagtgttggggatgacgctggcgggcgtggccggggcattaacgaacacgattctagtcttaggtttgattgggctactctatagtcatcaagcagccggcttttatcaagttaatttgagcaaactaatgccgtacttgttaacgatcgtggcctcgaatgggattccggaagcgattttagctggaattctcacaccactgatcgggacaccattactacgttttaaaaaataagtcgctaaagtgacagctagcttgaatcaattcaaatttaaaacagccacccttgaaatctcctgaatttcaagggtggctgttttaaatcgctatttaacggcttgaacttgtttctgactaataattactttgttgtgatacttatcaacgatggctggatcaggacttgtaaaggtgattaaatacgaattagtgtaacttttcgcaatggtcccggtataagtctggccttccaaaatgaacgtcacttgtgttccaatatccatgatgatgcctcttttcgcacgatagttttattaaggataacacaccagtggacgtaacaggtaaaagttcactaattaaaacgtcgccgaacttgggcccaaattcccgttgctagggctaagagactggtacccagcgttgcgagccatgactgagttgtttcgtcggtctgcgggagctcagttgtggctttggatgctggtgaggagacggcaactaagtcggcactgtcagtattagttgttgtggcagataccgtggctggcgtcgtcacacttgcttcctggtcactataatcttgaagcagactagccgtgacggccgaaccgctgtcatcgtgattaactaaccagtcagtgttagtcgtggcggttgaactgaccataattgaatcactgacttggcccttaatcacgttgctctgatcgatagtgcttgtctggttcacagtggtcgtcgcacgtgttgcgtcaaccgccgtgtcggaatcactatccactgcgttatccgtgtcgttcaagtcaacgtaactagtcgttgaatcatcattaggtttcgcatgattggtcgtgtccggtgttgtatcactagttatgtcggtagtgtcagtggtcgtgttatccacgatagtttgatggtcactgatggcctcatcagccgtcgtttcatcggtaacattgtcctgtgctgtggaatcggtcgttgtaccgttgtcagccgctccctgattacgattatccgttacttgatcaacatcaactgcttcatcttcagcatccgctacggatagcaatggtgttaagaaagctaacaagtgttggcggtattgtaggatcgcgttattagccgcagcgtgaccaccgacagtccctggtaagatccaaacttcttggttggcagaatgattggcggccgctaattccaatgattgagtatatggaatgaaggcgtcgtcttgcgtgtggatcaagagtaacgggatagtgattttgctagctgcatcggttgctgataagtcatcgacactgaaaccttgttccttgatcaaacgagcgttcatcgcggccacgattttatcataggataagaagggcaggctcgtgatggctggcagaccaacggattgaagtgcgtttgaaacggcggtgatggctttgttgtatagcgaactacctagttctggtaaggttgcgtacccggcgtccgacacaactgctttaacggattttgaaagtccaggaactgaggctgcttctaacacggtgtcggcacctaatgattgaccataaaagacgacttgactgtcggcgccattgcgttcgtcgaccatcttaacccaattcagccagtcatacttgtcctgataaccaaacgttaagttatcaccgtcacttaggaactggccacgttgactcggcatgaggacgttataacccatgtcataccaagtctttgaaacgtagccgatccaatcaacatgttccgtccaaccttggccgatgatgacggtcttggtggaatcaccgttttgaatatagtaagcacggacagactgcgtcgggtcattgtattcaggcagggtccaggtttctttggtaacgttatcccaccaagtaactgttgtcggataatattcttcggccgcagcccggtcagcagcataagcgactggatcgaggccggtccacgtattggagatgtcatagcggtgctggttcatttcagtacgtagattagagagggcttctgagccagttcccgtgaagacgattgggtagagtacattacccacgatcgtgctggcgatatctgtggggagttctttcaactcgtcaagaattgtcgtcagtttggctttggctgctgctaattgttcttggccagacggggtcgctgcttgatttgctaagtccttgatcgtattaacgacggccacaatatcactggcatctaacgtgaccgtggtggtgtccgtcttatcagaggtagtaacttttttccaggtcacactgtaagggccactttgtgtaatggtgaccgtactcttttgattgccagtcgtgtcgttggtttcgtagattaagccatgaccgctgtcacttgtcgcggcactagccgcgctggtcgtcgccacactagttggcgttgccgcagcggtcgaatcggtgttggtactcgtatcatcagttgaatcaatagctgaatcaatagctgaatcggtcgttgacttagtcgtggctgtcgccatatccgtgacttgagtagcgtcactcgtcgctgagctagcggcctgttcgttaccacttatggtattgtctgccgtcgaattagtagcgctggtcgtctgactagttactgtgccactcgcactgttagcaacctcactagcttggtcggtagctgacgctgcacttgtggcttgttcagtcgcgctagtctcagtagcgttagtactagtcgtaatttgattggtgtcagtggtagcgctgctgtcggtatttgacgtggtattactgtcttcaccagtagtcatgctacttgtcgtggttgacacggttgccgttgccccggcggcttggctgagttgactggcaacgctagctggggcgttggccgcagaagtggtcgtggcactaacgggggtagccgttgctgctaaggcgttagtcgtcagcattaacgtactaccgagccccgcaatggtaatccccgcgtaaacccaatgtttgccatctttgaacattttataatgatcaacggtggttgattgttgtgaattccttttcattatatttactcctcgtaacgttttattctattgcacgttttaaaatatagcacgacaacccaggcttgtttgcgttttcgcgggctaaacttgttaaatgaggtacttttttaataacggcatcagttgtttattgtatgaactaatttgttaactgattgagtacgatgattgatttttatgatgcgacaagctcagttattcgcgggagtcacgcgtgattttaccagcagatgccagattgcaaaatgtgaacttacaaacgaataagcgtactaatagtggccttgaaaattagcggctttgactattttgggaataaaagttgagattgattgaaatttcacttatcacttgctattatgaaaggtgaataaagtgtttccgctttcgtagggaataaattaataaaggggggaccattatgaatctcggattaagtattttatccttggcgcgttttcagttcgcgatgaccacggtgtttcatttcttctttgtgccattatcaatcggcttagccttggttgttgccatcatggaaacggtgtatgttgtcaaaaaagacatcatgtacaagcacatggcacaattttggggccgcattttcttacttagctttgccgttggtgtcgtgacagggattatacaagaattccaatttgggatgaactggtctgattattcacggtttatgggtgacatttttggggcgccactagcgattgaagcgttagttgccttctttatggaatccacgtttattgggttatggatgtttggttgggatcggtttaatgccaagctccactgtgcgtttatctggctaacgtcgattgggacgatgatttccgcgatgtggattttagcagcgaacagtttcatgcaaaatccagttggtttcatgatcaataccaagactggtcgtgcacagatgacgagctttgcagcagtcgtcaagaacgaacagctctggtatgaattaccacatgtgttgtttggggcgtttgttaccggctcatttgtggttgctgggatggcggcgtttgcgttactcaaaaagaaaaacgtcacgttcttccgcaaatcgatcaaggtcagtttaatcgttggcctggttgcttccatcggtgtgattggaatgggagatttacagacgcgttacatcattaaagaacaaccgatgaagtttgccgcaacggaaggcttatataaggattccggctcgccagcttcatgggcagttattgaagggatggatactaagaaccataaggccaactggtcgattgaaatcccgtatgtgttggatattttaagctatcataagttgtccggtaatgtgaagggacaaaatacccttaacaaggaacttcatgccaagtatgacaagaaatttggtaaggacatgaactactacgtgccaacaaagacgcttttctggagcttccgggtcatgacggtagctggtgggctcttcgcactgattgccattatcggtctatacttcaaccgtgcaaagtcaacgctgattgagcggcagcgctggttcctgtgggtactaggaatctgtacgttcttaccattcgccgcaaacacggccgggtggctgattactgaattaggtcgttatccatgggttgtttatggtttactgacgattgcagatgccgtttcaccaaatgttagtgtcgcttcgttgctgatctctaacatcgtgtacttctgcttgttcagtggcttaggcattgtcatgatcgtcttatcacggcgtgccttacaccaaggacctgatgatttgttacaagctagcgatgacgcaccgtacgatccttatggtaaggaggcgttcagtcatgagtaatctacaattcttatggtttattctggtgggcgttctatttagtggtttcttcttccttgaaggttttgacttcggggttgggatgacgattaagagcttagcccaaacacgcgctgagcgcgatgttgtgattcatacgattggcccacattgggatgccaatgaagtgtggttgatcactgctggtggggcgatgtttgcgtcgttcccaatgtggtatgcttccttattctccggattctatcttatcttattgttgattctagtggccctcattatgcgaggggtctcatttgaatttagaagccggatggaaagtgacgccggccggaatttctgggaatgggccgcagccctaggtagtttctttgctgccttcctatttgggatgatgtttactgctttggtcaaagggatgccaatcaatgccaatggcgatatgactgcccacttcaccgattacgtgaacttgttctcaatcgttggtggggttgccgtaacgttactctgctatttgcacgggttaaactttattcgtctgaagacgaccgggacgttgcgtgaacgggcgctccagtgggccaaaccgttatactgggtcctgtttgccggtgaagttgtcttcgcaattctgctgttctttaacaccgatttctttaccaagaaaccaatctcaaccacgattttagtggtcgccttagtggctttgacggtcttggcaacttggggtgtttatggaaatcatgaatggctctcatttattagcagtggtctctcactgatcgacgtggtcgtgctcctgttcaatggactattcccacgtgtcatggtggcgaacaattctgcatacagcattctgattaaagatgcgtctaattcaccatatacgttgcatctgatgactgtaatctcattatcggtattaccgattatgttgatctactttatttggagttactgggtcttctataaacggttggcatcgtaattcaaatgcagatgacgacagtatcactggtgcggtggtacaattaatttaacagcaccaacggggtcgcgaccttggccaagtgccagggtgcgaccccgttcattttaagtagggagtgatcgaatgtgtttgatccggcattatttaaactaccagggatgcgccgagcagccacgattttagggttactggccatcgtcgagggtatttgtattgtctttcaggcctactatctatcagtggcgattgttggactgtggcacttgcattcattggcgtcgatcagtcagcccatgctatggttcgcattagcttgggtcggacggcagttactggtcgtcattaaaaatcgtgtgatgtacccgttagtcgaacagacgacgggtgacttgcggcgtaaagtgatgcagaagttataccaactcggcccaagttatgtagctaagactgggactggtaacgtggtgacgacagcgcttgaaggtatcgataaagttcagacatacttaatgttggttgtgattaaagtaatcgacatgatggttatcccgtggatcattttaatttacatcgcgtggttgcgttggcgtgaggccctttttctactggcaatttttccattaattattctatttatgattattttgggctatgccgctcaagctaaagcggataagcagtacgtgggctatcaacggatgtctaatcacttcgttgatacgctgcgcggtttaccgaccttgaagcagttaggactgagcaaacggtacgctgacaacgtttatcaggttagtgaaggttatcgtaaacaaacgatggcggtcatcaagattgcgatgttatcgactttcgccttggatttcttcacgaccttatcgattgcggttgtcgcggtcttccttggttttggtttgattaacggcacgattacgttgctaccagcgttggttattttggtcttatcgccagactatttcttgccattacgaacatttgctaatgattatcatgccactttaaatggcaagaatgcgtttgcggatgtccagaagatgctagctttgccggtgccaactgaacgtcaacagctcggtactcagcctgtgcaatggcaaagtgatagtacgttaagtttacatgacgttgattttaagtatgatgatgatcagctggccttaaaacacattaatattgatgtgcatggttaccaacggatcgggattattggggcatccggatccggcaaatcaactttgatcaatttgttaggtggctttctaaccccggtcgctgatcagggtaaaattcaagtcaacgggaaaacagtctcgcatttgagccaggacgcctggcagcagagctttttctacattccgcaaaacccatatctgttccatgcaacgttagcagagaacatcgctttttatcagccagacgcttcacgtcaagcgattgaacgagctgctgaaaacgccggattaacggcctggattgcaacgttaccagcggggttggatacggcgattggtgaaggctcccgtggtgtcagtggtggtcaggcgcaacggattgctttggcgcgggcctttcttgacgactcgcggcgagttctgttatttgatgaaccaactgcccacttggatattgaaactgaagcggaactgaaaacgacgattttacccgtacttgataatcacttagttttctttgcgactcaccggttacactggattaatcagatggattacgtgttagtgatggatcatggggaaatcgttgaacaagggacaccgacggaattggccgcgcatgacggggcgtacgttcggttacgtgatgaaatggtaggtgcgatctaatgaaagattttttggcaacttttaaaaatgatacttgggtcatgccgtatttgcgcaagtataaaaagttactagccctgacgctgtttttgggtctaatgacatttttctgcggttcagcgctgatgttcaactcgggctacttgatcagtaaagccgcacgacacccgtataatattctgatgatttatgtgccaatcgttctaacgagagcgtttgggattggtcggcctgcctttcgctatgcggagcgaattacgagtcataactgggtgctacggatcgtgtcagattttcgtaagaaactgtaccaatccgtcgccaagcacgccgtagcgattcgccaaaatttccagactggtgatgtcctgagcattttagctgacgatattgaccatattgaaaatttatatttacggaccgtttttccaacggtgattgcctggttgatgacgctagtgattgtgattggtctgggctactttagctggtggttcgggctattgatgttgttgatgttaggattggtcgttgtgataatgccgctatggtcggtcttactgaatggtgctcgtgaatcacgcagtcgtcagattcaacagggcttttatacgcagctgactgattcggtaatggggctcggtgattggttgattgccggacgtcaaacggatttctatgagcggcaaacccagcctatcgaagcaattgcggcacttcgtaaacaggaccatcgctttcagtggtggcgagattttacgattcagatcattttcggggtgatttgtttggcgctcttgatctggagtagtttttactggacaacgaatgcggccagttccaattggattgcggcgtttgtcctctccgtattcccgttggtcgatgccatgcagtctgttagtcagggtgttagtgagtggccaagttatcaacggtcaatcaaacgagtcaacgccttagacaccacgcctgaagatgaacacgatcagacagtcttaacggagccatttcaagtattgcgtattgcggaccttgactttaaatatgcggaaggtggtcacgcgatttttgacggtttgaatctgactttaaaagccggtgaaaagttagccctgctaggaccttccggaacgggaaagagtaccttgctcaagctgattttaggtgacctgacaccggatagtgggacggttcaattgaatgatgtgcccatcacacggttacaaaatgagcgcgcccagttattcggcgtcttggatcagcagccgtacttgttcaataccacgattatgaacaatgtgcggatgggtaacttgcaagcgactgacgaacaagttaaagccgcactagcagcagtcgagttagcgcccttgatcgacacgctccccgatgattacgagacagttgtagaagagggcggtgcgcgcttttctggtggcgaacgacaacggctcgcgctagcccgcatcttattacaagatgcgcccatcatcattttagatgaaccgacagttagtcttgatccgattaccgaggcccatttgctgaccacggtgttccgggtcttgcatgataagacgattctgtgggtcacgcaccatttggccggggtcaaccatgtcgaccaagttcgcttcttggaagatggtcaattcgatatggccggtacgccgagcgaattgtatgcgaacgcaccgcggtttaaacgcctttatgatttggatcaagggcgtgatgatgcgaacaatgatcggtaatccggttgatagcagtcttcacgtgcaccttgggcttgtgaaacagacttttaattactgcgctgaatgggtattcagcctacgaatgtagtggtcatgatgaccattactgattacaccgccgatttagagcgtaaaaaggacttggtcgctgtgaccaagtcctttttatatgcaattaatcgccaggttatgatttaacctgttagtaattttgtaattgtgcccgattctgaacgtcgaccacgtaggctttcgtgcctaagcggctgagtaaggtccgtacatcattgtaattgattgagacgcaaccagccgttgcccattgattcttgacgtgaataaagaagcccgagccattatgctgaccgtgattgtccatcacaatcgctaattgatactgattgtggggcgcggccttcgtgtaatcgatcagatgctcgttcttattattggcccagtttcggttctgccaagtgttatattgccggtcatgtggatcttcaatccagtaagatttccggttgatctgtcgataggccataccactagttcttgcactggcagctttaccaaatgcgaagcttaagtgataaacgcctttgggtgtggtactgctgccttcgtgagaattgccgatgccagcggccccgatgcgacttgcggaagttagtgtattcttccagccgcgattggttttttgccaaagtttaagagtggccgtggatgagccattttgaatgaccgtcacgatttgctgagcctttttggacacgcgcattctggagacgagtgttgcttcggatggggtggcagctttggctttaactggctttaagtagccactccaaatccagccagtggccccattcttgctattgtgaacccagtagtaacgaacctttttgccgtgcatgataatatcagtttgctgagtcgttgtccagacggtgttgcaatagttcttcaaatcatgattggccctgaatgtccaacgattataattaccattagccctaaaggtatgtgatttggtatcggtcgtataataggcctttctagccgttgcccgcgttggcgtgcgatgatagtaagtgctggcattcgcagatactgaacttagcattgtgaccgctgcgatcattagtacgctccccagcaaccaattaacaatctttttcatgaaacccctcctagtaaaaatagccccgttattacaatttttatacaaacactataatactatttatctcggcggaatggataacaattttgactaaatcgcggcggtgtagggtgagtaatggttgtagctgaaaaaacagcgcgtcagagtaataggttactttgacgcgctgatttaatttgtgtattaatggttgcgaaccagtaattcagtcactagccggcgtaaagtttgttgtgtttcaccagttggtagctgatcgattaggttcagtgcggttttggtatagtgagtagccaattgttgtgcctgggtaacgccccccaaagcaatgacctgatcgcgaattgtcagtagctgttcattactgatgtggtcgccgggttggggtaattgttcggccaattgtggttcagcggtcagggcgtagataagtggcagtgaataaacgccgtcccgtaagtcattaagcaccggcttttgagttaaggcctcatcaccggcgtagtcaaggacgtcatctaacatctggtaggctaaccccatcctttcaccaatctgttgcgctagtttaacgacgcttgcgtcggcacccgcgaagtgggcaccttgttcacaactgaggctgaacagacgggccgttttgccacgagcaattgccaagtagtcatcgaccgtggtcgtcggatcgaagttatgtgccatttgatccagttcgccttggaggatggctcgcatcgccgcagtattgattttaacgtcgtcagctgtcttggcagcaatcaggacttgatcgaaatagcaggtaaacaacagatcaccggcgtaaatagcattacgttgaccgtagtcttggtggatcgttgtcacatggcggcgttctggcgattcatcaattacatcatcgtgaatcagtgttgccacgtgtagtagttccatagccgctgcgccagcacgtaaccgggccgtgttatgatccggtccaaattgactaaacaagtaaaagaagcccgggcgtaaaaacttaccacccgcagcgagtaagtcgtgtacgcggtcattaatggcggcgttatcaatttttacgttagtagctagatacggcttcagcgctgctagctcctttgcgacaagactttccggttgccaaatggtttgcatcataatcaaaataccccgctttatttgagagatggctccgggacgttttgacgccaacacttgcagccagtcacattctaaaatacaatctatattaaaggtacaaataacttgtttcgttgtcaaacaaaaggatggtgtaaatcattgaaaccaaaagtgtttcttgaatttgttgaaattaaatcattaattgcgagcgtgttaccgttcgttttggggagtatgtacgcctattataattatcatcagttacatcttggttatttattgctatttttcattgcatcttcactttttcatatggcgactaatgcgaatgataattaccaagacttcctacacgcgccacgtaatgacgacaatcaagaatttttgcaagagactaatgtggtcggtgttaaccagatttccattggtcaggcccggacgattacgtttggtttagccggaatctcattgattatcggactatggttagtaacacaaaccgggttgccgttgttgtggatggggctatattcatatgcggtcggttacttttacgctggcggtccgaagccaatttcacaaggcccgtttggcgaatttttctcgggctttacgatgggctttatgatcttctggattgccgtctttattaatacgtatgacacggcagccattacttggcagtcaacgctggctgttttaattgcgtcaggtctggccatttttgcaatttttaacattatgttagctaataatatttgtgatatggacgaggacattgcgttaggccgacacacgattttgtattaccttggcaaaccggtgatgcttcaggtatttgcatggagttacgttgctggttatgcttgtctggtgatcgcggtcttgatgggtgtgctgccaaagtttagtttactaacgttgctcagtattattccagtttggaaaaatacgcgggtcttcttgcacaaacaggtcaaacgagaaactttcacgatttcaattaaaaacgcaacgttgatttgtctttcatttatcgttttcatgggcttaggactgatttttaactagtccttcaataaacgagtatggctttgagaaagcgccaactaaccaagttgatactaagcagtatttttcccagcgagtccaagctggctttctgattttatggcttagggtttttcaatggtatttcacgggggtaaaaaaagcttggatatcgtgtgaaaaaacacacggtatctaagcttttttaatttacataaagatgttattcataactagttttcaaatggatagcggaagtcccattgtgcacgagcggcagtcatgatatccataacgtcagtcgttttagcaagactcgtgttgtgtaattcgccagcaaccattttttgcatgtcagcaatttcgtaattcatggcgttagtgctatcgccggctgtgatggtttcagtatggccttcgctgtcggtgaaagtggcactgtcggcacgtggataggtatcaacggtaaagtaaccattctcatacgcgacgataccgcgtttaggcattttagctcggaacgttaaggcaacggtggccagttcatcattggcgtttcgtaacgtgattgtcgaagattcatcgacgccactgctgaatcggtgcatggttgttccggtaatgtatggtttagcagtcaagaattcttccacgaaggctagggcatagacaccaatgtccagtaaagcaccgccggcaaggtcgggattaaagaagcgattagttgggtctggttctttaaaactaccaaagctagcttggatcattttcagatcaccaagatgacgttctgccgcaaaatcatggagcttctcgtataatggcatgtgatacagggtcatcgcttccgctaagataaggtggttgctagcagccacttccttggcgattgcgagttgggtactagacattgtgatggccttttcactgaggacgtgtttgccagcacgtaaggcgggtaaaatcgtgtcaatgtgataattatggggcgttgccacgtaaacgatgtcgacttgttcatcagccagtagctcgtctaaattaccataagctttgggaatgttgtgttcggcagcaaaggcgttagctttttcctgcgaacgtgagcaaacggcgtagatttctccgtcaggttgatcaaaatatttaacgaaactgtgcgcgatgttaccaaggccaacaatggcccagcgataagttttcgacattataggttcctcctaggattaatcgaatgtgaccacttacattttagcaaaaaaataaggaattggcgcccaataatcatgtaaaattaattcaaaagtcggtaaaatagagtgtaatatgaccgatgctcattgcgatttaggcttacttagaattaaaacatgttggttagttggattcttattcgtcagcacgtgcgcgtcttatgccgactttcggggccgggtgacaattactggaacgcagccgatgtcgatttgagctaacgcccaagccgcttcatctcaaatacgagtcttattctaagcacgtttacgctaactcgaactttttacagcgggcctaagctggcagctttgaactaagaaaccagcatgttttaatcctaattcatgataaatgaacaggtgtaatctgtaaggtaattaccagaaaggaggcggctatgatggcgggtaagcggcgaaaatcgcgccggaagcaacggacaaagacacaattatttgtgaagaagggccgccttcagtgggtcaatatcttattagtgttggcggcgatggtggggatggtttggtatattcagcataattgggcggttaagtcgcgggttacggcgacagcacctacaacaacgcatgcggcatttattaaaaagctagtaccagctgcgcaacagcttgatcagcaataccacgtgctggctagtatcacgctaagtcaggcgattttggaatcggattggggacaaagtaccaatgcgacagagaataataatttatttggggttaagtccacgtcgggacggctcatgacgacgcaggagtattatgacggggcctatcatacggtcaaacggcgcttcgccgtttatgatagctggcacgcttcgctggtcgatcatgccaagaaattggcgtacggaacgacttgggattctcagcactacgctgcggtgattaaggcaactgattatcagacagctgcgcaagcattgcagacggctggatatgcgactgatccaagttatgcacaaaaattaattaatattattcaaaaatatgacttacaacggtatgatagaaagtaatgaaattaatagcagtatttcaatgtcgcttataattctaggagggtactatgcgagaacttgaagaacgcattttgaaagatggccgggtacttcccggtgaagtattgaaagtggacggctttttgaatcaccaagttgatcccgacctgatgtttgccatgggaacggaatttgcccacttgtttcaagatgcgggtgtaacgaaaatcttgacggttgaatcatcaggaattgcgccggcagtcatggcggggttagcaatgcacgtgcccgttgtgttcgcacgtaagcacaaatcagtcacgttaattgatgatttatatacagccgaagtttattcttacacgaagaagacgtctaaccacatctcgattgccaagaagttcttacaggcggatgacaaagtcttgttaattgacgactttttggccaatggtcaggcggttcaagggatgtttgaaatctgtgataaagcgcacgtaaaaattgcgggtgtcggtattgtgattgaaaaagtcttccaaacgggtcatcaactgattgctgatcggggtgtccgtttagaatcactagcacagattacgtcatttgatggtgaccgggtgcactttgcatcggaggacacccaggcttaagttaagaaagcgggggattgtgatgcacattgacatggggatgctagtccttattttcatcatcaactttgcttacattacgttaaacaccgtacgttttttgcttgtaatgcggggttatcggtattttgcagcttttgcaagtgtcattgagattacgatttatgtgctaggattatcattggtcttaaatcgtctcaataatccgattaatttagtcgtatacgcgttaggttacggtgtcggggtgtatgttgggatggtaattgaagatcgattagcgttagggtatacaatgatttcagtcattttacctgatcccaagtcgtcgttaccgggagtgctccgtgaaaatggctttggggtcacacaacacgctgcttatggcttagaaggtgagcggctagaactggaaattctggccccacggaagaacgaacggcggctgtatggcctgatcaaagacgcggcgcccaatgcgtttgtgattgcgtatgaaccacgctatatctccggtggcttttggctcaagcgagttaagcgacgcaatgctcgccgaaaaaagcagtgataaacttgcaactgtgcgtgtcagcaagtatgattgttacaggataatgagcgttaaaataattcaataatcagattataattatttaaagcataggaaagtagggactgaagtggacaactcgattttaaacccaggtggtacgcttggcattattggaagtagtactaatggtgttggattagtaattgccgcgcgtaatgctggcatcaatgtcggggtatacggcgataacgaaaatactgagaccatggaactggcagattttcgcgttgtcggggccctcaatgatcaacaacagttacagaacttcgcagaacgttgtgatatggtgacttacgagtcggaaaccattgatgcgtcggtcattaattttttggcggcccatacccgggttccacaaggcgccgatgcgcttgagattacacaggaccgctctttggaacgggcgtttttcagccaacttaacttgaatgtagcaccgtcagcgacaattgtcagtttggatgatgtctatcaatcgatcgggtcaattggatatcctagtattttgaagccgattcaaaagggcttgggtcaaaatcggcaactggtcattaagacgcagacggatattgtcaaggcggctgatctgttggattggggcacatacttgttagagtcattgattccatatgataaggaactctccgtttttggcgctaagagtggtgatacgacagctttcttcccaaccgttgaaaaccggtatcgtaatcatgagctagttgcctcgattgtgccagctcaaattgattcagctgtgaatgacgaaatgctgcggatcacaaaggaaattagtgataacttgagttatacgggtgtctttgaagttgccttcttcttaacgaagagtggtaatttatacgtgaagcggattgtccctgcgatgcatcaggcgggttatgtcttcgaacgtgctacgaatattagtatggcagaacaacacttgcgagcaattgcgggactgccgttaatgccagtcaagcagttgatgcccgtggttgctgcttactttacaccggctcaggagagtggcattcgcacgcagtggcagattaagacgaactggttctttaatttctatcaccgaacgttgttacaagcgcaccgggcaccagtcgctggccacgtgctagtcgaagcaccaagtgttaaagaagcactcgaacagatcgaagacacaagtatttggcagtttgggcaaacgacgccggctgataatgaacctgaagctgagtagtgtatgatcagaacctagttttacggattattacggttaaactaatcgtactgttcgcaccgggtgaccagctattatgggtaaccgtcgtgaataaataaagttcgaaatccaattcattttgtgaattggatttttttagcggttggggagaagccagccaaatggcgagatacggttatctgagggggaatcgttgagattggcgtggcgggtattttggttagaaattgagggagtctcaaaattacttaaagttacgcaatattgccgtcaattcgtttcccgtgaatagtagaagttgtaaaattaacataggtgtcactgacaatggaaaaaccgcgatttttgtatgagatgctgaccttaaagtacagcaatcacggccaaaatttgctataatgtttggtgactgatttttagaaagggtggcgaacagcgtgtcgaaagaaagcctattggcaggaatgaatgacaagcagcaagaagccgttttagacacagaaggaccgctactaattatggccggtgcgggctcggggaagacccgtgtattgacgcaccgggtagcttatttaattgaagagcaaggggtcaacccctggaatgttttagcgattacgtttacgaacaaggccgcacgcgaaatgcgtgaacgggttggtaagctgttaggtgaatcggcgcaggaggtctgggtctcaacgttccatgccctgtgtgtccgaattttacgacgtgacattgaacaaatcgggtataaccgagcgttcacaatcgccggcactagcgagcaacggaccttagtcaaacgaatcttgacggaacaaaatatcgattcgaaaaaatttgatccacggtcaatcttatccgcaatttcaaatgcgaaaaatgacttacaaacgccggagatgtataaagaatcggctgccagtccctttgagagtgtcgtggcagacgtttatttgcaataccaacgtgaattagcggctgatcaagccgttgactttgatgatctgatcatgctgacgattcaattattcaagcagaatccagaaacgctggcgtggtaccaaaacaaattccattatattcacgtggatgaatatcaagatactaataacgcacagtatacgttagtcaacttgttagctgacaaatataaaaatttgtgtgtagttggggatgcggatcaatccatctatggttggcggggtgccaacatggaaaatattctcgatttcgaaaaggattatccgcaagctgacacggtgatgttggagcaaaactatcgttcgacaaagacaattttgtcggcggctaatgcagttattaacaataattcaacgcggcggccgaagaaattatggactgagaatgaaccgggtgacaagatttcttattatcgtggtcagagtgaaagtgatgaaactcactttgtcattgccaagattcaagaaagcatgcagcaggacaaaatggactacggcgattttgcgatcctttatcggacgaacgcacaatcccgggtaatggaagagtcactcgttaaggcgaacatcccctatacaatggtcggtggtaataagttctatgaccgtaaagaaattcgggacgtcttatcctacttgactttggcagtgaacgatcaagattcaatgaactttgaacgggtcgttaatgaacctaagcgcggcattggtcaaacgagtgttgaaaaattgcggttgttcgcggatgaagcgggttattccatgttggaagcagctagcaatgttgatatggctaatggcatttcagcacgagcgaagggtgctttagcgaagtttgcagcgacaatgaatgaattgcgcgctatgcgggaatacttatccgtgacggatttaacacaagagattcttgaccgcacgggttacatgaaggcgttgaaagatgctaaggcaacgaaatcgttagaggcacaagcccgtatcgaaaacattgaagaattcttgtctgtcaccaaacaattcgatgatagttatcaacctgaagatgaagatagtgacaaattcgtggacttcttagcggatttagcactggtttcggatgtggataacgttgaggaagaaccccaagccgtgacgctgatgacgttacatgcagcgaaggggctagaatttccggttgttttcttgattgggatggaagaaggtatcttcccactgtcccgggcaatgatggatgaagacgagctggaagaagaacggcggttagcatacgttgggattacgcgggctgagaagaagctgtacttgaccaatgcatactcacggatgctttacggtcggcggcagaataatccggcttcccgtttcgttgaagaaatcgaaccagaattactcaaaaatgaaaatacgttggatggtgcaagtagcactggtcctaaagttccatttggtgcggatcgtgaacggcgtgcttttacaccttcatataaaaagaatccagtggggacgcgggccacggtcaagaaggctagtggcacgggtgctgacaagaatagttggtcgatcggtgataaagtcaagcatcgtaagtggggaaccggaacggtcgtgaaggtctccggtgctggtgaagatgctgaactagacattgctttcaaatctgaaggaatcaagcggttattagccgcatttgcaccgatccaaaaagtacaggactagttaggaggactggctgatggcggacaaacccaacacaatgacggttgagcaggcggctgatgaagcggctgctttacggcaaacgttaaatgaatggcgtcggcagtactatgacgaagatgcgccgaacgttgaagatagtgtgtatgatcaaaagtatgaacggttggtcgaactcgaacaaacttttccacagctcgttacaccggattcaccgacgcaattagttggtggaacggttaaagcaggctttgataaagtgacccatgagattccgatgttgtcattgggcgacgtcttttcacaagctgagttacaagagtttgttgatcgcttggaacaaaacgttggtcatccagtcgattataattgtgagttgaaaattgatggtttagcgctgtcgttacgttacgaagatggggtgctcgttcaagggtccacgcggggtaacggtacggttggcgaagatattacggctaatattaagacaatcaagtcgattccacaacggttgacccgaccactgacgatcgatgtacgtggggaatgttatatgcctaaggcagcgtttgctgccttgaatgaacgccgagaagcagcgggagaaccagtctttgcgaatccacgcaatgctgcggccggtacgttacggcagctagattcacgagtcgtggcggaacgacagctcagcacgtttatgtataacattgccgactacgaaccgttaaccgcccgtacgcagagtgacatgttaacggagttcgcagatcttggttttgccatcaatcctgactttaaggtggcccattcgatggccgatgtctttagttacattgaccattatcaaaatgaacggccagaattagcatatggcattgatggcatcgtgatcaaagctaacccgttaccgctgcaacgctcactaggagcgacagtcaaggtgccacgatgggcgattgcctttaagtttccacctgatgagcagccgacccttttaaaggatgttgaatggaccgttggccgtacaggagtcgttacgccaactgcggttatggaacccgttcaactagctgggacgacggttgcgcgggcttcgttacacaatcccgattacgtggcggccaaagatgtccgcatcggtgatacggtcttgctacacaaggctggcgatattattccggaaatttcatcggttgatttagccaaacgacccaaggatgcgcaaccattagttattccaaccacgtgtccgtcttgtggggcgccgctggttcatttggaagacgaagtggctttacggtgtattaacccgaaatgtccagcacaagtccaagaagggctggttcattttgcctctcgcaatgccatgaatatcgatggcttgggaccacgaatcattgcgcaactctatgcaaatcggctggttagtgacgttgctggtttgtaccgattaactaaggcacaactgttaacattagataaaataaaagataaatctgctgaaaagctcttgacagcaattgaccgtagccgtgataattcacttgaacggttattgttcggtcttggtattcggcacgttggtgctaaagtggcgcggttaatcgcgcagcattttgggacgattgaggcgttgatggcagctagccaagaagagattgcggcgatcgattcgatgggcgatgtgattgcgaacgcagtggttcaatattttgagagcgacgaagttcatacactcatccgcgaattgcaagcagtcaacgtgaataccacttatcaaggccctagtgccaccgtggcagaagatagtaacagttggtttgcaggcaagcgggtcgtgttaactggtaagctggaaagctttacgaggccagatgcgactcaatggctacaagctcacggcgccacggttacgggaagcgtctctaaaaagacggatctcgtgattgcaggtagcgatgccggaagcaagttgcaaaaagcacagcagctggacattactgtatgggatgaagcccggttcagcgaaacaatgagggaggatgcacaagcgtgaatgttaaacgcatacgcacgattggcttagtggcagtagctgccattgttctagccgcctgcggtaatttaaagaattcgtcctttgggtcgactagtagtagcaccacaacgaccggaacgaaaacaacgaccaccactggaactgctgatagtgagttctatcaaggcgtcatcaaaaatggccgttatcggacgagtaagtcgcgaggcgtggtcgtttcgcaaaatgataacgtcatgaatttgaagagcttcgaaagtggcttattggacgtgtctaaaaaggtctttccaacgagtaagtatgtctttcaagaagggcagtatttgagctcatcgacagttgaaaattggctcggacggaaatcaagcagcaattcggagggcttgaacccagagaataacggtaagaaggatccgaatactcggaatccgatttacttacaacagcttgaagaacaagattatatggttcaaaatggtagtaagttatcgcttggcggggtcacgattggcttgggaatgaactcggtcgattattatactaaggtcgaatatggggcaacatacgaaacggacatctcaacgactgagttaacggcgcaaggtaagaagatggcgaatactgtcttacagcggttgcggcaacgttcagctttgaagaatgtgccgattgtcttggcactctataagcagtcttcgaatgatagtttagttgggggcgacatgattgcctacgcggtttctaagaacggctccacttcgatctcaaactggacgtcgttgaattggaagaattatgtcttcccagcgacctctgagtcaaagaactcaggtgcgaatagtaatgatgagtcggactttagtcagtttaagtcccacgtgcagaatttcttcccgaacttgtctggcgtaacggcgaatgctcattacaaggacaaatcgttgagtaaattaagtgtcaacatcacgactaagttctacagcgaaacggaaatcatcagtttcacgcagtacttagcaacggctgctaaacggtacttgccatctggtgtaccggttgaaattacggttaagagtgccaatggtgacattcaaagcttcttagccagaacggcgaagggtagttcgtattacacccatgtctttagtgaccagggcgacgattaaacaataatattgagtaagatttgagaaagaaggaaatctgatggctgaagaacgaattaatgccgaacaagtgcaacacgtggcgagcttagccaaattggagtttacaccagaccaattagcgatgttcacaccgcaactagaaaaaattatcggcatgttcgaagaattaagcacagttgataccacgggtgtacccgttacgtcacggatgagtgatcatacgaatacgctacgtgaagacgtggcagttaagagtgatgaagcactccgggaagcattgctgaagaatgccccagaaacggccaatggcttgatcaaagtgccagcaattattgatgaaagtggggacggtgaataatgacttatttcgaccaagatctaactagtctacacgctgacttggtagccaagaagatcagtgccacggaactagcgaaggccacttttgcgaatatgaatcaggttgaccctaagctaggggcgttcttgaatttaaatgaagaacaggccttacaacaggcggctgctttggatcagaatggcatcgacgcgaacaacgtttttgctgggattccgatggcagtcaaggataatattgtgacgaagggcctaacgacgacggcggcttctaaaatgttggaaaacttcgtgccggtctataatgccacggtggttgacaaactattagcaagcaacgcgttgatcgttggtaagaccaacatggatgaatttgccatgggagggtcaactgaaacgtcggcgttccatgtcactcgtaatccttgggacatcagccgggtgcccggtgggtcttcaggtggctcagctgtcgcagtggcttctggacaagtgccagttgcattcggttctgatacgggtggttcgattcggcaaccatcatcatttaacggaattgtcggtatgaaaccaacgtacggtcgggtctcacgctgggggctgattgcctttggatcttcattagatcaaattggcccaatgacacggacagtcaaggataacgcggccgctttgaatatgattgcaggtaacgatgtgcatgataccacgtcatccaaacaaactgtaccagactttacggctggtttgacgggtgatatcaagggtatgaagattgggttaccaaaagaatacatgggcgacgggatcgatcctaaagttcgtgaagtcattcaacaagcagtcaagcagtttgaagacttaggtgctacggttgaagaagtctccttaccaaacagtcgctacggtgtggctgcttattacatcattgcgtcttcagaagcttcttcaaacttacaacggtttgacgggattcgttatggtttccgggctgacgatgttaagaatttggaagatgtctatgtccgtagtcgttccgagggcttcggtgatgaagttaagcgccggattatgttagggaccttctccttgtcagctggttattacgatgcgtacttccacaaagctggtcaagttcggacgatgattatcaatgactttaataaggtctttgaagattacgatttgattatgggaccagttgcaccaacaccggcctttaagttgggtgacgaattatctgatccaattacgatgtatatgaacgatgtcttgacgattccagtcaacttggctgggttaccaggaatgtcagtaccagctgggtttgcagacgggttaccagttggcttgcaattaattggtaaggcgtttgatgaaagcacaatgtatcgagcgggctatgcctttgaacaagcaacgcaagtttacaagcaaaccccgaaagtcggaggtgctaactaatgaattttgtaaccacgattggtttggaagtccacgttgaattaaaaacgaactcaaaaatctttagtccttcacccgtgcaatttggttccgaaccaaatgccaacacgaacgtgatcgactgggggtatccgggggtattgccaacgcctaacaagggcgtggtcgaagctgggattaaagcagcaacggctttacatgctgaaatcgaacatcacacgtactttgaccggaagaactatttttacccggataacccgaaggcctaccaaattacgcaacatgaaaaaccaattgcgcatgatggttggattgaaatcgaagttgatggtaaaaagaaaaaaatcggtatcgaagagatgcatattgaagaagatgccgggaaaaacacccatgaaaacgactattcctatgtcgatttgaaccggcaagggacaccgctaattgaaattgtttctaagcctgacattgcctccccagaagaagcttatgcttactgtgaagcgttgcggcaacggatccaatttacgggcgtttcggacgttaagatggaagaaggttcaatgcgggtcgatgttaacatttcaattcggccggccggttccgacaagtatggtgtgaagaccgaaatgaagaacttgaactccttcaactacgtgcgcaagtcgttagaatatgaagaacaacgccaacaacaagttctcatggcgggtggcaagatccaacaagaaacgcggcgttttgatgaaacaacgggccaaacgatcttgatgcgggtcaaggaaggtagcgatgattaccgttacttcccagaacctgatattccagcagtcgatatcgatgatgactggattgcatccgttaagaagaccattccagaaatgcctggttcgcggcgtgaacgttacatcaatgaatttggtttaactgcttatgatgcgggtgtgttgacccaaactaaggaaatgtctgacttctttgatgcaaccgttgctgaaggtgcggatcctaaattagcttcaaactacttgcaaggggacgttaacgcgtacttgaacgagcataaagttgatttgttagcgactgacttaacgccaactaacttagctgggatgatcaagatgatttcagatgaaaccatctcaagtaagattgctaagaaggtctttaaggccattatggcgggctcagaacctgtccaatgggtcaacgacaagggcttagtccaattgtctgatccggcgaagttacaaccaatcgttgacgacgtattggataataatcaacaatcaattgatgactttaagaacgggaaagaccgggccgttgggttcctcgtgggtcaaatcatgaagaagacacgtggtcaagctaacccgaaagtcgtcaaccaactattaatgacatcattaaaagcacggtagaagcgttggtcgataaggtgttgagcctcgattgatgcatgtccagcgttggggtagagatgagacgctgaacgcttgaccgtgtgagcggaggaataggaaacatgcgtaaacgggcacgacttatttataacccgacttctggacgtgaggcattggcccacgatttagttgaaattcttggtatctttgaacaagctggttatgagaccagtgcgttcgcaacgacgcccgcccctaattcggcggctgatgaagcgcgacgttgtgccaaggacgggtttgaactgattgtagcagctggtggtgatgggaccatcaatcaagtagtaaacgggttagccgggttaaagcggcgacctaagatggctattattccggcgggtacgaccaacgattatgcccgggcactgcggattccgcgcaatgatccggttgcggcggccaaggtagtcctaaagaaccagacggttaagatggatatcggtcaggctggtgaacagtatttcattaacattgcggctgggggcatgttaacggagctgacctatgacgtaccatcacaattgaagtcgatttttgggtacgcggcatacttagccaagggtgctgagttattaccacgagtaaaaccagttgagatggatttgaaatatgatggtggtcattatcagggcaaggcttcgatgtttttcttagcgctgactaattcagttggtggctttgagcagttagtgccggacgcgtcattagatgatggtaaatttaccatgattattgtgaagacgagcaaccttgctaaaatgcttcacttaatgacattagtgctcaatggtggcaagcatatcaatgatccaagcattatttatgtgaagacgagcaaggtcgtcgccaaaccagctgacaaggatcgcttaatgatcaacttggatggggagtacggtggtgatgcaccgatgacgttccggaatttgaagcaacatatcgaaatgtttgccgatacggatcggatccccgatgaggcaatcacggatacggatccagagttggaagacgctgagcgacactttgtctcagctgttgatcagttgccagctgcaactgaggacgacgaaaaaacagaataacttgcttaaattaccgtttaccgatacaatggtggacggtaatttttttaaaagtgttaccgtcacagggacacgattgagcattgcctgacgatttaatcgtttgtcggtttagcaatgatttgtcagtggtgcaaagcatgagacagctcaaattcgcgcgttttgacactcacagtaagcaatttgaatagcatgtttaatcagtaaatgttaacgacactgccaagtgtggcagtattaatggccatatcattcgctgcccggagcagtggctaccaggcagtaactaaaaaataataagtcactaacaaagaaagcaagaggaaacaaatgaaagttaatttaccagtgcacaagggtgaagttttagacgtcactatcatggatttaacctatcagggtatgggtgttgctaaagtcgataattacccaatctttatcgaaaatgcattgccagaagaaaaaattacggtcaaggtcacgaagacgacgaagaactttgcgtttggtgatgtggaaaagattaaccaagtgagtcctcatcgggttaatcctaaagggcgcgtttatcgtcaaaccgggattgcaccactacaacacttggaatacagtgaacaattgaagtttaaacagcaccaggtggccgaattatttgcaaaggtccacatggatgatgtcgaagttttaccaacgattggtatggccaacccgacgcagtatcggaacaaggcccaagtacccgtacgacaagtccaaggacaactaacgactggtttttacaagaagaacagtcatcaattgatgccaattgaagattattatattcaagatcctgcaattgataaggctatcgtggtagtgcgcgacattttacggaaatatcatgaggcagcctacgatgaattccatcatagtgggacgattcggacgatcatggtgcggcgtgggtattacagccatgagatgatggttgttattgtgacgcgaacgaaacacttaccaatggctgacgtggtcacacaagagattcaagcagcgttacctgaagttgtcagtgtgattcaaaacgttaattctaagaagactaacgtgattttagggccagttaacaacgtgttagctggtaaggccactatcgatgatcagttactgggcctgacattcgccatttcagcccagtccttctatcaagtgaacccacaacagaccgaaaagctttatcagttagccattgatcaagctggtttgacgggtaatgagacagtgatcgatgcttattccggtatcggaacgatttcgttaacaatggcccaacatgccaagcaagtgtatggtgttgaaatcgtgccagcagccatcgataacgcacggcagaatgcggataagaatggtattacgaacgcgacctttgttttggatagcgctgaaaaagccatggctaaatggcaagcagatggcgttaagccggacgtgatcgtcgttgatccgccacgtaagggcttggacgccgactttatcaagagtgccggtgaaatggcgcctaaacgggtggtttacattagttgtaacccatcaaccttagttcgagacgtccaacggtttgcagaatacggctaccatattagtgccccagtccaacccgtggaccagttcccacaaacaccacatattgaatcggtaacggtgttagaacgcgaacaataagcattttaaaactggattattaatgaaattatgaaaagtgtgttgggtgcctgattatttgtcgggtaaccaacacacttttttactcagcttgagggctaactttgaattagaagcacaaaataaccgtttttaagcgctgatattgatttgaattcgtccgattttaatagacagatcatttagaatcggctaataaaacagtttattgataattataattattgctttaaataatttaataaataatgcgctgtaattgctgtaaactagttcactggagctgtttgagtcaaatttagcgtattaaattaaataattgtatttattggtcaaaaaacacccacaaaaaccatcaattgtattacttttgataaaagtatgtatttcatctcggtttttgaccagtttgggttataatgataaacgaaataaaccgataaatgggggagcatgatggtaaagagaagaacactgacacaggcaaaagtattagcaacagctaatcagttaattgaaagcaagggaattaacggattaacaattcgggatttagcgttagttttggatgtgcggccgcaatcgatttataattatgttgatagcttgagtgatttattagatcaggttggcctccaatttgttcaaaatgttgcggatcgtttaactgaaacaatctcagacgttgacggtgatgaggctttgatggcatttgctcaagaattccgggcggcctgcaaccagcatcgggggttggcaccgttattacttgacttaaatgataacctaagaatcccacggtctcgtaaagcaattgtgcagttataccaggatatgtttaaaccattacaattggatgattcggcgcgggtggagaataccttgtaccgttccacgttgttcggattcattatccaagagattggcggcttctttaagatgcaggggactgaacttgatgaacggttcacgaaggtgatgcagttagcgattgaccagacacacttacctgctgataagacgaaaaaataatttaagattcagtgcggctatcttagcagatagccgtttttttataggttaaattcgccaatatttagcagtaaatggggcgtaatacaataatctttgttaaggctgaaatcaaaatcaataatgatttattgaagtaattttatgatcaatcgtaatgaaaatcttaattctgcatggtaaacgctaaattagggcgttattttagccccaggcttaaaaaatcgtttacaataaggttaaagttaattttaagggggcccaccatgtcggaacgttatttatcagcaattgaacacgggttaacgactaagcaagttgaccagcgcctgacagcgggtctaaagaatgagccgttaccgcccttaacgcggtctgttaaacagatttttcgtgataatttgctaacactttttaactgtatcaatgttttgttagctgggttagtttttttgacaggaagctataagaacatgctgttcttattcgtggtcatcgtcaacacggccatcggtatttttcaggagattcgtgccaagcgccaggttgataagctatcactattatcggccactaagattcaagtccgccgtgacggtcaaacggtagcgatcggtcaggacgaaatcgttcaggatgatttactattagtgacccgtggcgagcagattcctgtggacgggctcgtgcgggcgaccgctggattagaggtcgatgagtcccagattacgggtgaggctgatccggtcattaaggggccgggtgatgagttggtttctgggagtgtcatccttggcggacacggaatcgtgcaggcgacgcaggttggtcacggtagttttatcaagcagatggcgcgagcagctaagcaaaaacggcggacgccaagtcaactgttaacgattatcaatcgaattatcaaaattttgacctttacgattattccactaggtgctggtctgttcatttccactatgatgcggggtgaaagtcagaaccgggcaatcctcgggacggtggccgcgatggtcgggatgattccggaaggactggtgctgttaacgtcagtcgctttagctgctggggcgttcactttaggccggcaccaggtattggtgcgggagctacccgccattgaagcactggcccgggtcgatacgttgtgcctcgacaagactggaacgattactagtggcaagttagtttttgaacgcgttgagccgtggaaccagcatgatttgacagcagtggagcaccggttagctgcgttagtcactgctattgatgatgataatgaaacggcccgggccatcaagactgcttttggtcagccaccagtgcaagcgacagaagttcttcccttttcttcaagtcgtaagtggagtggggccgcgtttgatggtcacgcttacgttatgggcgcaccggaatttatttttaccacggtacccggcgagttacagtctcgcatcaaaacgctcgcgcaacaaggttaccgggtattagtgttagccgaagtggccgccttaacgacgcccaaaccgactcgaccgatgactttgggattaattctgattacggatgagttgcggccacacgctaagacgacgtttggtttttttgctaatcaagacgtcgccctaaaagttatttctggtgataatccggtgacggtcgccagtattgcacaacgggctgagatcaaggacgctgatcggctggttgatatgagtcaagtggggactacccccgactatgatcagctagtgacaaattatacggtgttcggtcgagtgacgccgcaacaaaaagagcaactaattaaagcctatcagcgcaacggccataccgtagcgatgactggtgacggcgttaatgatttgttggcgctgaaacaggcggattgtagtatcgcgatggcgagtgggagtgaagccacgaagagtttggctgattttgtcttaatcgattcgaactttgatgcgatggtgcaagtgctgaacgagggtcgccgcgttatcaataatattgaacgggtcgccgcgctctacttgattaagacgatgtattcggtcgctctgacgttgatttttatcttcatgagccacagctacccgtttgagcccatccaattaacaccgatttcatcgttgatggttggtattccaacctttttcttggcgttacagcctgattatacgcgaattaccgggcgctttatgaaacaggtgatggagattgccgttcccgcggcgatctgcgtggtcggctatatcatggtcatcatggtgttaggtaataagttccagctgaatttcgaaacgaccgcgacattgagtgtgttgatgaccgggatctttagtttaaatgcgttattgattgcagcccggccgttgaaccggttcaaaattgggttagtcgtgttaatggcaacactgttcgtcctagtctttttgtttgccggccgaattttctcattggttaatctattagattggtcgttagctgtgatttacctaccactgatgatcagtgcgtatccggtgttcattgttctgcaaaatggcttaggaaaacgcgttctcagcaagatcaattggcgataatcgatcaaatttaggtgacggggccacgctgcaattacggcgtggccttttttggtgtaatcagattgctgtctcagcgtaagccacaccgttgttgaccagtcagattaaattaacaatccgatataagtatggttgataccagcatagcatgtaaatttataacagattttaataggcagcagcgtctaaaacggcttataatgaagttcagtagattaccggaatgggggcggtattgtgtggcttgatgaacaacggttaattcaacggttagtgccgcgcttgttgcgttttcggcaaactaacttctatcggattattcaacggaccttgatgttgacgttcccattcattttgattgggacgttcagtcaaatcattcaactgaccgtgttgacgaaaacggggtttattgccagtatctttcacctgtcaaaatgggtcccatactatcgttacttacactatccgtttgatagtttaacaaccttgacgctcaacggtgtggccgtagtagcagcatttggtgcggcaaaataccatgccaaactcaatcagcgcgatgaccaactagcgggattgaccgccgcgattgcgctattgatcgtggcttatcagtatacgaatcaaaaccaaattggtgtttttaatactttattgatcgggactaacggtctaacgggcgcattgattgtgggtggcttgaccggcctgtttttcaaatggttcagcaagccggttccggcacaaagtagtccgcatatggccgatatcttgacacggactttcagttcactacttccaatggccttaatactagtattggccgtgctagtgagcctcgctttgaactggctgatgattattacgtactctgctgaaagttggtcggcatttcaaaagtacgcaacgactagtcacagtctgtggctgacctttggcatggcagttgtgacgctgttgttagaaattcttggactagctggtccgtaccaagaacgcttggtgaccaacagtgcgacaatgacggccaatttgaattatgcactcacacatcactcggcgtatcacgtgccgtatccgtatacggccaacacgttgtatcacgcatttgggacgtttggcggaacggggatgttgctggccttagtgattgccatttatatcggtagcaacaatcataactaccacgtagtcgcgcggtggagtctattacctgcgctctttaatagtaatggaccgctactgacaggcttaccagttctatataatccaatctatctaataccatttgtgcttgtgcctgtcgtaaatatgggactggcggcgctggcaattgggtttcattggattccacccgtggtttatccggttcccgtgggtacgccgggaccgttgattgcctttatcggcactaacggtaacgtggtggcacttttacttggtatcgttgatttggcactatcagtggtgatctatttgccgttcatgcggttggcggaaaccattgtgcaggcggcgcaagcacaggtggggggtgctaagcatgtataatcgacctaattggcagcgacggcggcgaagtctgttagtgcttgtattaggcttactatttctgggctttttgattcagccctcataccagtggacgaaaaccaacgtggctgcgatggcaggacgccatgattcgcagatgtcaccaattattatgattcccggcagtagtgcgacccagaatcggtttgacaccttagtcaagcaacttaataaggctgatcatcgtcggcatagtttaattaagctgaccgtgatgacggatgatacgattaaaatgacggggtcgttgcgtgcccgtgataacgagccaatcatcgtcgttggctttcaaaataatcgtgacggctatgataatattaagcatcaggcccgttggttctcactagcctttaagaagttggctgccaagtatcaattcaataatttcaaagcaattggtcactcgaatggtggtttgatttatacgtactactttgaacactattttaatcgcgacgatattaaggtcaaacgaattatgaccattggctcaccttacaatttctcagaagctaatttgaatcataagacacaaatgttagctgactttattaagtaccgcgatcgattgcctaagtcggcgacgatgtattcggtcgcaggtaccgaaaactatgattcagatggtcttgttccagcgcgaagtgtcgaagctggtaagtatatttatcaagggcaagtcaagcattttacagagattacggttactggtacggatgcccagcactccgatttacctcaaaatgcgcaaattgtgacgttgatcagaacttacatgttggataagccgaaacagactcgtaagggcttagtatcagttggcaccacagaatgaatggtaacaaggtctaaccgctgcggattggtcagtaatcaatggcccacaacgatagcatttgtgaggaaatttagggtgttattaagaattgtggtaaaatttggtcatggaggtggccgaaatgtccacacaatcaccagtacatcgcaatcgggtcctgactttaattcggtcttattatccgaatctaagtgtgacggaccgcaagattgccgattatattattgccgacccaattaaaacggcagctcagtcgatttcagacttggccgcagcggttggcgtttcaacggccacagtttcacggtttgtcaaacggattagttttagtagtttccgggacttctcacgtgaactaacggcggccgaaccgattgaacaaactaatgctgaagcttttcaagatgtcgaaaaacaaacgacttttaaaggaattgcggaatcaacattcaatagtattcgtagttcgctagatcagacaagtcaggtaatgacggaagcggacctcaagcgggcagtggaattgttgctgaatgctcgctcgattggtttttatggtctcggcggctccgcagtcgctgccctagatggttatcataagtttgtgcgcaccggtattccgtgcgctcataatagtgactatgatatgcaactgatgcaggcagctcagatgaacgctaatgacgtggcagtggtgatctcacatactgggcgtaatcagcaaacactacaagtattggctaccctgaattcacaaaacgtgccaataatcgcgttgactagctttggtaattcccccctagccaaggacagtactgttgcctttatttcagttgcagaagaaattaattatcgttcggaaggactaacttctttgattgctcagatgagcattatcgatagtctcttcttgatgactgctgtccatggcaatatcgaaatggcagaaagtcttggccgggttcgcgaggccattagtcaaacgcgaacagagctttaatgctgtaggcaaaggattgatgagatgacaaagcggcaacattatcgaccagtatacgcgaaaacgcggtggcgttaccgaattggctggttattagttctattagtgattatgggcagtgtttggggcggcttggtctggctacgttggcgcagtaacgctgtcgtgagtggcttcaatgtgcgtggagttgccgtgtcacaaaatgacggttatttagactttgcgaccttgcaaaatgatggcctcaagtttgtctatctacatgccactcaaggggctagttatacggatgataacttcgcaagtaattatgagcgaatcgttggtacgagtttgggcgttggcgtgattcacacgtttagtttttcatcgactgctgcggcccaagcggcctatttcgagaaaacggtcggggatagcgtcggcaatttaccaattgcgattcaagtgcaatactacggtgactacacggaccagacgattgcggtccgaaaaagtcgtgctaagcttaaggcattagtgaccacgttgaaccaggattataatcgctcctgcgtcgtatggtcaacgcccgcagttgccaagcagatcgttaagcccgcactaaaagacactgacttatggctggacacggcgaagacccaccaacagggacgacgagtgatgtttatgcattattccgatcgcgccgtttaccgccagaacgggattcgtcaagagttcgctggaattctattcaacggtagtgtgacagcgtacaataaagttgtggcgcagggcttaaattaaggcctaatccttgaataatttatttcgcaaatcaaattaacagtttattagctgctaggctgactaaaaataagtcgcaagttcaagactcttcttgaacttgcgacttattttgatggcgacctattaaaatccttaggacgtcactagcgtcattaggtatttggcgataagatgacataactgcgatcatcggcttcgtcaaagagggttacaggtcgttgctcattagcccgcacctcaaggtgaaatccatattgatcaagtaagacgagcgcactcgatgagatggattcgacggtggctggtaccgagcgcccgtcgatgcgaatcatcatgttgggatcaatctccaacgtgtggtcccggtgatgcgcctcatcacgataggtccaagttcccgcgtagaaaaccgctaagtcaccgtcagcgatcgtactagggtgccgtttgtggagtagtgtactagaaagtcctgcaagtaatgataaaccaaataatattgcgccacgccgcttcactggatcaaccttctttctgaataaatctatagttaaaatataccactaaaacggcgttaacgtcacgtaataagtggattcttattaaagcctttatgtcactgttacctgcgggtaatgaacgtaatatttgatcaatttcggaagggcggtaactaatttttttgaattaatttgtgttctgattggaaattactgggtgagtgtgttaatctatataatgtgattggcatttatgtgaagttttaaagtatcatttaattgtgttaccgtaaattctttataggtgttaataacatgtgttagttactttttatttttatatcctaggaggatttagttcatgaaaaatggtactgtaaaatggttcaatgctgataagggttatggctttattactggtgaagatggcaacgatgtattcgttcacttctcagctatccaaactgacggtttcaagaccttagaagaaggccaaaaagttacctttgatgaagaatcaagcgatcgtggcccacaagctgctaacgttgttcctcaataagcttagcttttaaaagggctgcccgtgtggcggctctttttttatgcgcaaaatagcgggtgacttttgacccttatggcccaacttaacggcgaaaactggtaaaatagaattataaactaaacgcacgagtaagcgccaccaatcacgactggttgactagcgccgttgagaggagtcaaatcgatgttaaaattaggaattatcggaacgaattggattacgcaacaatttattgatgctgccgctgcctctggtgaatggcaattgacgagtgtttattcccgccatgctgagaccgcgcaggcttttgccgccaagaatcatgccgatgagacttttacggatttagatgcatttttcagtcggggtagttttgatacggtctacattgcgtcaccaaacagtctgcattttgcccaggctaaacaagcaatcgcctatggtaagcacgtcatcgtcgagaagccagccgtggcgaaccaacaagaatttgaacagttagatgccgttttaaaggctcaccctgatgtcctattatttgaagcagcacgccagattcacgaagttaatttccaacgcgtcaaggatcagattaaaaagttatccttagttcagggtgcgacgttgacttacatgaaatactcgtcacggtatgacgccgtcttggctggtgaagaaccgaatatcttctcgttgaactttgccggtggggcgcttcaggatttaggcgtgtacctggcctacgatgcggtcggctggttcggcatgccggaagaggtggcttactacccaaccttgattcgaacgggcgttgacggtaagggtgtggctattttacgctacgctgactttacggtgaccttgaacgttggtaagactagtaattcgttcttgccatctgaaatcaacggtctgcgcgacgctattgtgatggacaatcctgctgaacttggacaaatcacttatcaagataaggatggtcaggagcatgcgattggggcgcaacccgataccaatccaatgctggccgaggcgcgcgacttcgcaaccgttatcaatgacccaagtaatcaccagacggaatacttagcttggcggcaacttagtcgaaatgttaataaactattatttaatttgcggcagtcagggcacctatattttacgggtgaagcccctgataccgataaatagaaatgaggcactatgttagacgtatttaaaactaaatttgcggcggcggggttcaccgagttgtcgccgattcaaacggcagtggccgagccacttgcagctggtcaatcggtgttaggactcgcaccaacggggtctggtaagaccctagcgtttacgtggccaatgctcgaagcgttgcgggtcggagaaggcacgcaggcactgatcctagcgccatcacaagaactcgcgatgcaaacaaccaacgtggtgcgcgagtggggccaattgatcgatgccaaagtcctcgcgattaccgggggggctaatgttaagcggcagatggaaaagctcaaaaagcatcctgaagtaattgttgggacgccggggcggattactaacctgattgcggatgggaagatcaagcttgggcatctgaagatgatgatcgtcgacgaagccgatgaattactgacagatgaaaccttggatcagattcgtgaaattctcgacgctacatttgctgaaacgttacaattaggcttcttctcagcaaccgaaactaaaattttagatgagttgccacgctggtttggtcagcatgttgaaaaaattgatgtgcgggccattgatcagacccagggggtggttcggcaccggacgatgcaagtgggtaatcggcaccgggtggacttactgaaacggattagtcgtgttgaccatatgcgggccctcgttttcttcaataagatgcaggaactccaacatgtcgccttagaattacgacaccagcacgtgagttacgttgccttgaccagtaatcaacggcaggttgaacgtgaaaaagcgttgcggttattccggcaaggcaaggtcgggctgttgttgaccactgatttggcggctcggggtctagacgtgcccgaattgccagctgtgatcaactatcagttgcctaaagacgtcacgacttatattcaccggagtggtcggacaggccgcatgggtgctgatggactagtcttgacgttcggtgacgaccatgatgtccgcgactttaagaagctgatggcgacgactgactatgaaatcaagccgggttacttggtcgattatcatattgttgatacgaaaccagataaagttgttccaccgttaacgttcgaccatccagaaacggctggcaacgcggctaacggtcggcaccgggtcgtgagtgctggtcacccagatgaggttaagcgagtggagacgagccggaagcggcccgctgcggcaacacctaaaaagaagaaaggtcacaataagcattctaagaaaaaagggatgcgcaagaaaaatcgtgatcgctttagcaatcagtaattgccaaaatgcacaatccgtgagatgatattttacggattgttaatggcctcatagcacaactggatagggcacctgcctcctaagcggttgatcccggttcgagtccgggtggggtcagttgaatattagaaagcaccgtttcagggcagcgttttagtgacgttaccttgaaacggtgctttgggtttaagtagccacaaatgatatgaaatcgaaatgaatactgtattagtctaaacgcccgctaccagtccaaatgactagtagcgggcgttgcgattaacgaatgacgatgacgttgcaaggggcgtgatccacgacgtagctggtcgttgaaccaacggctacgcgatggggcgagttggtaccagtggcgccgagcacgatcaagtcaatttcgggatgttgcttggcatagtcctcaatggtgtgttttggaatcccgtagctgatttcagtttttaaattcggtgcggacgtggtggcgacgaattgttgtcgctgccgcatggcatcctttgcgtgagcggcttccgcgtctagtaattcagatagaaccgggtcgagtgcgggggtgtggtaggcgctgtcatccaccacgtagagcgcagtcaggtttgcttggtgccgctgggcaatgttgaccgcttcagtaaaagcggcttgtgcagcatcggaactgtcaacaggtactaaaatatttgtgtaacggcttggcattataaccacctccagttatctttacgataattataatggattagtgttgggcaataaaattaaacgcacctagtgggcaaggtcgatgaactagcgtatattatagacagtaaatttcttttgggggttaggtatgttaaagcatgtacagaacggcctattgacctttgaacgggtcgttgagcggcaacgttattggcgcgccttacgtgatacgttgacgctgctttttccattcgcattagttggggcgtacgttagttttatgaaccaggcaatctttcagcgcaatggttttttgaatcatatttattatctcagtcactggctgccggggtttaaacatttggcaacttacacgacgatgcttaatctgagtatcaacggcatccttgccgtgattgcggctttttcagccgctaattttgtcgcgcggagtgcccagcgtgataatctgttagcgggattgacggcggcaattagttttatcatgcttaatatcaattataatttttttagtacccagggtcagcctgctggcagtcggtttttagaagataatttgggaactcagggcatcttcctcgcactattggtgggcctgttgactggttggttgttcagtcatttgacacggtatccacacatccaccaggagatcgagacccagacccacttgctagcgcgggcacacgcgaactggttaccgatagtcgctgctttgctggtgttcagtgccatcgggtatggtattagttttgtcagtaaagggggattaaacggcctgttttacgcggtcttcaccttaccattcagtaatccgggggcgtcgctactagcgataattggcgtggcatcactcagcaatttatactggttaattgggattatcggtccggttgactttagtggtaacagtactacgagtacggttcaaaatttggaatatgcgttgcaacacggttcggcgtggggcgcgccaaatccagtaacgctccatacgttatttgatgcgtttgcgaacgtaggtggtcccggaatgacgttagcgttattgattgcaattttgtggcgttcacgtaaccgtaattatcgaacggtggccaagaccagtgccttgccagtactgtttaatatcaaccaaccgttgctcgtcggcttaccgattgcttatagtccgattttagcgattccgtttttgttagcgccactggctagtatggtcatcacgtggtgcgcgttgaagcttcaatggatgccgccggtcgtttatccggttggtagaacgatgccgggcttcttgaccggttggctgggaactggtggcgactggcgggctttcatcgttagtctgatcaatatagcggtggccacagcaatctacttgccatttgtcttactggcaaaccaggttgagggggaggcgaaggcggatgcttaaacgatattggtggcggtggctcctcggaatcggtttgttaatcgggatttgttggccggcctacacgtggagtcaagcgaatatcaagacgctgaaaaacactggtcggacgcggatggcaccagttattatggtccccggatcgagtgcgtcacaaaaccggtttgatagtttgattaccgagttggggaaggaaacgccgaaaaaacacagtgtattgaagctgacagttcagacggatgggacaattaagtatagtggttcgattgctgctaatgataatgagccgttcatcgtgattggcttcgcgaataatcgtgatggtaaagctaatattgataagcaagctgtctggttgaatacagcattcaaggcgctggtcaaaacgtatcactttaatcacttctatgcgctaggtcattccaatggtggcctcatttggaccctctttttagagcgctatctaaaggaaagcccgaaggttcatattgaccggttaatgacgattgcctcgccgtacaatatggaatcgacaagtacgaccgccaagacgagcatgttcaaggaactttaccgttatcggactggtttgccggaatcgttaaccgtttactcgattgcggggacggaaaactataccagtgatgggacggtgccgtataacagcgttaactacggtaagtacatctttcaagatcaggtcaagcattttacggagattactgtaacgggggcgaatacggcgcactccgatctaccacagaataagcaaatcgtcagcctgattcgacagtatttattggctgaaacgatgcctgacaaggttcgtcaaaaaaacgcacaacgggtacaaaattagttacgttgtgtggcagtgctactgctgttaagacaacactggtgaacgatctggttaagaaagttatacatgcagtgaatagaacaacaaaaacgattagcgtctcgtaaccgggacgctaatcgttttttagttagatttgcaataaattaatgatgatgcctggcgttgtgtgagcgggctgaccgtttcgaatagtggtgcttcgacggcttcgcccggtgcttgactcgcattgtgacacgggttccccgaactcgcaaggcttgtgcattggttgccggcagagtcagtaaaccgccacagacggccaggatgacgagcactggtaatcctcggtggatcgacatgatagaacgcccccttaactaaaatccttatttagtgtataagtaattcgagtcagcgtcaacctaaggtccgttactgactttacaaaacgttaacggcatattaacggattattcacaaaaagccggcaaatttgattgtattttgccaagttttcctttatggtgggagtaatatataaaagggagtttggctaaatgaatattgaaatcttaaactcagcaatccaagacttacatttccaaatcgtttatgatcgttctgaagacgatgacaatcctggtcagggtcaattcagctatacgaccgccaatccagatgttaagaagacgtttggcgatgacgttgtgcagacccaattacaagtgacctataaagaagaaatgttcgacttatccgcgaccgtttttgcgattgtacgcctaagtggtgagatggtgggaattattgaacgtcaatctgacaacaaatcaattgaagacgacgaacaagaaatgttgaacaatttgaatggtgccatcattccagcgttgtctgccaaagtccgggcctatgcagcattattgtcaactgaagctagcaactttgccatcatgccagctgactttgatgatagccagcccaatgatgctgaataagcgtaatccaagagcttgtcaaactggcaagctttttttgatggcttaaggaatgagttctagcgttgtgtaaccgttaacaaaggtgctataataatgatggtcagagttgactaggcaactgcggttgcaatgacgaggtcagaaggtctgattggtgacttcagcaattattactttgatccaggcttatcggaatggttcaaagcgggggtgaccgcgagtcggtcagcacacataggggcagtgaatattgacacatagtttgagccaagctggtaagtattgtggtggccaagttacgctgtaatttggccgctatttttatcttgttttcagccgaacactgcgacaaaaaatgaaaactgtcgtgatgaaatcactgtaaattgtcacatgaaagcgtatactgacggtgagaggggtgagcgttatgtttaaaccaatggcatctgtttttacgaaccatcaaattgcgggtcattatcgggccattgagcgggcgcaaaagtgcgtggtcccatttcattttgagattcagggacaggagtatccaaagccaaaaccagaacgtaactggttacggcgcttatcggggacgtcgagcgaaaagtacgcaatggtcgaactgaccccgacaaaggtcgttttgtggtcaccagaaggacgcaatctgggtgaaatgccattgagtgcggtgcggcgaattcagatcggtgcgattcggtgtcacgtaacggaaggactcgacccacgccacgcatttcgggcgacgatctttgtgctgactgatagcggtaattattattttgctaattctgatatggaagttttaccggcgatttgtaagttcgcccatgaacatcaagtgccggtagaagacccactgcggttgattccgcttttgaaggtcggctggcgggtcgcggccgtgacgttacatgaaacctatgcgcaactggttgcgcacacgggttatccggctgataaggtttaacttaattttatgattaataataatgaaaaacggactgtcgataatgacggatatactcctctttgggtagacaagcaaataatcaaagcttgcctacctaaggaggagtttttctatgggcagaaaaggttctcgctatacgatta

SEQ ID NO: 7 - DNA, 180009 bp, synthetic construct
  source 1..180009: mol_type = other DNA; note = Lactobacillus plantarum PDG8 -Contig 7
tatttgctagcgaattgacttcgcaaatgttttgctcttgattcaaaatcaagagaccctacacatttgattcgtcgaaactttgttcagttttcaaagatctaattccgtgcgttaatcgcttaacacaactattacataatatcatttcatcatttccttgtcaacaactttatttaagaagttgaataactatgcaaatgaatttgaaacgttattaccataacataatcgttaacacctcaatcagttgaattgttaacgcgacaagaaatatcttatcattagcgattactcatgtcaataacttttttgctgttttgaatatttattcacttacaacaatttgaaatgaaacaatgtaagtgctagcggctagctgtttaacagcagtgctcgcagcgacaagatatatattatcaagtattagtatgcaggtcaaccctttattcgaatttattttgataaattcgtaaacggcattgtttcactcacacgaacactcgtaaataactcgtgcaattcactggctagaacaaactcgagcccttgacgatcaaactttgcacgtacctgcccgtcaacagctaggtggtcaaagacaaagaccgcaactttttcatcatccaactcagccataatcgaatcatacaagcgcaattggtcaacatcaataccaatcgtatatcgcaaatcccacaatactgacgctaagggcgaatgccctgctcgtactggcaactgataaaaattgtatccattagtagaatgcttaactaaaaagtgcgacccttgctggtcattataaataattgtcccggcaacttttttctgcactaatactcacccgctttcaatcgatttagtgaatccgaagtccaactcgctaaatgattggcaattggttcaaagccagcatgaacatgccgattcgtccaaaaatgcttatgccgaaaagtcttgtagatttccaaatcattgaccgtcggatgcggttgatgctcgatacaacgtaatgacaagctgatttttccagtatattcgtcaatatctaaaataataacatctacggcttgaccaacctttagatactcagtaatacttttaacgtatccttcatgacactctgaaatgtgaatcaatccctgatgctcaccatctaaggtgacaaaagcaccatatggttgaataccagtgactcgtccgtgtacccgcataccaattcgataattgctcacgatcataccatcctttctcattcattctatattgtcgataattctaatccccaatattataacctgaatacagcggattgcaaaatcgtaattgcaaaaaaagaaacccgcagccgcagatttctttcaaactaactaatcctcaattgtaattgtttcgatcacaacatccttcactggtttatcctgcataccagtctcagtggccgcaatcttatcaacgatatccatcccatcactaactgcaccaaaaacagtgtgccggaaatctagccagggcgtgccaccattgccatacgcagtcacgatttcttccggataaccagcttgcttcatctgatcactcatcccagcatctaattgtggcttttgaacgataaagaattggctaccgttcgtattaggaccagcgttggccattgataatgcccctcgcaagttgaaaacctcttgtgagaattcatcttcaaatggtttaccccacaaactttcgccacccatcccggtaccggttggatcgccaccctgaatcataaaatcaggaatgacccggtggaagataatgccatcgtagtaacccttctgagctaaaccaacaaagttttcaacactcttgggggcctgctttggaaatagttgaaccttaatatcaccaaagttagttttgattgttgcttttggtccatcgacctgacttaaatctaattgcggaaatgccacaaaatcacccgttttctattaagattatcttgataatacaagagaactcgattaaatgctagccatttgtaaggatttcttgcgattagcgactaagcatagtatttcgactgattttctggtaacctagataggattaatttcacattacttggaggtaaccatgagttttttaatcgattttgtgttgcacattgaccaacacttagtcaccatcgtgaatagttttggaatctggacctacctaattctctttgccatcatcttcattgagactggcgcggtcattttaccatttcttcccggtgactcccttttatttgcagcttgcgcactcgccgctaatccaacctatggcttacatatctggacttttgtcattctcttcttggtggcagctttggcgggcgactcacttaacttctatattggtcatttcctaggagaacgcctaactgaaacatcctggtttggtagactgatcaatcaaaaacagctggcaaagtccgaaaaattcttcgaaaaacatggtggcatcaccgtgaccatcgcacgcttcatgccaatcatccgaacctttgtcccatttgtagctgccagttcgcgaatgaagtatcaacaattcattcgctacaacgttatcggctgtgtcctgtgggtcattctctgttgtggtggtggctactacttcggtaatatcccgttcgttaaggaacacttttcgatggttgtcattggaatcatcctggtttcactgattccagctgtcttctctgctatccgcgcacgctttagccatccaactgaaaacgaagattaatccaattataaaaggccgatcagctaataatagctgaccggccttttataatctaacttaaaatgcagtgtccactgtaaatactcttcattaatccgcttcacgtaacgcttgtctgccgatactgagtaagtaaaaaaaagaccactcaatcaggataaacgctagaacaaagcactgaccgaagaacgtatccggcaagaccaaaatgattcggtccaatagtggatcgaacaaccagtccgaattgcgaaataagatcttatggaacatgataaagaactgatcaaaattgatagccattataacggtcactactggtggtacccagagggctgtctgcatcggtaatactaaccgccacaattgtcgatcacgtcgtagtcgctgccaaaaaaaatagaccacaacactcgtgacgataaacacaccgtaatcaagcataaatagattcttcacatccgcaaagtgaaccaacgcactcgtcgaatccgtaaaatcgttcatagttaatttgggtacccacggaaagttaagatatgctaacagctgatagtagttcgtcatcagccgtcccaatgtcaaattcacagttgcgcctaacttttgaccaaccgcattggcaaaatacaaccagctcgcgttgattgttacaattatcgtgccactcactaaccataagtataaactcagccactgagccgcatttttaaatttatttagccacaccatcgtctaggtcccattcgtccaaagaattgatctcattagttggtttgacggcctgttgtgccactagttcaggggtagagacaccggtatacaccaataaggagtcaatcccaaagttaattgccgctgagatatccgtcatataattgtcaccaaccatcacacaatcgtgcttatcgagaccaatccggtcgaccgctttctgcataataattgtctccggcttaccgatgtaagttgcacgttgttgggtggcccgttcgaccatcgcaattactgaaccagcacctggcactagcccccgctcatttggaagattagtatccgcgttggtgccaatgaacttagccccccgcttaattgccagcgtagcaagttcaaatttatggtaggtcgcatcatagtctaaaccaacgattacgaatctaggtgtgcgctcatcgaacttgaagcccttttccaacattgcacccttcaagccaagttccccgatgacgtacatcgttttatcaccatcacctgcaaggtcattaacatagtctgcagtcgctaacgctgccgtataaacattcgcaggactcacatgaatatcatgattgttcgctaagtttgcagccacatcttctggtgatttagtcgtgttattcgtgaccaataaaaaatcagtctgactagcctgtagtcgttcaataaaccgtttagcagcaggaatacgttcccgaccacgataaactgttccatctaaatcaattaaataacccttgtacttacccaatcaaaatacctctctctgttcctacttttgtcgaatcgtaaagtggcgtttaccactactctgcttcgttgtttgcgcttgcttaccattaccggccgtaactttcgccggttgccgccgcttttcagtaaacggtgcggccttctgcttagtggtgaagctatgagacttccgccgttgtttgctgcgactactgttacggttactccgcgctcgggattgccgactattagtgtttttctttccccgccgatcatccttacgtgagcgactggtacgcttaggtttaatgacccgttcgtttttaatgataaaataggcgcaaccaaaattacaatattcgtacagatagtcttggaccgccccaatcgtctgtgagcgctggacatctttcatatcatcacggaaaaaaccttttaaccgtaactgttcaaaaccccaatcaccgacaatataatcatatttatttaaaattgagctgtagcgctcaacgaacttgtcgaggtcaaacccttggcgataatcgtacacgatttcaaacgggtgcttgctaacttcaaagtgggtcttatcagttcgtaatccatgatacaaattgcgccgccgttccgcttgttgttcagctagttcatcaatatgttcgcgattcacattgacaccacctttctcttatttaaccggccatcgacgcattaagtaatcgccaacgaccgttcttaacatggcttcaaataatatctcagttcgaccactgatattaatggtcgggaaaaacggaatgaataaatcatgatctaataacgcaatctggtacgtttgttgccgattgaccggctgaccattcactagtaatgtatgctgtcccgttttccacgtgaggccctggtactggatataaccaaagacttgaccacgaaatcccattcctttaatcggaaatttgttcaaaaacgggcgaactaactccatctcatagactaagcgccacaatgcttcaccacttaacgtcactcgaataacatgcatcgcgtgaggtagcatggtatgtaaatcatttcggttgaccatgcctgcgggaagatcccgcatgaacaggccaccgttcaacatacctagatcagttttggcatagtccgtaatggccgctagcccgagggccgtcaaatcacttgcatggtgccaatgtggccgcagctgcgtcggcaccttcgcaacaacttgccgcgtgagtaacgtttcaccctgttgctcccagccagtaatcaacgtttcatcaccggccacaattggtaagctggccgtggcaacagtatgcgccgcggccgctttaacgtgatgttgatgatcaatcgtcagttcaattcgcccaatatactcaccgtattttccagctgccgctatcaggaccccatttttcagttcaccgttcaccagtaaatgatgcgtatgactgccaataacaacatcgatcaccggaaactgttttgctaaccaccgatcgacattgataccaaggtgggacatcacgattaagacatcatattgccctgcatattgtcgtaacaactctgggaatcgcgtcttaacactggccggcgtccaaccgttcaacgggtaagtcaacgtaaacggtgccgtaaatgccagcaacaagactcgtgtcccccgtgcagttgtaatgattttagctggtaatgcccactgcggcggtcgttgcgttgcagtatctgtcaaattatcgagaacaacatcaaagttggcgcggtcatacaaccggtttaaggccgcgtgcgttaaacccagtccttcattattgccaatcgtgaccgcatcatagccaatcgcgttcaataacgccacgttggcctgcccttgagtggcttctgagagtggatgggcacgatcaaccgcgtcgccgaggtcaaccgtgatcacatggcttccagattgccggcgctgctcacgttcggttaataaataccgttgaatacgtggccagttttcaaaatgcgaatgaatatcattggtatgcagaatcgtgacttgctcgtccacggtcaatcgcccctcaatcgttgtctttgttaatcctaaagcattcaccaaagtcggtcaagcactcgcttactggcgcttggcaaaatcaatggctttaccgtcaaccatctgctcgatctcggccagtgaaaatggcgttccaaagggcaccggatggtctaagtaatcgacttctggtgtatcgacacccacgttgatgttctccttgacgttgacggcataatgatgaatatgcccgtgcaaattgataatttgtttgacgatccccatcatcattgggtagtgcgttatatagtattggcggtggtcgtacttaatcagtacccccacgtcgtgaaactcaaacttcggttgaccattcaactgtggatcatgagcagccaaatacttaaagaaggcccgtgaatcatggtttccctttataaaaatgattttgccatttaactgtgctaagagtgcaaaaacccgctcataagacaatttcgctggtcgcgtaaaatacagcgcaacatcgcctaaatgatagactgtatcctgatccgtcacacgggcattccaatggtcaacaatcgcttggttcattgtctctacatctggaaatagccggggcgcaaagtcgttgtcccccaacaaatcagcatgataaaaatgtgtgtcggacgtaaaatattgcatcgttcaaacctcttattcgtatatttacatttgtaacatcaatcggatgtgtcatgtctagcgaatttcatgacttttgcttgaaaagctgacttatccgttcgtcagcatatacccatgtcagtcattcgaatcctattacgactgtcagtcatcatatggcacactaactcggcaagtttatactaaacaaaccgtttccaccgagtcaaagctgacagttttggcacttactgaacagcacgtattaatcatgaaccattttaaagaacacctgacacaacgcgttagtcatttatcattgtaccgcgcaccgttctaaaagacactagaacagttttaagtttattgctttgtcagcactggaaccatgttttatgaccaacccatattcacaaatctagctaatatcgtcaaaaagtgcacttaactgcaatcggcagagttaagtgcacttcataaatcccattagttaacctacttgatagccaatcagcactcctggttattgctgactagtcgtgtgtccgttgacgaattcggtcactaacgatcttgacaatgtataagccaaccacccagaccgctgacacgagtaacgcgattaacgtttcaaacttcagacagagaacaacagcgataaaagctaagaacactagaatgaagtaatcagataacggaaacagtggcatctggaatttcactttagcctgactgcccgcttgacgtcgatacttgatatgtgcgacgacgattgcgccccaaataaagataaaacaagtagtcgatacactcgcaatcagcgagaagactttcccaggcatcagtaagtttagaattactgacaacccaatcaccagcgtcgagaaccataacgcattgcggggaacttggcgggtcgatagtgtccccattcgtttggcaaacttgcttttgccatcatacgttagtgagaataacatccgcccggtactgaataacgcactattacaactagaagcggccgccgtgagcactacgaagttgataatcgcagccgctgaacgaattcccaaattggtgaatacttgtacgaacgggctgtgtgccgatgaaaagtattgccacgggtacatacacattagaaagaatagtgacccaacataaaacagaatgatccgcacgggaatatcattgattgctttgggaatcaccgtcttcggatcagccgtctcagaagctgtcatgccgaccatctcgatcccaataaaactgaacaggaccatctggaaggaaagcactaagcctttgattccgtgtggcataaaaccgccataactaaccaaattggttaagctggcgtggcccacaggggtcttaacgctaaacaagaccataccaatcccaacagcaattaatgccaagatagcagcgatcttaataatcgcaaaccaaaattcagtttcaccgaacgctgagacattaatagaattcaagcccagcaataaaatcaagataatcagccccggaagccattgcggtaacttaggccaccaaaactgcatatactcaccagcagcagtaatttcggccatcgcaatcgtgatccagcaaacccaatacgtccatccagccacaaagccggtcttatcacctaagtattgcttaataaaatcaatataagaatgcgtatgaaggtcagataacagtagttcacctaacgcccgcattaataaaaagcacactaaaccggtcactaagtatgcgatcaggatcgctggccccgccaagtggatagattgaccggcccctaagaacagtccagtcccaatcgtgccgccgatggcaattaattgaacatggcggctttttaagcctcgcgagagttgttccgtcgcaggctgtgaattttctttcgtcattatctttgcactccccttgaaattattatagcggccaaattcctagcattcaaaaggccacgcttaagaaaatcacacgattggactataccattgttcgctaacgaaattcatcttatgtacgcgtaagcgtttgctaacttgcatggctgggattcagctttgttagttgactaaaccagtgaacgctcccgctacgtgaataaagtgaaggcaacgcatactaacatgaataactttcacttcagcatctaaaaaagcacccggattttcatccgcgtgcctctttacaaccttaatcatattgaaacgatgctgatcactgattctgagccacgcgctcaacatcgcgggcaatcataagttcttcatcagtaggaatgagtaacgtccgaatcttcgcatcggtcgtactcaggtcccgttcgacaccactgacttgattcttagtcgggtcaatcgcgacgccaaagtaggtcaaccgatccgcgattcgttgtcgcatccgtgcatcccgttcaccgataccagccgttatcactaatgcatccgcaccttgtagctcagccaaataagcaccgacatacttaacgatccgattgacaaaaatatcaatagctaactgagcctgtgagtcctcatcataacgtgcctcgagctcctgcatatctgcagaaccagctagccccagtaagcctgactgcgtattcaaaatcgttaacatttcatcaggatcgctaatattaagctttttcatgagataagcaaccagcgacggatccacatcgcccgagcgcgttgccattgtaataccagctaacggcgtaaatcccatcgaggtatctagtgactgtccatgatcaatcgccgtaatcgaacttcccgcacctaaatgcaacgtaatcagcttcaacgtttcgagcggtcggcccaataatttagctgctcgcaccgcgacgtagcgatggctcgttccatgagcgccaaacttgcgagcaccatatcgttgatagtaatcatacggtaacgagtatagatagttaaccgccggcatacttgcatgaaacgccgtatcaaagacagcgaccgcgggcacatgtggtagtacccgcttgaaagcacgaataccgaccgcattagccggattatgcaatggcgcatattcggccagatccgtaatctgcttaagcacttggtcagtgattaaaactgaatcatggaattgctcgccaccggcaacgacccggtgaccgaccccagtaatttcatcatatgagtcaataattcgcaatttaattaactcatccaaaacgatattcacggcagccaaatggtccgcgactacggctttctcttggtaatgatgatcaacgccatagcgaatattgaccggtgaagttttgaatccaattcgttcaacagcgccctgtgcaatcacccgttcctgtggcatttcaaataacttaaatttcaacgtcgaactaccagcgttgatggcaatggtcttccccaaacgacacactcctagcgaataatattctggtcgacccacgcatcaatttgagcggtaaacgcttgaaaggcacgttgatcctcaaatgatggaaagtcgcctagtaatactttacctgcttggtgggcccgttgtccatgtttctgtaaaacaacaattgattttcgtgatttttcatcaagaaaaaggttagtcggcaagttcaacagaccttggaggtaagccgcagtgctcatccattttaacagtccttgagactcttgcgactgaaaaatcgtcgttggaacaaggaaaacaccccagccgcccggtaacaaatgagccatcgcttgctccatcatcaaatgatgaatgtaagaatgaccattcgtcgctttcgtttgaaaaccttggacacggtcatccaatgggtagtaccccactggcaaatcaccaattacaacggtcgttttcggcatgaccagggaatcaattgcgtcttgatgaaacaactccactgctgatcgttggagatccatgctcatcgcggcgattgccaactgattatcatcattatcgactccgtaaccctgaatcggacgtggccggtccgtctgcaactgatttatgaccgtagttaataagttaccagtcccgacagcaatatccaaaattgacaaatcagtcgtcgatccaactaacttagcaatcaagtatgccgttaacagtccaatcgaatctggtgtcatttgatggtttggatcaacgtgatcattatgaatcgcctttagtaaggccaactgaagcgcacgccgaattgtttcggcgtccaattgttttaagtcgatcgtttgatagagctttgttaaagctgccgtctgttccggatttggcttgccatcctcaacatgtacagattggcttaataaattatcgccagtctcaatgagcgcatccacgtaagaaacggatagttgttgcatcaaaacttgaactgattgatctaagacctgaaaaagcgtctcggtttctgcttgtgccagaatactcaccctcccgcaaaatctgtaatccttaaccatattactgattttacgcgttaagttcaagtcacggggttcactcaccaatcaagggagcgaattatgctgataagggtgctcataggattgtaaaatcaagcgatataacgtctggcgagactgaaaattaacgtatcgttgggtttcaaacgccccaccaattaacaataagctaatcaccgaaagcaggatcgttccgcgtcgcttcctcatctaccattgtcctccgatctggtaacagtaattgggcttgaaaatgaatccccttatcagtcgtcatcgtcagggtcaaatcatcggccacgtgaaattgccgaacgccctgcatcagattgatttcaccaccaccatagtggcgcaatccgattcgatgtaggatatgataataagtcaataaatactgtttgccggtgaccgtattaaccaaatgaacggcttttcccggcgtcagaccaccctcatcggaaatatggtccaccacaaaatggtgatccggattttcaagctcgtgaagcatcaaataccaatccactgttggcaaatccacttgggtgcgccgggccaaattgcgctgcccctgaaaaagtgtcgtcagcactacggccacgattgctaacgacacaacggcttcaattaacgtaaaaccgcgccgcctaatcatgtgcttgctccggtatcctggataatagctgctgacgttgccggtcttcatattgttttctggctgtctgaatcgcctgcaaggtctggcgttcatgtgactgcatcataatctctaaactttcaaacccaatcaaaccacccatcaatagccccagagcagtaatcgtttcaatcatcaaaaaacccattcgcgtctttaacatgtgtgactttataggccccccaccccatcaaagcattcagtttgattttctgcttcggctgtaattgcgacttgaaaataaccactgctagctgtggatgcccatttttctggatttgaatatcacgaccgcgctctgtttttaatgttgcaggcagtgggagatgccactgtgggccactgataggccgcccccgcttgccaccccaagtcacgacttccgtgccacgaaagctcacgacctggggctgacccgtcacactagcggttaaggtctgttgctgccacatcgtttgtaactcccgccagaaagcctgttccgcattctgttggcgttgccgtgtgggaaaacggtgcacagcaatcaccgccacactagccacgatcgccaagaccgctaccgtttcgattaaggtaaatccctgtcgcttaaccaccaactactttttgtggttgcggccgtaccggactaatgccctgtgacttagcctgcttatattgaccatcgttaatatatcccttgttccgaagttcttctaacattgcgtcgtcatccgtgacggtcttacccgtatcattcgcatacatttcagcctgattttgaacaacttcagtcagggcttcttgttggcgaccagccgcctgtttacgttgttgattcaaattgggcaccacgatcaacatcaagagactgatgatcgccaatacgatcaccatttcaattaaggtaaaaccgcgctgtggtgctgccgtttttttcatcaagcgtttcattaataatgtcattttaaaatctcccccattgattgatacatcggtaataacaaactcaagtatgtgccgacaacgacgagtgcaataatgccaaacatgatgggttgaatccaaccaatcatccggttcaactgtcgaatcaagcgttcgtactgcaaagttgcaaagtatagtaattcctgacttaactgttctgccggactctctttgccgaccagtagtgctaactcatcaggtaataatcggtcctcctggataattgtgactaacgaagtcccagtcagtaacgcctgttcgataacctgcccttgctgataaatcagcgccttagtttgaaagtgctgactgacttcacaaatgccacgaatccctaaaccaccagtcagcagcatacccgcattaaggcttaaatagtaaccacagtagtttctgatcaggggaccaatcaaggggacttgagccaaccactgatagcgccgccgaatgggtaatcggctaacttgaaggccaaccagcaataagcaaatcaccaaggtaatgaccgtgataccgctaaaccattgccaattcgcgattgtcccactaccattaccaccatgagcaagactcggtaaaatcgcagctttgaccgtgcctaaagttcccagcagtagaattaacagcagacaagggtactgtaacaaccgccgaatttggcgtccctgttcagcacgcgctcgcattaattgacctgcctgcatcaaggtccggcgtaattcaccatgagtctcagcaattaagaactggtaatacaagtccaccgcaatgtatggacgcagcgccatagacaaatcatcacccgcagctaaacgccccagcgcgggctgcaaggattgaaaggccggtccttctacatccaatgtaaattgaaaggcttgctgaaacgagaagccgttgcctagcaagtcggctagcgtttcaaacagcttcgcctgcatagcaatcggaagccgtttacgcttccttaagttgattggccgtcgcatgatcgagacggcccgctgccaattgttcatcaattaactccgcccacctttcagtcatcatttgcgacgttttgggccttgcatgcggtaacacgaccgtatcgaaaatcgtcgccacgctgccatccgtcactggtacgaggcgctgataggacattgcagttaaagcctgctccaaaacagcggcttccactcccaattgcgtcaaccggggaataatcccgtagacaccgcgcgcatgaatagtacttaaaactaagtgaccacttagcgctgcctgtaccgcaatccgagccgtttcggcatcacgaatctcaccaataataaagacgtcgggatggtggcgtaacccaaccttcagtaagtcgccatacgccatctgggccggcgtgtttacttgtagttgtaaaaattgtggttcataaatttcaaccggatcttcgatcgtcatgactagccgttggccacgaagctgccgcacaagatcatacatcgtggaagttttgccagaacccatcggcccggaaaataagatcaatcccgttcgtcgcattaattgactcaattgttgccgttgctgtgggaccaaatagctcaattttcgggccggaccttcatacaataaccggacaaccaacgactcacggtccaaaaagtcgccaactgccgagattcgcaaatttaaagtttgctctgccaatgttaacgtcatcgcccctaattggggccgccgatgatcactaatcgccatgttactacggtatttgatgtgattcatcaattgctgggccaactcagttgtaatctgagtaagtgcccgcaaactgcctgctgcttgcactaacacctgatacccttctgccgtgggtaaccaataaatatcactggcccgctgattcacggctgcctgaatgatttcgttcaactctgcttcaatcaccatttatcatggtcacgctcctttcaatcattagtttcgtaacaacgaccactttccacgaaaaaaatgacatttattttggcatcaaaaaagctgttccagaaataacaaattatttccagaacagctcgtcatcgcatattttcatttgcaatcctaacatacggcgttataagcgccccgatataaaccaattaaggcgttaggcccgctcagccgcttcaatggcttccttagttggaatcgatggttgcgcacccaatttttgaacagctatcgaagatgcccggttggcaaaccgtaccgcagcggccaaattactaaagtctggcattaagaccgaactgagtgcaccaataaaggtgtccccagctgcagtcgtgtcaacggcctcaaccttataagctgggacgaagccgtgctcagcaccgcgcatccagaaagcgcctttactcccaacggtaatgatcacgttagcaacgcccagcgcctgcaacttctgtgcaccctgaatcatcgattgctcatcagtaatgtgcacgccagtcaaggtttccgtctcagtttcgttaggaacaattaagtcggtcgtcgctagtaattctgcgggcaccgtcgtcgtagctggtgccgggtttaaaatcgttttttgcccagcggcctgagccaattcaaaccctcgaatcgttgctgcaatcggcgtttcaaactgtgcaatcaaaaaagtactagcgctaattgcgggttgggcccgttcgacatcttcggccgtaacctgctgattagttccaccatcgattaagatacggttctcactactactatctaacaagatgaaagctgagccggtactagccacattgctatgttgaacatattggtcattaacaccactattcgtcaactgctgcaccataaaggccccttcctgatcagtaccaactttaccgataaaagtcgtttgggcaccagcgcgcgcggctgcgatggcttggttagcccctttacccccaccagcgacactcttaccagtcagcggtagcgtttcaccaggcttaggaaaacgcttgaaacgcaaaatcgaatcaacattcaaactacctagtacggttactttattcatgattattcgtcccttcagtattcaactgctctaattttagcaaactggcctgttcgacgcacttgttttactaatattttaagcaataaaaaacgtggttcttgatttatcatcaaagaaccacgtcttttcatcattaatctgggtagttagcagcttcgtatacttctgatacgtcgtcgttatcttccaattcatcaatcatgtgttgtaacttttccactttatcagcaggaacgtccgttaggttttcaggaatcatggttaattcagctgtttccaacttgtaaccattagcttcgagggcatcacgaacggcagctaattgtttaggatcagtgtaaatttcaaacgcttcgtcgcttgattgtaaatcgtcgccaccagcatctaaaacgtccatcaacatcgtatcttcgtcggtatctaaatcttcgcgactgatcacgatgtaacccttacgatcaaacatgtaactaaccgcaccagttgcggctaaagccccaccatgatgcgtgaacgctgaacgaaccgccgcagcagtccggtttttgttatcagttaatgcgtgaaccagaacggcgataccaccagggccgtagccttcgtaagtaacttcttcgtagttctccgcaccggagccactacctttatcaaccgcccgtttaatattgtctttaggcatgttggcagctttggccttatccataactaaccgcaattgcgcgttagaatctggatcaggacccccggcttttacagccatataaagttcacgggaaatcttttgaaagactttcccacgtttagcatcttgggcgttcttacgtccttgaatgttatgccattttgaatgtcctgacatgtgtgactccttctttcatatttattttcagtttagtagataaacatacgtaaagtatgatagcaaaaaaagcgagcgatttcaagcactagaaccaagggcgtccaagttctgcgatttttattgcaaatctaatgaaccagtttcgttattggactctctttcagatttgaaatttcagtttgctaatgacaaccacaaccacgacaaactggtgttatggccgtaaatatgcgtaacccacagcttgcaagtccacgattcgcaccacaccagcgggaacgaccgtcacactggcaggaagttgggccgcagtcatttgatgactcaccatggcattatggcaagcatcaatctcaacttgcggtaacgtctgttgtaatggcttccaggcaccagttaccagcgtcgtgatagcgggcccgttgaccacaaccaccaccgtactagttggccgggctgccaaaaaattctgcacattgcttatggccgttgcgaccttagccggctcgtcgacatggactactaagttagtcattcgcttgtcctccctcgatcgaccgcagttcgagtgcgcgtagatagtgatagctactcaacatgttagcgcaggtcgcatccgtttcatccggcacttcataaatcatggtagcgtgcgggttgaggactggtaacacccgctgccagtcaatcagtccctgccctaaaggtaaactatcgtgccgcgtccccatcgaatcaaccaaatgataatgttgaatgagtggagccagccgcttcaaagccaacatggtcaattccatatcaccgtgcagcgcaatgaagacgtggctcaaatcacaaaccagcggataatgatgctgaatgatacgctcatctaactggggatcaccatacataaaacttgccgttaccccattttcaatcacgacatgtccactcgcctgacaaaccaaattatccaaccgctcaaagaccacgtcacgtgcaacctgcaaggactcatactcatcgatcaagcgcccactgtcgctaccatagccaccgtgtacgagcaccttgacatccaattccgtcgccaacgcaagtaactgggccgtactcgtttgtaggaattggtacgccgcagcttcacgatgtggatcaagcaattgatcaagatgaacgccttgataactcatagggtgatgaatcacaatttgctcggtgacagttgtctttacaaattggacagctgttttaagtgtctgaaatgcttccggttcaaagtccgtggcactcgtaaaaaattcaaatacttcgggccggtattacaaacgatccattaattgtgcgggtgcttgggacgccttcaagcctaacttaatttttccgggccgtggccgcattattagttgtgtcatccgtttaactcatcctttcacgcattccaaaaccaaaaaaggcttggaataaatattccaaacctagtataacgctatcgttctaaattatgccaacgtcactagctggcagacaaccgaacttaatcagcagacttggttgagccccgccgaacaatgccgtatggcaaggtgaccgtcttctcgtcaagttctttatcgttcatcaacttagttaacatccgcatggcaaccgcaccaatatcatataatggttgggtaatcgaggtaatggctggacgcgtgatttgggtaataatcgtatcattactcgtcacaacttccaagtcatctggaacgttgatcccggattccatacttgcgttgataagaccagccgccatttcgtcgtccccaacgaataccgcagtagcgccactatccgcaatgactggttgtaacttccgcccagcatcatatgagtagcccgcttcataaacgagggcgtcgtcaaacggaatcttagccttggttaaggcccgtttgtaacccgtcagtcggtattcagcgttgattgattgtgacaatgagcctaaagccaacgcgatcttcttgtgaccacgtgcaattaagttagtgaccacttcttcaacagctgcagcgtagtcgatattaacgcttggcgtttcattgttcggatcaaccgtcccagctaaaacaactggtgccttggcccgtttgaattcagcccggagcttgtcatcaatatggttacccataaagatgaccccgtcaacttgcttagccatcaacgtattcaacacgttgacttcttgttcacccgcatcatcggagttcgttaaaatgatattgtacttgtacatcatcgcaatatcatcaatcccgcgtgctaacgccgcaaaataaatgttggtcacgtccgggatgattaccccgaccgtagttgaacgcttacttgctaaccctcgtgcaactgcgttaggccggtaatctaaccgttcaatgacagctagtacctttttacgcgttgcgggtttaacgttgggattaccattgacgactcgtgaaactgtggccattgaaaccgccgcttcgcgtgccacatcataaattgttactgtttgtttttccatataaaaatagccctttcttgcttggtatcatatgttttcatccgttttcatgcaacatcaaccaatatagcaaaattacgcttccaatgcaacttaagattgttattgaaatcgctttcatgaaaataataccgtacttgttttcaaaatgcaagatttaccacacgaagattgttattttgggctcattattctcagctttttatcatcaacagcgctatactagtattattatctattattttatctaaggagtgtttgaattgacagattatacgaaactgcaacaagtccgtcaatggacccaagacaatcacgttgacgtgacctacatcagtaactttcacacaatttcatatttgactggttttgagagcaacccctacgaacggacgctagcactgtttgttttcgcggatgcggaaccatttctctttgcacccgctctcgaagttgaagcaatcaaggagatgggctggccttacaaagttttcggctacctcgaccatgaagatccatacgcgctaattgctgatcacattcacgcacaattgactgatcctaaagtttgggcccttgaaactgggaacttgacgttagaccgctttaccgcgctcaaacagcaatttccagctgcccacttcgataaggatctatcaccttatattcagcaattacggctggtcaaaacagctgatgaacttgaaaaactaaacattgccggtaaatgggccgactttgcttttgaacaaggatttgctgctgtcaaggcgggtcgcaccgaacaacagattgctgccgaattacagtatgccttaatgaaaaagggaattatggaaatgagtttcgacactttagtccaagctggtgaacatgccgccaacccccatggtgcaactaacgaagcccaagtcaagccaaatgaattagtgctattcgacctcggcgtcatgtatgaaggctatgcttctgatgcttcccggacaattgcttatggccaaccgagtgccaagcaaaaggaaatctttgacgtctgtctggaagccaacttgactgctcaagcggccattaaaccaggcatggcagccgaagatgtcgataaaatcgcacgcgatatcatcaccaaagcgggctatggcgaatacttcattcaccggttaggtcacggaatcggccaaactgaccacgaatttccttcgattatggctggtaaccacatgccactcgttgaaggcatgtgcttctcagtagaacctgggatctacattcccggcgtagctggtgttcgaatcgaagactgtggggtcgttactaaggaaggctttaagccatttacccatacgccaaaagaattaaaagtattagatctttaattaaaaacgtcaagagggccgtcacgacataatccgtgacggccctctttttttacctagcgttgactggtacttgcttttagtgttattccggtagcggatgttcggtttcataatcagccacttcggctaacagtgccgccgtcgttttcaatggcagcacgtcacagtcaaccgcggcttcactccccgcctgactcgcacgccgataaacatcaatcttatgattgactttttgcaaattcaacaaggattgatggatttgcgcttcaacagcctggcgttgctcttcaaacattgctagccgttgatcaatcgttccatccccatcggcacaccaactaataaattgtcgaatatcctctaacggcatcccggtctgcttaagacaacgaatcaatgccagtgaatccaagtcttcatcattgaagacccggcggccctgcttatcacgcttcacaaagggcgttaagcccgccttatcataatagcgcagtgtataacttgaaataccggtctttttggcgaccgctccgattgaatacaatgtgattcctcctcaaaagcagataggacaccgagcacttgctcagtgtcctatcttatcgctgtcagcttacttggctggtgacgattcatccgttgtcgattcatcatcagacttcgcaggtgttgcgtccttagcaggtgctgattctggtacgggcgctgaagtcttctcgtcctcgccagctttttgataagcagctccaccatcaatgacgatatcttcatcatcaccttcatcatcttcgaccttagctaattcagaccgtaaactatccgtagcttggtcaagacttgagccaaagctttcacccgtttcctgcttagcggcttgatactggtcagcaaaatcggccacttttcgctttgtatcttcaaattgttgcccagcttcagccttgaagtcttcagcagcatcgttggcatagaacgcatagtcgattgcccgatccttaaaatcggcaattccttgctgtgctttagctttcaattcagcctttttatcatcatccatcttcataacggcggtagcaatcgctgcaccacctaaaacaacacctaataagaatccctttttcgacataattaagactcctcactattattttttgaacgtcgattacgatagacatcaaaagcggctttgccgaccttgcttgcgctggagaacttgctccgcttctcattgttcttgccaatcttggctgttaagtctcgagtcgcagcatttaagtcagagacgctctgacctaagtcgcccatcgcttgaaacgctggatcaattgttgcaactttgccgttaacatcctttaagagttcattggcatttgccatgattttttcagtctcatgtgacaaggcgtcaacatcatccgtaatattatttaaactacggttgacttcccccatcgttttagtaatccgcattaaaaaaatcccgataaagcatactaataataagaacgcaatggcggcaatgatgcccgcaatgtgtgtaatcatcctaaaattcctccttcaacagccatgatattaaaactagcatagcattgtctttagtataccgcaattaaaaaagtgcttacaacattcacccagtcacatttggtcgcaataacttgatcacggcttggttgcccgcgtcaaatctgataaactagtgaacagacaacaataacgagggtgaagatatgtttaattcaattaacctagcagcggttgacacaccgactaaacaagtttcggtgtggatgaagttggctaagaaaattgactggcaacaaattattattaatattggcggcaagctactcgaaatcattttatttattttactattttgggtgattgatcggctaggaaaacgcctgatccaccacttatttttaacgaatgctaataccagtgatactgccaataatcggatttcaacgatttttacattatcattaaatatctaccattacgtcatcatgttttttggcatctatgcggtactttcagtgttaggtgttcccgtggggacgttgattgctagtgctgggattttcagtgtggcgttaggtttaggcgcccaaggcttcgtcagtgacattgtcaccgggttcttcattctacttgaagatcagattgatgttggggattacgtcaaaatcgaaaccattgaggggaccgtctccgcaatcggtttacggacaactcaagttacgagtcccgatggcacgttgaactttattcccaatcgcaagattttaatcattagcaaccagtcgcgtaacgatatgcgcgtgctgattgacctctacattctcacaacgactcccgttcaagatctgactaacgtggtccgcgaaactaatgccgacctcgtgcctcagtatcctgatatcatcggtgagcccgacattcaaggcgtcacgacacaagccgatgggacgttggtcttccgagtacaattttacgtcaaaaatggcatgcagttcgcaattcagcgcgactttttggccgcctacttgaacgcggcccgagcagcgggaattcaactcccctcgccacgtttaaatatcgccccaacgcacaagtaagctcaaccaacacaagcccgcacagcggttgctcagaaatgagcgccacggtgcgggcttgatctttcatctgacaaatttcttcaggtgggaaccatgacgcacgttgttattgtcaggaatagttttagttattcccattcgcaacctaacgtgaccaggcgaaaactattgtgcggtcacaaccaaccattaattgcaacaacgctcggcattcttgaaactcaaaaacgtactgacacgtgttagcgcagtacgttttgtaatttatttgtgtaacgcattccgatgagtcaaaaagctggtcatcgcattgaccccactcataatggcagccgtgtgcggcaccatgttttccgagtgcaacgaatatggactgtcgacccctaaccagaacattgtccctggaatctgatgaatcaaataaccaaagtcttccccagtcattgctggttccgtttcaataaagttgacatcatcatcctcctgcatgtacttgataaaatcagcagtgattgcgtcattgttctcaacgggataataaccaccttgattgagcttcaaatcgatattgcagtcataggcgagcgcaatcccctcagtaatcgtccgaacccgccgctgaatatgcatgttcatctcctgcgtcaacgctcggatcgtcccgtcaatctgggcctcaccggcaatcacattgccaatcgtgccagcagtaaagtgacctaatgtcaccacaccactttgaatcgggtccacgttgcgcgctacaatcgtctgcagctgggagactaacgccgcaccagcgacgaccatgtcgtttgcttgatgtgggtaagccgcgtgtccacttttaccacttaagtgtgcgtggatctcacaagttcccgcaaataacgtgcccatccggcaaccgatcgctccagttggtaaattaggattgtcatggaatgcaaaaatctcatctggcatccaatcaccatctagcgcaccactttcgtacaagcgttgcccacccgaggcattttcctcagccggctggaacatgaaaaccatgtcggtcgcaggtcggttctctgcaaagtagcttaggattcctagcgcgactgacatatgaatatcatggccacacgcgtgcatgacacctggatgggtcgatgcaaatggtaagcccgtattttcagtaactggtaacgcatcgatgtcagttcgataaccgattcgataatcatgctttaaaccactgactttcactaaaatcgccgtatccaaagtaggaatggttttgattgtcagccactcttgaggcatcttaccaataatcgacaataaataagcctgtgtttcatgttcttgtaagccgatttccggaatttggtgtaagtgttgataaattggaattagatcggtttcccgtaagaccattgtttatccctccaccattaaagattccgtaattctgccattaattcagtcttgctcttagtcttatcatcaatatctttcaacttacgagcaggaaccccaccgactacggtgttaggagcgacgtcttcaatgacgatcgcacccgcagccacaacggcacccttaccaacatgcacgccttcaagtacggccgcattggcaccgatcagcacgtcgtcatcgatttgaactggtttagccgaaggtggctctaccacgccagctaacacagtaccagcgccaatatgacagttcttaccaacaattgcgcgaccaccaagaatggcacccatgtcaatcatcgagccttcaccgatttcggcaccaatgttgatcaccgcacccatcatgataacggcattatcaccaatcaatacttggtcacgaataatcgcaccgggttcgatccgcgcattgtattgcttcaaatctgccattggtacggctgaattgcgcgcgtcattttctaattcataatcttcgatatttgcagcgttagcctttaagaacggttcaacatccgcccagtcaccgaataataccccagcgttgccactgaagaaagttttgatgcctgctggaacgtttaattggtctaaagcacccttcacgtatacttttacgggtgttttctttttcgcactgccaatgtagttaataattgattgtgcatctaattttgccatcggagaccctccaaaaatttatttagctttttcactagtggaaaaatccttctcaatcatatcatattgtttgccgatttcatgggtcagaaagttaaaactcttcatgaattcacgacgagtgacaattccttgaaaaatttgctgttcatcaacgactggaacaaacggattatcaatcatcaagtgtaacgtctcttcaacgtcatccacatcatgaaccgtcttaacttgtgtctccattacgtcacagacacgtttttgcagtaatatttcagtattcagttgatcaaaacctaacatttgttcagtaatcagtggcaacgatactaaaccttcaaagtgaccaccatgatcaagtactggaattttggaatacttgaccttcgttagtactaaaaacgcgtgatacaaattattatcagtttgaacgttggcaaccacgtccgccggaatcaaataatggtcggcgttacgtgacaataagtcctcaactggttgaattaacatacagcgcctccttcactaagcccatccctttattttaaccgcaaaagcactttgcacagccctaaaaatcagtttttttaccacattttaatcagcaaaatgaaattttagttctggcaccgcttgtagttgccgatcataatattggacgtcgatacctgcggctgacgttgtcacgatggcgtaggtgccaccgatacgtgcaaattcaccacgcggataagtaatactaccaggattaagcacgaccacgccgcctcgtcgttcaacacccagttgatgcgtgtgaccaaagaaagccagcttcgcattgtgcacctcagcattagctaatagatggtccaatcccatgttcacaccgactaagtgaccgtgcgtcatgtagactgtcacctcatcaatagttggattcacttcatttggaatcacggcatcgaaatccatatttccttgaaccgtgaacatctcttgaaaaaccgcgtcatcatgcggtaattcagaatcaccacagtgaaaaaaggcgtcgacctgaccgcggtacttatcaagcaatcgaactaacacgtcacgatcgccatggctatcactcactactaaacatttcatgctttcgcccaccattcatcgaatttagtcatcagttgtcgcaaggctgcaccccgatgactgatttgatttttttgtgctggcgtcaattccgccaaggatttttgaaacttacttgaccaaaataacggatcataaccaaacccattgtcaccacggggggcaatcagaatacggccggctaactcaccgttaacgacaagtttctcaccactgggtttaagggcaaccagggtcgtatgaaaagtcgcggtccgctccgcttcaggaacgccaccaaggttggctaacaacttggcattattcgcagcatcatcatgatcaccagcataccgtgccgagaacactcccggatcgccgtgcaacgccttgaccatcaagccggaatcatccgcaattgccggtaatccggttgcttcgaccacaaccgtcgcctttttagtggcattttcttcaaacgtgataccgttctccttaatttcaggaatatttggaaaatcagccaacgttttgatagtaatatcatacggtgccaacatcgcgctaaactcgcgcgccttattggcattgttagtcgcaatgatcaatgtttgtggtttagtcattcgcttcactccctaaatcaatatgttgtgcgtgaaagtccggttggcccaaccagttccgcgcgattgcttcgaattgatcagccgcccccgtcgtgtagtactcatccggataacgcttagtagaacgatcgttagcaatatccaagtaatcgagtaccgccgagacatcgttcaccgtttcggcaccagaatcaatcaaggtcaccccaggccccatcacattttgaataagtggccgcaataatggatagtgtgtgcagcccaaaacaagcgtatcaacgtcttgtttttttagttgtttcaacgtttccgcaaccacccgcttggcaaccgttgattgatactcattcgattcaaccaacggcacaaactttgggcacgcctgcgaaacgaccgtcgcagtaggatctttggttaagatagcatctcgataagcattactacgaatcgtcccctcagtcgcaatcacaccgattcgattacgatgagaagcttttaacgcagcccgcgaaccaggcgcaatcaccccaataacgggaattgacaactgctgccgcaacgccggcaatgccgctgcggtcgcagtattacaagctatcacgagcattttgatctgctttgctattaagaaatccgccatctgaaaagaaaaagttcgcacttgttcagctggtcgcggaccgtatggcaaacgtgcctgatcaccaataaaataaactgtttcgcgcgggagttgtttcaaagcttgcttgacgacagtcaacccgccaacccccgaatccatgaagccaattgcatgttcatttgccattttaaaatctccgttcactgaattctgaaactttattatggtcttttttgaaattgatttcaagccagaccaattgcgacgaaattgtaaagtttccgttgataaattgaaaaaaaccgacacattagtggaaacggggtataataatgattatacagtggctagagtaccacgattttttgcatggaaaggaattatcatgacgaacgacttttattctcaatttgcgggcaactcgatcaaagcttccatcctcagtgtggaaatcttgcgagatgccttaataccaaagttattgggtgatgacagtagtggcatcctttactgggcgggtaaagacttggcacgccagtttcctgtcgctagtgatgatgatcttgttacctttttcgagcaaaccggctggggtcaccttgtcgtgattacaacgacggatgatctaatcacgtatgaattgactggtgagccggtcgctcggcgtagcgccacgatcaaatcaccagactttatgcttgaaactggctttctagctgagcagtcagcgctccgcaccaactgtgtgagtgaagctaaaattacgttccaaaatcgcatgcgactgcgcatctcagttacgattgatcacaatcaaccaatcgtcaatcacgatcccgcaacaccaatcgaaatcgtgcggcctcaagttgaacttgatgacgaacaacctgaagaagcacagtaaaaaggacggccacgtggtcgcccttttttgcaacgttaaatagttttccttatatagtcattattaacggttgtccccggtcttaaaaaagagcgcaaaaaaacgcgccgttcacttaagaaggcgcgttcgctagcgaaccattaatgaaataatggcccagcttattatagatattgagctaaagtttgttggatctgttccttggaatggtagccaactaaggtatcaaccacttcgccatccttcttaactaataaggttggaatgctcatgataccaaagttgctggccgtttcagggttggcgtcgacatccatcttattgaacgtcaccttgtcacccatctcgtcagctaattgttcgaccactggtgactgcatccggcaaggaccacaccatgtcgcccagaagtcagttaacgttactcctgaagccgtatccgttgtaaaagttttatcagtagttgctgcgaccattataatcggcctcctttaagctttatctgttactaatagtaagtataccagtaaccgggtggaacacaaacaatttgcctgcaatcaaagcgccgatatcgtgcacagccatgaattcgcgtcatcactgatctgcacctggcactcgtcactggttatttgaactgcacctcagtcgcaccattgccgccatgatttggcgcagcaaagtgaaacgacttgacttgccgattagacttgagatagttggtaatgccttctcgtagagcaccagttcccttcccgtgtacgattgtgacggaaggatacccggccaacaacgcagcatcaatatagcgatcaacttgagtcatcgcgtcttcataacgcacaccccgcaggtccaagttcggcgaaacgtgactcgcgtgggcactctgaacagtagcacgcgcgcgttttggctcttctggcttaacgcgttccaagtcaacgtcactaatcttcatcttcaagatgccgagttggacttcccactcgtgtttacccatctgacgcatcaacacaccacgttgaccatacgatttgaccagcacgtcatcaccttcatgaaaatcatgttgggctttggcacgccgtaatacacggtttttcttgagcttaggctgttgctccaatgcattcaacgcgcccttcgcatcaatcaactcgttttctttgacagtcgccgtaccactcgctaattgtttcttacgcaaatcactaatgatagcatcggccttagtcttactttgctcaacaatggtgttcgcctgcactttggcatcttcgatcaactgatctttacgctgttgatacgcattgaattcgctcttcaactgccggtgcaatttttcagaatctgccacttgggttttcagatgcagttgttcatcttcaacctgtttgcgcttcgtcaccaaatccgcaatcattgcgttgaggtcttgactatccgtatccgtcaacgaccgagcttgatcaacaatcgcttgcgggatgcccaaccgctgtgcgatatcgagcgcattacttcgaccaggaatcccgaccaatagccggtatgtcggcttgagtgtttcttcgtcaaactccatactagcattgatcgtatcaggtcggttaaacccatacgccttaagttctgggtagtgagtcgtcgcaacgacttgggttcccttggccccaatggcatccagaattgcgattgccagtgccgcaccttcttgcggatcagtcccggcacccaattcatcaacgagtactaaactgtgagcgtcgatctgcgctaagaaactttcaatattttccatatgggatgagaacgtacttaaattctgttcgatcgactgttcatcaccaatatccgcaaagatctcattataaacgccaacgcgacttccggcttcaacaggaataaataatcctgactgggccatcaattgtagtaatcccagcgtcttcaacgtaatcgtcttcccaccagtgttaggccccgtaatgaccatcgcctgataatcagtacctaaactaatatcattggcaacgactttgcgaggatcaatcagggggtggcgtgcttgccgtagatagacttcatttttgggtgaaacggccggttcagtcgccttcatatcatgcgcataacgcgccttggcattgataaagtcgaaatgtccaagaatcgccgcattattaatgatttcgtcctggtaaggcgcaatcaagttggagagtgcctccaagatacgctgttcttcttgcttttccgcaacttgattttgccgtaaccggtcattcatcgccatgacagcctggggttcgataaagagcgtctgcccactcgctgattgatcatgcacgatgccaccaaaccgactacgattctcggccttgaccgggataacgtaacggtcgtttctaatcgtgatgattgggtcgcttaaatacttggcatcatggtcacgggtataatgacccatttggttacgaatctccgtttcagtacgacggatattgctccgaatccggctcagttctggtgacgcctcatccgtgatatgaccgtcaccttcaatggcagtagcgaggcgcttcgtcacatctggtaaagtaactaattctgcaacttcatcaaacaggtgtcgaatatcattctcaggggcatcttctagcaactcggcaaaaaagcgcgtgattgcgcgcgttgtccgtaacacccgcccaacttgcccgagttcactcccattcagggtcgcaccgatagctaaccgtttcatatgcggttttatatccgctaaacgagcgaccggaatgccaccctttaaacgatacacttctgccccatcgttggtttcatctaaggcccgttgaatatccgcaacgctggtcattgggtgtagttcattgagtgcttgttggcccgttgccgagactaagtatggtgctaattgttgttttacttgttggtactctaacgtattcaatactttggaattcactgatatccctccgaagttccaatgaattacgaaaagccgcaaaaaaacggacaatgcaattacttgtcggcatcatccgtttgcattttcaataattcagcttgtttgtcaacctgatctgaaatcgcattgaatgcgagcaacgtcgcaatctccgtatcagacaaatcgggggctaatttttttaattgtgccacttgctcattcatcatccgcgtcaccgtttgcatgtgacggtcagatgccgtgccaatgatcgtgtaagtacgaccatcaatttccgctttaaagcggcgcttgttagcagtcatcaacatcccgcttcctttcaataacaattaatattctagcatggttatcacaattatgcgacagttagaaccgtctcataatttctaaaaaagcccgcggacatacgcccacgagcttaatctactttcgactattgcatgccaccgtcatcggctaagaaggtattcaaaactcgctcaaccatatcccattcgtcgtccgactcgatcagttgtaattcgccattgtcgccatcttcaggattaaagatgtaggcttgaatatcaacttcatcatcggccgcagcatcagctggatataataaaatataggagtgaccgaaatcttctgaatcaaacgtgaacaaaatattaaataaggtttcgttaccttcgtcatcaactaatgtgatcacatcattgtctttacgatcttggttttggctcatgttagttcctcgctattcttgtgtgagtttgccgtggcgatccaagtagttttgcaagattaaacttgcagctagcttgtcgatcacctttttgcgtttcttacgtgaggtgttagcttcttcaaccaacatccgttcagcttcaacggtcgtcagacgttcatcttcaaagtctaccggcaaatgaaaccgggctgtcagtaactcgccgtaatgttgcgccgcctcagcccgtggtcccaaggtattattcatattctttggtagccctaggacaaagcccccagcatccaattcttcaacgagttcagcaacccggtcgattccgaattcctcagcatcctcattgattcgaataatttcaacgccctgcgccgtccatccaaaagcatcactaatggcaacgccaacagttctggaacctacatctaaccccatcaacttcatgcatcaacatccttatctgcctttaagtaagacttgacaagttcctcgataatctcatcgcgctgatgcttccgaattaagttccgagcatcctttaagcgcgggatatacgccggatcaccggatagtaagtaacccacgatttgattaatcggattgtagcccttttcttgtaacgcttcataaactgtcgttaacgtgtcgtggacatccttaacgctgtcattatcgaagtcaaagtacattgttttgtctaatgaactcatatcaagcacctcccgctagtttccggttctaatctattttactaaatgcccatatgaagtacaatcaatccactttgatgtaacacattcgtaataataacccggagaatgcagacgttttctgcaaattcatcccgatttacactgttttttcatatactgacatacccctgtttcgaatgttcgaatagttgaaattcaaaacaggcacaccctttgtaacccaatcttctacgagttaagccggtcacaaggtgccataacattaaaaaatcagtaccgttagaacggtctcgtcctaacagcactgatttaattgttattttgatagctttaacatagctaaccaacataaaaaacaggatgtgcaaccaaagcaatcagtcttattgttcggcaagccactcatgcgcagctttcagcgccgctggtagtccagcaggcttcttcccgccagcttgggctaaggttgggcggccaccgccgccaccaccaacttttggtgcaatggctttgatcaagtcaccagctttgatacctgccttgaccttgtcatcactaacagcaactaataagttgaccttttcgccaatgactgttccaagtaccagtacgtcagaatactgcttggtcttccaagtatcggccaattgacggagttgatccatgccagagacttcaatttgttgggcgatcaacgtcgtaccgttcacatcgtcaacttgatcaaagactgccccagcctgctgtttggctaagcgactttcgaggctggcccggttctgttgttccgctttgagatcggcttgtaactgactaaccttggctggcgtatcagctaacttcggtgccttgacttgagcagcaacttgcttcaaggtttgttcttcgccggcaagcagttcgaaagcttccttcgaagtaacggcttcaatccgccgcgttccagcgccaatccctgtttcggaaacaatcttaaatagccccaattcactactgttcttaacgtgggtcccaccatcgaattcgatagaataatcaccaattgaaacaacccgcacaattttgccatacttttcagtgaaaaccgcaattgcgcccatcttgtgaccagtttcttggtccgtttgaatagcactgactggtaacgctgcccagatcttatcattgacgatttgttcaactttagctaactcttcgtcagtcacttgaccaaagtgagtaaagtcaaaccgtaaataatcaggttctacaagtgaaccagcttgtttcgtatgttcaccgagaacgtcacgaagcgcctggtctaacaagtgggtggcggtatgattcttttcgactttgttgtggaatgccaagtcaacgttcagcgtataagtcgcgtcttttcgcattggtttcaacacttcaacggtgtgtaaatgctgcttgttgggtgcattttgtacgtcagtcactttagccaccatttcaccggcatcatctaagatcacaccacggtcggcaacctgaccacccatttcagcataaaacggtgtcttgctgaaaatcatctcagcttgaccactgtcgacgtgatcaaccagggtctcgtcaacaataatgtcgttcaaagtcccctgcacattcgttaattcgtcatatcccacgtattcacttggcgttttgatgtcgatcaagagactccgttggacgcccatggacttggcactgctacgtgcattgcgtgcgcggtcacgttgagccttcatttcaacttcaaaaccagcttcgtcgacatctaaatcttcgtcgccagcgtattccttagttagttcgaacgggaagccataagtgtcatataacttaaatgcatccttaccagctagtgtatcgtgaccagcctgcttggtttccgcgatcaagttatttaacagattcaacccatcattcaaggtctcattgaagcgactttcttctgaagccacgatcttttcgatatacgcactatttttgagcacgtcgggatagtgtgaagccatgatcttgccaacaatcggtactaattggtccaagaaagcttctttcaaacctaatttttgaccatgtaggattgcccgccgaatcaaccgccgaatgacatagccacgaccttcgttggaaggtaaggccccgtcactaatagcaaacgtaatggcccgagcgtgatcggcaatcactttgaaggacacatcgtcctgggcgttatcaccgtagtgcttgccatcacttaattcttccgtcttatgaataattgggaggaataggtcagtttcaaaattggttttcgcattttgaaagaccgaaacgacccgttctagccccatccccgtatcaatattcttacgcgggagtggttcgtaagtaccttcaggagtgtggttaaattgcgaaaagacaatgttccaaacttccaagtaacgttcattttcgccaccaggatagttttccgggtcatcatcagctaaattattgaaagcttcgccacgatcataaaaaatttctgaatcggggccagatgggccttgaccaatgtcccagaagttatcttcgactttaatgatgtggtctggtttcacgccagttgcttcccagaatttcacggcatccgtgtccttgggataaacagtcatgtataacttgtcaggatcccagccaaaccattttggtgaggtcaagagttcccaggcccaactgattgcttcttttttgaagtagtcaccaactgagaaattaccaagcatttcaaacaacgtgtggtgccgcgccgtccgcccaacattctcaatatcattcgtccgaatactcttctgtgaactcgtcatgcgggggttatccggcacaacggagccatcaaagtacttcttcatcgttgcaacaccggagttgatccataataacgttgggtcatccacgggaactagtgatgcactagggacaatcgtatgacctttttcatgaaaaaagtccaagtacatttgccgaatttcactactacttaattttttcatttaattctggcatcctctctatcattcttaatttaaggcaaaaaaacaccgttgctagcaaagacgctgttaacgcggtaccactctgcttgcaacgatgtgttcgtttacctcttaagctcattaacgctgagacacggactagtttgctagtcattacttctaggtagcatctaccccacaccgcactttttccagcaaccaaagtgtttcttgaccgatatgtgagatagatatgtccttactttgcaaagtatagaaaacttgcggcgacttgtcaatacaccactcagttattttgcattaatctatccggatgcacgtcaattaagacttacgatccttgcgttccttgcgggcagccgctcgttgttcgatgcggcggtccatccgcgccttatcgctgatctttttacgaatgcggcgtttgtaacccggcttgatctttttcttggactttttgacgtaaccaatcaaggttgggtccagtttttcctgttttggcccccgtttagcccgacgattacggtcatatgaatccacaatctcaccatcacgaatcgccttcggtttgaacttgatccccattgcttcaactgcactgaccttggcttcttcgcctgggctatataacgtaatcgcagtccccgccattccattccggccggtccggccaacacggtgaatgaagaattctaagtcattcggaatatcatcattgatgacgtgtgaaacaccttcaatatcaatcccacgggcagctagatcagtggcaacaacaaattgatacttcaattgttggacgtcgcgcataacccgctttcgttcacgtggttggatatctccatggatcattgcgaccgttaaaccttgttggcgcaaataatgggtcaactcttgaactcgttccttcgtgttagcaaaaatcaacacgagatacggttcaccaatcgtcagcaagcgataaataatactgtttttatcgtgactcttggtggaaatcagccagttatcaatagtcggactaatcacagattctactggaatttcttccataactggattgttcatgtacttgcgcaaaaatggcgttaatttttgtggcatcgtggctgagaacaccaacatttgtaaatcagcaggcattcggccagcaatctggtcaaccacgttcaaaaagcccaagtctagcgtcatatcggcttcatcaactactagctgagtcgcacgatgcacatcgagtgcctgggagcgcattaagtccagaatccgtcctggggtcccaataatcaactgtggttggtgccgatttagcttttcaatctgttcctgcttatcagtcccaccgacatagagtccaatgtgaatggctttcgggctgtgttggatcaactgtttagcagcagtctgaatctgataagctaattcacggctgggcgttgtgataactgcctgcacgtaacgttcatcagcattcagttgattgatcattggcagtaaaaacgtatgcgtcttaccactcccagttgctgactgaccgatgacgctgcggccagcagcaatcactggaatcaacttttcctgtaccgcagtcggtttgcggaaattgatgtcagtcagtgcctgcatcaagaacggctgcaatttaaaatcttcaaaacttgcggtcatatttaaacctctttctcataatggctagcgacttggtcgagttctcgcactaccgtttcaatttcttgttggtctttagccttggcaccgctcgctaatgcgtggcccccaccatcatggttcttggccacaccgttgattgacggtccctttgaacgtaaccgaatacggaagtcaccttccttttgttgaacaaaaatcgcccagcacttaaccgtatcaatacgcccaggtaatgggacaaccccagcagtactagcatcaccgattgcaaatgaatcgagaatcgcattcgttaaaataacgtaagctgcacccgaatccaactgtgtcagatgttcataaacgtaggccgacaaccgtgcgactggtaacgtgatggtatcttcaatacgattaacagcttcagcatccgcaccggcttccattaaggccgctgctgctcgcatggtactaggcttggtcgcagagtatagaaagcgaccggtgtccccaacgatgccggcatacaacaaccgagcggcgttagccgttagcgttaactccgccgcaaggggtgcgtaccaattataaatcatctcactcgtactggaagcatcagcgtcgacccactgtgggtcaccgaaagcgtcatcgtttgggtgatgatcgattttaacaattgtcttaccttgattccaaagttcaccatcaattcggggctgattagcggtatcaagaattaatactagtgcgtcttgatagtccgcttcggtaacctcatccatttgtcctaaccagtcaaaaccatggtactgttttccaggtgtcaatacccgcttcgcaggaaagctagctttaatgatagctgctaaccctaactggcttccgatggcgtctgggtcaggtcgctgatgacgatgaatgatgattgtttttgcttgtttaattaagtcaaaaattgctgtttggacggtcataaatgaaccttcttactctcataatttactggtggcgattaaactgtcacagtactccagtataccgaagaatccgcgtcgcgccaaataaattaattatcatttggataaagtggtaacgttaagttctcaaacgccagtggtgccaagccagttagcgtgatccctaacaggcggatgccagagttaaaatgatcatcgaccacctcttcaaaaatctcttcggcgtactgctcaaacaaggccgcgtcattaggtatgaattcaccgaacgttcgccgcttggtaattgtgacaaagtcaccgtaacgcaacttgagaacgagtgttttaccgtggcgctgatgcgattgcatgctagctgctaccaacttagcgatggccttcaagtgcgtattaacttccgtcgtcgattggagaaacggtccaaacgtccgctctttgccgattgatttccgttcacgtaaatactcgactggccgatcatcactgccgcgcactcgccggtataaaatatagcccaacttgccaaattgtttgattaggtctaattcagactgtgcgtataaatcctgtccagtcttgattcctaaatcgtgcattttaggtaccgtctttttaccgacaccccgaaatttctcgatgggttcacgtaataaaaatggttctgcatcctgtggtaatacgatcgtcacacccgctggttttcgataatctgatgctagtttggcaatgaatttgttgtaggagattcccgttgaacaagttaaatgtgtttgatgccaaatttcttgttgtaatcggtgcgccagttcgaccgcactatggatgtgtttcttattcgtagtcacatccaagtaagcctcatcaaaggcaattggctcaatcatctctgtatactcatggaaaatacgatgaatctgcgccgaaacttcgcggtacaacggaaagttgggcgtcttaaatactgctgttgggcagagttctaatgctttagcagctggcatcgccgagtgaacaccaaattggcgggcaacatagttagccgtcgtcacaacgcctcgcccacctgtctgccgaggatcatgcgcgatcactaacggctgcgtcttgtaggctggatgctcccgctcttcgatcgacgcataaaacgcgtccatgtccacatgaataattttccgactcgtatccacccgaataggcgcttcaacaattgactgtgccatccgccgcccctccaatccttagtactttcattatacacgaacatacgttcaaaagcgcgtttcaagaccaaaaaataagcaaaaaaaataagcggtcatcagtaatgatcgaccacttatggtgtaaacctattttgcttcagaatcagcattatcgtcggcggctgagcttgccgattcaacttcagaagtagcagctgattcagccgctgccccagattctggtgcaactgtcttagcttgtgcatcttcggctggagaaatcttagcaacagcgttcaaatcaaaaaccaagtagatgccatcacagtctaaagtaactgttttttcggtttcgttaacttcatcaacgaccccgtgcaagcgaccaattgtcgtaaccttgtcaccacgtttgattttgcttaacatttgttgatgttgttgttgttgtttccgttgtggacggatcatgaagaagtataagaatgcgaacatgaccacgataaacagaattgatgccatttgacccatttaatatcgctcctactctaattaaaagtttgactatctttaactttaacaaattacagtctgaaataccagtagcactaaaagtttttcgggtttttatcgttaaaaccgtacatttcaaagaagttctggcgaaactccagtaaattatcatccataatggcttgacgaacttgcttcattaagtgtaacaagaaatataagttatgataactcgtcaaacgcaaaccaaacgtctcgtccgccttaatcaaatgacgaatataagcacgcgtgaaattacgacaggtataacaatcacaattatcatctaacggggtgaaatcgtgagcgtaggccgcatttttgacaactaaacgcccatgggacgtcatgcaagtgccattacgggcaatccgagtcggtaagacacagtcaaacatatcgaccccacgaattgcaccgtcgatcaaggcatccgcagagccaactcccatcaagtaacggggtttattttctggcaatagtggcgtcgtgaagtctaaaacatgattcatctcagccttcgattcacccactgataagcccccaatcgagtagcctggaaagtccaagctaacaagatctttggcactctgttcacgcaagtctttaaagcccgcaccttgaacaatcccaaataagccttggtaatcagggtgttgatgaaccttcaacccccgctctgcccagcgacttgtccgggcaactgacttgctaacatagtcgtaactttcaaagaatggtgggcattcatccaaactcatcatgatatctgggccaagatcattttcgatttgaatagccttttcaggagataagaacatctttgagccattcagatgattcttaaagtggaccccttcttccgtaatatcacggtttttagccagggaaaagacttgaaacccacctgaatccgtcaagattccctttttccaattcataaactgatgtaacccgccagcttctttcacgatttgctcgcctggccgtaaccacagatggtacgtattcgataagataacacccgcacccatcgcgtctaattcttcgggtgccagtgacttaacactggcttgcgtcccaacgggcataaacatcggtgttggaaaggtcccgtgtggcgtaatcaattcgccaaggcgggctcctgtgtgtttttctttcttaattaatcggtatttaattgccggttccatatctgttcctccgtattaaaatgttgctaaactcaaataatgatagcacgaaatccagccgtgaaccagtcgcggcaattggcgtgggcacccacgtggctttagtcagtctgttaacaaagcgttcaaacgtcaaatagtcgcctcaagaatgcattttaacttcttgaagcgactattgacaatctttattatctccagagctaaaacgtcagcttgaaattagcgatacgcctcgtataatacggcattttaatattcaaccgtcatccgtttcaaaataagcgatctcgtttaaagccagttatactagtgaataaacatcgcatcgccaaaactgaagaagcgatacttttcatcaatcgcatgttgataagccttcaaaatcatatcacggcccgtaaaggcagccactaacatgaccaaggtcgacttcggtaaatgaaagttcgtgatgaacgcatcaacgactttccattgataaccaggtttgataaagatatccgtccaacccgaatccggcttgatttcaccatcaaacttactaccaatggtctctaacgtccggattgacgttgtcccggttgcaatgatgcgcccaccattttgccgtacttcattcaacgtcttagcagcatcttcgtccaatcgataaaattcactgtgcatcttatgatcatcgatattatcttcttcaactggccggaacgtccctagtccgacatgcagcgtcaagtaaaccaacttaatacccttgtcttgaactttttgtaagagttccttcgtccagtgtaaaccagctgttggcgcagctgccgagccattttccttggcataaacagtctgataacggtctggatcatcgagtttttctttaatatatggtggcaatggcgtttcacccaggctctccaaaatttccatgaagatcccatcgtaatggaactcgatcattcgaatgccatcttccttttcggccgttacggtcgccgtcaacttaccatcgccaaatgaaatcacggtaccgaccttggcacgcttggcaggtttcatgagtgtctcccattcatcaccttccgtattatgcaataataggacttcagcgtgaccaccagtttcaggtttaacaccatacaaacgagctggcataacgcgggaattattcataacgaccgcatcgcctggattgagttgatcaataatatcgtagaaatgcttatcttgcatttcgcccgtttggcgatccaattccaacaaccgtgaactatcccgttttttgattggtgtctgggcaatcagttcatgtggtaaatcataatcaaaatcttcaagtgttaaactcatgttgtgacctcttatctttatttattttctgggtatgggaatcccaaatgctgataacctttaattgtaacaacgcgtccacgttgtgttcgcttcaagaacccaatctggagtaagtacggttcgaccacttccgcgattgtatccgtttcttcaccaatattggccgcaatcgtagcaagcccgaccggacccccgtcataatactctagcatcgttcgtaagagcttattgtcagtctcatccaagccggcatcatctacgcgtaaatatgtcagtgatcgcgccacgatggcctcatcaatggcatcttgatccgccacttctgcaaaatcacgaattcgcttgaacaagcgattagcaatgcggggcgttccccgtgagcgacgcgcaatttcgtgggcacccgatggtttgatactcgtttgaaaaatatctgcagtccgcttaacgatatcttccaaatcagcaacttcatagtacgccatatgttcgacgattccaaatcggtcacgtaacggagctgacagcataccagctcgggtggtcgcgccaatcagcgtaaacggcggcagtggaaagtgtacgggatgggcggttggcccctgtccgaccacgatatcgacaaaaaaatcttccatggccgaatacaacatttcttcaacgattttcggtaaccggtgaatttcgtcaataaataagatatcacccggctccagttcattcaagagcgcaaccaaatcacctggcttttcgattgcagggccactggtcgtgcggatattgacctgcatctcgttggcgattaccatcgctagcgtggtcttccctaatcccggtggaccatacagcaaaacgtgatccaaggattcctcacgcttgcgggccgcttcaatatacactcctaattcgtgcttgacccgggcctgaccaatatactgggctaacgtttgcggacggagcgatttttctaatgacgcctcttcgtcatcggctttgtcaccggataataacttgtcatcgtccatttagttacccctcccatctacttcttcatcaatagtcgtagtccttcactcaacaaggtgttcgtatcggccccttgtgtctgactaaacgtctccaacttcttagtgaccttcttgacatccgctttcgaatagccaagagcttccagagccgccaacgcgtccgctaacgcgccatcaacagcaggagcatccacatcgagcgcagtttgaccagtcacatcaacgtttagatcgtttaatttacctttcaagtccagcacgatttgctgagctgtcttcttgcccacgccaggaaaactcgtcagataagtcgcattctcttgattgatggcttggatcagacctgcatggtcgttgttggccaaaatcgcgagggccgacttcggaccaattcccgaaaccccgagcaacttttcgaacaacgccttctcgtcagcatcaaaaaagccaaataggctcatgccattttcgctgacggcttgatggatatacatcttaactgctgttgggcccacctggtaacggtatggattagccgttagcactttataaccaatgccgctgacctcaatcaccacataaccgggggttacatcggtcacttgaccgagaaaatattcgtacaccgaaaaaactcctttaaataaaacgtatgtttgcttgctaaattgtaccacattttcacagtggcttaacactggtgcaccgataaaaaccaaattttaatgttaaatcaatttcacctcgattgacggatttcgttgcaagaaatgcttgccgccacgttaacgtcatgctatgctcaaagtcctagggaggtctcgctatgcaactcaaaccgtttaaagcggtgttaccaaccacaactggtcaaactaaaattcaaacagctgcgaccaattgggacagccaggatacaatgacgacaaccgaagccagctattactggtacgaactcacactcaacggtgttcaccagtggcgcttaattggcagctggccggtggatcaaaccgtgacgaccatggttcccggcacgatcaacacagtcctttacccacagcagcccgttatcgagatgttgattgacgactgggtcggtcattttgccccggtcgtcgaggtgacggataccgcgcacgtcacacatcgactctggcagattactgagtctgaggtcaataccgacatcacaacggccatggcacccgttatcccgcagaaaacgtggttgacaacggtcagcacgccactcgtcatgttagtctcaaccagtgaatggcaaaaattagtcactgcaccggtcattcccgaacaattaattgcgttagcgacatctcataattaaccagtcgtggctgttaattgtgaatttcgctatggcatacattcgtttgtgttccatctaacgttaaataggcttcttaggaatcaaagttaattcctaagaagcctattttaataccgatttactcaattaagattgtctgacacgtttgtgaagcccccaccagcaggcaatcagtatgctaatcacaccaccaataatactcgaccatatgccgatttttagtcctggtgtgtgatacgtcaaccgaatctggtgccggccggctgtcaacttggcccccacaaaccctttgttgacgacttgggtcctaacggtttgaccgtcaactcgtagctgccaaccagtcgaatacggaattgacgttgttaacacggttgctgtcttagtcagcgtggttcccgtaatctggttgttcgtcacttgttgatgcttcaacccactcgtctgtagttgccgcgtccgttgacgataagtcttcccaagcggtacagcgatcagtttagcggacttaaaatgcaaactacgaatgctcgtaaagttcaacgtaatcagcttacgcgcgtacttgctataccctaagttgattactgctgatgtccggggctcataatctgacatattcgtggtacccaactgactaaagctcgtcaagttatccgttgtctgagcagttaaagaatacccactagcgctcaaattgcccttcagaccatcgcgaacatcatctagataatcgactttggtatacggacgggccgtgaacacgttggtattttgactcgttgtcaaggcgtgcttgattgaggaacgccgataactgatgccatctagcacaagatagagttccgtatttcgatacttcttagggtgttgaatggtcaattggtacggtatctggtgcccctgcacatcactgaccatgctcgttaactcgtcggcattgttttcctgatttttctggactaacttttgattagctgcaatcaagttcaacacgcggtttgacggtgtcgtcaggccagttgccggcgtcaaactttctcgttgttccggcgttaatgtgatcgtatctgccggtaacttagtcaacgcgttgttcgacgctcccgttgcatgttgattgcggtaaataatcaccttgtccaacgtatccaaaacattcgtcgtatccgcttgaaccgtataagcgacgttttttccggtaacggttggcttgacagtcttaacaccactaacctgctgcgtagtgaccgcaccttgtaacaaggcttgctcgcggtcaactgcgttcaagcgattaaattggcgttgactaatctgatgctgctgtgtataaactaacggcaacgcattcttggattttaacaagatcgtgccggtatgattactcatgccataaataaacttgtccgcaaaaatcttcggttcgccagttttcatcttaacaacctcatatccggctggtaaggcttgtttcttcaactggtcctcacgtgcaaataaatatttaacacctaataagttatacatcgtcgtccgaccgtccaacgaaccgagtggcgagttcatcgcatactctgagttgcctaaggcctgactaaatgcccccacgtaaccattttgaactgaaaaatacgatccaaccgtgtgagttcctaacaccatcggcacatcactctcagccgaacgcatcgtatagtagttgggtgccaaagccgttcgataaaattggctagtcgtggttaaacttttttgcgcgccatcaaaataatttttgacccatttcattgccgcgccctgccgcaactgctcagtactattagaattagtattgatactaaaccagcccagtccgttattcgccaggttcagcgtgacaattcccagtaataacacataaaattgccgattggtcaattttaaggattgtttggccagcaggaccccaattaacgctaacaagataagatatgtcgcaatatcatgtttgcggatattgagatagaatccattgatcagccaaataatgacaagcagaccgccactaataccagccaaccattttaaatcagccgctgtcagagcagtgacttggtccataaatgccatcgtcgcataagcaaacacgagggttgccatcaacaaccatcgattagaaggtgttgaaaaaacgttgaatacggccgcaaattgaggcaacaaaatacccaacatcatcacgaccagtacccaattaagcacccaatagcgtctgaaatgacgtagtgtataaataattgcaataaagctaatgctactcagcccgagggtcacccagtattggacactgccaccattggtcaacagtcgattgggtaaattaacgtaataattgatgggataactcgtcaagccattcgcaaagttaaaactcgcacgcgttgccgtcaacatcgcgagcagcgtgggcactagtaagatgcctgccatcgtgacaccaagaccaactgccactagtaaccgccaaaataactgtccaaacgaccgcatcgttaaatggtcacgacgacgtgaccagaaacgcaccaaagcatagactaaaccgcccaatgcgagtaagtaagcaaaatagaagttactcaaaattacaacggcggtaatcagactgagtggtaaccaatgtcggcctcgtaagacccgttcaatcgcccaacacagtagcggaaaccaaatcattggtaacaagaaaaacgggtggtgcatcccaacatagaacgtatacgcggtaaacgtatacgtcaaagctccaatcaattgactgatacgtttgaacttgaactgccgactgaaacctagaaaagcaagtccaacgaagtacaatcgcagcaagatcaacgcttggtaggcccattccaaatgagcgcgcgaaacaaacgccactaaataattaaacggatcaccgaccacgtagtaggaaaaagtcgtcagttgatcggcccccaagccgagattccatgaccaactgaataattgttgtgggtggtgctgtaagatccgctgaaattccaataaaatcgggaagtgttgggcgatgccatccacttcccaaatcaatgtccggccggctaagaaaagcccactgtaagtaatcgtcgcaataaccacaaacatcgccgtataccagacgactagtggtatcttccgtactgtcttcaaatcaggtgcccctatcttgtaattacgtcgacaacgcaatccccatattttgccatctcaaacaatgtttctattttaccatgaacaatttcgtctcgtgatgttcagtttgaatcttaataaattcgtgattcacagctgtcccatcaacaactaacgccaatcccagttatctaaagtttcaatcttagtagtcgccggataactcccaaacaactgtactaaaggttgtaagccactcacagcattatcacgttgtaagttgatcgcagcgattgccgcttgatcatgacggttaggatcgagctcaaaaacagcaacttgctcatataaatttagcgtaatcaatttggcgtcccgcgcacttggatgcgcatttaatttccacagcgtcttgcgcccggccacgaacgtgggcgtggcctctggtaaatctgccaaaaaacaatatgccgaataaacctggcgataataaagtttggtcatatccaaaacaatcaactcccaatcatgttgagtggtccaagcacccgatacgcgctcaccactcattttaatcaatgatagctaactatttaaaccaattcaatctgaaattttacaactcaaattagtgtcacaaacgccacttccccaatcttaaagttgttttttagaccgcaatactggcgacaataaaagtgaggctgtgacataagtctctagaaacaaagcaggtctggaaaaatcttcgaatttttccagacctgcttttgatataatagaaaaccaaaaaagagcatcggtcgcacccgatactctacgaaattatcctcgaaaggacattcctaatatgcaagattattataacatgaatcaaaccactttgagtatcgccttggattaccaaccagaagagcatcatcctgctcgttacatcaaccagcttgttgagagtttaaaactaaaatatgattaccagtttggccgtccgcgggaatataacctcggtaccatgttaaaactggtccttttagcgtacagctatggcattttcagcagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgacctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttggataaacgacgtgataaaatgcgtgaacaccaagcacagcaagcaatctatggtcagcgtaacagctactctaagacggatcacgatgccacctttatgcgggtcaaggaagatccgatgcaaaacggtcaattaaaacctgcctacaacgttcaaatcgccacgagtaatcagttcattacgggatatcggcttttccaaaatcaaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcgacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagttttttggcaagatgaaggcttctttacatttcaatcgattctcggtgcgaggtttcgacaaggtcaccaaggaagccggaatcgtaatactggcgttaaatattatgaaactggtcacggtagggaccaactttaaaaatcaaaggcgtaagcgaatgggacgagaaaccaaaattcggtttctcgtcccattcgcttatacagaggctagttatgtcacagcctctactcaacattgctatttttattcgataacacattcggttcgtgattattcagtatcagtcatgattaaaacgtgccaagtttagattattgttcgtcagccggtgtgcgtcctatgccgacctccggggctgggtgccaattgctggaacgcagccgacgtcgatttgagctaacgcataacccgcgtcatctcaaatacgagtcttattctaagccggaagcagaccacttccagctaagaataatttggctactgagcattgtcacccagcccctccagtctcaagcctgtgaggggtcacgggttgaagccgagcattgcctagccaacggattaatgcggttttggcattagtccgttggcgtagcaagcacaaggctttagtggcaccgaacacgtttcgggaaaccgctcgaatggctgatgaacgaccacctaatttggtacaattagtcgctgactattttgatgctggaagtttaaacaaagcgctaggtacattaagcactctgtcaagagattaaatcctactacaccgattcaggattagtgagccatctcaatattattttcagtctgacagttgattaacaaaattatcgtttataaaaagcaacgacaaattcatcaaaagttggtgcatccatgtcagccattcgaatactgtcccgactggaaggcgtttcggccaatgcccagtggtgaaatttcacttagcaagcgtcttgtgcttggttagtgaaaggccagtatttgagacgtgatttttcggctcaaatctgtgcccaccacgttccggcaattggcagaaatgcctggaagtcggtgtaaggcgcacacaccaagcaagtctacgctagtccgaactttttccagcggtcttaagctggctgcttttgaacttaagaaatggcacgttttaatcataattcatgaaatatttacttgcacaatgcggatcgattacgaatcatactaaagtaacgagtacgccgccaataatcactttaatcacgtgcttcatgactatcctgaattcgtttgaacatccgttccatgtctgaattcgtgaagtgtaccgtcaccgggcggccatgtgggcaattgaacggattctcgcaggtcggtaacttggctaataacgcgcgggcctgctgatcatccaaatggtgattggccttgattgcccgtttacaggacatcatgatagctgacttttcccgaaattgggcgaccgtcaacttatcatcctgtaagagccaatcaatcatttcacgaatcgtatcttcttcttgcccagctttgaaccaggtcggatgggcatgaacaatgaagctgttgccgccgaatgattccagatgaatccctaattctgctagtaacggcaatttttccttgatctttaaaacatcgctcgtcgggtaatctaaaataatcggaaccaataaattttgttgatccgcactaacctcacctatcgcttggcgataatattcatagttgattcgctcctgggccgcatgctgatccaaaatgtacataccatcatccgcctcagctaacagataagtcccgtgcatctgaccaagatagcgtaactgtggaaaacgttccgtatccggcgcttcactagtcggcgcgcttgcagccgtgctggtttctaacggttcagcagtttcaccaaagggtaaagcgcctgattctgactggtaacgctggtcaaatgcttgaactggagtagctgtcagttcgtcgcgatggctaatcataatcggcgggttggcagaacttgccgctgattctgacggaacaaccgcactaactgctgcacggtttaccgctgatggctgtgctgaagtagtacttaccatggtcgttgccgagctgggctgcatggttgccgctgccagcgaggctgcaaactgctcagtcgatgccggcgttgtcttatccgctacttgatactgtgacgaaacggcgttcaaatccatcgccagctggtctgtatttagatgttcacgccgatggctgccaagattggtcaatgctgacggaatcaagttcacatccactaaccggtccgtaatcgtggtgctgaccagtttggctaattctggttccttactcaaacggacttcttgtttcgtgggatgaacattgacgtccaccaataaaggatccattgttaaagcgatcaccgcgattggataacggccgaccatcaacttagagccgtaacctttgatgacggctttggtcaattgctggttcttgatagcacgaccattaatcagaacagtaatatactggcgactggcccgcgtcagctcaggtaaagccacaaagccactcaatttaaaatcagtggtcgatccttgaatggcaaccatcttgcgcgcattttggacaccgtaaataccagcaatgacttgttgtaagtcaccgcgaccagccgtttttaatagctctttcgcattatgaactaaccgaaatgccaccgctggatagctaagtgcgatgcggttaaccacgtctaaaatattcgctaattccgtttggggggacttcaaatattttagtcgcgcaggtgtattaaaaaacaaatcggtgacggtaatgtccgtcccttgccgcaacggagcgggcgattgttgtaatagcttaccgccgcgataatgaatactcgtcccagtggcgccggtactcgtattcatcaccacgtccgctactgacgcaatacttggcaacgcctcaccgcgaaaacctaaagaatggacgcgaaacaaatcttcacgtgatgtgatcttactcgtcgcatgccgtttaaaagcggtcaggacttcagcgtcatcaataccgtcaccgtcatcgataacccgaattgactgaacacccgactcttgcaccaaaatatcaacctgcgtcgcgtgcgcatcaacagcattttcaaccagttctttaacgaccgaggcgggccgctccacaacttcgccggcagcaatctggtcggccagcacagaagataactcatgaatttttcccatttccatcggtcctttcacataaaataattaagctcgtgtcctgcacgaacattttcgattaccacaactagcaataactgactagtgtcgacctacctgtccgtcagacgcaccaatagcccatcataacagcttattgcgctcatttatgatgagttaaaatgcgcctacttgcctaatttttgttgccatttatacagctggttcattacatccatcggagtcatcgccatcaagttcaacgtcttcagctgttgtaaaaccttttcacccttcgcatccgtcaccgccggctcagcaaataacgacagctgttcatcaccggcttcagcgaccggagcttcggcaaccggggtctccgattctactggctgtgactcatcggcggcctcaaccggcattgaagccgctgtgttaggtgccacgctattagcagcatcactagcagcaatcgaagccgctgtcgtcgataccgtactcgtttgattttccaaactcgttaaaatcttattggcccgttccaataaactcgttggcatcccagccaacttggcaacgtgcaccccgtaggacttatcggcggccccgggctcaactttatgcaagaagacgagctcgccatcctgttcagtcgcacccacatgcacgtttcgtaacccggataattcttgatctaacgcggtcaactcatgataatgcgtcgagaacagtgtcttggcatgaatatggttatgcacaaactcaataattgcttgggcaagcgccatgccatcgtaagtcgccgtcccccggccaatctcgtcaaacaacactagactattggctgtcgcatgttgcaaggcattattggcttcctgcatctccaccataaacgtactttgaccggaaattaagtcatccgtggcaccgatacgtgtaaaaatttggtcaaaaattggaagttgcgctgatttagccggtacaaaacaaccaatttgcgccatgatgaccgtcaatgctaattgacgcatgtacgtacttttaccggacatgttaggaccagtaatcaaaaggaccgtctcatcaggtgacattgtcacgttatttgggacgtaactctggttacccatcactttttcaacgaccggatgacgaccatcaacgatcttcaaatcatgtgatttagttaatttcggtcgaacaaagtggtaatcttcactaacgacggcgaaactttgcaagacatcaattgctgcgaccgccttcgccaatgtttgtagccgctgaattgcctttttaaccgtttcacgaacctttgtgaagagttgatactcaagatccgtagaatggctctcagcttctaaaatcaggctttcatgcgatttcagttcaggagtactaaagcgttcagcattcgttaacgtttgcttacgttcatagcggtccttcggtaattgggccaagttggccttcgtgacttcaatataatagccgaaaacccggttaaaccctatcttaagattcttgataccggttgtcgcccgttcctgggcttccaactcagcaatccattttttcccattattcatagcatcccgatattgatcgagttgctcgttataaccatccttgatcacaccaccgtccgttactgacaaaggcgcgtcttcaacgattgccgcgtcaatcaaatccgcaacgtcttcgactggatccagctgattaacttcatcattaaatacctgcgtatctaattccgataagatataccgaatctttggaatctgacgcaaggatgtcttgagttgcactaagtcacgcccattcacgctaccaaaagccacccggccagctaaacgctccaagtcataaactttagtcaactcttcttgtaagttactacgttcaaaataatgatctaataacgtcgcaaccttattttgacgcgtttcaatatcggccttcacaatcaatggccggtcgatccactgctttaatagtcgtccgcccatcgccgtcttagtttcatctaatagccacaggagagttccttgctttttaccagttcggatggacttcattaattccagattatacttggaattatgatcgagtttcaggaagtatgacggctcataagcgatcgccttttgtaagtgcgcgaggctccgcttttgagtcaccgtaatatacatcaataaccgttccacgacctgttgttccaaatcgaccgtcaagtcctgagtcaagtagctcaattcagcctggggggtgacgttattctgttctgaaattagaattcctagcgtcttaatttgatcgcgcaaatcgctagcaacagagtcgtcgaccacaatttctttagtttgcaagctggtcaactcgttaattagggtatcgttagtcgttaagacactcgtttttagttccccagtcgacaagtcggcgtacgcaaaaccatattgttgatcacgctgaatcagcgcagtcaagtaattgttcgtcttagcttgttccgcgccccgttccaacgtcgtaccaggtgtcacgagctgaatcacttcgcgtttgaccatgcccttggctaatttgggatcttccatctgttcacaaatagcgactttgtaacctttatctactaaaatatcaatataattttgcacggctcgatggggaaccccacacatcggtatggggttttccgccgaatgattccgcgtcgttaaggtcaactctaataactgagcacctttaatcgcgtcatcaaaaaacatttcataaaaatcaccaagtcggtaaaataaaaacgcatcgggatattgatttttaactgcaaaatattgacgcatcatcggtgtatcttttgttttctgtggcacgcttaatcctactttctatcgtaaatcttagtcatcaaaatatgggtggtccggattaatcaaaatccgggcaatctttttcgcccgaccactctgaccatcaacgtcgatcacacaacccgacaacactgccgaactatcctcttgcacgttgaaacgggtcggcatttgttccaagaaacgctgaataacattctcacgggtcattcctaaaataccattatacggacccgtaaaaccaacgtcacttaaaaaggccgtcccatttggcaatacgcgttcatcactcgtctgcacatgggtatgggtgccaactaccgcactcacctgaccatccaaataccacgccatggcttctttttcacttgtcgtttcagcgtgaaagtcgatgaagatgttaggtgtctcttcccgcaattgctcgaccaatggttggacagtcgtaaaaggatccgctaaattttgccccataaagacgtttccttgaagattaatcacggccaacttcaccgtattgaccttcacgatcgtataaccaacccccggagtcgtcgctggcggaaaattcaacggtcgaatcaacttcttagcaccattaataaaatcaaaaatttcattattatcccaggtgtggttgcccatcgtaatgacatcagcccccgcagtcaagatgtccttatacacttcctgattaatgccgcggccgcgggtggcattttccccattaacaatagtaacttgtggcttgtagcgccgttttaacttaggtaggtacgtggtgaccgccgtttggccgacattgcccatgacatccccaacaaatagaattcgcatagattgctcccttgttttaacgttataccaattattttagcattatttagccttgaaaacgtgattgaattctgctggcaactaaaaaaatgagcttaggtcaagacctaaactcatttcccggttatttagcgtaatccactgctcgaacttcccgaataaccgtaaccttaatatgaccgggatattcaagttcattttcaatctgctttttgacatcgtgcgccaaaaccgttgcctgtaaatcagaaatctcgtttggcttaacgatgactcgaatttcacgaccagcttgaatcgcatagctcttcttgacgccatcctcattattagcgattgcttccagcttctcgagccgatgaatataattctccagcgactcactccgagcacctggccgggcggctgaaattgaatcagacgtcgcaaccaacaccgcgataatcgacttagcttccacatcaccatgatgggaggcaatcgtgttaatcacgacggggctctctttgtacttcgttgttaattccacgccaatttcaacgtgggaaccttcgacctcatgatcgacggccttaccaatatcgtgtaataatcctgcgcgtttcgcgagtgtaacatcttcaccaagttcagcggctaaaacgcccgctaacttcgcaacttcaattgagtgattcaaaacattttgaccataactggtccgataattcagccgaccaacaagcttgatcaagtcaggatgcatcccgtgcaatcctaaatcaaagacagcttgttcaccagtttcacggatcttttcgtccatttccttacgcgctttttcaaccatttcttcaattcgagctggatgaatccgcccatcttgaatcagcttttcaagcgcgatctttgcgatttcacgacgaatcggatcgtaaccacttaaaacgacggcttctggcgtgtcatcaataattaaatcaattcccgtcagcgtttccaacgttcggatgttacgaccttcccgaccaataatccggcctttcatgtcgtcattcggcaaagaaacgaccgaaaccgtggtttcagaaaccatatcggcagcactttgctgaatcgcttggacaattaagtttttggcttctttttcagactgcgctttcacttcgtccgtattttctttaattaacacggcccgttcatgcgttaattgttcgcgcgtttgggtcaaaatctgatcgcgagcttgttcttgcgacaaggcggcgacccgttctaactcagcttgacgttgcgtgattagtgaagctgcactttgttgctgttgttcaacgcgtttttgctcattggcaatcttatcttcttttttacctaaagcatcctcgcgcttttcaaaagtattctctttgtgatctaaagtttcttcacgttgaagcaaccggtcttcttgcttttgaacttcattccgacgttgctttaactccgtttcaacttcagcccggtagcgatgactctcttccttagcttcaaggactttttctttcttatgagtctccgctgcccgtttggcctcagaaataataccttcggctgtgttcctggcaacgtccaattctttttcatggacgttcttgcgtacatagtaaccaatcccataaccgacaacaattgcgatgactgcgaggattataccgaaaacattcatgtttccacctccgcaccaccaaaatccagttaacataaaatcaactacaaattttcagatgttatattttgattatttacacacttgttattctaatgttagaaacgaatagtgtcaacttaaagtcttatggcaaccgctctctgcaggctacttttgtcgtgcaaacaagctaagtatgtacaaaaaacgcccaaaataaatattttgggcgttgcataacaaactgtctatttttcggttggttggtcgccgagatcgagagcagtttccgctggtgtcgctttagtggacttactttgacccttactgccattcttagcagttcccttatccttagcttctttggcctgatcatcagtttcagacgtttcttcaccagttgcatccataccatatgcatcacgaaccttttggcgaatctccgtcatgacatcaggatgctcgtccaaatacttcttggcattttcacggccttgaccaatgcgatcgtcaccatatgaataccaagaaccactcttcttaacaatatccttttcagcagccatatcaacaatttcaccagtttgtgagataccttgaccatacatgatatccacttcggcacgcttaaatggcggtgcaaccttgttcttaacgactttgatccggacacggttaccaataatattggttccttccttgatctgttctgcccgccgtacttccaaacgaatcgtggcgtaaaatttcaaggcccgaccaccaggagtcgtttcaggattaccaaacatcacaccaactttttcacgaatttgattgataaataacgcgattgtcttggttttgttcaatgtccctgataacttccggagcgcttgtgacatcagccgcgcttgtaacccaacgtgtgcgtcacccatttcaccttcaatttcggcacgtggcactaaggccgccaccgagtcaacaactaaaatatcgaccgcaccactggaaactaaggcatctgcaatttcaagcccttgttcaccagtatctggttgcgaaagtaacaggtcatcaatgttgacccctaggtgttccgcataaacggggtctagtgcgttttcagcatcgatataggccgccgtaccaccctgcttttgaacttcagcaaccgcatgtagtgccacggtcgttttacctgaactttcaggaccgtagatttccacgatccgaccacgtgggtagccgccgacacccaacgcgtcatctaaggccaacgatccacttgaaatcgttgaaatagtcgtctgggcagcgtcacccatccgcataatcgcccctttaccgaaattcttttcgatctttttcagggcagtatctagtgctgctttccgtgcatcagccaaattatttcctcctttggtgctcgtttctaactcttaatatcatagctgttcaaagttagaattgcaagcaaaaagcgaacaaaagttcgtattatttttttaagtccgtatcttcattcaatgcatgtctcaataggtctaacccggccatcacactgcgttcccgaatttgttgtcgattaccagcaaaatggtactgcttggccttcacgggtcgatcacggtaagcaagaccaatccataccgttccagccggttgaccttccaaggttcctggaccggcaacgcctgtaaaactgataccaacatcagtatttagctgctgcttagcaccactcgccatggccttagcggtcgcttctgaaaccacgccctcagcgtcaataattgcttgtggaacgttcactagctgatgtttggcctcattcgcatacgttacaaagccgcccggaaagattgcggagaccccggacacactgccgatggtactctgaaacagcccagctgttaagctttcagcggctgtaatactcagcttagccgcaatcatttgattaataacagtagtaactaacgagttatcgtctccataaccgtaaaagtacggcccaatggtagccttgatctggtggtcaactttgtcgatcattccccttgcagccgtttccgtcatagcttgggcacttaatctgagggtaacctcgttagtcttggcatagggtgcaatcgtaaccgcctgctgttcatcaatcaagggttgcacccgggtcgccaattcagactcactgatgccataaaaacgcatcactcgcgaatagatttgggcttgttccccatatgcagctgccaacttcggttttgcctcagaatcaaacattacggctaactcacggggtggacctggcaataacaagaaatcagcactattttctgactgataaaacgcaccaacagccattccgttatgattagtcaacggttgcgcgcctgccggatacaatgcctgtaatcggttgttggccgtcattactttgtcattagtggcaaaccaggccgtaattttttgcattgctgcctgatcttcaaccaaggcaacattcaaataatgcgcgagcgtctgcttcgtcaagtcatccttggtcggccccaaaccacccgttaaaataactaagtcattccgctgggccgcaatttcaatgacggtcgacaaacgttgccgattatcaccaaccaccgtttgataatagctatcaattcctaattcggccaatccacgtgcgatgtacgtactgttcgtgttcgtaatctgacccagtaaaatctcggtaccaaccgcgattatttctgcttgcatgccatatatgcctccccgtaatcctatcgattacactcagtgtgggcgcgatgattatcgtcctacattaagtatatacgaaaatgacgatcgaccccattaaaaagattagcattttcaaataccttcatttgacataacctgccaacgcgactcatcgttaaaattatcgactgacaggagtcatgattaattaataagggcaacacgttaatggtatacaaaaacgtctcaccgaatgcaagactcggtgagacgctcatgattaattttatttgaagccatctgcaaacacgtcacgattctgaacaaaataatcaatgccagaataaataacgaagaataagcagatatataacataattgccgcaaatggaatgtggattgccgcaaataagacattgttcagcagcaggaagatgatggcaatcatttgtgtcgttgtcttaatcttcccgggcatagcagcagccatcactttaccattattttcaacaatcaataatcgtaaccccgttaccgcgagttcacgacacatgataatggcaacgacccaatcaggggccgcatttaaccgaactaagatgatgaacgcggtcattactaacatcttatctgccagtggatccgcaaacttcccaaaattcgtaaccaagtgttgaccccgggcaatcttgccgtccgctaagtcagttaatgacgcaaccgcaaaaatgacagttgcaaccacttgggtgactggaattgttgttccagcccacacaacctgtccccaactaaggggtaacaccataataagaatgaaaactggaatcagaataatccgaaacaccgttaatttattaggtaaattcaaagtacccgcctcctccgcaacgttatttgatggtcaaggtaatcgtccgaacttgtgacgtactgttcttcggattaaaattgaacgccttaccattgattgttacggtcgtggcagttgcgttcccaaactggaacttaaccgtcgtagcattacttggtaacgttaatgtatgtgagccatccgcctttagcgttccttgccaagtctgagtaccgttagtcgtaacggaagtccaagcagccttagtagacttgatgaccactttgttcttatccgcaccattcgtcaaagtataagccgtatcgctactgccgttagccttgattgtttgttccttggcagaagacgctttagaactagactttgctgatgaactagctttcgacgaactcgattgcttcttagaactcgaaacttgtacagaagaactgtccgcactcgtgctagagcttgaaccagcgtgcgtgcgaaccgccataaaccaaataaataacaaaatcaaaaccacaatggcagtgacgatgatcgttggtaaatagttacgcacgcggctcgctggtgaagcaggttgttcgcgactagcaactcgggtaggttgaacttcatcaacattttcaacgatggtttcagtatgaacactcggtaattggtctcgatattcttctaacaacgcgttaccatctaaagcgactgtttccgcatattgcttaacaaacgcccgaacgtaaaaatcaccgggaagtttatcgaactgttcatcttcgattgcaatcaaatagcgtttctgaatcttggtgatttgttgcaaatcatcaattgtgaggcctttcgctgtccgggcagcctttaagcgcgccccaatcgttgttgtttcttcgttattttcactcattgactttttctccaccctaagtctattttcaaaatcttacggttaatagtatatcacagcaactaaatttagcagccccatgaccattaaatttcagatttccttaactctttgcttgtggtcgaatctggtattcactgattgcctgagaagtcaataattgttcagcaaccgtctgcaagtctgcaagggtcaactgatcaattatacccggttcatcaaagattgtcgccgtcccgaatagccgttgatcataccggttcgcgattgcctccaaggagttcgccatgaagacgacccgcccaatcatttccttcttgactaatgcgagtgctgcttcctgaccaactacagccgtccgccagttttctagcacatcaatgatggctgcatcaaactgggctggatcatccgtttcaccactaaaagtgacaaaattaaatccagactgtaattcgaaatcataaccaaacgtatcatcgatgataccctgatcatataatcgcaaataatctgctgacgtatcgccaaacaataattctaataaaacgttaaccgctgcacggtacttcaaagcagcagcccccgcttcaatcggcagcaagcctttgacaccaacgattgatttggcccgattgactggcatatcaatcgtccgataaggaataatgtcatgtccatccgttgcggtttcaggaatcttacgtccaatcggttgaaaggcagcaaattttttagttgcttgattagtcgtaatccaccctaacacttcgtctggatcaaaattaccaaccacaaataacgtcatgttctcaggatgatagaacgtccgataagcggcgtacaagtcatcagccgttatcttagcaatcgactcagtcgtccccgcaatatcatattgtagtgggtggttcggatatagattaccaatcattccgaaatacaggcgccaacttggatcatcatcgtacatctcaatctcttgcccaataatgcccttctccttgtcaactgtcgctggcgtaaaatacggatcttgaacaaaatctaagagggtcatgaggttgtcctgcaggtgccgggtagctgagaacaaatagctcgtcttcgtgaagctagtgaaggcgttcgcgctcgccccgtactgaccaaaaatttgaaacgcatcatggttagccttctcaaacattttatgttccagaaagtgggcaattccatctgggaagcgttgcatttcagtacttccggctggaacaaaggtattgtcgatcgagccatagttcgttgtaaacgttgcgtacgttttgtgataaccggccttgggtaacaacgtcaccgtcagcccattatccaactgagcttgataacaactttcattaaattgatcatatttttttactttcatgcggttaccccactcaagaagaacccattattaagggtcaccatcttcgcgactgcaatgatctgttcacgcgtcacactttgaatctgccatagccattcagtatccgtaacgcgttgttgcgttaaatcatcgatcaaggcttgcacagcgaatgtccgttgactatccaaactggactcaaaatcgttgatcaagcccagcttcagctgttcaactaaatcatccgtaaaatcaccggcttgaatcgccgttaattgggccgcaataattgctaacacttggtcatgatttttgccatcaatcccagcttgcaccttaagcaccccacggaaagtatccaatgagctgctggcatagtaagccagactcgccttttcacgtacattcataaacaatttagacagcggtgacccaccaaatagttcgttgaaaaccaaggccgcgtaataatgattgccacgataaaagactggcaaatcataacctaaatttagctttgcttggctgagtgcctgttgttcactcacttcgacgtactggtttgtattatgatgttgataaaatggccgtgggcgccccgtcagtcgatcctcaaaaccagcttgttgccactgagctaaaacggccgcctcatcaacgtcacccgtcacgataatatcgatttgatcattttggatcatcatttgataatagtcgtacaaaccttccgcagtgagggctgccaaatcactcgccgtaccgtaacttggcacttgttgcgcaggttcgtccgcaaacaacgccgtatttaactgctgtgcagcataatattgcttatcatcagcgaccgacataatcgccgcttccaaattctttttttggcggtcaaacgtcgcttgatcaaactgaccgtccgccactagcggctgtaaaacgacttgttgtaaaaactggatggcctgatttgtcagtggctgatccgttgccaaataccgttcattcgcaacggtgatggctaattgcaagttatgcgttggtcccttacgactaacacccgcaccaaacgcagcaccatacatggcagccaatgcgttggctaacgctcgctgatctggataatcacgagaacttgtttctaataaattcgatagtagcgaccgctgagtaattgtttcacgtgcaagcggtgcccgaaaattgataataatctggttggttttaaattgatgactctgaaccgtcgtcaattggaccccttttgctaactgagtttgcaacatgtttcctccttgcatatgtaataaataataagcgaaaggccggattgacgcaactttccgtcctattgttttttttattttcagattatggtcgccaaaatgattattttcacgattaaattaaattctcgtgagtggcaattaacattgccaagtcgcgatttgtctgctattcttttcattattgataaaattaaggagcggttaatgtgaaagtaattaaatttggtggcagttcccttgctagtagtcagcaactgcaaaaagtcctcgcgatcgttgaggctgatcaaaaacgtaaatatgtgattgtatcggcacctggtaaacggttcgatggcgacaccaaagtcactgatttacttattcaatatgcccgtcaaacgatccatcatcaagatacgcaagccgttaccgcagctatcattgaccgttatgcagaaatcggtcacgggtttaacgttcccgaagcacaattgactccgatttttgaaacaattcgcaacttaccaaaacaatcatacgccgacaacacctacttgatggcagctttcaaagcgcacggcgaacgtctcaatgcgcaactggtcgccgctgtttttcaacaaagcggcctcaacgctcgctaccttgaccctaaagatgcgggaatggtcgttacggacgttcctgatgatgctcagattatcaagagtagttatgaccagctcgctaagtgggccaacagcgaacaaatcctagttatccccggatttttcgcctacaatcgtaacggccaaatttgtaccttttcacgcggtggctccgacattactggcgcaatcatcgctcggggtgtccatgctgaacgttatgaaaactttaccgatgtcgatgcaatttacgcggtcaatcctagtttggtcgcaaaaccagcggccattagtgaaatgacgtttactgagatgcgcgaactttcttacgctggcttttctgtctttcacgacgaagcgttgattccagcaatcgaaggcaacattaccgtcaacgtcaagaatacgaaccatcccgaggccccgggaactttgattcagtcaactcgcgaacccaatccccactacccggtgactgggattgccagttcttctagtttttgttcactatacttacgtaagtatctgctcaacaaagaagttgggctgggccgtaaaattctaacgattttagaaaatcatcatattagttatgaacacatgccatctgggatcgatgatttgaccatcatctttgatgaacatcagttgacgcccgaattagagaaaacgttagttgcagaaatctcagcggccatcaatcccgatgaaatttactttacgcacgactactcaatcttaatgctcgttggcgaaaacatgcgcaaccgcgtcggcatcatgtcacgtgccgccaccgcattagccaacgacaatattaaattaatcatggtcaatcaaggcgcctccgaaatttctattatgttcggtgtacacgacaatgatgccgatcaagccgttattgcgttatataaagaatttttcgattaacccatacgtccgactagtcaactagtcgggcattttttatggccgtgtttttcatcaattgttgttgaaaggtgccggcaattgaccccggatactcgttcgtcagcatgtacgtgtcctattccgacctccggggctgggtgacaattgctggaacgcagccgacgtcgatttgagctaatgcccaacccgcatcatctcaaatacgagtcttattctaagccgaaagcaacccactttcagctaagaataatttggctactgagcattgtcacccaacccctccagactaaagtgtgcgagggatcacgggttgaatttaagcattgcctagtcaacggattaatgcggtttgggcatcagtccgttggcgtagcaagcacaggattcagcgtcaccgcgcgcgtttcgttaagccgctcgaatggctgattaacggccacttaacttggtgtaattggtcttttaataccggagcttcaaataaagcgtcaggtgtaaatctctatgtttatcgagaagttcaattattgctacattggttcagaaatagtgaaccataacaatatcattttctgtctgaccgttgcttgacaaagttatcgtttataaaaagtaatgacaagtccatcacaagttaggtacatcttcgtccgccattcgaatactgtcccgactggaaggcatttcggccaatgctcagcggtgaaattccacttagcaagcgttctttgcttggttagtggaagaccagtatttaagacgtggtcttcggcttaaatctgtgtccaccgcgttccagcaattggccgaaatgcctggaagtcggcttaggacgacgctagccaagcaagtttatgcaaaactcgaactttttccagcgggccttagctggttgtttttggccttatagcggcacctttcaacaatttttcgtgtataagtttaagccttcaatcccattttgtctgcgtgccaatataaataggctttccaagacatcgtccgtcttggaaagcctatttatgattagttgctcaccgataactggggtcactgaatgacaagtcctgccacgtcacgctagttttcaactttttgattaccaaaccatttcttgttgatcttatctaacgttccgttagccttcaacgtctttaggccggcattaattttgcgtttcatcgttttgtcacccttacgcatcccaactgcgaagtcttccgacttaaaggtgccttgcgtttcttggtaatccgcagagttcgcttcgtgcttaatataatagctcgcgtagacgctatcaatcaagagccctttaattcgcccagcattcaagtcgaggaaggcattcgtgaaggtatcgtattgaactggcgttttcttagcaatcttatccttcagcagtttcggattgttttccaatgactcatagcccgaagaacctgactgaacacccaacgtcttaccaatcatatcgtcaaatgagttaatatgatttttctttaaagaaacgaggacttgcttgttcttcaaataagtattactgaaagccaccactttttcacgttggggatttttcgtgtagccgttccaaatcaaatcaattgtgccattgcgcaattcggtcgcattcatggaccagtcaatcgtttgaaagctgatcttaataccgtacaacttaaagacggcccgggcgaggtcgatatcataaccaactagtttcccagacttttcgcgaaagcccatcgggacaaaactgtcgtccaaaccaacgacaacgtaaccgcgtttcttgattttagaccaagtatcttgggtgtcagcgcgtttagtcacattttgaccacagccacttaacgtcgttgccatacccaggagcatcacaacgatcaaactgagtgcaaataatcttttcttcattctgacgccccctattgcttcttggttggttcaacgtggaacatttcatccgcgatattttcagcaaaggttaaatcatgggtcaccacaatttgagtcatgccatcagcctttaagcctaaaatcaacttttcaacttcctgtcgtaagttcgggtcaagtgctgaagttggttcatcatagcataagacattcggtttcatggctaatgcccgggcaatcgccactcgttgcttttgaccacctgataattcgaaaggatactggtcagcgtgatcaccgagattcaaacgatctaataaagtctgcgcctgctgttctgcttctgcgctagactgctttaagaccgtggtcggtgctaaagtaatattctgcatgactgttaaattgggaaacaattcaaaattttggaatacaacaccaatcacactatcgttactccgattagtataggggtcaaatggttggccgtcgactaagaactcaccggcattcaccttttcaagccccgtaatacagcgtaataacgttgttttaccagcacctgaagggcccacaatacttagaatctcgccatccttaacggttaaattcaaattcttaataattgtccgtgaaccaaagctttttgtaatattttttagttctaacatatgatggcctccctatttccagtaactgtagtgtttttcgattcgtccaagcacaaaagtcgttacggctgtcagtgctaagtaaatgattccgactaatactaagggtaccaaagtaacatcgcgcgctgtcgcaacgttaccggcacgtaacaagtcgccgagaccaatgacataaactaacgatgaatccttgaccaagttgatgacttcattgccaactgacggtaaaacaattttgatcacttggggaataacgattttacgaatcgtctgccagtagctcagccgcaagacccgtgcactttcatattgaccattgtcaatcgactgtaacccaccacggaagatttccgcgaagtaggccgcgtagttcagaataaatgcgaataacgcggcgtagtaccgtggaaaaacaatcccaatcaacggtaagccgtaaaagacaaagattaattgcagtaacaacggggtaccacgcattaaccaaacgtagaaatgcaataaccattgcagcggcttgaagttagacattaatcccagaccaacaactaaccccaatggtagcgacccaatcagggtccaaatgaaaattttcagtgtcataacggcaccggataataatgatggcaaaatttctaaaatatactgcatgtactttccctcccaaatttacaggtcacattgtcctgcgtccactaatcggtcacgactcaagtacacaaaaaagtccccttgagtcgaatactcaagaggacggttatccgtggtgccacctcacttcgtaataacttcacagttattacctcagggagttttgtgataataaaaaaatcgtccttaggccagcatgcctaagaggacgatttaatcgcggttccacctcatattcactagttgctcacacaactaatctcaacgagtttatcactaaactccgccgctaacgaggccaaccgaaacagcttactaacttcagctgtccaactcacagatgtggttcgttgtaatccttggtcatcttcccatcatcgataactcgctcggcaaggtccttacaactactcttctgttccctgttttttaatgttgagttcatactaatcgaaaattaatcaaccgtcaagccttttttacttgccacgatgaaaaattccggcgattcgtgaccaaacacccggtttaggtgtatccaaattcattaatggcaccgtttcaccttcgattcggcgggcaatgttgcggtagccttgtgaggctggattcttaggatcaagaacgatcggttcaccgttatttgaagtccgaatgacggcatcgtcatcgaaaacgattcctagcaagtcgatcgataagtgatgcgtaatttcatcaatatccatcgtctcaccatcttgcatcatgcgcgtccggattcgattaatcactaacttaggtgcttcggctaacggatattgttccaataaaccaacgacccgatccgcatcacgaattgctgaaatctcgggtgtcgagacgataatagccgcatccgcaccagcaatcgcattcatgaaaccttgttcaattccggcgggacagtcgagcaaaacgtaatcaaaatctggtttcaactcgtctacgattgcccgaacttggtcaggattcaatgcatccttgtccgcattttgtgcagctggcaataaaaacaataagtcatcaaaccgcttgtctttgaccaacgcctgccgtatttgagcacgacctgcaactacatccacaatatcataaaggatccggttatcgagacccaaaataacgtctaaattccgcaatccaatatctaaatcaactaagcaaactttcttgcccatcaaagcaagggccgtccctaaattggccgtagtggtcgttttgccgaccccacccttaccagaggtgatgacaattgcttttcccatcaaacacgtcctccatttcgagtaaatagcttcggtcgtacccgttttaattgctggagcggctggtagtccaacgcttgaatgtcattaatatagacgacgttcgtcccatcaacaactttttcaaggtccactaattctaacaattcaccgactcgaacccgcgggacggtcgctaaggggctaacgatcaccgcatcattgtgatcgggataaccggcctcaagcgcaccgtttacctcacccatcacaaagatactacccgtcgcccggagcaccccaccttcatggatcttaccgaagaacaacacgtcccccgtaatctcaacgacctgaccgttgcgaataatctgattaaccagatgcaccgtatcacgttcaatcatcgctaaagcatccgccgtcaaaataacatctgccgttagcttatgaatactgaataacggatatcgttgaatcaactgtgtcactttttgattttgttccgcagtcagtagtcgactagccgtatccaggtcaaacgagatttgtttatcagtcgtattatcagcctgcaaccgatccaacaagaccttcaagtcgaccataatatcatcgaaacttgcttcttgccgtaaaatcagttcatagccgtcattactggcctttaaaactacactctgttgcatgttagaattcctttctgccgactaattaacactcagatataaccgacgcattggataatataatatgacaaagatggctaggttgaccgcaatcgtcggtcctagcgtgtacaccgcaaagtctgctaacccactagagatcacatggctcatcgtgtaccaaatatacgtaaatgcttccaaaatggtcaaattaataatatagatcatcagtaacgttaaaaagttcaggtcgatccatggcttgatttgtcgacatatatagactaccaacggtaagccaatcatgtaaacgcctaaaatcccagtatagtaccagtcaaacaccaagcccacgaatgcagaccagattccaaccgacagattatcacggtcgtctaaaaagacagcgaagacaatccacagtaaaactaggtgtaagacactggcgtacgggtaactaaatagtttaccggcaaaaacatttgacaccgagccgtctaaaaagagtgcaacaaataacccaattggaaagatgatttttaatcttgagtaacgcaccgttgcacctccctactgttcagcgaccgtcacaactgttaagtcactaaggtccgctgcgggtgtgatttccacttcggatgctagcccgtaatcatcctgcttgacactagcaaccgtgccgacataaagtcccttcggcgtattgccgcctaaaccactcgtcacgactttatcgccttttttgattttaacgttagacgtcacggaacccatctctaaaagattattgctcttatcataacctgaaataatcccgttaacagtcttaccagcactattcgtaatctgaatagcaaacttattcgaagacgaactcgtattagaaattaattcaaccttagaattcgtttggttaacttccacgacccggccaattaaacccttttgtgacatgacaggcatattcttctttacaccggatgtcgcacccttagagatcacgagttggttcatccaagatgatggtgtccgcgtcaaaacattggcggtcaccgtcgtataatcagataacgaattatttaatttcaactgcttgcgtaactgcttgttttccgcacgcgtcgtctgggcactaaccttggcctgcgccagttgatcaacttgcttcttcaatttttgattttcttgataggtgttcaacaagtcagaaactgagttggtcgcactttgtaagccattgactggccaagcaatcacccggtcaaccgcaccagccacatcgtttccaaattgttggatcaatggtggtgtcgatttcttatcacgaatggctactgagacactcatcaagccgaaactaataatgaacacgacaatcgcaatcactagttttcggttagaaaaaaacttttgcataatgaacccccggtcgaaaattcaatgatttaacaataaataagcgggaagacgtcttcccgctcacctgttatcgctttttcataacgtcgatgctcttgagtgattcaccggtcccaactgcaacacagtcaagcggttcgttagcgatgaaaaccggtactttggtttcgtccgcaatcacttcggaaagattcttcaataaggcaccaccaccggtcaaaacaatcccgtggtcaattacgtcagaggcaatttctggggaagtttcttcaagggtttctttaatggctgaaataatttcagagaccacttcttggatggcttctgaaacatctacagatgagatttcaaccgtctttggtaagcccgacaaaagatctcgtccacgaatcgttgacccttccaagtcttcagcggcttccaaagatgctgagccacagtcgattttaagttgttcggctgtgcgttcaccaattaaaagattaaacttctggcgaacatggtaaatgattgagtcatcgatcttatcgccagccattcgaattgaacggcttgatacgatcccacctaaggaaattgtcgcaacatcggtagtcccaccaccaatatcaacgaccatgctcccagttggatccatgactggcagccctgcaccaatagcggctgcaaatggttcttcaatgacatatgcatcccgcgcacctgcaacccgtgttgcatcaataacggcccgcttttcaacttcggtaaccccacttggtacacaaaccatgacgtatggcttaccatttgagcggccgagtgtcttttgaataaagtacttcatcatcgcaacggtcgtatcgtagtccgcaataacgccatccttcattggccgaatcgccacaatgcttgctggggttctcccaatcatatcccgtgcttctgaaccaactgatacaatttcaccagttttcgtgttcttcgcaactacggatggttcacgtaatacgatgcccttgccgtcaacgtacacaattgtgttggccgtaccgagatcgatcccgatattctttgtcccaaatccgaacactacattcatcccttcatcattaacaaatttaattttttatttagtcataatagtaagtattatagcatagtcgcactgcattaaaaaagcattgcctgaatcctagcataccgtaaattaatgaaaaatacagtcccactatttaacttagataaaatttaacaaaaaaaacgcgatcaggccgattaaattatcggtcctaaccccgttattttaccacattctgttacgaatccgtattacaatttaacacgccctgctcggcaaaactaaagtaatcgtttacaccgataataaagctatccaagagcggtaaccccatcagttcacaagccagttgtaaccgcttggtaaattcaacgtctttttttgacggcgtcacatcaccactcggatgattatgtgcaataacgacccgggcagtcggtgtcgttagggcaactttaataatttcccgcggttgagccggacaactattgagcgtgccctgaaagacgacctggcgtttgatcacttgatttttcgtatctaagcataacaattgcaactgttcctgctctaagttggcaaagtcccgtgctaaaacggctcccagttgttcactaccatatacctgccccaaaattaatcgacttggccggggtaatagttgcccacatctgagcgccacgattaaaccttgccagcgcggattttcagacgactcatgtaaccactctatagcgtcctctatcgggtactcacgctcaaaggcctgcatcgcgctagtcaccgcgtcgttgggtaaaaacgtcccaaagtaggcttgcattaattcacgaacttgtgctgtcggtatttgttcttcgctgatcatcgtcattgaaaccaccctttctacctagtagtttcgtaaagtgaccggctaaccattaattcaccgacattttaacgcaattttttcagttaactcacaatcatctttgataatatcagtaccaaggacgcagtattatttcttgcgcaattgtcttctaagcatccgtgtcagcccctaatcagtttctgagtcgctgccatccttgaaataagcccgtacgtcactaataaagtacagcgaccccgttagtagtaacgcatcatcactcgacatttcttggagtgtctgcatcaaggcagcttgccaattatcaaatacttcagcggtccggccatttggcatttcatgtgccaacatcgtcgggtcggtcgctggacgttttgcgttcggaccttcgaattgtgtcaaccgtaattgaacattaggtaatgcgcccaaggtctgaatcatttgttgatgctgcttatccgctaagaccgcaaagatgacataaacggtttgctgtccaaatcgctcactcaaagtagctgctaattcagttactgccggctcattgtgcgcaccgtcaatcatgatcagtgggtcctgattcaagcgttcgaaacggccaggccattgtgttgctgtcacagccgctttgacgtcgctagtgaccacgggtagctgagtcgcttggtggtaagttaggtacgccgctattgcaacggccgcattatcaacttgatagtctcccagtagcggagttgtcaagtctttaaaatgcgcctctaacccgtcaaagttaaaccgttcttgccagccttggggcggtaataatttggttgtaaaatcaactcccaacgtccgcaacggcgcccgtttgctcatggcggtatcaatcatcacttgctgtgcttcagccggtaatttaccaacaattaccggcacctgcgtcttaatgatacctgctttttgagtcgcaatcgccgtcaatgtattacctagaatttgcatatgatcataaccgatcgtagtaatcacactaacggctggtgtccaaacattggtagaatcgtataacccacccaacccaacttcaataatggcaatatcgattggctgagcagcaaagtaaagaaacatcattgcggtaatgatctcaaattctgtggggcccccacttgccaatgtcgcgtcaagcttggcaacgatcggttgaatctgttgcaccagaccaacaagttcttcatcgctgatgggggtgccgtcaacactgatccgttcattgaagcgaacaatgaacggcgacgtgaaagttcccaccgttagcccatctgccataaataattcgcgtaaattcgcaaccgtcgaccccttgccattggtccccgccacgtgaatgccggccacctttaactgtggatcacccaattcatgtaagaattggcgcatacgactgagtgtcggggcttttttgaactgagtccggccgtgaataaaggctaatgctgctgaataagtgtcaatcatgttggtcttccttcctgtaaaccgcgcgaatcatcatttggccgtttgctcaccatacttctagctaatgagcccttatattttacgttttaataataaaatggtaaccatcccaaaacgggacgattaccattttaccagtaacacacatttcagttaactattatcgcaaattaagcttcagccttaatatcaactaaacgttgctttaaggcagctagttttgtctgattgtccgctaacttctctttttcactattaacgacgtcttcaggggcattggcaacaaagcgttcgttacctaacttcttcgtcgcccgtgcggcttcgctttcaaacttggcttgttctttttcaagttttttgacttcttcatcgaggtcaacaagttcagctaacggaatgtaaacttccgcatcactaatcacttgtgtcatggctaacttcggtgcaaccacgtcggcgccaattgacagtgtcttcggatgtgcaaaccgttgaatataatcttcattagctttgaaaacagcttgtaaccgagtgttgtccgtcttaattaatagatccacggctgatgacatcttcgcattagcttctgctcgaatgctccgaacggccgtaatcaattcaataagtgaggccatatcactttccgccgtttcgtcatcaaattcaggatggtcaacaggataagcagcgactactaaggattcaccaacgtgtggcattgataaccaaatcttttcggtcacaaatggcatgattgggtgcaataaccgtaagatttgatccaagacataggctaacacgttttgggtattggccttggcttgagcgtcatcaccggtcaagacttccttactcatttcgatataccagtcacagaagtcattccagataaagttgtacaaggctcgaccagcttcaccaaagtcaaacttatcaaaggtagtcgtcacttgtttgaccgtcgcgttcaaacgactcaaaatccacttatctgctaacgtccagtcacttgcagctggtaattccggtttgtccatggtgcccaggttcatgataacgtaacggctggcgttccaaatcttgttaataaagttccatgcagcatccatctttgtatagctgaaccgcacatcttggccggccgtcgacccgttagataagaaccaccgtaatgcatcggccccgtacttttcaatcacatccattggatcaatcccgttaccgagtgatttgctcattttaacaccatgttcatcacgaatcaggccatgtaaaagaacattcttgaatggtcgccttcctgtaaattcaagactttggaaaatcatccttgaaacccagaatggcaaaatatcatagccagtcactaaggtattcgttgggaaatagcgcttaaagtcttccgcatcagtgtttggccagcccattgttgaaaatggccaaagtgcacttgagaaccaagtatccaacacgtctggatcctgttcccagttttctggatcttttggtccatcaacaccgacatacgtttcaccggtcgtcttgttataccaagctggaatccgatgtccccaccagagctggcgtgaaataacccaatcatggatgttttccatccactgcttaaaggcatcttcaaaccgcttaggaataaagtcaacggcatcgtcaccctcttgattcttcaaagcttgttcggcaagtggcttcatctttacaaaccactgggttgagagccgcgcttcaacttggacatcagtccgttcagaatgcccaacgctatgcacaattgggtcgattttaatcatcaaatcttgatcttcaagatccttgaccatcgctttacgtgcttcaaaacggtccataccttcgtatttacccgcattggcgttcattgaagcatcatcattcatggtgttaatccgtttcaaatcatgccggttgccgactttaaagtcattcgggtcatgagcaggcgtgattttcaccattccagttccaaactcagggtcaacgtacgcatcggcgataattggaatttcacgttctgctaatggcaagatgacttttttgccaaccaattccttgtaacggtcatcactcggattaaccgcaacggcggtatcgcccatcatggtttcaggacgagtcgtggcaatttcaatgtaatgtttaccattgaaagtatagtctttgtcagcaaatgggtacttgacgtggtagaacgcacccttgtcatccttatgaatcacttcgatatcagacaaagccgtccgtgcttgaggatcccagttgatgatgtattcaccacgataaatcaagcccttgttgtaaagatcaacgaagactttcttaaccgcatctgacaggccatcatccatggtgaaccgttcacgagaatagtccaatgacaatcccatcttagcccactgttgtttgataatcgacgcgtattcgtctttccaatcccaaacttgttgaataaacttctcacgaccaagatcgtaacggctgatcccttgttcgcgcagtttggcctcaacctttgcctgtgtggcaatgccggcatgatccattcctggtaaccataaagtatcaaaaccttgcattcgtttctgacgaataataatatcttgtaacgtggtatcccaagcgtggcctaaatgcaacttacccgtgacatttggcggtggaatcacgattgaatagggtttagctttcttgtcgcccgaaggcttaaataaatcttggtctaaccaagtctgataacgacctgattccacggcggtcggatcatacttagttggcatatcagtagttggttcttctgacattggggcacatcctttcttttggcactaaaaaagtccactcatcctattagactaggacgaatggacttcgcggtaccacctaattttaaagccatcacaagtgatcgctttacagcttaaacatcgttgttaacgaacggtgtatcccgtccggctattcctactaaaacagttcagaatagcagctcgcaagctaccttcacgctaaaaccgccaagcgtgtttcactgttcacgctctctctgttgacgttgtttatcgctactctcttgctcattgctggttgtcactattgtaatgaatttcctgagtgccgtcaatccttattcgaattgttttagggcatccagtgccgcaacgtaatttggctcgtgactaacatctggcacgatttcatgataaacgattttaccggccgcatcagcgacataaatcgcccgggtcaacgtcccattgttgggcaagtatagattggtggcgtaaccaaaggatagttcttcatcggaagccaccgttaagttcttaacgccttccttagcgcaccaaccagcttggtcagcaaccgcgttattggaaatggctaaaaattgaacgtgggggtacttatcagcctgttgattgaacttctttgtttgaatagaacaaactcgcgtatcaatatctggcatcacacttaacaagacaggcttacctagcaagtccttagtcttaatcttttcatcatgggtagtgaacactttgaacttcggtaactggtcaccatcttgtaacggttcaccgactaagtctaatgcttgatcatgaaataatacttgcacgtaaaacaccccttcgataactaatggttttctaatatttgtggtagtaatagtatagctcaaatttaacgcaatttcagtttccgcgcaaataatcgtctcaaaaattatcattcttgacatgcgacgcgttatttgacgttagtcatggtttaaacgtgcttattagttggtttgttgttcgtcagccgatgtgcgtcctaacgtgccaacacgtgtgtacgccgatttcagtatattcaagcattaaaatgtggtgtcgtagccagctggagtgcaagttgggttgcacgttcgagcgaatcgtttgtttgttgttcccagcgggcagcgagtgtgttggccgggtcgtgcagactagttaagatatgttgggcgacttgcaacgcgtgtggttgatgtaaactggtagccatagtttgtagcgcgtcagctagttgttcgccttcagttagctgtcgagtcacttgcatgggggtttcgatggcaacttgttcgttggcgcgctgacccgcctgaatccaattatccgtactagctggcactggtaaccagagcatcagtaaaacgaaccacgttaagcaggtcagttgggacagatcgatgcccgcaccggcccatgggttcagatctaagttacgtaattccaagtattgaatcccatcctgacatagttgtgaatgaccaccagcatgacgcaaccgaacctgaccgtaaaattccttggtcgcacttaattttccattatcaacggccgcttgcagtgtttgacaataatcatttaacgacgcgtacgagaccgtaacacccggccgattggtatacccgctagaactgttgcgtaagcttcgaacgggctgggctggtggcgtaagaccagactgtggccagcagcatggtgagcagccataaagatacgtcagtagccagcgatagtgcaaataattctgcgcaatgtgcaggtaacagtgattttgaaaggtggtgaaatcacgactatctgtctgggcctgatacaatcccatcatcagactagccgccaagctcacattacagtgaacacctgacaacatttgacgtcgtcggccatagcggtgagcaagtccttgtcgataggcgacagcggccgcatccaacttagcgattggaatatcccggtcttctcgtggaagtgtgggcggcatgcttagcggccaaatcagttcaggcagaagcctttgccggacttgttgtgtgagcatcgttaaggcgtgcaacgcagcaaccgcacttgcttgcggttgggtgactaactccaactgtgtctccgcaaagtcccgttgcaggccggacaactcgctgataagtgttggtgataatgccgtatccgccaaatgaccggtcaccgttacccgctggccttcccgttccagcccaatctgaacaacctgtgcattgatcaacgccgtattttccattaataattgttgccactccatccactcacctcgctgattcaatctaaatttatcgtagcatagtcacgaccttggttcgctgattatgacctattatttagctgacttaccattacgaaatgagcttccgcgcgtccctgcttgatcatccaaaaaatcaaaaaaacgagtacccagtattaccgggtactcgtttttagggtaataatatcacccgtttttgacctacaatagttcagcaaaaacgtcttcttgtgtattcaaataattttcacccggcttgatctcagtcattttaacaccagccaaagcgcgtgccatcagtccttcaacatcaatccgttcttcgtaggaccgtgaacggtctagcttcggatgcgtcttgggtgctggcggcgcaaaaatcgtacaacaatcttcaaatggcatgatcgacaagtcataggtatcaatatcttcggcaatcttaataatttccgtcttgtccatggaaatcactgggcgcaaaaccggcaaggtggtcacatcattgatggcaatcatgctatccatcgtttgtgaagccacttgccctaatgattcaccattaaaaatcgccttaccatgccgttgacgcgtaatggcgtccatcaaacgcatcattaggcgccgttgaacggtcataagataaccctcgggcactttttctttgatttcttcttgaatctcagtgaatggaatctgaataaacttcacgctaccagagtaacttgctagcgttgacgctaactgcttggcctttgctaacgcctgttcactcgtgtatggcggactgaagaaatggaccatttccatgtccacaccacgcttcatgccaaggtagccggcaactggtgaatcaatcccaccagaaagcatcagcattcccttgccagcggtgccgaccggtaatcccccggcaccctgaatcgtttctgatgataagaagataccgtttaaccgaacttcaacacgtaacacaatgtccggattcttcatcttaacttgaatcccgtcaacgtggtccaagatttgcccaccgagcatgtcattgatttgatttgtatcgtattcaaactgatgatcggagcgccgtgtgtaaattttaaaagtcatccccggtttaaactgggctttgaccatcgcaatcgccgtttcatagacggcatccatgtcggcatcgacgcgaatacttggtgaaaagttttgaattccaaaaactagcttcaaacggcccatgactttatcggcatcctcaccatttaacatgatgtgcatccggtcacggttcgcgtggacctttagttctggaaagtcgtgcaacgctttgcgtacgttacggcctaagctatcgataaagttccgccggtttttacccttggtcgatagttcaccataacgtaccatgatttcagtgtactgcatgaacaagttcctttccgttatgcgtctgcattaatttttgagaatttttgataaagttgatcaaatactttaataaactggtcagcttctgccagcgtattattctcatcgaggctgacccgcacagcactcgtcgcaatgttttcttgcacgtgcatcgccattaaagtactggaggccaagtgtttcttcgatgagcaggcactcgttgttgagatataaatgccctgatcttcaaacgcgtgaacaatggtctcgccccgcacaccgttgatcgtaaaacacagtatgtggggtgcgaaccccgtcgttggctgactgaaaatcgtcactttaggaaacgacttaatgtgctcgtagattcgctgtttgatagctcgctcacgagctaccttaccatcttcatccgtgagcaacaatcgcagggccttcgccatgccggcaattgctggtaagttctcagttccagaacgccagttactttcctgaccgccgccattcattaatggcgctaacttacgaccattgcgcgcgtaaataaagccaaccccgcgagtcgcatgaaacttgtgccctgaaaaggtcacaaaatccacccggtcattcatgatcatgttctggattcctttaccaattccttggactgcatcaatatgaaaatgaattttcggatattgtttcagtagttccgccactccaagtaaaggctgaatcgtaccgatttcattattgactgccatcgttgacactaaaatcgtgtcaggccgaattgccgctttcaagtccgccacgttgatgcggccttcctgatcgaccggtaagtaagtcacttcataaccaagttccttcaattgttccatcgaattatgaatggcaggatgttccaccgccgtggtaattagatgcttcccaaaggcccgcttttcaatcgctgtacccttcaaaacccaattatcgccttccgtcccaccagacgtgaagaaaatttcgtgggcttgcacacctagtaagccggcaatttgttgacgtgattgttccaacaaatgaaaggccgtttcaccaaagttatgcaaactagacggattaccccaaattttttgggaaaccgttgtatacgtctccagtacggcaggagcagcttgcgtcgtcgcactattgtcaaaataaatcattactacgccttctctttccaagaaagtgtgcattgcacttactttcgataagaattctttgcaattataccaaatattactagtgaaacaagggtttttgtttcaaatttctgattaatcacacgacaattgcgtcctaaacaccatttttgttggccgttcccagtcacccttctcagaaccatcacgactacttgcatcatgatgccaactaaaaaccagctggtggcggttgtcatttaacaatcaccaccagctggttattttcagttaactaaaattttgcatatgggcggtcccaactatcctcgtcaggcctcatcgttcatcttatcagcttgtttgttcgcatagtaactgtcctcaatccgtttataggaccccggatcaactttatccacagctgttgcaattacttctaaactccgcgcgtagtcatgagtctcggtaaacaaccgttgtgcttccacgctggcttcttgcacctcttcatgattcgtcttgtaacggttagcgtattgtaagagctgttccgccataaccgcagcatccgttaaatcactggtcttttcctttaaggtcgccatgtccgcctgaataacaatcaactgtttcgtgatgtcttccatattgatcacaagcttattaatatcatggtcaagccgttcgatttccttggcaactactttgaaatagtccaaatagtctttcggtagtccaggcaagttcaaattttcaacctggcgtttgatcgcgtggatttcaaaatcgaaccgttgcagcgtctcgtgggctttggactcttcagcggtcaaactcgccacacctttgttaattgccacttgttcttcttcaatgcctttcaactgctcatcttgttcggcaaaatgagctgcgatctcactaaagacagcttgcttactagtaatagctgtgacgtccgcctgataaacagcttcgatattcttcagttgttcgttcaattcacgcgtccgttcaacttcgccattattcaacgtatagctttgtgctaatcgatccaactcaatttgtaagcggtgattctgattcatggcatgtgtcaagaacttactgatttcttcttgttgttgatcaacaacggccttagcatcgatctctgcttgcatcacgtcgtataagtggtcgatccgcttttcaatcgcatgattgccgttttcagcatccgtaactttcaaatcaccaagtaacgcaatattatcgtcgattgcttgctgtaacgctttgatttctggatcaatcgattcgacctcaaagtgaaaatgttgagccgttaattgttgataaccactagccagttcggctaactgatcaggaaacccactcactaggtccttataaatcggtggaatccgatcaatatccatttcaagagtgccagtatcgtgatgtaactgatccaaaaccttttcagccgcgtcatgatcgccagccttggctaattcggaaaaatgatcaaaatcactttctaagttagctaactgatcctccaatttgtcgatgctcggaccaaatgaaaagttttgcgataataacgtcttccgtatgttttggtacttcttctctaaactagccactgcttggcggtgcgcggcatccgcgtcatctaaggcctgcaagccctgacgaatttctgcctgtcgttgttcaatcgtatctaatgtggccgcaaccttcttcagattctgctgagcatcgagaaatctgatgccccgcgcctgcgaagtaatggccgttaattgctcactaacggcgggtaactgatcattatcaacttcttgaccagcgctctgcaacgcttccaacttcgctaacgatccgcccgttagtccgagttgttcaattttttcgaaatctgtggtctgcgattgcttgactagcgcctgttgccgttccgtcaattgacggacttgcttgtcgatataaaattgaaagcctttgaccgccgcgtagatgacaatcgcaaccacaacaatgccgattgctacttgcatacgaataccccttacattatttattccgttttaattgcgttgcgcctcaccctgttgagaaccgtaaccttgcttttttctgaaaatccaattaaaatctatcttaaattataacatagacgtaactaacggacagtaacaatttattaacattcaaggaggattttttacatggctaccacggaaacatcacttatgaaccaacaactcgacgccctactgtttcaagaaactaacctggtcgcgaacttagctaatgctagtgccctcctcaacagtacttatgacaaccttaactgggccggcttttacttatttaacgaacaaactggcgagctcgacttaggtcccttccaaggcaaagtcgcttgcatgcacatcaaagttggggctggtgtcgtcggaactgcttttgaaacgcaaacgaaccaacgggtagccgatgtccatcaattccccggccacatcgcttgtgacagcgccagcaactctgagatcgtggtcccaatcaccaaggacggccaccaaatcggcgtactcgacgtcgactctccatcattagaccgattcaatgctgataacgaagctgaattgaccgaatttgtggcgattctgacgtcacacattgactaatcagcattaaacgtgttatgctactctttgtgtaaaataatgcagcagtgagtgggtaagctcgtcaacagattggtgccaatattttggtcagttagtaacctgcggctgcaatggtgaaacctgcagtccaatctgaacgaatatcgaacttacatcggattattttactccaactaaaattattggaggaaacattttatgtctcgttatacaggtccaagttggaaaatttcccgtcgtttgggaatgtccctttcaggtactggtaaagagttagctcgtcgtccttacgcacctggtgatcatggccaaggtcgtcgcggtaagctttctgaatacggtacacaattacgtgaaaagcaaaagttacggatgatgtacggtttaactgaacgtcaattcgctaacttattcatcaaagctggtaagattcgcgaaggtaagcatggtgttaacttcatgatcttactcgaacgtcgtttggataacatggtttaccgtttaggcttagcaacaactcgtcgccaagctcgtcaattagtaaaccatggtcacatcactgttgatggcaagcgtgttgacatcccttcatacgaagttagtgtcggccaagttgtctcagttcgtgaaaagtccaagaagttggctgttatcaccggtgctgttgaagccgttgttgcacgccctaacttcgttcaattcgatgctgataagcttgaaggctcattaactcgtttaccagaacgtgaagaacttgaagcagatatcgacgaatcattaatcgttgaatactacaacaaactttaatttccggtatttaaaaaccgtcgcgtttgcggcggtttttttgtatgttctgttaatttcagacctgacgctcagcactcacagccgccatgaccggttgataaatcgacaataattgtttgaatgttgtgatgatcaatttattcaacgtatcagcatcttcaaataacggatcaccgaccaagactgcgcggcccacgaccaactcgctgtgtttatactgatcgaatttcttgatggcctgcgtaatattggccggtgttgcaagttgcgtggccggcaccccatgattattactgataacatagcccgccggcaaggccttcaaaagtggtgttaaatctgcgagttgcatctttgcctgcacggccggtttacactcatccaaaatatcaaaatagataaacaaacggtcaggccatagccccaattcaaaatgtggccaggctttgtagctccgtttgttttgactaaaagcgacccaagtgtctaccggtggattcttaaatcgccgtaaatgtttggcaacgtgcgcgtagaacggtggctcgctaggtgtttgtaaactcgctataatcgttggtgcgacctgttcgaacttaggatcgatcaccgttttgattaaatgcatgcggcccgctaacgtctggtcattaaaaatttcaaaatcttgatttgtaaacaagttttatcatccccaaaactaatttagattaaccataccgcattcactaacgcaacgctaccccccttcccttcgctattattggaggaacatgctacaatgataattactatcaaggaaaggatgttagacaatggctgaaacagataaacaaccagttgaccgcatcgaaacggccatgcacgggacgccaaagttgcatcccgacgaacaacgcaagtacctggggacctttcgggaacgcgtcgaagtcgcagtgaccgttgcccaaattaaacaggccaattacgtcgacgcacttcatcaagcatttacgagccatccggatgaccaattatatattaatggtaatttagaccaggaactgattgggccgtatatcaaggcggctagtcaagccaatatcaaattcactatcaaaacggatgacatctaccacactgctgatgatgattacgcgcttgtattcactgctgcaagcgccattaaccaagatattattgatgttgcgcagcgttatccctcgcaggcttcatcagcaacaccccaggccgagaaaacacctgggttgctagataaattcaaaaagttactttaatacaacaaaggtccccatccacgcacggatgaggacctttttacgtttgactgcgttaattacgcgctagagtgccataaagactcatgataactaaggccgcaacaatgatccccatgaggctgactgaaacccatgctgttgtgacgatactcagtagtaacaatatcccaccaccaactagcgtatagcccaaccaataacgaacacgccgccaaatcattggccgaatcgtgtgaccacctcggtgcatctgcgcgtattgatttgcactgattgttggcaaataattcccgatggccatgaaaataaaggcaatcaaactaacggcaatacgccaaatatccaattgatggtctaagttataactgatagttgtcgcatagatcacacttgatagtacaggcacgatccaaatgatcatctgttcaaaccgtggcgccggtgccttatgattggcattcaaccgtgtcaccccaacgcaaatcagctgaaacgccatcatcataattggaaagccaacgaccactaataattttgcggccattccattaggttgattatccaaattaaaatgaatagccattttggcgggcaaggccgcataattcacgacgccgtagctcattggtaacagaataacaatatagctcagccacaactgcaagttcctttttgtcatcacttttcatccccctgctttggactaaaacgatatagccacgtcaacatttcctcaaatacgctcgcatttagctcatagtacacataatttttttccttggtcacggtaactaaaccagcttgcttcaaaagcttgagatgataagacaccgttgcattacttaacttgaaatgagccgcaatctcaccagccgattgccgattctggcgtaaatcttccaaaatctggcgtctgacaggatctgcaattgctttaaaggtcgtattcaacgccatacgggctacctccaatcacctatttagatatatatctaaatagagtataacaggcaaccaggaattcaacaagagatatttagataaaattcgaaataggtgttttcaatcatgacacttaattatgagctatcaaaaaagctggacaaggccagctttcttgtttttaatcttcatttttaaacaatgcatccaacaactgccccgccactggttgggcagtaccaaacattgggaacaagtgcggatacaagtacggcgccgcatgaatacccaagtataccgccatttcaggatgctctggcactaattcggcatagagattgggaatcatcacgtcgaccccagcgaccgctaagtgtaagtctgctaccagcttttccaccgcctgcacataggattgatgcatatcagccgtcgcgtctaacacgtccgccccgttaccaaaagtcgcatcctctcgtaataagatttgagttccccggctgaccacagaatctaaggtcaagtgatatgagtccaggcgataccgttcgatcgttcctaactgtagcgctgattgaggccacttaaaagcggtcccgcgcaacgctcgaccatttttgcggtcaagtaacgtcttgactgttgagcgaccatcaccaacaatattggctggaattcgttcgacgattgcttgcacacgaccatcgataaccaaaaagcgataacttgatgcgactaccactttctcggccattaccgcggacgtttgctcaaatagttgccggacgacttgttcaaacagtccgcgttcgggcataatccgaaagacaattactttgtgcgactcatccgccgcttttaatacgatcccaccagcttgaacgtaccgatcataatcagcaatcaactgattagctgtatgatatgtctgtgaagccggcaccggaaccccgtgctcagccagaatttgtttggccgctgctttatgtgtcagtacggtcgttagcgcctgtggatttaaatccgttccgctcccattcacaactaattgcgaccgtcctaacttagtcaatcgtaaaatgttagcgtgtgggtcaacaacgtccacctgcactccccgcgtcaaggcctgctgggctagttgctggctcgatagatctagcgcggtaaagcccgcaagttcaaacggacgttcattgctcgattcctgatagcgtgcagcccgttcgagtgcccatgctaacggatcggcttgcatggcaatctgcgcactcagcgtcttctttggatcagtgacccgcgacttcaactgtttgagtaacacggcatcttcatttggtaggccataggttttaacaaaatcagcaagtgcatctaaaacttgaacagccggcacggcctgagcactagccgtcgttggattttcacccaaaacttgacgggtcaattggtcagcttgagcgttgacttgggataccatcttagctggaagtaccggcatcattacgaaataactcgccaacaaacgaacaaatgccaccgcgttcgcgtccaccccgactggactagttggatcgagatccaagccccggtattcaagataatagaccccctgccgggccatcatagctagctgcccattactccgaagccgaactggcccgtcaaaatcattgaccgacaacaactgctgttgacgaacagccgccgtcaacttggccacgtagcgatcaattgacgtatagtctcccgtcacttgactgtagcgaccatcgggatgttgaacactactgcgctgtggacgactcgtagtatccgtaacggctaggcgtggtgaagcgccaaataaatactgaatcagccagttcatgcgcaccaatccctgagcgactttcagataaattgcattgcgaaagtcaacataactgtgatactgctgatggaaagtctcagtatataaacgggtgaataaagcttcattcaagctcatattcacgtgactaccagtcgtcattaatcgctgtaactcatacttacgagctaagtcgcgacgacgctgatagctgacttgatcaacatcagccagtggcacgttcgttagatcatccggcaacacaggcgtactcgacagtggccaaagtcgttcgtccgcatcgagtgaccgccgtgctgcggtattcaagcccttcagatacgctatcaatgcaggaatgtcacgacgtaccggcgtagtaaactttaaagcacttgcggaaaagcccggacgtaactgatgattttgttgcgctgatccaaacgcttgcgggtgtgctgtcgtcgctaagtgaccatggtcgtccacccggtgcatggtgacctctagtcctaaattagcctgatgaacgagtgggactaagtgatactgtacaattgccttaccaacggcatctaattccataatgatcaatcctttataattattttgttcgttaaactgattattcggtgtccttcattgtaaatgctataatagttgggactagttttgcaaggagggatttcaaacgatgcaacaaccattagcctaccggatgcgaccaaaaacgctgaaagacgttgtcggccagcaacaattggtcggcccaggcaagatcatcgcccggatggtcaaagccaaacgactatcatcaatgattctatacggcccaccaggtactggcaagactagtatcgcgagtgccattgccggttccaccaagtatgcttttcgcatgctgaatgcagctaccgacagtaaaaaacaacttcaaatcgtagccgaagaagccaaaatgagcgggacggtcattcttctgctggatgaaatccaccggttggataaaactaaacaagactttttattgcctcacttagaaagtggccgcatcattttgattggtgctacgaccgaaaatccatatattagcattaatccagccatccgtagtcgaacgcagatctttcaagttttcccgctcactgacgatgatattcagcacgcggtggaacgagccctcgctgacgaaaaaaacggtcttggcagttaccacgttgatttagcacccgcggccatgcaccacctgtgcaccgctaccaacggtgatttgcgcagtgcccttaatgggttagaattggccgtattatcatcgtctccggccgatgacggcaccatcgccatttcacaacaaacgattgaagaatgcttgcaaaagaaagccttatccgcagataaagatagtgacgcccactacgacgtgatctcggcctttcaaaagtccatacgcggttccgacgtaaacgctgcattacactacttagcccggctagttgaggcgggggatttaaagagtattatgcgtcggctgatggtgattgcctatgaggatattggattagctaatccagccgcgtgtgcccacaccgtcgcagctgttcaagctgccgatcaattgggatttcctgaagcacggattccgctagctgacgctgtgattgaattagccttatcgccaaagtcaaattcagggatcagtgccattgatgccgcgctcacaacggtccgtgacggccatttcggtgatatcccggccgacatcaaggatgcgcattatcaaggcgctgccaaactcggtcatggtgttggatacgattttccacacgatcacccgggtgattgggtcgctcaacagtatttaccagatgccatcaaatcagccaagtattacgagcccaaaacaaatggccgctacgaaacagcccttgcgcaacaatacgaaaaattattaaaggctaacgagagaaatcgctaacaataccttggttgtgctaataattgcaacttttatttttatatgctagactaagagtcgaaattactaaggtgtgcgcattgctctaaacaaagtgttgccgaacaattaatactactttgggatgtccgttagctaattccataacatgtcttatcctttggtagttagcgaattagtcagaacgtcccacctgccttaaagcgggtcaatactgaagggcgattaacggcaccactagtttttccggaagtttacttccgttggtcaggacttgttcctggcctttttttgtggcgtgaaagcgacccaagttcacaacgtcattttactaacaccgtccaaaactcatggggagaatggttaattgggaagccggttatacatgactaatctcggctactgaaatacagtccatcacgctggtttgggtatttctgcaacaatccggcactcctgaacaattactcatcctcataaaaccagcatgacgtgtgtcgcaatcatttgacgctaaattgtgttgtgtgaactactagtactaatcgcttatctttagctagcattgcatttgtcttctcttccggaatcaactaaaataagattaacatcacctgttggaggttcattttgattacattactgcttgtcatatacacgctcattgcgggttggctcagttattatctgctgacgcaccagtcccgaccatttctcttttttgacccgaacaaagcgccgacaatcaaacacgtcgcacgctatggtggcggcttaatgttactagttaccatcgcctgtttcgtgaccatctttgttcaagcgacaatgctaattgccattgtactggctagcggttcactgattatgatggcaattgcactaattttagtgagtttcatgcaaatctcatagaaaacgctttttattttttgcgaaaacctttacaatatagttataaagtaatgaggggtgagaatgatgttacaacaataccaacacattttagttcctgttgatggttcttatgaagcggaattagcatttaaaaaggcggttgccgtcgcgaaacggaacggacctaacgcctcagttcacatggtccacgtggttgatacccgtgctttccaaaacatttctagttttgatacgaccatggttgaacaagtgaccgatactgctcaaaaaacgttggacaagtacgttgcagaagctaaggcggacggcttagataacgtggattattcgattgaatatggcgcacctaagacgattattgcgcgcgacgttcctaaggatatgggcatcgatttaattatgattggcgcaactggtctcaacgcggttgaacgcttattgatcgggtcagtcaccgaatatgtcactcggatggctgtttgtgacgttctcgttgtccggactgacttggaaaataagccagctcctaaaccaaagaaaaagtaatcttttgatacacgtacaataaaaatcggctcagtgaagttacttacctcactggccgattttttactatttgccaaaatcataccacttactgctctaaaattgcccggtaaagcgcctgaccaagatcattcatcgcgaccgtttgcgcggtacgttccccactagcagtcatcatcgtcatgataaaagttccctgacgattctgaacgatggccgcatcattttgaacaccgtatgcttgatagtccccagttttgttatagatcgtcgcgcgtgttggcagatttttgaccaacttactgtgatccgtgttcgccttcaaaatcgttaacatcgcgtgatcggctttgttcgagatcaaacgcaggttcgccagtcgtttcagcaccgttgccacatcccgaaccgaagtatcgttatcatgcccggcctttagtgcggcagtatccattaaccgccgagccatttttgtatcagtcagacccaactgtgcaatttccgtgttgaccgccgagaagccgccaacacgatccaacatgatattagcagccgtattatcactctccgtaatcatgcgtttcgtgatttcagcatacgtcaactggcttccagctggtaatgtgtgcaacgtcccggttccaccaactttatcggcagcacgcagggtataacgatcctgcatgcgccaattattttgatggacctgatcaaaggcagtgaccataataaataacgtgatcaaactgccagcacgttgcgctcgattattcaaaaccacggtctggctacccgttaatggcatcaccgctaccgaagtttgaccagccaacccattcgttgcttgcgcaaccagatcagtaactgtcgtagtcggaaatgtctgtgttgccttcatcggtgcgtcagaatcgctggcagccggcttatgcacctggcttttacctgccgactcggcagttgccgatgtcgtagacgaccacaatagttgtcccacgatatagccgccacccagcaatagtaaccccgcaattaataccccaaggagtgtttgtggcctaaagcgactcgaaaaagttgtccgccgtgattgttgacgccgccgctggactcggctttgctgattgacatcaccattcactggcgttagacgatgaccacattttaggcaagtcacggcatgcggtgaattttggtaaccacagttttgacaactcatcttcacattccccccggtattaaaaataggacagtcagcggtgtgccgtgcctaatgggaaccgcaatatctcccattaagcgcggccgttcaccgctaactgtcctatcacgttatctaagcgtcgttagccacttgcaagggtgcaatatggtactcggccatttctttcgtgattttttcggtcaaactactgttatgtgtcaccagacttaacgcatacgccacgtaatagtgatcatgcgctgactggacattatttaaaacaacttcattggccgccttttgtgcatacaaacggtctaataaataaagtgactgactctcctgagccttcttgagtgccaagtcgatcaactccaaagcttcctctggaaaattgatcttagcatacaattgtgcggctgaggcgtaaatcaaaatttcattttgtaagtaatcgtcgtcacccatcggcattgcttgcgcatccattgtgtgtaaggtagcaactgcctgtttgacaaaaatttcagccttgtcataggcctgcttacgttcataagctaagccggttccaagtgtggccaggatggcaaacatatcgtgactagacttgacgaactgattaagcaacatcccaaagttaaagatggcttcgtcagcattgtcattgagcactaattgaagatagccctcatagtaataatactgtttcttatccgtattactacgtaactgcttcggacggatatgctggaacacatcctgagcctcttccagttgtgtatgtcgaatcaaagtatcaatttttttgaaggtccgatataactggtcgtcattttcaataatgacttccgataaacgaattcctaatcgattacaaattttcatcataatcttcatacttggaattttactttttttctcgattagactaatcgttgcctgagtacaaatcccatcagccagttccttctgcgacatgcccttccgctttctgaactgccgcactttttctcctaatattctcatgcttaacccctcttcattgattgccttaaaccaaactcattttgtaactccccttgctgcccccactaaatgaacaagggtatcgtgacacctaatcaatcctcgttaatccgttcgaataattgagcactaaccaattggacaataccaattacgcatataattatattcacataacggaattttagcaagaaatacgcgtaattcttatttaatattaagtttataccatgatatcggccgaaggtcatttattaattatccaggcttacagttcgttaaccaccctaatcaaggacttgttcattaaaagtgagaactactgaaagcgatttaaaggggagcgaattaaccttattaacagcaaacatcaattgtcatgacaccctcaattaatcggttgacgtggcttaataattaagattagttctcatacttctttcagtagtttataaccaactaactaaccaatttatcaattgataaaaataataatgcttagattgaccctgtaatcttcgtagttggcccggtcgatttgtgatcagcccgtcagcccccatggccgtcagtcgctgcattgcaagcggccgatcaacagtccagaagtagacgatccgatgttggcggtgggccgcactgatctgctcacgggtcgcggtcagtgcttgtaaagaataaaatcccgcgacggaattagaaaaatccgtcagataaaacggcgttatgaagccaaccggtagttgcgccgcccgttgatgtaatcgttcaatcacacgatagtccaaagagtgtaccgcccctttttgttgtatcagtcgttgtgcatagttgtcggcaaaaatccccattagttgatcagccgtcccaactgacttgatttcgactaataaaggttgctgtaatttgtgtgccaccgcaaagtactgcttaaacgtactcaagtagcctttttgaccatgctcccgtagtggtaatccactcaacttatcaacggggtactcatgaacgggaccgggttgacccgctaaagctttcagcgttggatcatgcatgacgacccagtggcgatccgctgtcggctggatatccatttcgaccatatcaggctgaacttgctttacagtccttttaagcgccgctgtggtattttggacaccgtcacgaccattaacaccccgatgtgcaataattgctagcggcgccgttggtggcgttcctagccaccagcctgcgtaaccacccaagactagcaaaccggtcaacgtaagtagcccagtttgccagttagagtgaccggcgattgctgtttctggccaaaggcgcgaccaccatcccataaacattaaccaagccagcagttgcaacacagtcatcatgaaaactgcaacaaattgactgaccagctggctaacagcgccactagcccacactatgccaccaccaatgattgccataacgagccagctaatcaggaacagccacacatttcgactttttttaaagactgtccaccaggaaatccgccaacccgttcgccaataattacgccagctggtcggagcggtcaattggcgttggagtgctggtaaccacttccagctaatcagccagcccaacagccaaagtggtcccgccacaggaagccagtcataacgcgtattaaagattatattttgaacagtcgctggcaattgtatgctcgcttgtaaagttgctaaatagcctaaccaaccgagtggtaaccaccacaccgccgtaaacattaacagcacccagcgatacaaaaattgaccggcctgccacgactcatgattactacgagcgaccatggctggtaaccaggcactcaaaagcaacaagcctagcaagctgactaccccaccgaccagaatcccgagcaccttagcgagtaccgccagcaatatgccggccaaccaccagcaggctagcggtccagccagttggcgcgctccctgcatcactaagtgccatccgcgacttaacaacctgacccctcctcacaaaaaaaggcggccgtgatgaatcgcttcatcccaaccaccacaaaactcattactatcttattccgcgtctaacgcaacgaaatcatagtgaatatcagattgacgtttgaattcatcaaaaccaagttggatcaattgatcgatcaacgccgtataactaatgcccgaaacttcccatagctttggatataaactaatgttagtaaaaccaggtaacgtattgatttcacccaagtatggttcaccatcttcagacactaagaaatcaacgcgtgccattccttttagaccaagcgctttaaacgcgtctagcgacatctgttgaatccgtttcgtcaaatcagctggtaattcgactggtaattcgaacgtcacaccactcgcatccacgaacttattattatagtcgtagaacgtgtccgtcttcggcacatcaatggcaccaagcttagatgccttaggattttcattgcctaagatcgagcattccacttcacgcggattgtcaatcgattcttcaactaaaatcttgtagtcatatttgaacgcatcggccaaaccatccaagtattcttgttcattctcagctttatgaatcccaatcgacgatccttgattggctggcttaatgaataaatgatcacccacgtggacttgtaaataagcgtacgtcatttggtcccggttttccggtgtaaccaccacgtacttggtgttttgaatatgatgatgcgttaaaatctgcttcgtaatatccttatcaaaactagctgccgacgctaagacaccactaccaacatacggctttttcaataacttgaacagcccttgtaaagtaccatcttcccctaagttaccatgaaccactggatagaagatatcaatatctttggccagtgtcaggttcttgatgggagctaatggatcactcatgtccaactttggcatttcttcggcgacgacttgatcttctggttcaccatcaaatacgcgccgagttgcagcatcactcaagacaatcccgttcttcgtgattaaaaacaagtcaatctcgtacttattcttgtccatggcatcataaatgttgtgcgctgaacgcttcgaaacatcatgttctgaagagttaccaccaaacaacataccaacatggatctttttttgtgtctccataattttgttcatcctatcaaggtttatttcatactacggcttagttaattctacaatatctgagcacaattgaaaacatttttacaataaaacgttgttttttacgcgtcaaatggcgcagtcaagacaatcttacccaacatttgccccgtctctacgattgtgtgcgcagttcgcaaatttgctgcattaattccagctaaagtccgcttggtcgtcggtacaatcaccccggcatcggccagttgcgctacctgtgccagaatactcccctgcgtcgccatcgatggcaactgatagttagccttcgtaaacataaactcccaagcaaaattcaaacttttcggctttagtaacgccattggcaaggggtgctgatttgtcactacggcgacgatcgtgccaagtggccggactagcggtgtcactaatggcaagtattgatccgtagagtgtaatagtatcgcatgatcgacagcctgcaaaccggccgcagctaattgcgatcccagatcttgatggtaatctaagacgatatcagcacctaaccgcttaacccattcagtggtttctggcttaccagtcgtcgtaataacttgaagacccgcccactttgccaactggatggccatcgagccaaccccaccagcaccattgatgataaggacgctctgaccaagattcgcgtcagccactgcagtgaatggtaatttttcaaacaatgcttcccaagctgtcagtgtcgttagcggcagaccagctgactgcgccggcgaccacgttttcggggcacacgcaactaaccgttcatcaaccaattgatactgagcatcactccccggccgatcgacggcgccagcataataaacgacatcatctgtcataatcgttgtcactgcttcaccgaccgccaacactttagcaacggcatcaaagcctagtattcgcggcgttgtcactggcgattgaccttgccgctgcttcgtatcgattggattgactgcggttgctaagacggctactaagatatcacggccacgaggttgatttacattaatggtgacatcttgtaaactattcggatcgctcactggcaacccttgcgttaatccaactgcttttgcctgcattcaaaagacttccttccaaaactaacctaaaaattctaattcatcatccaaataatctacgacggccgttggcagatcatcgtgtaatgcaagtgcttccaataatcgattacgattgaaaatctgcgtccattcagcttcactagccggacgagtatgcatcatcaactgctgatgccagtccttcatcgcagttaacaaataatcacaataaagctcatgtttgtttgtaatcaaggtcaaataagtcgatagtcgttctggctcgccaaaaatcaacggcgttgttaacttttgataacgagcaatcaatgcggccaacagtaataatttatccgcacgtgcgagttgagactcatctgccagttcatctaagatattaccaatatgcgtgtacgcatgcgcccaaccggtggtgcccacaaacccccgagtatccttttcgagtaaaatgtagactgtcatttgctcaacaactagatccagccgcgcgggtgtcataaacttgagacccgcatggtccgcatacaagagcactgacagtaatagtatcgcaaatgaccgctgataaatggcatcattttgcggctcatcgatgtgtgcaaataacatctgatcttgaatcaactgatcaaaaatatcgcccaactgttccggtgtgagtacctgctgctgtaatgcctcgtttaacaaatagtagacgccttgatcacgaaccagcggattcagcgaaccaacgtgtgccatcaataatttgatttgatcgtcgctcatcgcggtcaacgtgcctttcttcaactgctcatgaagtgttgcaatcagtggaagcacctcttcgtcgctcggaatcgttaccgtggttgtcacggtactcggtaactgcttaatcagcgttgccattcgactgggcagtgactgatagatttgtcccgctcgaagttgttgtcttaactttaacactgcatccttaacctgcatcaatttctctgcttgcataatgacctcgtaatctcgaatttaccttctattttagcatgtcagcgcctgtctgcccaaaagaaccattcaatcataaaacgtgacctaattatagacgtcacgaagccaacctgagccaatacccaagtccacaccgcacaccctgattaggccacgtttaatgacaagatgtttcaatccatgcttagaaaaagcttatgcttgcggtaaaacgtccacttgcgacttgataaacttcgctgacgctgctaacgacgctcgttcatcagtggtcagatctagttgaattaatgattcaatcccgtttttaccaatcacagcaggcatgccaacgtatgtcccatattgcggatcaaaagctgaaactgggcaagccagttgtgcatccgcgctgacagcttctgccaatcggacaccacaagtagcaatcgcaaagtttgtataatgcttacccgccatgactgcaaatgccccttgccttgcatcttcttcaagttgatcaaggttcagacctgggaaatttttgataggctgcccattgacgctaaccgttgaccaagctacaaattgtgagttgccgtgttcgccatatacgtaccccgcaacatttttaccattcgtaccagctgcttgtccgacatacttttgcatccgcgccgtatctaagaaggtccccgtaccaaaaacccgttgccgtggaaaacctgtcattcgttgtaaataatccgtcatgacgtcacacggattcataatatcgatcaaaatacccttgaagccagatgccacaatcttgggcgcgatctcccgtacaatcgcttggtttaaatcatactcaccaaagcgacccttggaactattcatatcaatggcaccaatattgccagaagccacgatcaacacttcggcatcggccaaagctgaataatcgtttaaaataatcttagtggttgagcttagacgaggtgacgcgtcgtctaaatcgagtttttgcgccttggccaaggcctcattcttatcgattaaaactaattcatcaacggttccttgttgaaccaacgtataagccactgtcgcaccgacttggcctaacccgatcacaccatatttacgcatgctgcaaaccccaatctgtagtttatttaacttggttagcgtaccttgcaaccgctataaagtcaagcaggacgctgtctcataagaatttaatcaatagtactacttagataatatcaaacgtgcattttcattaacccgcttcggaaagttaccgtagtcaaactccgtgaaaaaagctagcctcagggaatccctgaagctagctcaatcaatcaatattctgatttaagatggtccgtttagtcggccgaaactggcaggatggcacccttgtacttcttttcaatccatttctgggtgctcttagaacgtaaagctttcattagtttcttaatagctggcttgttcttatcacccttacgaacagccacaatgttggcatatggtgaatctgatttttcaagtgcaatcgcatccttcttaggattcaacccagcttgaaccgcgtagttcgcgttaataacgaccgcgtcaccctcgttatttttgtagaatgttggcattaacttagcttcgtatgaatgtttaaacttcaaatgacgtttgttggtcttaatgtcattaaaagttgctgaagttaaatctgtcccttttttcaaagtaattaaacccgcatccttaaataacgtcaggacccgaccatagtcagccacgttgctgctgaccagaacggttgcgccgtctttcaagtcttttagactcttaactttcttggaataaacaccgattggttccaagtgaaccttccccgctgatacgaggctcccattattttccttattccagttatccaagaatgggatgtgttggaagtagttggcatctaattctttcgaagccaatgccttattaggtaagacgtaatcttgaaagactttgatcttcaagttaacgccttcctttttcaattctggctgcacgtgcttcaagatttgtgcgtgtggcactgaagaagcccctacagtaatggttgttgtctttgttgacgatgacttcccacaaccgactaacaaaattgccgttgccgcaactgctaataatcctagaattcccttttttttcataattccgtttcctcctatacgaactttaattaacccgtttatcaatatgccgaactgcaatatccccgataaattggaagataaacacgataatcacaatgattaccgtcgccactaatgtgatggcgttgttattggactgaaacccgtcttggtaggccaaattacccagaccaccagcaccaatggctcctgccatcgcggtgtagccaattaatgaaatcgtcgtgaccgtgattccagaaactaatgccggcatgctttctggcaataggacttttcgaataatctgccaccgggtcgcccccattgattcagcggcctcaatcactccatgatccaattcatggaaggccaattcaaccatccgcgcatagaatggcgcagcagaaataatcagtgatggtaaggccgcgcgcggtccgataatcgttccaactaacttagacgttaccggcaataatagcacgatcaaaataatgaaaggaatcgaccggaaaacgttgacgaacagcgcaacaatccaattcaaggccttagccagcggattctgactccccgccgtctcataaagtaacagacctaaggcgattccgagaatggcaactacgaccatcgacacaatcgtcaaccaaattgtttcccacgtggccgacatcatgctaccccaatcgacatttgcaaatttaaaatatgaatctaatccttgatcattcacggttcaagacctccgtttccacccgcatcgtttgtaggtacgctagagcgcccttaatctgttcctgatcacccgttagttgtaagtacagcgaaccaatcgccccttcttgggtttggtgaatcccaccctcaataatatttaaatctaacggatacttcttcaacatctctgaaacaatcggtagctgggcttgatcgccatggaacgtcagttgtacgatggttccctttggatatttcgccagcagctggtccacgaccaccgttgtgtcattcagcgacggcgtgacctcttcattaacaaaccgcttagtcacagcctgctgtggtcgcttgaagacttcaagtactggtccttgttcgacgattttaccagcttccatcaccgcgacatgatcagaaatcttgcgaatcacgtgcatctcatgcgtaatcaatacgatcgtcaaatggagcttctggttgatcgataacaacagatccaacacttcatcagttgtctgcgggtctagggcactagtggcttcatcagaaagtaaaatctgaggatcattcgcaagtgcccgggcaatcccgacccgttgcttctgaccacctgataattctgacggataagccgtttcccgaccggccaacccaaccaagtctgctaagtgttcggctttcttacgggcatccaccttggacagaccagcaatttcaagtggaaacataatgttctccaaaacggtccgcgaccataatagattaaaatgttgaaaaatcatgccgatcttttgacgttgggcgcgtaacttggccccgctcaacgttgtaatattgacatcatcaatcacaactgacccactagtgggtgtctctaagccattcagcatccgtaccagagtacttttaccagcacccgaatagccaacaatgccataaatgtgaccatcttcgatttttaaattaacatcttgaacggcgtgaaccgccccttgcttagcatcaaaggttttcgtcacatctttaaattcaatcaagtcaattcctccttacgcatcaaaaaaagctcctcatcccagacaattacgacaataatcatcaataggacgagaagcttagcctcgtggtaccacccatcttcacaactagctcacgccagttgtctcaagagttactttgaactccgcatgataatgggtgcgacccaagcttagcttgcgactgctcactaaacttcattacttcaagaccatcttcagcttcacgattaatcccctttcaccaatcagggactctctaagtaatcataaccgcgtactcatcttttcaaaatgataacttttttaatcaattgttaatgtaacgagtataccgagcctgtttctaattgtcaaggcctggcaattagtccacgtcgattaaccaagcaacgccgtcttcaacgctatttaacgcatcgaagttctcactcaacgccgggttgaccgcaaccacggtcccattgattggacagttgaattcagaaacggctttggtcgcttcaacgctcagaaaagcgctgttctgactgaccttgtcaccgatagctggtaactcagcatatttcacttcaccaagagcctcatgggcggccttagttaaacctaaccgcgtatgtccatcaacgtcttttgtccaaaaataagctgcatcttcactcatactaaacaccatacctttacaataattttactattcaaaccggtcgttacgactgaacatgtaggacttgtaatgatatcgcatcgacatcattaaacctatcccagccatattggcaatcaacgccgaacccccttgactaataaacggcaagggaatcccagtcattggtaacagtccgatactcatcccaatattttcgaacacgtggaagagaatcatcataatgaccccggttgaaatgtaagcgtagaattcgttcttcgtatcaaacgtcactcggatcatctggtaaatcaataagaaatacaataaaatgaccacggcacaaccgataaagccaaagttttcaccaattaccgagaaaatcatatcagattcacgcacaggaacagtcacgtgggaaacgttaaatccccgcccagtaatctgacctgaaccaatcgctttcatactctgccaaacttgataagcattgttagacgtgtccgtcgacggattcaaccacgtatcgatccgcgcaaattggtattgcttaaaaccgatagcttccaaaatatggcgaccactctgcgagatcacgagatataacgcagtccccgcaatcgccgccacaatggcaaacgtcggtgccaataatcgccacgaaatcccagaaactaagataacgcccccaagaatcgcgaagaacaccagcatcgtcccaaagtcattctgtaacttcaaaaggatagcaactggcaccatgtacgcaattaacttcccaatgagttgccaatcgctcgccatcgtatgtgttgggtgctccgtgttatgcattgtcacgactcgtccaagcatcaagatgaaggcgggcttcatgacttcagacggttgcaacgtcaaggaaccaactgcgaaccaacttttagccccagtgctcgcaaacagtgatctactgtacaagaccaaaacggccgcaagcaggaagatcccaaaccaataggcaatcggtgccactcgccataactgttccgaatcaaattgcatcacaattacggcaatcgcggtcccaatcacgaaccacatgacttgagaaatcacctgcttcgtgacgtttactgaactagagtcgtgcactgcggcgacataaatcgacgccagcccgatcaatcctagcatcatcactgaaaatatgataccccagtcaattcttgaatcctcgtcttgactgcggagtctagattcttctgccacaaataacgctcctaacctgttgggattagcccaccgcacgcgtcagactaaccctattcacaatatcattttgtactttaagatagtttttattatacaacaacctggtgccgaattctcggaaccaggttgaaggtttactaaaaattagcctttgtgtagatggtaagccgacaagatctcttgcagactctcatcaaaagatttggtatgcgcaaatggttggttgtcactaaccatttcagcttcaaatcgttcaccgacttgagtcacttgtccaatcacttgtttaccgatcaaaacttcggtaactggttgaccgttgaccttagtttcgtttaaagtgaccgaaatcgccttatcttttcttgccacggtggtcttcctccttgtattgcggattacgacgcaatgaaaaatgggctggtaccggatcaaagccgcccttaactaagggctgacaacgtaagatacgtgcaactcccattagaacgcctttaactgcgccaaaccgatcgatcgcttctaacgtgtaattagaacaggttggataatagcgacaatgagccggactaaacgcagaaaaggcccgctgataaaagcggatgcctttcattaataaccgtcgcatcgtaatttatttcttgttcttagcagttttctgcatatgttcaagtaaaattccagccccctgagcaacgttgttcaatgggtgttcggcaaccattacgggcacctttaagttttcactgatcaattgatcgaggccactcaacagtgcgccaccaccagtcaacgtaattccacggtcaataatatcggccgcaatttctggtggtaaagtttccatcacgtgatgggccgtgctaacgatctgcatcagcgtttcgtgaatagcttcttcaacttgattggagtcaatgtcaattgagcgcggcatccccgtcacagtatctcgaccacgaacttgggtgaccttatcatcatcgccgtcctgcttgaaaacttgtgcgatttgaatcttaacttgttctgcactgcgttcaccgatcaacaagtgatgttgatctttgacgtagttcacgatgtcctgattcatccggtcgccggccattcgtaacgaactacttgccacaatgtcacctaatgataggacagcgatatcactagtcccaccaccaatgtcaatgaccatattcccacgtggttggaaaatatccatccctgcgccaatagccgccacttttggttcaacttccaagtaaaccttgttaccgccagatttttcagcagcttgcaagattgccttgcgttcaatttcagtagtgttcgttggggtacagatcatgatacttggccgcgacataatgccacggacatttaattttttaataaaataggacagcatttcttcggtgacatcaaaatccgaaattactccgtcttttaatggtcgaattgcccgaatgttactaggcgtctttccaaccatttggtaggcttcggacccgactgccaacacttgattcgtgttcgtatcgatagcgaccacggatggttcgttaaggacgatgcccttacccgatacgtaaattaaaacattggcagtacctaagtcaataccaatatctaaagccatgtttttgctcctctcaaacatacaattatacgactaatcattataccatactctacagttgatgagaactgacggctgtcctagccactcgttcatttgtcactaccaatcaattggctgtgcctaatcatcctgtcgtttcgaccactcatcgaccgtcagcgaataaattgcttcatcacgatattgaccatttaacaagatattttctggcagggtcgcatccaaatgatattggcgtcgctcagcaacagcccgacttgcctggttggcaacgtctgcacctaagatgaccttgtgcagatcaagctccgtaaaagcaatttcttctaatcgttcgagcgctttagtcatgacgccacgaccagtatatttctggcccagccagtagccaatctcaccgttgtgattaatggcactaatattatgcaagtctagcatcccagcgacttcgccatccacaatgatggtggtgataaacacctgtccatgagcctgcttggtcaacattgattcgataaaatgacgctcgtcttgcacggtcgccgtcgcatcaacccacggcatccataacttcaaatggtcgcgattatgatcaactaagtcgaaaagcggctccgcgtcagccacttcagttggtttcaatgaaatgtgtttgtcgataatattaataaacataagctgtcctcctgaatgttggcgccgggttaccccgcttcgccacaaaaaagccttcaaaaacgagtttatcgcactttgaaggttttgtaagcatttatttcgatttattccgcagcttcgttcgcaaaatcaggattcaacgcataaacggtgccatcgggaacatcaactcgtttaatctcagcacctaatttagccagcttaccatggaagttaaagtagccccgatcaagatacttcaaattagtcacttcagtgtaaccccgactgaccagtccagcgattactaacgctgcagctgcccgaagatccgtcgcagtgacctgggccccgttaaagtcagtgggaccatacataatgacggagcgcccttcaactttgaagtcggcgttcattcgccgtaactcatcaagatgcatgaagcgattctcaaaaaccgtttcagttaataaactagtgccctgcgcacacaactgcaaaattgtcatttgtggttgcatatccgttgggaaacccggatggggcatcgtcttaacggaggttggcttcaagatttctggaccaatgacccgaataccagccggttcttccgttactgtgacgcccatctcacgcatcttcgagatcaatggcttattatgttcggcaatagcatcctcaaccaagacgtttccctgagtcaccgcagcagcgaccatgaatgtcccagcttcaatccgatcctgaacgatactatggtcacagccatgcatcgctttaaccccttcaatgcggatcgtttcagtaccggccccggtaaccttagcacccatctgattcaaatagttcgctaggtccacaatttcaggttcacgagcgacgttttccatcgtcgtgatgccatctgcaagtgttgccgccatcattatgttctgcgttgccccaacacttggaaaatctaagtaaatggccgctccgtgtaactggttcgcggttgcttcaacatagccatcgtggcgttcgatttcagcaccaagcgcgttcagcccctttaagtgtaaatcgattggtcgtgaaccaatcgcacagccacctggcatcgcgactttcgcatggcctaatcgtgctaatagtggtcccatgaccacgattgaagcacgcattttggatacgtattgaaatggtgcttcggatgataattgacgactagcgtcaatatcaattgttttattaatttcatcaaaatcaattttagtattcaaaaatttcaagacgttgttcattgtaaaaacgtctgataacactggtacatttgataaatgtgtctgaccagaactagccaacaagcttgcggctaagattggtaacacggcatttttagcgccctcaatatggacatttcctgtcaaacgttgaccgccatgaactacaatttcctccatggataaaccctccatcactaaacgataatcaacaaacaagttacgtgagatttcggattgcgtaaaaagcacacttactaaaagaacccgattggatcagatgcctcgcacctgcccaaattccactgttcaccgctgtactaagcaaatcggcaacgcgcggtgtgcaatccaaacaccagcttaaccatcaaaacaacctggacacaccatggcaacgtgccaatagcagcatgcaggttcaaatcggttcctaatcatcataccatagaacactagtggataaatattacattttacattttcgttacaatttcaacacaaatattaaatacttatgattagttaactaattagaagtccgtcgtgcaattatttgacaagccatacccatattgattagcagtatcgttcgtttgtaatcgttttctttattgtaatctcactataagttgcattctaccattccacttatcgcaatgcccctaatacgctcaatcgattagtaaaatttagttcacgaacatccgcgccgactggacaaaacatttcaacgtcgcgacaaaattggccgctgaaacgtttaagttcgctgtaaacttagttgttcatgtttcctatgccgacctttggaattgctgccaattgtcggaacgtgatgatcacccatttaagtcgcgatccacgtcttaattactgctctgccagatactgatgcaatattggcgaaaaatattcgaatcagaccgattcttctagttaacaacgcgatatcgccattagtaagccagtgcttggcccttgatcaacccacggttccaatcggctttgaaccgtgcaagcttaaaactggacagtaacgggtacgactcaccgcggtaagtttgactaacttgtgcatcgcggcttaactgaaccgcacaaaaaaagcacccgcaaataattgcagatgcttttcagaattttaagttgttaatgccgagcaacattcaaacggttcatggcacgccgcaaagcgacttgggcccgcgccaactcagcatcatcgtgcttttgttgggcattttgaatccgtgtttcagcgcgtttccgtgcattttcagctcgagcaacgtcaatgtcattctgacgttcagcactatcggcaacaatcgttgccgtattattactgaactcaacaaaaccaccattaacggcaatttcgtcatcttcctgatcactttcaagttgcttgatccgaacctcatcgattgcaagcgatgcaatcacaggaatatggttcggcaaaattccgagttcgccgtcaatcgttcgcacgatcaacattggcgtcttattctcatagacctgaccgtctggagttacgatgctaacggttaatgattttgcattgtcagccatgtaaacccctcctaatcagttaccatcgatttcgctttttcgaccacgtcgtcgatcttaccaacttgacggaatgcgtcttctggtaggtcatcatatttaccttcaagaatttctttgaagcccttgatggtatcgttgattggcacatacgaaccaggttggcccgtaaagttttcggcaacgaagaagttttgtgacaagaagaattgaatccgccgtgcacgcgcaacagttgtcttttcttcgtcagataattcatccatccctaaaatcgagataatatcttgcaattcacgataacgttgcaagacccgttgaacttccgttgcaacttgataatgttcttcgcccacgattgatgggtccagagcgattgaagaagaagctaatgggtcaacggctgggtagatcccttgttccgtcaaagaacgttccaagttggtcgtcgcatccaaatgggcgaaagtcgttgcaggtgccgggtcggtataatcatcggcaggtacataaacggcttgaatcgaagtaactgaccccttcttggtagaagtgatccgttcttgtaattgacccatttcagtggctaaggttggttggtaaccaacggctgaaggaatccgaccaagtaaggcggaaacttcagaaccagcttgcgtgaaccggaagatattgtcgatgaataacaacacgtcttgaccttgaacatcacggaagtattccgcaatcgtcaaaccggtcaaggccacccgcatccgggcaccaggtggttcgttcatttgaccataaaccatggcggtattcttcaaaacgccggaagccttcatttcgaagtaaaggtcattcccttcacgcgtccgttcaccaacaccggtaaacacggaaatcccgttatgttcttgggcaatgttatgaattaattcctggattaaaacagttttaccaacaccggcaccaccgaacaacccaatcttaccaccacgaacataaggtgctaagaggtcaataactttaattccagtttccaatacttcagtactggtcgttaattcatcatatttaggcgcatcccgatgaatcgggttacgttctgcgtctggaccgaattctggaccaccatcaatggtttcccctaaaacgttgaagacccggcctaacgtctctttaccaacgggaacagtaattgaagaaccagtgtcttcaactgtcattccccggcgcaagccatccgtaccatccatcgcgacggtccgaacaaccccatcacctaattccaacgatacttccaccgttaaagtgtcatcgttgtccttctgaatgatcaaggcgttattaatatcgggtaacttatcgtttagagagaattcaacgtcaacaacgggtccaataacttgtacaactttacctgtactcattagtcgttaattcctcccacttcgttattcttgcgcaaccaaaccaccagtgatttcagtgatttcagtggtaatagcagcttgacgcgcacggttatatttcagatttaatttatcgattaaatcgccagcgttatctgatgcagccttcatcgcggttgacgacgaagcatgttcagcagtcttggcatccaagattgcaccataaaccaagctttcagcatattgtggcaacacggccgacaaaatggcttcttctgacggttccatttcatactcgggaccgacatctacccggctatccttggctttacgattatctgactcactttgttcaaaggtctcttcggagatcggtaacatcttaacggcccgaaaaccagaagagagccgattaataaagtggttgtagaagacgtaaagttcatcaaagacttcgttgtggtacattgatgtgactgtcttaacgatttcacgaacctctttaaaagttgggacatcagagacgccgcggtactcataagccacgtttaacccgttctttttatagaaatccgcaccagtgccaccaaccgccaaaacgactgcgttatcggcatcaaccttgtgcgtccgcatgaaatcgttagtctgtttcaacacgttactgttgtaactaccaacgaggccacggtccgaagtgatcaccaataaaccagtctttttaacggggcgttgcgcgagcaattcactaactgaaatcgtgttcgaattactgttagcaacaccggcacttgctgacatcagatgagctttggcaagatgtgaaacgatgctttcaactttagaagcgtacacctgatacgtgctggtatgcttttgaatctggttcaattttgaagttgagaccatttgcattgccgacgtaatttgatgagtcttctttgttgagtcaattcggcgcttgacatccattaatgattctgccatgcactactcaccatccttttcagccataactacttcgcagcggcagcggttggctggaattgttctgcaaacgcatctaaggccccattcatcttatcagcttctggtaacttcttggttgccaaaatcgtatcaaagaggtcctgatgactagcatgaataaattcaaacaattcactttggtaacgggcaatatcatcaactgccactttatccaaataaccgttggtcaaagcatataaaatcattacttgttcttcgaccttcaatggtgaatgaacaggttgttttaagacttcaacgatccgttgcccacgatttaatttcgcttgggttgcagcatccaagtcagaaccgaattgtgagaaggattccaattcacgataagaagccaagtcaagacgcaaggtcccggcaacggacttcatcgctttaatttgcgcatccccaccaacccgggaaacagaggccccggcatcaatcgctggccgcacacctgaatagaatgaatcactatccaagaagatttgcccatcggtgattgaaataacgttagttggaatataagccgaaatatccccagcttgcgtttcgataattggtaaggccgtcattgaaccgccacccaattcatcgctcaacttggcagcccgttcgagtaaccgtgagtgcaagtagaagacatccccaggataagcttcacgacctggaggacgacggaggatcaaggaaagttcacggtaagccgttgcttgctttgaaaggtcatcatagacgatcaaaacgtgcttgccgttcatcataaattcttcacccatcgctgccccagcataaggagctaagtacagtaatggcgctggttcagcaggtccggcagttacaacgattgtgtagtccatcgcacctaacttcttcaacgtttcaacttgggcccgtacagttgagtccttttgaccgattgcaacgtagacacaaatcatgtcttggtccttttggttcaaaatggcatcaatggcaacggacgtcttcccagtcttacggtcaccgataatcaattcacgttggccccgaccaattggaactaaggcatcaatggccttgatcccagtttgaagtggttcgctaactgattgccgttgcataataccaggagctttatgttcgattggccgcgtattcgtggtcttaatctcacctaaaccgtcaactggttgacctaatgggttaacgacccggccaatcatggcgtcaccgactggaacttccatgatgcggccagtccgcttaacagtatcgccttcacgaataccatcaaaatcccctaaaacaacgataccaacatcgttgctttcgaggttttgtaccatcccgtaaactccgttactgaattcgagtaattcaccttgtaaggcgttgtcgagtccgtgagcacgggcgatcccatcaccaacgtaggtgacagtaccggtttcagcaactgagagctcagtttgataactttctaattgttgtttgattagagcactgatttcttcagatttaatgctcataaaagtttcacctcttcgtaaactaattgttgatgagtgctcgtcttaaattcgttagttgtaacgcaacgctaccatcaaacgtttgattatttgacttcacaattacaccgccaatgattgcttcatcgactttacgtgacaaaacaacctgattggcaccaacacgcttggcgaatgcctttgcgattgcatcagcttgctcatctgacaacttgaccgcagacgttacttcggcatgcactattttgcgactctcatcgaaacgtgcttcaaacgcgtcaacaatgccaactaagttcgacatgcggccgtaatcatacaacatttgaataaagtttttaatgtattctgaagcgtggtcagtcaaagttgacaacgttgtctgtttttgatcaaccggaagcaatgatcctgagaggacctctgccaattgcgggttgtcgacaaagacttgccgtaattgctttaactcggccaggaatgcttcggtctgatctttttcaactgcaagttcaaagagtgcctttgaataacgacttgcaattgtaagattatcaagactcatgctttcccaacccttcaatatacgaattaattaatgcctgttggccttccggatccaattgcttcttaataatcttcgtagcaatcgcaatcgaaatgtcagcgacgtctgattggacgttcttcaaggcatcttgacgctcctgttcaatatccttacgcgcattttgtttatactgcgttgcttcgttttgcgcatcggcaatgatacttgaccgttgcttttcgccactctttttcgcgtcagcgacaatttcactcgcttcagcgcgagagtgtgatagcgcatcacgccgttgatcagctaagtcactcgcttcttgccgagacttttgtgctgaatcaatgtcgttcgcaatcttgtcggctcgatcagccatcatttttgtgatgggcttccaagcaacaacagagatcaatgccatcaaaacaataaagctaatcccgataaacaacatatcaccaaggtagagaccggatgcaccgataattaaatgcgagagcatctaatgacacctccttctttcattttcattaaaatgaactcgttgaccaatgattacttgttcataaccatcaaagcaacaacgaaggaaatgataggcattgattcgaccaacccaacaccgatgaacatgttagtccgtaattgaccagataattctggttgacgggccatcccttcaagcatcttagaaataaccaaaccgttaccaataccagcacctatagcggcaccacacatagcaatacctgcagcaattgctcccataatctgtgtatcctccttaaaattaaaaaactagaaattattcctcgtcgttaaccttctgagaaatataaactgaagtcaaggttacgaacacgaacgcttgaatgctcccgataaacactgagaaaccttgccataagagttcaattggaaatgagtaaacatagctcaaccaaccgttgctctttgccaaatcagcaaccttcgttagtaacatttcaccagcaaagatgttcccgaacagccgaagacctaaagttaggaaatcggtaaattgttcaaagacgttaacaaccgagaaaacagcaaaaggttgtgtgtattctttcaaataaccacccatacctttcttacgaacacccgcagcatgtgcaagtgcaacggtcataaacgataacgtcaaagtcacaatcggatcggcggttggactcttcagatacgtatactgcccgacctgaacgtgaatgaacaatccaagttggttagcgatgaagataaagagaaacaatgtaaatgcgtacaaaccgaagttagacgcttcgttacccttgatcgaccctttgacaatgccattcgtgaactcgatgagccactccagcacattttgtccacccttgggcttcattgttaaatgtcgcgaaagtaaaaaaacaaacaagaaaacaatcagacaagtcacaattactgagatgtcattcgcgatattaaacgtcagtccaaggaatttgactgtaggaactggatcacccactgaatatcacctctttcctttaatttcggtgctacgataaccttaacctttgagctagtcaacgtcaattttatcgtaacctgaaatggtagattagagacacccctaatcaaaatacaaaggtaataataccaccaccgtcgaaaaaattcaaaataatttcaacatttcgtcaatcaataaaaatccaacaatatcaagctctcattaagctttcaaatcgttggattttcattattttgactttattttcattcttggcacgcgcaatgacggcctacttctcatttaccgccgtctttggcagcaccaagttcatcacaattccgagcaccgttgcaactgctagaccactgaactgaaagcttcccagttgtaaataggcattgccaattccaatgaccaaaatcgctgatgcaatcattaaatttcgcttctgattaaaatcaactttattatcaatcagaattcgcatcccacttgaagcaattaccccaaacagtagaaagctgaccccaccgatgacgggtgatggaatactctcgatcaacgcggataacttacccacaaaactaaagacgatggcaaaaaaggcggccccaccgagcacataaatactgtggacccgcgtaattgccagcaccccaatattttcaccataggaggtcacgggtggtccaccgacaaagccggcgataatcgaggctgtcccgtcgccagccaatgtatggttcaaacctggattcttgaagaaattccgcttagtcaacttattgagtaccataatatggcccatatgttctgacatcgtcacaaaggcgattggtgccatactcagaatcgcgccccaataaatgccaggatgataactaataaaaggcaattgaaaggcgggcatcgcaaaccactgcgctttttccacaccagaaaagtcaacgattccaactaacacggcaatgatatacccacagacgattcccaacaatatcggtactaaactcataaatccacgcaagtacatgttaaaaatgacggtcagtaacatcgtcgccatcgcgacgccgaaatatttaatatcataactactcccgttcatcgttgcgtccttagctgccgtccctgcgagtgacaacccaattaccatcacaatcggccccacgacgatcgggggaagcgccttatcgatccagtcagaaccgattaaagtaactaataaactaactagcaggtacacacagcccaccgcgacagtcccctgagcgatggccggatatcctgcggtcttcatcagagactgcatcacaacgataaatgaaaagctcgagcccatatacgccggaatctttccgcgcgtgatgaggatatacattagcgtcccaacaccagagctaaacagcgcaatacctggatttaatcccaccaggattggcaccaataccgtggaaccaaacatcgagaacagatgttgcaccgacaagcctaaccaactacctaattttggtcggtcatgaatatctaacacgacttcatcattatgaaacgccgctttctttgtcataacgcacccctttttatgaatgattgcaaaagaaaagacagcccaccactcaaagcggctaggctgtccgaaattacgcacagcttccttgaaagcgcacgtccgttcatccttttcagcctctctgagctaatttaaaggaactgtttaattgcaattagtctactcgtctccgaaataattgtcaactcaatgtttgaaccgaaccagtaacagcccctaaaaacgatattagttcaaaacatcataatatttatgacaacattcctgaaataatgtgactttctcacccaacgttaccgaatattcgaccaatacagcgtaatcgccatctaaaacaccctaattatccagtgtcccccaacagttaatgtcaataactacctataatatacgcgttgtacaaattattatttggcattaacggtgattaaaacgtgctaattagattgttgtacgtcagccggtgtgggtcctattccgacctccggggctgggtgacaattgctggaacgcagccgacatcgatttgagctaacgcataacccgcgtcatctcaaatacgagtcttattctaagccggaagcagaccacttccagctaagaataatttggctactgggcattgtcacccagcccctccggtcggtaagccgctcaaatggctgatgaacggccacttaacttggtacaatttgtcgctgactattttgacactggaactttaaacaaagcgttaggtgcattagcactttgtcaagagattaaattttactacaccaattcaggattagtgagctatctcaatatcattttcagtctgccggttgattgacaaaattactggttgtaaaaagcaacgacaaattcatcaaaagttaggtacatcttcgtcagccattcgaacactgtcacgactggaagtcggcttaggacgaaccagcaaagcatgtttacgcccacttacacccgtttccagtggtccatagctggctgcttttaatcttagaaattagcacgttttagtcacgattcatgactaatgaactcacagaatgcggatgattatagctagagttgttaataattttggaaaacaaaaaggtagccccccagacattgcctggcggtgctaccttttgtcaatgcaacttacttcgtaccaaataaccggtcgcccgcatcgcccaaaccaggaacgatgtagccatcttcatttaaatggtcatcaagtgctgccgtgtaaacgtcgatgtctggatgtgcgtcccgaagtgccttaacaccctcaggcgccgcaactaaacacataaacttaatattacttgcgccgcgctttttcaacatatccatcgccatgatggctgaaccaccagtggctaacattggatcaacgacaaataattgccgttgtgaaatatcacttggtaatttaacgaaatattcgaccggcttcaaggtcttttcatcccgatacatcccaacgtgcccaactttagctgccggaatcatgtttaagaaaccgtcaaccatccctaagccagcccgtaagattggtacaatggcgactttcttacctgccaacgttttttgcgttgacttggcaatcggtgtttcaatctcaatgtccttcaacggcatatcgcgtgatacttcgtacgccatcaacgttgaaatttcgttaaccatttcccggaagaccttagtaccacagttcttttcccgaatgatcgtcaatttatgttgaatgagcggatgatccaaaacctcaaacttacccatgttgctacgcacactccttagtgatttctttctattgtagctaatttagagagaaaaaaccagacctgatataaattacttaatcaacatcgatcgggtgcttcgctgttaaagccattgcttgctgtttaacgtcatctagatttgcttgatctgtcggtgcttgtaacgcttgcaaaatcaattcagcgaccttagttgcatcagcttcgtcaaaaccacgggtcgtaatcgcaggtgttcccaaccgaataccagaggtcttgaaagcccctaacgtctcattcggaatcgcttctttgttgaccgtaatataaaccgtatctaacagatcttgtacttggcgaccgttcaaaccagacttagtgacatcaatcgtcattaaatgattgtccgtgccaccagaaataacccgaaccaagtcagagtcattgaagaccttcgccattgccttggcattatcaatgatatgttgggcataaaccttaaactcaggctgtaagtcttcgcccaaagcaatcgctttacccgcaattacgtgatccaacggcccaccctgattgccaggaaaaacggccgagttgatcttcttgccatacttttctttcgctaaaatcataccgccacggggcccccgtaacgttttgtgtgtcgttgtcgtaaccacatcagcatatggcaccggattaggatgtagtccggccgcaactaagccggcaatatgagccatatcaaccatcaataaggccccaacttgatccgcaatctcgcgaaacttcttgaaatcaatcaatcgactataagcagaagcccccgcaacgattaactttggttgaaaatcttgtgcttgtgcaagaattgcatcgtagtttaattcttcagtttcaggatcgagcccataaccttgaaaatcgtaaagtttaccagagaagttcacactagatccatgtgttaagtgtcccccagcatctagtgacatccccatcacccggtcaccaggttgaatcagtgccatatatgcagccgcattggcttgggaaccagagtgtggttgcacattagcatattccgcaccaaataatttcttagcccgttcaatggctaaggtttccacttggtcaatgtattcgttaccaccgtaaaagcggtgacccggatagccttcagagtatttattggtcagcacactcccctgcgctgcccggacgccctttgaaacgatgttctcagaagcaatcaactcaatattatgttgttgccgtgcctgttccttactaatcgcagcccatacttctggatcttgttcctggtaattcatgaataaatctcctccatttcgcaagtgacaactttcgggttttcccgacttgcaatcattatacactaaaatgagtctgaccggcagatttatttaatcggttcatgtaggcaagcccaagtcctttattttcaaaggcttggcacagaatatctttaatttccgtctcagtatcaaagtgccgcaagcccgcgaacagctcccgacttgccgattgaatatcttctccaagcgaaaattgttcgcaattagtcggaatttgattgttagttaaaatatcatctgttgccataacgcccattggcacatcttgctgggctgcccacgccagcgcttctggccaatcttccgaacgatcaacgatataaacttgtgcgtttggcgcatagtgcttatatttcatccccggcgccttaggaacttccttagctccgacatggtgcaattcggtttgaactggcatgccaatgacccgttcgattgcttcaggcgttacggcaccgggccgtagaattgctggttggtcggttgaaagatccagaactgtagattcaacgccaaccttcgtcggaccatcatccagaataccagcaattttaccacgtagatcatgcaatacgtgttgcgccgtcgtcggacttggcttaccagatgtattagcggatggtcccacgataggcgttccggccgcacgaatcaaagccagggttgcctcattatcaggattacggaaagccgccgtctgcagcccaccagtaacttctggtgccaacgcatctggtttcaatttaaaaatcatcgtcagggggcctggccaaaacgccttaatcagcttcttggctgcttccgataacggttgagcaaaccgctcaacggtttccacatcagcaacatgcacgatcaaaggattatcactcgggcggcctttagctaagtacacttgcttaacagcatccacatttgtcgcatcggcacctagcccatagaccgtctccgttgggaatgccactaactgccccgcagttaacaacgccgcagcggccggaatctccgccggcgtatatactttcgtttccataatatattcaaacctctactttattattaattcatcgttactttcatataatattatttattatttacatcacggacttaatcaattgctcataaattcacgccgtacctcccaggttaaaaacagcccgcttaggataagactcacatttgagataacgcgggttatgcgcgagctcaaatcgacgactgcgttcacccacccccgaaggccggaatgggacgcggattacaaacagcaatctacctaatcggcccgcttttatcagcattctccaggataacgcgcaactattgccgagtcagagtcattgcaactcgcagcatccgatcgtgacccgccatatcttgtcgcagcgtcacggtcgcgtcgggcatcgactgcgcgaaaagcgtctgcaaggccggtccctgatggtagccgaattccaagtataagcgaccggccgaagtcagatgatcggcaaccgtcgtcgctaactgctcgtaaagtgccaacccatcgtggtcagcaagtaaggccgtttgtggctcgtgggcgaggacgctggcgtccatgacgtctttttcgctcgcagcgatgtatggcggattactgacaataatatcaaacggctgcgcagatacgctggtcaatagatcactgtgaaccagcttaacatctaaatgtaggcggtccgcattggctttggcaacttgcagcgcagcggttgaaatgtcgctggccgtaatctcccatgccggccgttcgtgtttgattgccaatgcaatggcgcccgagccggtaccaacgtctaagagtcgaactggcgctgtcgctgggacatccgtcaaaatccagtctaccaattcttctgtttcgactctaggaataagcactgctggatcaacttgtaacgtgagtccataaaacggtgcgtctccgagtacgtactgcactggctcaccagcaacaacccggtcaatcccctgctgataagcatgccaaacagcactgggtagcggctcgcggtaacgaatgagtaattgtgtctggtctagccgactcaagcccaataacaggaagcgagcactatcagtcggcaactgggccgtttttagacaaaaagaagcccactgctgggcttcaaaataagtgggttgagtgggcttattcattagttaagcgctccattttttcagcttgatcagctaaaacgagggcatcaataacttcgtctaactcgccgttcatcacccggtcaagtttgttgagcgttaacccaattcgatgatccgtcacccgattttgtggaaaattgtaagtccgaatacgttcagaacggtcacccgtcccaacggctgatttacgttcagcatcatattcgttttgttcccgtgactgatagtagtcgtagacccgtgcccgcaagatttccatcgctttggcccggttttgctgttgcgaacgttggtcttgcatcgagaccacgataccggttggtaagtgggtcatccgcaccgctgaagacgtcttgttgatatgctgaccaccagcaccagatgaacgaaagacatcggtccgaatatctttttgatcaatatcaatgtcaacatcctgcgcttccggcataacgccgactgttgcagttgaggtatgaacccgcccagctgattcagtcactggcacccgctgtacccggtgcgcgccactctcatacttcagcttagagtagaccttgtcaccagaaatgatcagaacgatttctttaaagccaccaacttcagtttcattacgatcagccacttctacttgccagccttgacgttctgcgtacttcgagtacatgttgaacaggtccgcagcaaacaaactagcttcgtcaccaccagcagcaccgtgaatttccatgatgatattcttgtcatcgttagggtctttaggcaacatcaataacgtgatttcatgttccaattgatccttttccgcgttaaggttctttaaatcatctttgaccatcgcgttcatctcatcgtcgagcttttcatgaagcaattcgtcattttcttcgatctgactcgtgacttccttgtagtgattatatttttcaaccgtttcacgaatattacccatttccttagataacttcatgaaacgttgagaatccgaaataacttccggatcacttaatagttcaccgagttcctcataccgatcggcaacggcttgtaacttatcaaaaaacttatccattctcagttaatcctcactttgttaatttcggcgggtaaaaataatgatgacgacaaactgggtagtacgcctcattacccccgatttgaacttgttcgccttcataaacgggctgaccatcgtggaaccgtaaattcataattgcttttttacgacagaaccagcagatcgtcttcatttcttcgatcttgtccgcatatagcagtaggtacttgctaccttcgaacaattcgttacgaaaatcattctttaaaccaaacgtcatcactggaatctttagctcatcaacaatgtcagccaattctaggacgtgatgctttttcaaaaattgggcttcgtcgattaaaacgcacgcagcatccggattcgtttgtttaacgatctcaaaaatattggtatcatcaaatactggcgttgcttcacgtttaaggccaatgcgactcgcaacatagcccacaccatcacgattatctaagccactcgttaagataatgaccgacttatcttgttcctcatagttatgggcaactttcaaaatttcaatggttttaccactgttcatcgcgccatatcgaaaaaataactgtgccaagcgactcattccccttttttacacatttctagtcaattatagcggatttggccgtgaatttcagcattctgtcattaaaactaattaacgaattgataatatgcggttaaatggcgggagtatcacttttcttttagggacgttcagtataaaatacttgagagtaggacattttgtccggtaattatgattttaatacccggtagttggtcacactgatcatttcccaggtaaatcaagaattaggggtaccgataacttatgtcaattaatagtacattagccacctggacgggtaaatccgcatattggtttttacacaccttccgtggcggtgggagctcactccccggcaagttagcgctgaagctcgatccaacgattttaaagcatctcgctaaaaactacgacgtcatcgtcatcactgggaccaacggtaaaacgttaacgaccgccttgacggtcaaggttttacgtgaacagtaccctgacattttaaccaatccaagcggatccaacatgaagcaaggtatcgtcacgacctttttacgggcacctaaagcgcaccaaaagccactcgcagttctagaagtcgacgaagctaacgtaatcatggtcaccaagtacatcacaccaaaagcctttgtcttcacgaacattttccgtgaccagatggatcgatatggtgaaatctacacgacatatcaaaaaatcttagacggggttgctttagcacctgaagcgacaattattgccaacggtgatttgccactcttcaatgccaaacaattgcctaatccgatactgtattacggatttgactaccagcccgaccatgaccaacaagcgccagcaaatacggatggcctgctttgtccgcgttgtcagcatattttacgttaccatagtcgaacttatagcaatatgggcaagtattattgtccccactgcggttttgagcgtccacagttgacatacaaattaaacgccctaaccgctatgacaccgactagctcagactttgaaatcaacggtcaggccatgcatcttaatatcggtggtcaatacaatatttataatgcgctagctgcctacgcggttgggcgcttcatggacgtcacgccggccaaaatcgcgcacgcccttagcgacaacgatgaacaagtctttggtcgccaagagacctttcacgttggcgaaaaggacgttacgctgattctcgtcaagaatccagtgggccttaaccaagtcttgcaaacaatcagcaccgatgaccggccattctcatttgccgctctgctcaacgcaaactatgcagatggtattgatactagttggatctgggatggtaattttgaaaaattaccggcattgaatattcccgcctatattagtgggggtgaacgttatcgtgatatcacgttccggctaaaagttgctggggtaccggaagatcagttaaccattattcctgacctgaccaacatgacgaccgcaattcaaaaactaccgaccaagcaagtctacgtcgtcgcaacttacaccgcgatgttgcaattacgaaaacaacttgctagccaaggcattatcgatggggggatggcttaaccatgacttatacactacacgccgcacacctctacggcgatctaatgaacacgtatggtgatatcggtaacattttagcaatgcgctactatgctaaagcagtggatgccgacatcactgttgacttagttagcttggatgatcggtttgacgaagaaaaatatgacttcgccctcttcggcggtggtcaggattacgagcaaacgattgtttccaaggatttacaaacgaaaaaagacgccttgaccgcatatatcgaagccggtggcccattattagcaatctgtggtggctttcaaatgctgggccattactacgttggggcccatggtgaaaagatcgcgggtatcggtgccttagatcattacacgctcagtcaggataacaatcgctttattggtaatataaccattgagaacgccgaaacccaccagacctactatggttttgaaaaccacaacgggatgaccttcctgggcgaaggtgaacggccccttggtcaagtgctccaaggtaacggcaataatggcaaagatcaatctgagggcgttatctacaagaacacctttgggtcttacttccatggtccaatccttgcacgcaatgaagccctcgccaaacgaatcttgaaactggccttacaacgtaaataccctgaaggcaacttcgatgcactggatcaactcaacgaagacctcactaaaaacgtcatcgtgaaaccttaaaacgtatcactcaaaatcgccactgacttagttaccagccagtgacgatttttttagtttgatccgtattaattggttacaatgataatagttttttggaagccttctcattagtaaaccccttcaagctataataaatatttatatactttcagatagtgattattaataaactgatactatcagtagatgcgcaaaaaaagattgatattggcttccaaccagtatcaatcttttttatcccatcaaggggttaactaattatgccttagccccaggttctgaagcaataatttgtaaatcgcctttcaatgtccattgttttacgtcaaatggcaagataaagtggacgcccttactcaatggatagtcttgaccgtcaacgacaatgctaccttcaccatcaagtacagagactaacgtataaggtgctgttccccggttaaaagttgcttgcccatttgttagccgccattgccaaacaccaaagaatggtgattggacgtatttggtcaccgttgcatccccaacctgggtagtcgtgatgtcaagatcagggtcatgatgcggaacgttagttgtatcaatggattgttgcaaatgcagctcgcgcttctgaccagtggtcttgtcgacccggtcccaatcatatagccggtaagtcgtatcagaactctgctgcgtttctaacaccataattcccttaccaacggcgtgaatcgttccagatgggacataaaggaaatcgccgggcttaacgggcactcgccgtaatagcttattccattcaccgttgttgatccattcagcgagctgttcacgggtcttcgcatgatgaccataaatcatcgttgcacccggttcagccgcaatcacgtaccagcattcagtcttgccaagttcgtgctcgtgttcagccgcgtacgcatcatcaggatgcacttgcaccgacaaatcttcactagcatccaagattttcgttaatagtgggaagacatctcccttagcatcaccgaacacatcacgatgttctgcccatactcgatccagtgtcatgccagcgtacggcccattttcaacggtcgctggaccatgcggatgagctgaaatagcccaacattcaccagtatgatcactgggaatatcataattaaaatcatcatgtaatttggtaccgccccaaattttttcatggaacaccggctttaaaaagtatggctcactcataagatctactcactccattgttgaatttaatatctaaattttagcataaatgaaagcggttgtgaaaccgaagtagctaatttgtaaccgtatccgccaaccaagccgcaattaaccggcgacgtgctggaaggaataccgaattatttgcaactggatgcacccggttggataagaaaacaaggccccgttgccgttgacggtcaagcatcaggagcgtgccagtataaccagtatgaaaaatcaccggcagcgtctcattagaacggtgccagaggttccaaccaaagctccggcgtaagtgttgattgggcgtccaatcttgatacaagcttgcaatcgtggcctgtgatagcacagctggtacgtcgatttggccgagcatcaattgtgaaaaccgaacaaggtctgtcacactggcaaataaaccggcggaaccacagtgttcacctaagactctggccttaggatcatgaacgatcccccgtaacaacccagttttcatggaatacgtcgtcggaacggtttgcgctagttgaggttggaaactcgtgtgtgctaaccctaatggctgcaaaacgcgctcagtgataattggctgaatggccgctccaagaattcgttcaatgacttgccccatgatgatcaagcctaaatccgtataaaccacccgatgattgcggttacgctcactgattggtagctgttgaatcgcggctaataacgcatctgcagacaacgcattccgatttggaatataaccactcagcccacttgtatgggtcatcaaattacgaaccgtaatcgttgtggactgtaaagccggtaggtagtcatgcacggggcggtcaatttcaagttgcccattttgcatcaactgcatcgccacggttgttgttcccacgaccttagtaaccgaggctaaatcatacatcgcatccggccataatggtttgatcgttggttttatttgagcgacgcccacttgattcgtgtgccactcagccccatcaatcaaggcataactcgcccctgggatcacttgatcttggaccatttggttaattagtgctgcggttctactaaaagttaacattaatttattcattctctcttattaggatcatgattcaagttgggattgactgtggctaaaccgccttcaaggtcagtatcaaccaagtaacctggcaaagtgtccacgttttaccctgacaatttctgcggatacgaactgacctgattgcatcaacgacctgcccgaagctagtgctgacttccgaataaccgcggtaatgtgaccaaccaataactgattaaagcggccccgccaatgatgagaagccattgattcgagacaacctgatgattatacagtaacgtacagcccaccaaaattcccgtgctgacccattcaactgcctgccaatgtcgattactccactttatcatcttgcccaactccctttaattttagcgtttcttcagcaactttacatcacaatcagcaatcttaacctaaccgtaacgtccccttagccgaataactgtcgttccgatcatgcgtctactgattagacagcatttcttactattcacaataccacgtgcatcatgcgcacgcacataaaaacgactttagttccacccgtatcacgggtcttactaaagccgtctttttattcacacaaacaacactgtacttagtctaattcaactttctggacccaaccttcaggcgcttcccgatcgccaaattgaattccagttaattcatcatataattttttcgttaccggaccaacttccgtttcactgtagaacacgtgtaacttgccttgatgttccaagccaccgattggtgaaataaccgcagctgtcccacaagccccagcttcagcaaaccggtctaaatcatcaatgtagacgtcgccttgttcagtcttcatcccaaatttatgttctgccaagtagagtaatgaatatttcgtaacggaaggtagaattgatggtgacttgggtgtcacaaaagtgccatccttagtaatcccgaagaagttcgctgaacctacttcttcaatcttacgatgttcaaccgggtcaagataaacacagtcggagaaaccgttggcatgagcttcttgacctgggaataagctagccgcataattcccaccaactttataagccccggttcctttatgggccgcacgatcatattcggacgtcgtaaagttggttggcgtcatcccgcctttgaaataactaccaactggcattgcaaagaccgtgaagatgtattcctgagctggatgaacaccaatgttacccccaaccccgatcatcaatggccgtaagtataaagtcgcaccagttccatacggtggcacgtaatcttgattagccttaacaacctgtttaacagcgtccacaaacatgtctgtcggcacttgtggcattaataaccgttcacagctggtctgcattcgggctgcattacgatctggccggaataattgaacactaccatctttagtgcggtaagcttttaagccttcaaagtcttgttgaccatagtgtaatgctgttgagccttcactaatatgtaaagttgcatctcccgttaattcttttttgtaccaagcaccatctttccaatacgcacgataacggtacggaagattccgatattcaaaccccaagttgttccagtctaattgtacgtctgccatatgcttcgacttcctttatatgtaattttccaaattaattaatttgaatttaattaaaagattaatggttaattagaagtttgtcaagggcccgtcaaacatttccaacgctttaagatttttttggtataatgagtgtaaatttagcaaaggactggtttgtcgtggctagtaattcagattcaatttataacgtcatgttctatatcacccatcacccgactgaaattcagtttacccaaccggaatacacgaatgtcgttcggatgggtgtccccgatcatattaaggtcgctaaccccgaaatttattttcctgacaacaagctattagtcaaccgatttcaggatgactttgtcgctaaaaacggcaacttacttgatttcttcttcgattacacagagaaaaaagtccctaactaccatgaagtgtgggtttcttcggcccatttaccagccaaacacttatacttcttagagttatcatttgagtaatttaacgcacgtaacctttacggtctatttggaatcaaatttaaaatggatcaatcaaaaaatcaccacctggattatgttcatccaggtggtgattttttgattactttacaagcgtaaaatgcagccgacttagaactacgggttcgtcccgtcataacctcgaatagtgagctttacttgactaatcaaagtccagtcgcgctcataaaacattacttagtcataaagatatacaagtcagacgtggagacaccaatcgtgaagcgaacgcccttagaggtaatcggatcgattgtcgtcgtactaccactattatccttggtttccttctggaactgtttcataaccttcttggcattggcgcccgttgttgtcgtcatcaaagcaaacgccgtcccaaagttcttctggcgggtcttgttcttaaaggccttggttggaacaatcatcgctgcccctaatacgtcacccttctgaacatttagccggatcttataatccttagttgttaacacgttcgtgatgccatcacttggcgtcttcgtcggtaacaattgcgacttgacctgctttttcgccgttgccattgccgcttcgacctgcttctgagtcgtttgcaaactagctgctttggtcttgagctgcgccgcagcagtttgttgggcttggagtgtcttagcacccgtggcagccgccgtaccgccagccttgatttgggcctgggcttgcttgactttggcttggatcgttgcttgttgctttttaagggctgcaccctcagtttgcaacttcttagccgcctgttgatcagacttgctgagtttagaagcaatcaaagcctgattgtaagtcgtcgccatcttttgatagccaactagcttcttggcgccctttacgtgcaccgtcgtggtatccgaaccggccttaatcttcaccgtttggcgggtcgtcttggtcggaacttgaataacaaacgtatgattacgcaccgtcgccgtcttcgtctgaccaccgtcaagctgataatgaacctttttaacgttggattttcctttgacggccgctactaacccgttcggcttgtatgtggttttagtcgttgataaggttgtcttaccacagcccgctaataagaacgttagcgcacccgcagtaacggcaaccattgctgttttccggaacaattgacacccctcctttagtcgagactaatattgccagtaaattgactgttatatagatccgcatagaacccattttgagccatcaactgttcatgcgtcccagtttcaaccactgacccatggttcatcacaataatgttgtccgcaccctgaatcgttgataaccggtgcgcaaccacaaaactggtccggttcttcaggagtcgttccatggcatgctgaatatgcacttcagtccgcgtatcaaccgaactcgttgcttcatccaaaatcagaatttctggattagccacaaacgcccgggcaatcgtcaataattggcgttgtccctgtgaaatatttgaagcttcttcgttcagaaccgtctgataaccatctggcaatttgcgaacaaagctatcaacatgggccgctttagccgcagcataaatctcttcatctgacgcatcttcacggccgtacttcaagttgtcaaaaatcgtcccagtaaagagccaggtatcttgaagcaccatcgcaaagtgtgaccgcaagtcttcacgatccaggtcccgtgtatcggtccctttcaatttaatagaaccacctttgatgtcataaaaacgttccaacaaattaatgatggtcgtcttaccagcaccagttggcccaacgatggccacttgttgcccacgtttaacgtccagattataatccttcattaacaggtcgttatccgcataaccaaattgaacgtgttgcagactaatcaagttatcactatctggttcggctggtaagttggatttcgtctgtttcatttcttcttcatcaagcacttcaaagacccgttcagcggaagccacggtcgattgaatcgtgttcaacaagttcgccatttgtgaaatcggttgtgaaaattgttgcgtgtattgtaagaacgcttgaatgttacctaacgaaacgttcccgttagccacatcaatcccaccaatgatggcaacaaagacgtagccaatattatttaagaacatcatcagtggcatgataatacctgaaataaattgcgctttccaggctgattgataataattattgttttggatttcaaaatcatcgatggcatcttgttccttgttaaagctcttgatgaccacgtgtccagcatagttttcttcaacttggttattcaacaaccccaagctcttttgctgtgttccgaagaatttctgtgatttcggcgcaatcacaccaaccaccacgacactcagtggaatggtaacgagtgcaaccaaggtcagcttccaactaatcgtcagcatcatccataaggttccaacaaaggtgacggtacttgtcaccgcttgggttaggttttgctgcaacgtgttggcaatattatccatatcattgacggcccgactcataatgtccccattcgaatgggtatcataatatgaaatcggcaccttttgcatcttacccttaaatgaacgccgcaacttatacacggtccgttgggaaatccgcgtcataatgtactgttgaataaagttgaacagtgctgaggccaagtacatgatcaaaacgatcataataatctgaccgattttttcaaagttgattgggtaaccggattgactgataccagccttctgttgcgcggcccccttcataattcccttataaagttcggtcgttgctttacctaaaatcttaggtgttcgaatctggaaaatcacggaagcaatggcaaaaatcatgaccactgccaaaccgacccaccggtctgacatgtagcgcatcaatcgaatcgccgttttccaaaaactcttaggcttttcaactagtccagcatgaccaccggggccatgaccgccagcaggacgtgcaggcttagtagaactcgtattcttttcgctcattacagctgatcctcctctcgtaattgtgacttcataatttcttgataaacttcattattagctttcaattcagcgtgggtccccttgccgactaacttaccgttatctaggaccaagatcagatcagcatccgccaccgtcgcaatccgttgcgccacgatgactacgacactctgttgaatctgtttatcctggcgtaattcagcccgtaattgagcatcagtcttgaagtccaatgcggagaaagaatcatcaaatacataagcggaagcctgtttgacaagtgcacgagcaattgctaatcgttgccgttgaccaccagagaagttacccccaccttgttcaacgtgtgcatccaggccgccttcttctttaacgaagtcagttgaacgagcaatttctaacgcatgccagatttcatcatcggtcgcgtgttcgttaccgaattgcatattttcacgaatcgtccccgtgaataaagtagcagtttgcggaacaaacgaaacggcttggtgtaaatcagctaacttcaactgccgaacatctttcccatctaatttgaccgccccactctcaatatcatagaatcgggggattaaattaacgagcgtggtcttcccagaaccggtcccaccaataatggcaacggtctgtccagaatgggctttaaagtcaatatctgccagcgctaattgctccgcactttgatatcgatagttgacatgatcaaattctaagctgtgttcagtcgtcgctggtaacgttgctgccttgtcagggtcagtaattttaggttcaatacttaagacttcttgaatccgggaagcggaagcggccgcccgtggaatgaacgcaaataccatggcaagcatcatgaaactcatcaatacttgcatggcataagtcataaacgcaatcatattcccaacttgcattgtttgactactaatcaattggccaccaaaccagacaattgccacattagtcccactcataatcaaagtcattaccgggtaagccaaggccacaatcgtattaaccttaatcgcattgtgcgtgtaatcttggttagcgtcttcaaaacggtcctgttcaaatttatcttgacggaatgcccgaataacgcgtactcccgttaagccttcacgaaaaacaaggttgatgcggtcagtcttagtttgcatcgcccgaaacaacggtattgcaaatgccatgatcaaaccaataaaaatcaatagtaccggaatagaaaccacgaagatccaagttaattcatgactcttggtatacgctaaaaagcttgcaccaatcagcatgattggtgccataatcatcattcgtaacgccatcatggccacgttttgaatctggacgacgtcattggtcgttcgagtgattagtgaagacgtctcaactttatcaaattcatcatttgaaaaattgatgacctttttataaatatccgaccgtaaattcttccctaattgttgtgatgaccgcgccgccaaaaagacgttgccaaacgctgcgacgactgataacaatgaaaaaccaatcatttcaaatccgattttccagatataactaatgtcaccagtagccaccccgttattcacaatattagatgtcaaactaggcagatttaaggtcgcaatcacttgcacgatcataaataagaccgcaccgattaccgcgggatacgaaatccgaccctttgctattttaagcatttgcacgctccccttcattcattcattattacataataatgcagtatcttaatctaactaaaaatggtccttttgtcaaccatctttacaagtctcacgtaaaatattgtaacgcgctcatcgcagtttagcactcaaaagaatttaagaatttattaagctcgccttcgtaataacacaaaaaaagtgctgcgtcactaatcgctgacacggcactatgcctaaatttaagccaatacttcttgtatattttgaggtacctgatttgtcacaacggcctcccatgaattcacgttttgtcccttcgtctcaatctttaaatagtgtcgttgctttagccggtgatctgcggtaaatgtcaaccagcgttgcttaccttgcgcatcgctggtcagcattcggtaggtatagatatcttcgcccatctgaccagtcgagtggccgattgcctgattagtccgaccatagaccgtttgtaccttaacaaatgggtttaagttatccaccgccattgccagctcactcccctgattcttcgtcatcgtcggtacaattaacaatgtacctacactaatcatcataataatcgccaccaaccaaacagcccattttttattcataaacactatcccccgaattaattattttattaatcgtatcggagtaaagttcctctggctaccctaactaggctttcttaatcagtttaaacgattactaatcaaattcgagtttccttaaacattaaggaaattattttaacaatacttcaataattatcgcgctttacatgctattctattagaataggaagtagtttttaaatcatggggggatttatcatgcacatgcggggtatcaactttgtattaggtctcggcgtcgcgctcggcctgttagcaggctgtcaggcggcttcaccggcaactaaacaaaagccagcagtcaatcatctaagactagcgctaaaagcgttcacagctcggctaaacaccaagcacaagcacggccttatcaacattggcataccgtcaaagatgttcacttgcctattttgatgtatcacagtatttctagcgggaaccagttacgtgtccccgccaaagaatttcaaactgaaatgacttatctaaaggcacacggctaccgaacgctgactgccaatgaagccgtatacgcgctcaaacatcggcgaattccacaaaagaagattgtctggatcacactcgacgatagctataaagataacatgacagcagcttggccaattttgaaacagacgcaccaacacgccaccattaattttattaccggctttacccataagaaaaaccacttaactttagctgatgctaagcggatgcaagcatccggtaatattgattttcaaagtcacaccgttcgccatctggatttaaataatttaacttaccaggttcaacttacggaattatcaagttccaaaaaatggctcgatcataatttacaacagaacacacaagttatttgttacccagccggccgtgctaatcagcagaccattaaagccgataaacaggctggctatcagtatgccctatcaacggcacctggcatcgccaccagcacacagaacccatacaatctcactcgacaacgggtcgtacctggaatgtcgctaacggcctttcagacactattaacgagtaataattaattcataggacccttacttgtgacacgatcccaaaacccttttttatgagcgcttaacagtgctgttgtgatcacaacagccaaaacgcaaaattggggttttaatttgataccaattagcaaaagagaagcgtcataatgctgatataccagcattatgacgcttctctttttatctaccgacgtcgacttatcacccgcacggggatcgaacccgtaactccgccttgagagggcgacgtcttaaccaatttgaccagcgggcacaaattcatttattatcttaccgaatgataagcggcttgtcaaatataattaagatttttgccacctaaaaatcgtcacaacaactaaaccaacaaataagagcaaacagtagaccacactacaccaaaaaacgaaagtcaataattgcggtaacaaaaagctgcgcataactgctaatccgatggccgtgaccgcccatacgatcaattgttgtcgcagatgatcgaataaatgatctaattctgacttcgacatacactcaccttccatttaactagtttagccaccaactgatacgatattcaagcaaaaatgcaaaaaatagacacaaagtttcagcaaagccttgacagtatttgctggaaaagttactattaaatagttgttattgggtattcgccaaattggtaaggcagcggactctgaatccgtaatttactggttcgagcccagtatacccaatattcgttatcagctgttatcattggttgtcaaaaacaccgtgattgcagcttttttattactttagtttatcattaattgtcatctcttttcactaaaagtcagccaaaaggacagccaaaaatataacaaaaaagccactgtttccagtgacttaatacttgcgcggggcagtgactgttagccaactttggttagcagtttttttcgttaggccattagtctaacgcttattatcaaggcaatgactgcaatagtaatgtgtatcacaaaaataacctttcttatagttttaggttcatgataatcaaacggccactgaataaagtcaaatactgacagaatcataaagttaaacgctaataaatttagcccataaacagtcaccggcatagacaagctgaaagccatgcggccatattgtaatatgctacatgttatcaaatatgccggaacaatcaacaatgtaatatttacagtaacttcgaacaaccattttttaatgaaataactcatttacaaggacactccagtaaatatttaactgcacattattaattatacagtaaaattgttgaagtttggctatagtagcattcaaaccgttagatcactgtaaaattttgcaaaagcgtgtaatgcttcattcttcatataattaaacttgctaacactaaccgataattggttacaagcttcattgcgggtgaaatgcttctcaataacgtaatcatgtaaaataaattgatattgtggatcatcaattgcatttagggcgtcttcgacttcttttagctggtaagacaggtcaacatggtttatcaggcggctttcagcgccgtttcggctgctatggcttgacactccatcgaatgaggggctggaaacttgattaaaagccgtcaaatcacgttttagtttggcatattgctttaataaattacgaattttcttaacatcttgacgcatcggaatcacactttctgatcccagatatatgtataaaaaagaggctcgggggaagagcctctcactataggatatgataatcgccgttattacgggaaagtaatattaggacaaattacaacattaattttagtaccaatcatttcatatgtcaatcctaagcttcaatttttccacgcagttgttgaatcatactgacaacttgatacggtgtctttgtcatatcagttactctgttttgataccagaattgtgtcagcaaggacaccgcaaaatcgtactgtttatagacagtcagatcttcattcttgctaacggccgtctgcacgtagtccttagcggcgtctaaatagctttgaatcattggatcatcttcggttacatcgattcgcaggcttagtttaatgtcgtctacagtcactgacaactaatcacttcctcataagtttaactttactctcataaaattatatggtataagtatagagtactcattgctcggtagttcagcggtagaataattgactgttaatcaagaggtcgctggttcgatcccagcccgagcagtttccaaaacacatatttatcataaaaggccgtgaccttgaagtcacggcctttttattaccaagtcatagcataatagattacctcaaacactttaaaagcaacatatgcggcgaatacatacgtgatgataataccactgtatgcaaggataaatgtgttcttcatggaatcactcctaaaattatagctgcacgctctattaaaatctgataagcgttatcatcatactatcacttgttgcttgaaatcccactcattttgtcttcctatttaccagcagtcgcagttcctaacgccacgttgattacagcggttttatcaatcacttcataatcattccgcacaattacggaaagaccttggctgaactggtcgaacttgtcccattgggcagttacttggttacgccggaaaacagccaccgcttgtgataagtcccccgcaatcattgggaacgtcccgtccgcgttgttagccagtaatttatcactgatcatgacgactggtgcccctaataaggtgaaaccactgggtgctgttggattaggctgtaataagtaacggccctcggtgtccttgagtgtatcaaggtaattaaacccggattggttcactagccacatcttgctcaaggcgggatctaacgtcacgttgaaaatctttttaagatcatcaatactggtggccgttgctttagcaaagctactacccgttaacagtcccatgatctgcgtgttgtccgtgttatcaaccaattgttgtaattgcgttttgacttcactgacaatatcaacttcggcgtcttccactacttcgttagataaggcaattttacccgcccgggtcttcacatcaaacggcacttccgtaaacatgtttgcgtcaacgtcggcaatgtccgctagttcgttcttagtagccagcaccgcagattgttgactagtggcaattggataagtcccggaaccgctagaaacttgcttaaccgttgcatattgggcaaggttgtacttagattgctttaattggaaaacaggggtaatcagttccttaggaataacggcactggcaccgtccgtctttaaaccgtcccgagtttccccgtgcgtccggacatattgttcaaaggcgggaataccagttttgttttcgttgccattgtcgttgttattgggatcaataattgtttgttttgccatgttatcaggctccttttcttggttaataaatttttcatagctacgggtatcaacttgaacattggtatcgtcataagcgggaacagcaaccactgaaacatcgaacaagctcttaacttgattaatggttcgggtgatattgccatcatcatctttagcccattcatcggtgttgtcgtcactatcaaatccaaatgaacaggaatcaacgttcccactttgaacttcttcgtatacatcattagcaaaagacgtatttggtagttgcgcaatgaaatgtagccccttatcgtccgtttctagcgttaacgtgcccgccttggcactggctaacacttgggtatagtcgtggttattaagcataagcacgtttgataaatcgacaccatcaagggccttgggggttacaatctcggtgaaaccgcctaaatctttgcttggtgagttccatacaattgcataaccactaattgttttgccttgttggtcttgcttatcaggttgttgctggttatctggttgttgttcgtctgttggcggtgtttcagggttttcagcctgtggctgttgtgcccgtaattccgcgttaatcgttaaccgtcggtcttgtttcatgaattagtcactccattcttttgtaagtttaagaaaatattgccatcgtcagttggtggcaagccaatcttggcccgagcttcgttacggctcataacgccgccagtgaaaccagccaccgcttgggcttgttgcgtttgcggatcaaggctcaatagcttgtccgtattaaacgtaaagtcatgaccaaacttgaacgacagctcgctggtaaagctatcaaagtaatgttgcaacgtgccttgaagatactgcacgccgctttgttcttggttagagtgatcgttctcaacccctaagcgctcggggggtaagccaaaggctttagcaatttgtcgggtcgtccagtcattcgagttgaccagttttaatacatcggtatttaatgataggttactaatatccatcgtgtcatcggtcacaatcgtattaaccgcattatcacctgtattggcttcatcaaactggttgcgaatattgcccttggcttccggccctaaatcagattgatggactttaataatcgtggtgccatgcacaccagcagtaaaaaagccggttagcaatttattgccggccgactgaatctggcgctcatctttgagggcatataacggactaattcccgatacgccgtctttggtgaaatatttaaaatgtaaaatgttgttaggcgcgatctgacgactgttaccgccaattggggtataggtgtaggtcaacgccccactgacgtcatcttgttcaactgtcatttggttattttgcacaaatttaagtgtgtgattaggcaaaatctcagcaaaactattgccattgagtaacaagttagccgccaacgcatatttaaaatggtacccgtccatctgactattgggggtctgattaatcatcgtgttaaagattgccgtatcacacataattggattgctggcaatatcgctcgcaataatgttaattgccgcgtaaatgtcactattacgcaacaccgccgcactcacaaacgtatacgggtcattgcttgataaactaaccaaggcgtcggctaccggatcatgcgtgccgctggtggtactgctttttacgaagaaactcatttaatcacctctttgcttttcataattaattagcaaggccagcataatcatggctataccagccaatattaatcccgcttgccagctgatccagcaaccaaaaccaatcactaagcagattaagccaagcaccaacaagatcgtttgtacataatcagaacagatctgccgcagtcgctgttttgtagtaatcttctgcatgctgttgatcctcactttcttggtaatagtccataccggcaacgtaagaattaattaaggctgctaccgggtcaatccggttgctattgcgtgccttatccagttgccagccattgtttatcactttcaagatggcgttattgaccgcataagcgagaatcttgttaccgttatgtttaatcttgccatcgtaaagctggtcacgaaagttacgggtgggaatattcaaagtcttggtgccttgtcgcacttcaaataatggataattgagtttttcaaacttagtaatcaaggtctgcgcattgtatgggtcatacgcgatggcttttactttccagttatattgaccgaccagattttgcacgtagtcgaatagctcatcataatcaatcacaccgctatcaaggcgagtaatactacactcaccagcgcgctccattgaccggtaatcaatcccatcacgtttaatcttagaatccagtccgtacttcgtgccaacaaacgaatgactatcacaataaaactgaccgttgccaattggaacgagccaactaaccgcggtcaagtcattactttttgataaatcaatgccaatataggcgtcacgattatgtaagtcgggcaccttggccaatttaccagcggcccaatcgtctgctgaaatataactgtcctcgctggcttgcaaccacatattgaagttcttaaccagtaccggaataaggttattttgcttaattgcaaggtcaacatcggcctgaattttctccgtcatgcgttgcttaacgtgtggttcactgaataacgggttcgccttgatccaattagcttgatcgtaaacttcttcgcggtcgtccagttcccagattgccacaaaataacggtcagcttcggttttgccctttaaaacgtccgtcagcatgtcatattcggcgtgcattggaacgttaaggttaagacccgaggtggaaatcaccgccagcagggaattatcctcttgcgcctgaccagactttaaaacgttgtacaccttgcggtctttagcttcgtgccattcatctaaaataacggtagtcccggcataaccatcaagcgtactggtatcactggcaagggctagggcttgcgaatcagtttctaggtcggtaatggcttgtttctgtaccttaatccgttgccgcatgtactttgattgcttacggacttgtcgtagcccacttgatagcatgtcgtagcctaatttagcttgtttaagggcgttgctgacgaataatacctgtcggttacgggcgggctgacgttctcttaaaagcccattagcggccataccagaagccagataggttttaccgttcttccgagccatactaatgaatgctcgatcatagcgccgattaccggttgctttttcacgccagccatacagctcactgataatccatttttgaaagggttgcatggtgagtttgctaccgtcagtcttaggcattaattcgataaatttaaccgcctgtgccgctttgtcttcgtcatagtagaacgggaagctgtcttctttagaacggcttaaatcgcgtttaaatcgctcgcacgcccatttaatcttttgaccagccaacacttggcccgataaaacttggtcaacatattcaatcatgacaacatcgcctcgaaagtatcttcgggtgtctcatctttctgcttgtttaattccatgcgggcccggctcgatagcgacatgcctaaatcattggctaaggcttttaaatctttcatcgcttgtgactgcaaggccacgtaagggttcggcttacgtacaccagtatcttgattagtttgtaccagtccgttcttacgaatatcattctcacaagtctgtaccgttgcataagcgcggcaataactggctaacatggcccggtcaagttcactaattggggtattggcctttaaataaggcgctacccgttgccattcagttaaggcccgatcatgtaaccaatctggcggggttaaatcaagcaccggataatcaaacaaggccctttcagcgtctttacgttgatcacgctcatcattggttaaatgtttcttcatactggctaaggcttttactttttggctcattcggagcactcctttcgtttaaatttacgtaccaaaaagcccccacgggttagacccatagcggctgattgatacatatatccagaattcgtttattatacctatattatcgcacatattccgagaaagtgcaattaataacatgtttatatttacacatcaccccctgactgtttatttgttcaaatttcgcattattagtagggatatttcacaatccagcaaaatcagcaaaaaatcaaagttcaaaagggacttttataaacccaaaagtccgtctgtcgctcctctcgggtcggccatagccccccatatcaacgtttctgggctgtcatgccgttttgaattagtctcgtggccgaaaattaagccgccaacttgaattgcaagtcgaaaatttctactcactaactcacccgaaaattcagggcagtattccgcacttgtgaggaaacatctttgctgtccaactcagccgaaaactcgtcgcagtcaattgccaagttgggcaacttagacgcaaaatgcgggttggttaactcggtcgaaaatttcgactcagtagctcggctgaaagttcagcgcagtattgcgcagatctattgcctaagttaaacttagccagtctggttcactcagcggaaaactccgctcaactaaaaagcgccgcacctttcagcacgacactcattggttatttagttggttgttcccgttgttctctagccagtctggtcttccggttatgatgtcggtaacacaatggttgtaggttactttcatctaagcgacgtgaccagtcgtctttgatttcaataacgtggtcgaccacatcggctttacggatcaccccatcttgataacattgaacgcataccggattgctttcaagaaaccgccgtgacaacttgcgccatgctgaagacttgtagaactgttggtacttactctcgtctgaatcgtacatgcgtttatgataccgccacttgttagtcgccttgcggtgcttctcgcagtagcgtgtgtcataggcaaccaacgtccgacaacccgggtgctcgcattgcttcattggcttagccatgaccgttgaccttggttagtgtgaccacgtcataagcattcatatcactatcagaactaacaccagcaaccttatacgtcaccccatctaatattgcttccaaagttgtcgtgatccggtcgtcatggcgcactgcaattagctggttagttgtcgcagtcgtaccagtaagactaatagtgttactgatggtcaacgtatactcaccacaccagacagtgaacagtggcacaaattgctgtttggttgtgccgtttattgggttctgaacagacttgacggtgccaaactgtacccgctcatttaggcggcttagattatagttcttcatcttcatcaccagtcctataaaccaatgcttcgcaataaatcacttttgaatcgctcaccttaataaaatcaaattctacatctaacagttcgtcatcaatatcttgtgctttgtcgacttccgaaacttgtgcaaataactcctccatattgtcagcatgtaccatcttaattttcattatttaagctccttttattctctaaaatattgcttcttaactacatcaacaacataatgacttgctaacaggtcatagtaatagtagttatatgtttccttgctcataatcattactagtgaagactggccgggataataccaatctactttgctatcaaatatcacgcccactaaatcaagcgacaagacgtgctccgctattttgctatgaacgctatcggccggcccataatcatgagcaattgcaacaattcgtgtagttccacttaccttttgcaattcggcatgatctaaccattccccaaggtaaggtggtgtgtcatacttattacccgcattgtatgaacgctcaccagctaacagtttttcaagactatgtgggcgttcatacacggcacatttatcaaacttaaatacgtcttcaaattttttgaggttttctgaactgctatattttgtgtctctcaataattgaatttcttgccatttcatacgtgtttcctcctagaactggaaatgttttttttaacgtggtccacgtggtccggtggtccaaacgctgatatatcagcacttaaaagaccccctgacgtggtccatatggtggtccaacgtggtccacttggtaaatttctgattaaacttcgcgcatatacccatgtagacgttgaccattcattctcattcgttgacttttccaaccgtccatattgtccattaacaacttaattcgcttagcttccgagttcgttcgcccggttaaataacgatcaactgttttatggaagacaacttccataatttcccgagttgttgtttgattgagcagtttccgttcattgctaacttgatcttgtagccacttagattgctgaccgtagtcactgacatagctttgttttaagctggtactcatttttccccaatctgtgggaacttccattgctaaaaacgcttcgatggcatctcgcatagggtcgacagcttccgcagccatctgatacgccttagcctctttcacggtggcctgatccagatatagcggttcgccattcctaaaccagtacacggcctccgccaatacttgaagtatataattctcgtccgggtgccatacatctaatttggccttgttgaccccacatttaattggatagaagcgccgttcaccggtcgcgtcctttaaatagtcggtttggttagtcgtgccaataaatacgcatttacgcgggtgtggcaacgcatagcggccgtaactattccgatatgtgtcggattgtgcactaataaaatttttaattccctcaacgtccgtttttttcatggcggaaagctcggcaacttcaataatccaactaccttgtaactgttgataatcgtctttctgcttccccattcctttcaacgaatcattgaatttatctgggtatagattcttaccagccgtactcttgccaagtccttggcttccctctaagatagggacaatttcaaacttaactccgggaacataggcccgggcaataagaccagttagccatttcttagtgatggtgcgggtgtagtgattatcttcggcacctaagtaatcaatgaaataacgttcagcacgtggctggccgtcccattctaccgcttcaatacgagccttaaccggattgattgtcttgcggcgtgcttctgtaactaccgcgtcggtaatgttttccttgctgaataacaagttgtaatgatcttcaatataacttctcaataacgtgtcatcactatcattccaaaaaccttttttgaacagtgagttgtctgcttgtggtgttttgacaatttgttccgagaactcgtcaaagacaactagtcctttcaacatttcgtcatgttccataattaaacggatattgtaaagagactgtgttttgatcccatcgtccgaattttttttgaaatcattctgccaatcagcgtcacgttgcattttgataacattattggccgcttctcgggtctctgctggtaaatccattgctttgcccattaatgaacccccttactctctcgttttaaaatggattgaaaaatcacattaacttccttgcttggtagtgccggatcaacgaacgaatcattgatcactgacagcatgttatagactgtcttgggatcagcaccgacgccaaacatacgaccggcaattttagttaaccaagcattgcgattaccttgggttgtcccagttaccatttcatctaacaagcgaccggtatacttcttttggcgtgtggcataggcgcgttctgacggccagttcactttttgccccgtcaacttatcaactagccattgaggagccggcttaatatcagccaacgttcggccacctaagggttcatacactttgccgttaatctcacttggtgcaatcaccgtgaagtcacttagcaagtcaattccgggccaaacgtcaattttgcgaaccttagcacccacgtatttaaaaaagtaatggacgccgccgttagccgtccgttcaatgtaagtatctttcggcaatgtcagcccttgcttaaatagttgtaccaagctagtccgaccatttttagttggctcgtgcatatcaatgtcaacaactaataaatccgataaatctagccgcaagcctaagttgtaagttgggtgcttttcgaaccatgctaagatggtgttctggtcactagttgcggcttggtagccggccacccctttaggtggctttttcgtattcttaatcagtgggtaaaccgcatagccttgttgggccagctcaatggctttatcaagcgttgcgaactctttcatttttcaacaccgcctaatcttcgggacaaatggcattgctaacttctaacatcacactagcaatattcaatagattattttcaaggttgcttgattgctggctcttaaagaaatagtcacaccaatcactatcatatttcgtaacagtcattgccattgataaattatcaatacttactttcaatgattcccacgccgtttctaatttttcagattgttccactaattcactatttgtcattttccattctccttattcgtgttaaaataagggaaagcatatttttgattatctcttagacctactactcgccaaagtaaagtaggtcttttttgtatgctttcccatgcgactgacctcacattccaaaataacgacgcgggttcttgattaacttaaccaccacgttgccaacaaacgacacaatcataaacttgattgcccataagattgctgttgctatcataaaatcacctcccttaaatttattctgcccccgcacggtacaattaaattttatgtgcttccatgaacttatcagcgtctagttggtcaatacgttttgtaccgttgattgcaactactcgtaaaccctgcttaatatatttgtaaagcgtgttgtatgacttgatatttaagcagtccatagcttgcttatatgtcatataacgtggcaattctttcttcattctatttcgtctcctttaacaatactttttgtcttaccaacgagttcatcatatattatacattttgtcttgtcaatagttaaaaatactttttgtcttgtttcaatcttgttaatggcttatacttcttttagaggtgataacatatgaaaaacaggcttagaaaactacgcaaggaaaatagcctaaccttggctgaactctcagaaatgttatttaaactatcagatttaagaatatctccagatttattaagcaaatatgaacgtggcgaaagaaatcctaaaaaaagtgtgttagtaacgctatcagaaatttttaaagtgccacctctctatttaaatggaactaaagatgttcattctcttataaaagatggcgccatttcaaaaatgaagagccaaaacttgaatattggcatatcagaagacaaggggggatattcttatgaaaaaataaatgagtacctagaagactgtattgataacaacccgcttatagattatatttttagtaatgagtctgattataaatcactcaatgacaaagttaatcaagcaatatatgttgtatctgaatatgtactattaagagtagagacttatgattttagtgtttctggaatgttaacatacttgtatttagaacttgatcatgcaggaggaaaactcgttgatgataatttgaacttgacccaaaagcaaaaagacaatatggcacaagtagtcccagaatttaaaaagatccgggaaaatgctatccattccctattgaaactagccaaagataagaattttgagtttgaagaggaaaacgctgtttcactagacttttttaaaaaaatagattcgtctaagtaattgataccataaatataatcagttctacataacactgcccccgcacggtacgttatggaggaaattataaatggcaacaatcaagaagtatcaggacaaggacgggaatacccgttatcagtttcaagtttatttaggtgttgatccactaacgggaaaaaagaaaaatacccgacgccgtggattcaagacaaaaaaagaagcccagattgtattatcaagacttgaacttgatatttacaatcatgggctaccaactaaaaacgataatacaatttttaaagatatttaccagctgtggttcacacaatataaacaaacagttaaggaaagcacttgggtaacgactcaacggctgttccggcttcatattttaccaatatttagtgattaccggattgctaaaatatccattaaggattgtcaaaaagccattaaccagtggtttaatgctggcttggccaagtaccacacgctaatgaactacgttgccaaggtgcttgattacgccatcaacattgacttaatcaatgaaaatccggctaagcgtgttattgtaccagtgaataaaaacgatcgttcacgcaaaaatttagaaaattactttgacaaggctgaattacaacacttctttgagtgcctgaatgatgatgacaatacaccgcaagccagtgtattctttcgtttagcggcctttactggtatgagaaaatctgaaatgctttgcttagaatggtctgacattgattttagcaatcacactatacgggttaataaaacacaatcccgtggtgatggtgcccgtctgctagtacaagcgcctaagacagcgcgtagcaatcggacggtgtatttagattccaatacggtcaaaatattgcaacgctggcaagttgatcaaaaagaatggctactgcgtttcggattcaacattaatcagggtagccactatgtgtttgccaatgaaaataacgaaatgtttcaaccatctaagccacgtaaatggcttgaacatactctaactaaatatgacttgaagcatgtcacggttcacgcattccgccacacttatgcgacacttgcatttgaagcccatgcttccatcaagtcagtacaagaccagctagggcattcaagctatcgcacgactttagatatttacaccgcagttactgccaagcaaaaaaatgaagccaccgaaaaactggctaattaccttaatttttaatatttagactgctaaatttgacacattttagcaggtggaccacgttggaccaccatatggaccacgtcaagaggtctttaaagcgttgatatatcagcgtttggaccaccggaccacgtggaccacgttaaaaaaaacatttccagttctagcaggaaatagggttaatttaaaggtagtcagccaaaaggacagccaactaatttttttaatggcctgaacaccttgtaatagctgatatacaagcatttatgataatacgggggtcgttcccagtatacccaatcagaagtacggataaagccacgcaggtaagatcaaatttacctgcgtggctttttatgaattgtcacacccttgccagtgcaattttatcttttttcactcaaaacggtttacggacttgattaggggtttataatagatagtgtagactgtctgtgaagccttgtaaaattgtcactattttaaattcaatccaaaggagataatgttgttggtatacaaagatgtttttggtatcgatcacaatgattgtcacattgttcagacgcggcacgagtttaaccggatcttcattatcgaaaatgaagttggctctcgctttacttgcatcaaagatgatgccccactcgaaaagaagatgtctgggcactggaagtatgcaaaagctagcgacgcccctaagaactatgccgttccttataaggcccagaaaaactaaacaaccgttgaaaagaggattacgatgcggcgctatcaaccgttaaccaaatcaaatggccgggttccccactcgctcaatcataacaccaacccctactatggtcagcatggtgctgattgggtcaaagacacgaatgcttcgctatttaatgcccaacatgagcatctccaatcaaagagccatgttgagcgacgcgtgcggcacaacgtccgtcaagtgctgtgggtggtcgtggtgattcttgccatgttacttggtggttttatcttgttctcattagcgatcaatatttaacactaaaaagagtcattcagcttatacaagttgaatgactcttttttactagcctttaatttccttggtatccactaaaactttgctgaccatccgaagctcatcagttaattcagaggttcgaatccggccaaattcgtcgaggaacttgccaaggcgttcttcgttaactttttcaatgacccgtgctaacttctcacctttggcggttaacgttagataacggtaccgacgatcataaggatcgatgttcaacacaatcaagtcattgttgatcaagtaggtcagtttccttgaaatcgctgaagaagagacgtggcagtcagcggctagctctttcaccgtaatccggtgatcagtgctatggtcaagatagtagagaatcaagaactgttcgaacgacacgtccgcatcagtcaccatcgtttgaataatctcgcgaagatggctttcaagccatgacatgcccactaagactttttcgaacaattccgcatcgtcgtacttggccttcttagtattagtcttcatcattatttaaaaccccattcatgcgtcacgttcaaggcatcatcaacaaccccgtgattacgcacggacttctgcagctggcataacggtgatttcaagatcacgtgtcatttgtttctcaatcgcagtctgaacatcacgatccgttacaactaagctcgacaacttactctttccgttgataatatcttggacgtgttgattatccaaatcatcagcagagacgattggtaagagatggaaattatcattcgttgcttgtaagcattggtcgaacaatggggcgttaactcccataaccaacacactgttttgttgttgtaagactgatgccaaccaccagttcaataattgtgcttcagaatggaagacattcgtgatggcttcttccttgttcactaattgaattgataattcgtggttactaccatattgcttgaccattgctaaagagtggtctggacgatagaagttttctagtgtcacttgtgagttattcgtccggtcaaggtactgagtgactgacaagaacccggcagcatcgtacacatcccgacgagttgctaatgacccattgaagtaagtcatgtaccaaatggcaccattcttacggtacttcaatgtcataattgagttaccgccgtcatcggcaattgacacaatctgcttatcagcattgcgcttatattgccatgcaggattatcaggtaattctggtttagtcttcgcaacggcacccggtacctttgcctgaatcgtgtagtacatgttgtacaagccagttcgtttatcaactaagccagctgattggtaactgttccaaatttctggcaagctgtcattatagttaaccgtaataacattagctttatccttaacttcactcttcaataagcccatgatcatttccatcgaagccttttcatcaccagacaatgattgaatcagatcggtgctgaacaagaagtactttgcagactggtcaaattcgacgggcgatactaagtgagtcgtcccgtaatccgattttaacttggcatcaatgctttcaatcttttgttggagccccttaacaatcgtggcattttgatcataatcatgttgtaatcgattgattttctgattaatcaagttgagtgaacgttcttgttcgtcttgagcactcttcttcttacgatcataagcaactaacgcatcttgagcggtatgtaagtctttttccgcactcgtaatcgcgtgttccttccgcgaacgttcacgggtttcagtctgttcacgcttctggagtttcacgagttcactgttgattgcgtcactcttttgatacagatcctgtgcttgcttctcctgttgcttcatcaacacgaataacttcttaagatcctgttcgccctgaattgctttacgcatatcagcttcattttgcttcaaatcagctaatgattgttcagactgcgtaatcttcttttccaacgatttgatggtttgatcgctcttagcaagagctttcttagcatcatcataacgtttttgagcagcattgatggtcttgaccattccctgccgttcgctatcgttcgtgttaacgactttgtcctgtttagacagagtaaccttagcgtcctttaactgttgttctaagtttaactgttcggcaactaaagtttcatactgttgcttttcgtgcttacgatcctgaactaattggaccttaagctccccacgtaaagtttggtattgcttgtttaagtcagccatttcgcgttcaatggccacactgtttttggctgctgtttgggtagcacgccgttggttgacccggttttggcccttaactggggcactagttgaagcagtcacgctgctactagttggccggacaccagcagatgaccgcacattgggggtcgtactactttgagtcgcctttggttttggcttttgagcagcaacggttgaagtcgccgttgcacgctcagaatgattacggtaatcctcattcttatctctgcgctttttattgaacatcttcataatgcaactcctccataaacttgattgtttgctcaaagagtagaaaggtcatcgctgacctttctatccgttcagcaaataatcaagctattctaattattatgcttcatgcttccgacgagaaacgccaaagtatagcgctgaacccatcaataaggttgaaagacccaagacagccaaggcagtcccgttttcgtcttcatccgtttgtggtaacgtctttgcgtctgaagtcgtcgtcttagtcgtaactactggcttcaatgaggctgatgcaggaacaaccccactagtcccattgttagtagtagccgtcgtcgttggcgttacttcatcatcagaaaccgtggttgctggtgccgttgaagtcgtcgttgatgaaccgttgtttgatgaaccattaccattatcaacagtatcgtcacttggcgtcgtaacaggagcagttgtagttgtaccagtaccgccaccgttgacgttgtcaccagtgccaggtgcagtcgtaggtgcggttgtcgtcgtgccaccaccgttattaccattgtcaccggtaccaggtgcggtggtaggtgcagtcgttgagccgccgttatcattcttagcataagttaaggtgatcgtcgcgtcatcagccaccgtaccactcaaagcaccatcagctgacttgtaagtgtaaccatcgattgaaggtgttgcgaccgtgtaagtgtccccaactttgtaagttgtggtcgtcgcactcttgatcgtattaccatctgcgtcaacatagttaactgtgatcgtcttagtttgttcagttggagtagtgccaccgttcttcgtgtaaacaagggtaactgtgttaccgttgtaggcaatcgttccggcaatggcatcaccagtggcatggtcataagtgtaaccagcaatttctggttgaccaaccgtgtaagcttgaccaacgatatattcagttacgctggatgctttgatggtgttaccatcagcgtcaacataattgatcgtcaagttagctttattttcaactggtgtcgttgaatccttggtgtaagttaaggtaatcgtcttattaccatcaaccgtaccagtcaaagcggcatcagctgacttgtaagtgtaaccatcgatcgttggcgtttcaaccgtataagttgagccgttatccaaagtttgggtcgtagcggccttgatcgtgttaccatcagcatcaacgtagtttaccgtaaccgttgattgttcaactggggctgcatccttcgtataagtgaaggtaaccgtgttaccaccagaaacaaaagtcccagtttgggttgcatcacccgttaaggtataaccgtcaatcgaagcggcatttacactgtaagcaccgccaacttcagctgcagtaccatcagcaccttctgtataagtcttagaaggtaagatcgtattgccatcagcatcaacgtagttaacagtcaagtttgaagcttcggtattttgtgagtagactaacgtcaattcagtaccagcagccgtcacattaccatcagaatcagtggtgtcagcggcaactgttccagtcaaagcactggacttagtcgtatctaacgtgtaattactgaaagtagcaggtgtaacggtgtaagtattgtcaacatcgccttgaacagtcgtgtcatccgcaatcttattgccgttttcatcaacgtaatggacaacgaccgtaccagcggcaacagaagtatccattacttgggttgcatagctccaagcctcaatctgctgattggcatcagtgttgttagtattagttgataacttattaactgaggtagtccctgtaaattccaaatatgcagcccggctacccgtcgtcgcgtcgtcgttagctttgaaagtatagagaacagtgacataactatcagcatcagttagcttcgtgatgtccacagtggcagttgaagcaccagctgcgtaactgtattccttaccggattcagttgcgtattcaacggcagtccaagtgccattactgttggaaccatttggcgcaattgaaacttgaccagaagcattagcccaatcaagcgcttggctcttggttaaccggatggcaactgcgtacgtatgcccggcagtaactttgatgttcgtgccatcaacattttcctgaatgtattgtgcttggtcttgtaagttgcccggaccacccgactgagtagcactcgtcaatgttccagcgtcaactgagccagcagcagtttgattagcagcttcagaagctggtgccgttactgttggggctgtagtcgcagccgtggtcgtagcagttgtggttgccgttgctgcagcagaagctggtgttgcaactgatgccttagcagccgttgctgcaacagttgccgttgaagtcgatgtcgcatcactgcttgctggtgtagtcgcactgacagttgcagctgaagaactagccgcactcgttgttgacgtagcagctgaagaagcagtcgagctggcagcactagaaacttgttccgtggttgcgtctgagctagcagcagtatcagcagaagcattaacgttggcaaatactaaacctgcagccaaagctaacgtggttgcgccggcataaacccaacgcttgccatctttatacatttttacccgataaaccgaatcaccggtcattttttgattatcttttgacatatggaatcctccccgagcacccacgattttctgcatttatgtaaaatgatgggcgacaaatcgcttgccagcccatcatcttagtcgtgcttatcgtgtcgtgcttaataacaccataacgattttgttggcatttcagttatatttaacgaattagcccttgaatgcggcaattacgtttaagataaaactgtgtaatccaccaaagatgtcgttggaaacacttgatgtatatgatgatgtgtgtgtacctggtaaaatatgaaaatcattgaaaaaactcatgagattaatcccctttaattgttaattaattagcctttgaatgcagcaattacgttcaatacgaattggtagaaagtaccaagtggttggttgctaacgtagctggtgtgtgatgaagtatgcgtacctggtaaaaagtgtaaatctgaaaagaaactcataatgtatatcctccctcattatctaaataatatcaagacattaattaatatattaattaattagtttatcgaaatagattatcccttgatcgctttaataacgttcaagatgaagctgtgcaagccaccaaagatatcatttgaaacacttgatgtgtatgatgacgtatgcgtacctggcaatacgtggaaatcgttaaagaaactcataatataaatcctcctaaaagattagttttgattacttgctgaataagctcttgattgcaggaatcaagtttaagataaagctatggaaaccaccgaagatgtcgtttgaaacacttgatgtgtatgatgacgtatgcgtacctggtaatacgtggaaatcgttaaagaaactcataatgtaaatcctcctataattgtttgactaaattactttttgaatgcagcgatcaagttcaagacgaagctgtggaagccaccaaagatatcgtttgaaacacttgatgtgtatgatgacgtatgtgtacctggtaatacgtggaaatcgttaaagaaactcataatgtaaatcctcctatgattgtttgactaaattactttttgaatgcagcaatcaagttcaagacgaagctgtggaaaccaccgaagatatcgtttgaaacacttgatgtgtatgatgacgtatgcgtacctggtaatacgtggaaatcgttaaagaaactcatgttgaaatcctcctataaaattaactatgattatttgctgaacaaactcttgattgcaggaatcaagtttaagatgaagctgtggaagccaccgaagatgtcatttgaaacacttgatgtgtatgatgacgtgtgggttcccggtaagaagtgcaaatcagtaaagaaactcatgaataactcctccttttaagttagttaatggttaaatccccaagcctagccacttgtatggcaagacttgagagtttggaaaacaaattaaattccgacaaacttgattaaacggttagaaaattcaactaattaatcattgaattccctaacacccgtctctagcaacgcttaacctttgattgcggcaatcacgttcaacacaaactgatagaaagtaccaagtggttggttgctgacataactagtatgtgatgatgtgtgggtccctggtaagagatgtaaatcactgaagaaactcatgttaatatcctccttagaaaatttacaaattgttcacaaattagcagctcaataatcattaatttaatttagtctgttaaataactaatattgattactaatgcgaacgtgaaacaagtaacctcgtttacgatttaaatattaactaattcgccccacaatcgtcaataaaattactaatatttgaataaatacagggcagtatcatattcaatcagtaaatgtgtatactatggacaacttacgcgtttcattaacggtcaaaatttgtgtccaatatcaatattatttatatttatcaccagttaactatgccagtagaaagcgtttaagcccctgataatatcagcatttcagcgtagttacttggtgcgacatcccctctttttttccgaattatgaaccataccatcgggaaatttattccctaaaaaataattataaatatcgcttttttcgacttattattaaaattattaatactttttatattttttacggcggttttatttcacgccgtgaccatcattatccatttaaatacatattttcggatcaaaaaagtggctattgccaacactcagcaataaccacttactaattttaataatcaaacaatatttcactaaggccttttttaaccgtgttgatactgcagccgataaaagtcacgataacgttcatgggttgctaataaggactcatgattgccatcacccgtaatctgaccatcctccatgaagagaattcgcggataagcttcgatctggtttaaccgatggacaatcgtaatagtcgtcaggtcagctggtaacgtcgccaagagctgggtcacccgttcttggttctgattatcaagactagccgtcgcttcgtctaaaatcaataacgacgggtggcggacgagtgcccggacgatggccaaacgttgccgctgcccaccagaaacattcaagccccgttcaccgacgtccgtatcaagaccagctgacagttcagctagccagtccgctaagccgacttgtgtcaacaacgcactcaattgttcatcagggaccggttccgtcgaacctaacaggagattatcgcgaatcgtcccgggcatcaagtctacttcttggctcacgtagccgatctgattacgaatcgagggaatcgtataactggccattgtctcgccgttcacgtccagctcaccacgagttggcgtatagtaagcctctaagagcgaaactaaggtcgttttcccgctaccactctcaccaatcaaggcaatccgctcaccgcgatgaattgtcaaatcaatgtccttaagcaccggtttatcactttcgtagccaaaatcgacgtgatcaaagtcgaccgtatcgatttttgacagcgtttcgcctgacaaccgcttatcttcttccggactatctaaaatgttgtcgattcgctcagttgccccgaccgtttgttgcaaggcagtcactaagccagttacgctactcagtggtgaaatcatttgaacagcatacattaagaaagctactaaacttccaattgtcaacgcgttcgtttgtaccaagatcccaccataaacaatgataatgaaaattgcggccagtaacatgatgtttagcactggattaagcaccgagatcagcttgatttgacggacactgaagcctttgatccgatcaacttgatcttttccctgttgtttcagtgccttttcagcaaccattgctttcactaaccgattttgaccaatcatttgtactgctgcactatttaagttggccgtttctttttgaatcgctttggagatccgcgctaacacttgacccattggcacaatgatcacggccatcaatggaaccacaattaaaataataatcgttaagcggaagtttaataacaacattaacgtcaaggaacccacaattgagatgatcccattaatggcattcgaaaactgacttgaaatcaattcaaaaatcgtcgatgtatcgttaactacccgactagacagttcccccgtccggttatggtcaaaatatggaatcggcaagtccacgatatgttgccataacgcgctccgcaacgtcgaaacggcgtcgacccccgtataactaagtagaaaactcgacgcaacacttgcaaatagctgcacgacaatcacagcgcctaaccgaagcaacagttgacccgaagtaccatggttaaaggcgtcgataaactccttcaacatcaacgtaatgccaagactacaaatcgttgcgacaaacgacaacaggattccaatcacaaagagtcccttcttcgggtgagcatgggtcatgatcaatctcaataaatcacgggtcccatacttggcatgtggttgtttagccgatgacgtgatatgcgtttccattggttgtaactcccctcattgcttgaatatcaggctgaatgacatgatcattccaacgttgccaaatcatagcctcagaaaaacggctactgttgccatatgcccgttcactcatcttcgccaactgtttagggtgttgtaagagcgttaaaatcaccttgcccaattcaactaaattattgggggtgatcaatcgcccattttcaccatccgtaatcatcgttgccggaccatacttaatgtcataggcaaccaccggaacgccatgacttaacccttctaaaatacctaagttaaagccctcatattggctagtaaggaccatcagttgtgcttggttatagaccggtgtcaaatcgcgctcaaagcccttaaacgtgataaatgactgccaacgttgcgaactgaccaaggctcgcaaccgattttcttctttaaatccagtccatgaatcaccataaccataaatatctaaggtcacattcgactgtttttcatgaacataggcgaccgccttaatcaattgttccaaatttttctctgccgataagcgagcaacggcaatcaccttgccctcaatccgatccttaaagtcaaccggacgagctgctaattgttcgtcacttacactaccaactggaatcgctaaagttggaatcacattatgaatgtggttcgtcatatcatcacactcttcttgcgtggacatgatcaaaccagccatttgactggcgtgatctaacccgatttgagtgtacggcacaattggtgagttcacaacgtcaagtgggtccagcgtgaaattactgtgtaagaactcatacttgcgcgctgctgtggacattttaacaatcggattcatcccagcatcactacgatccacgatcatggttccgtgaccgccatactcagtatttaacgcgtctaagaaaaaggcagtcagctgatcccagtcctcaaattcgtaattatgcccgtgatagtttaacagccgttgatgagtggcaactggttgttgcttctcatttggccggaaaaacgtctctaagacaggctgttgttgtaaattacagtgttgctctaacacaatattctgcttgtcatcaaagtactgggccaccgttaagaagccccgcgtatcataatagtctcgacggctgaccgcgccctgtggattgagaatatcgacgtaatcaatattcccctgcgcatttaacatcagtgctttttgccgttgttcccgttgaatgacgtcaaattcattagcgctgacccgttccagcgtttcacccgtcacccgtggataattggccgcagttaacggttcgccttcgtaattcgtagtgccttgaaaataatcatacatattgacctggaactcatcatcatacccaatgagttgcatattatgatgtaaatcgcgtacaaagttacgggtcacgatcaacgcaggtacccggtgctttgtgaataatttttgacgctgaatcatggctaactcaatagctgatggcgtcgaatcaattttgctcgtaataaagaaatacatttgctacgcccccgcttttattcatgtgataaactctcgactggatccaaccgtgccgccatatgtgccggtgccaaagcagccaataaactgatgacaacactgactgtaatgccgcccagcattgctgccccggagattcgaacgattggatacttaattaagctatagatggccatattgcctaagaattgccaaccttctccaaacagtaaccccataacggcggctaataccccgatagttaaggcctcagcaaagaacaaatgactaatatcgcgtttgcgggcgccaagtgcgcgcaaaaccccaatttcacgagtccgttcagaaacgctgacgtacaggacaacaatgatcataattgctgagactaataacgcaataccagccaccccggtcaatacgttagtggctaaacgaatataggtattcaatgaatcaattaaatcaccgattccggtatagttatactgttgcttcttattcgttcccttgattgccttgatttggtgttcgacttgcttaacattcgccaatttatctatttgaacaatggcaaaatttggtcgataagccacattcttagcagttaacatctttttgacggtttgtggtaagaccacgacgctagtatcattgctacccgtaattccgctgacggtcagcgtctgactgaccgttacggactgattcttgcgattaaccgttgccaatttaacggtcaacttcttattgagcgcttgttgataatttttcttacccaccatcttcttagctaacttacgaccaatcaaaacttgaccattttcaggacgtgaaccgtccttaattgtcttactcaaaattgtggggttatccgtctggagactggccgtcacggttgtttttttataactcgcttgtgtgctcgtgtaatagcccagcttagcagacttaacatgtttgatagccgctaattgtttgacgtttgcagtcgtcacttcggcattcttcgcggctgtgacttgttcttggttaaccgctgctttgtaagctgctgcactggttgcttttttacgcgcagccgtgctgactttccccgtcttctttgatacttggacagcggttggattaacttgagacgtaatctggtgattcatataattttgaatccctgatcccaagcccagcattacgacgatactactgatcccgatcgacgatccaaagataatcagcaggtaacgaagccacattcgacgcatatgttgcatggacatccggaacatctgccgaaagccaagtgttcggtaacgcgtcggttgcttatcgaccacgtcgaaaggcgccccgatcactaattcgtcatgaatctggccgtcatccaaatgaacgatccgcgtcccgtagtcagccacttcctgcgaatgggtcacggtgatcacaagtttaccttccgcagcgattgagtataaaatatccattacttcttgggtattttcactatccaacgccccggtcggctcatctgcgataataatatcggggtcactggctagtgcgcgagcgatggcgacccgttgcttttgaccaccggatagttcatttggatactggtgcgtctgttgctcaagtcccacccgcttgagtaggtcctgtgcttgctggacttgttgcgcatgggacgtcttagtcatctttaatgaaagcatgacgttatccaagacagttaggtaacttaccaagttaaagttctgaaagataaacccgattgtctcccgacgataccggtccatttgccgcacattcattgaacgcaaggattggccgtctaacaagacatctccatcataatgatgatccaagccaccaataatattcattaacgttgacttaccaccaccagactccccaagaatggaaataaactccccccgttcgaagtttagattaatgcccttcaagatgacattctcttggtgatttaaggtataggccttacgaatatcgtgtaattctaaaaagctcatatatgtacctccactattttattaactacattccccacaatgtatttcctcattaataacattgcgatttttggtgaatgatgtaaagtgttattgaatacctgtggtcatcattcataattaaaattataatcatcctaaatcctaataaaccacctacttggtagttacaatttgtaaaatatcacccattttgctgatttttacaataaaattttttctatttcgaacttattttatgacggcaatcacgacttaaccgtcagcagagataaatccaagcaccccacacattcaaggcatgaactaaaaagcgtccattactaggcacactgactgccagtaacggacgcttcatcgtattaaattacacctaatgactccaacttcaatcagcaggattcctacttaaaaaaggaccgcttcgtgaccacgcggtaaatcgcatccgctaaaccagtcacaaatacgacaatcagccctgcaaattgcaaccatggcaattgttgcctgattactgtcacttcactccccagccaaaagactagtaacccgagaacaataatgatactttcgataatgtttaatttacgcatctcaaactcctcacgtacatcacacatcgttgcgagcaactaccatgcatgactatatttgtcctttaacacctaatctattataacccgtctgctgttaaatcacatgccaaccactcacgattaaactcgagataggtcggcagatttttcattgcgtgatgtcattcaaagttagtgcgaccagtgcggtcaaaaattacgagcgtcaccatgttaaattagggtcatcttgcggacgtagcgattcatttcgccaacaacgttgtgattcataaattttagattagcgacgacgctcaataacagctacgaacacagcgtcagaaagacaagcaaaaagcccccaaaacaagcagcctatcagccagctgatagttgtttgttttaggagcttccatcttaatttctaaagtgctagcaccttagtcactaagacgtgcggttaacttcttagttaattcttcgtaaccaggcttgccaagtaaggcgaacatgttgttcttgtaagcttcaacaccaggttggttgaatgggttgatcccgttcaagtaaccagaaatggcaactgcagcttcaaagaagtacatcgtgtaacctaacgtataggcatcctgtgaaggaatgttaacgaccatgttaggaacaccgccatcaacgtgggccataataaccccttcgaaagctttggtgttaacttgagccatcgtcttgccttcaagatacttcaacccatcaaggttttcggtttccttaggaatgtcaacatcactagtagcgttgtcaactttaacgaccgtttccatcaagttacgacggccttcttggatatattgacccaatgagtgtaagtcagtcgtaaagttagctgatgatgggtagatccccttttggtctttcccttcagattcacccattaattgcttccaccattctgagaacatcgccatgtttggttcgtagttttcaagaatttcagtggtgtagcccttccggtacaagatgttccggtaagcagcgtattggtaagcttcgttcttagataaatcggcatctttgtattcattttgggcatccgcagcacccttcattaatgaatcgatgtcgccgcctgataccgcaattggtaacaaaccaactggtgtcaaaacagtgaaacgaccaccaacatcatcaggaataacaaaggtttcgtagccttcagcgtcagcttcttgcttcaacgcaccgcgcttgcggtcagttgtggcatagatccggcccttagcagcttcttcaccatacttcgcgattaaacgttccttgaagacccggaatgcaattgaaggttccgtcgtagtccctgacttcgaaatgatgttaacagagaagtcacgatcgccgattaagtgaattaagtcgttgacgtatgaagatgagattgagttcccagcaaagacaacttgtgggaatttacggtcttcacgtgaaagtgatgaccagaaagtttcgtgtaagaattcaatggctgcccgtgcaccgaggtatgaaccaccaatcccgattacaacgaggacgtctgaatcgtcttgaatcttctttgcagcggttttaatccgtgcaaattcttccttatcgtaatctgttggtaaatttaaccagccacggaaatcattaccggcgccggttccttcacgcagctccttatcagcagctgtgaccatagcttgcatttcgccaagttcgttattatggacgaacttagttaaattagagctgtcaaatgaaatgtgtgccatttactattacctctttctatacgtatttacatgtcatattatacaatagctcgcctaataatgaaaagcgcttcctcccttttttcgtaaattttcgtcatttgtgtaaaaaataaatacaattattaacaaaaaaggtgctgataacttaccgttaccgcaccttcaacagatttttttaatctgtaaatcaaataattaattttttagtaaagctttactaagccttcattaaggataacgcgaccccaccaacaatgaccaggatcgagccaatcaccacgtaaaccatttctcgcttcgtcttgtgctctcctaagaggtagatactcccaaacgtcgaaataacaattcccatttgcgaaagggagtatgcgacagcttgtccgatttgggccattgccataaacatgaagagattcccaataccccagaccagaccagtgacgatattacgataagttgctttaacaacccatggcttatccttaaaggaccagatcaaagcacccagcaacatcccaacagcttgaggcattacaactgcctgtgcattgacgttaccataatggaccacaatcgtatagccagcgtatccaatcgttgataagatcaaggcacgaatcccaacaccccaattttcagaagcactacggttcggatcagtcttatcagttaaggaagttaaaacagccccggcaatcaacacaattacagaagcggagccaatccaatacatgtttccgtgccattcattgaataacagcacaccggccaacgcattagcaaccagttgcatcccagttgaaatcggcgtagtccgtgaaataccaaccgccttcattgacgtaaattgttgaccttgaccaatactccagaataacccagagacaatcccaatcaaccaaattttgcttgttaaagttggctgttctacggcccagagtgccaagccaaataccaaggctcccatggtcatcccaagggtctgttgccgagcggtaccgcccattcggccactaattaagccgatactgccccacgcaatcgcaggaatcagtgcaattagaattcccattactaataatcctcatttctatgttttctctcttgcctaacgacaaggaattattttaccagttaagtaaccgttttaccagtcacaatcagggattcagggttaaatataattattttttatattttcatgaattcgttttcttagcgatagggaccgttttcaattaatgaaaacggtccccgaaataccctttaaaatttttttctattccacttaaattatggcgcacacactacttatcgagtgtcaaaaccagaaccttcaaatagttgcttgccaagtaagccttgcgcgtcacgaagtctgctggtaaccggaacgtctcactaagtgtgaagtgccgatcactgcccacaaaggccgccgtgaccgcggctttaaacttcttcattgaaaaattattcgcagtcgttgcaatcactaattgcccatcacgccgaacaactggtaaggtcgctgtcaataagtcagttaaatcagttgcaacttggaacttctgctttttcacccgcgcaaaagtcggtgccgttacgacaacaacgtcataacttagtcggtgcttctgggcgtaatctagatagctgttcacttcgattgctcgaatttcctgcttatcagggtcaatattattgaccgccaattgatcagcggtctctttggcacccttcttacttgtttcaatggaaatcgtcttggcagcacccgcaacggcagcagcagccgtaaccccattttcctggctaaacaagttcaagaccgtcttaccttgcaattcggctccggccaaccattcccggatgggacgcatatctaatagtaacccggtcgttaaatcatcagcaaggtgtaatggatacgtcaccgcgccttcagtcactaataacggctctggtgctgcttcacccgtgacgagttgactctttaagttagcttcttcgacattaaatcgtaatttcgcatagatgcctttaaattgatgttcagtagccgcttcaaaagccgcatagatcatttcgcgttgctggtaaacaccttgtgcgtaccatgtaaagacatagtaatcttgataacgatcgattgctaacccgccgagaccgtcgccatccgcattgaagacccgttgtggtaactgtggatccatgctcgttgctcgccggaccaacgcctgtttgaataacttacgaaagtaatcggtcgttggcgtctcactttcatccaagctcaagacccagcctagttgccgacgatgcttcgcaatcagcgcgtagcccataaattgagaacttgccattaacgccacaaaagagccatcggttagtttcatactcggatccttgagatcatcttgtacgagtaaaggatagccgtccttgactttacgttgcgaatttcccgtaatttgtactctttgcatagttgttgtttctcctattcatttcaaatcttatctaaactattgataaatcgctgtttgcagccttgttaagggtaacatatttagcctcagagtgcgaggtagaacagtgtcaatcgctgaaaagtattaggcttaaggtccgcaatcgattactattaaacgtccgttcctactattaatgatgggttattgctatggcccaccgttaccccgcattagcaaaaccgggcctcgagatcattacgatccccaagcccggtccgtacggatttacccgctttaaactatcacgttaatcatcaataatcggtttatcaaaaccttcatctgggaaagtaacggtaaagcacgtcccttcgttctccacactgtcaaccttgatcgaaccaccatgttgttggactaattgatgtgaaattgctagccctaaacctgattcaccatacttcgtattctttcgtgatgggtcagccttataataccgttcccaaatatttttgacttggtccggtgtcatcccaatcccatggtcttgaatcgcgacaaccgtcgcatgatccgtacggctacccgttacttcgatcacgttagcttgtgaaaactgaatggcattctgcatgatgttaaacaagacctgaacaaagcgatcataatcggcccatactggcagtttctcgggaaccgtcagcttaaattcatcatccgcggcggccgctttctttgtgagctgttcaactaagttatgcaaaacctcggcgccatcaaaattggtcttgttcaaagcaatctgtccggttcgaattttttcgtaatccaagttctcattgactagtcgaatcaaccgtttcgtctcattttgcatcagttcaattgaatgacccttgtcttcttctggaatagcatcgtacgctaacccttccaaaataccattgatcgtagtcaacggcgttcgcatttcgtgggccgcatcggccataaactcccgacgccgcttttcctgtcgcttaatttcttcattggaagttcgcagggagttgaccatgccgttgaaatcatccgccaagtcatcaatctcatccttatgattactgtcaacttgaatgtcaaaatcaccatttgcgaccgagtgcgtcgcgtaccgcaatcgattaatacgacgaacggaataacgtgccaaaatgtaacttaacaacagagccgcaatccccgagactaacagtgcaatgaacagatttttttcgatctgctgttcattggcctgcaaggtctgttcaaacgacccaatcgagatggccccaacaaacttcttcgttgctccattcttatagaaaaggggcactaaaacgtcaatggttcgcaacgacggtgtattcacgggttgatcacgattgcgtgttctgaacgttacgtggggcgactgcgtaataatcttattccgcttcagcttcttccaatctttggctgagatcttgggatcataaatcgagccaccaggggtcccactcattgttgtccccataccacttggatagaccaactttttgttagcatcatataccgaaaagtgaatatgttgatctcgtaagatgacggtcccatcatttagaaattgttgattaaacccgacaacttgattagtcttcgtattataccgaatagcttccttttcaatactcgcggcgtactgctgcaattgttgccatgagttttgataaagcatcgttctagtcgttcgaataaatgaaaatccgaggacgacgattaccgtaataatgacggcaaagaacgctagcatttgttgataaatcagtttcattgagcgtcaactccactatcatcaaacttgtagccgaccccccaaaccgtctgaataatttgtggcccagctttttcaatcttttggcgcaattttttgatatgtgcatccacagtacgttcgtcaccataatattcataatcccagaccagttgcaaaagttgttcgcgtgagaaaacttgccgcggcttttgagctaaggtcttcaataaatcaaattctttgggggtcaagtcttgaatttgtttgtctgctaaataggcttcccgcgtcttggtattcagtttaaaatggtccgtctgaacatcaaaggaactcaccgtgctggcaggttggtcagccggcgtggtcttagccaaatctgctcggcgatgaagggccttgatccgagcaatcagtgtaatcggtgaaaacggcttggtgacataatcatcagcgcccatctctaagccaagtacctgatcactttccgaatcacgggccgtcaacataataattggtacagttggggaagccttgcgaatatccgcactaacttgcatgccatccttgcctggcaagttcaagtcgagcgtcaccatatcccagccatcgacatcttcattgaacatttcgacagcttcattgccatcataagcaaaatgggcatcccacttttccttcttaaaaaacatggccatcatttcagagaccgatttattatcttcaatcattaataatttcatagtgcaacgtcctccaagttaattacgattgctaactttgttgattaatcatcatttattaacctatctattatcataccctacttcgcgctaggattcaggattagggtccgtcttaaaactacttaagtaagatgcaaattgaggcaatgtagaccgtagccagataaacatgagcgagcttatcataacacgttgcaatcctacgaaagttct

SEQ ID NO: 8 - DNA, 164449 bp, synthetic construct
  source 1..164449: mol_type = other DNA; note = Lactobacillus plantarum PDG8 - Contig 8
gattgcaacgtgttatgataagctcgctcatgtttatctggctacggtctacattgcctcaatttgcatcttacttaagtagttttaagacggaccctagtataacatactgatttttagggtaacaggggattaatcagtttattgcctcacgatggcttgtttttggaatggaccaggtttagatgactcttcggcagcatgggcaagttttatgccaagtcgaaagaaagttactttaaaaaaagtcttcaccggtacgacggttgacattcagcaaaaaatggcagtataaagcaatcaatagaatgagagcggctattaagtagcagaacaaaaaaacagcggttcactgccagattaggactgtgaaccgttgcttttaagcgtcataattaaggttgttctgtttcattgagaccgactgattcatcatcaaccgtgttttcggctgcgtggcggttgaagagtaagttaaggccaactgcggctacactaccaacgaccaccccgttgctcaacatgatttgaagtgcaccaggtaagaattggaagatattggtttgcaccgtgacgcccaaaccaagaccaatcgaaacggctgccacgagtaaattattgttattgcggaaatcgacttgagctaacattcgaatcccttgaatgccaacgatcccgaacatgacgaccatggcgccaccaagtactgggtcggggataatcgtcgctagcgcaccaatcttaggcagtaggcccaatacaactaagaacgcagcggaaaagtaaattggctttcgcgtcttgacaccagataattgaacgacgccgacattttcagaaaatgttgaataggggaaggtactgaacaagccaccgaggatgacggcaattccttctgcccggtaaccacgttttaaatcgtcgccttcaattttacgaccggtaatgtcgccaagggcaaagaagaccccggtcgattcaaccatcgttgttaaggagacgaggatcatggtcaaaatggatgaccattcaaagtgcggggtcccaaagtaaaagagggtcggtaaatggaaccagctagcttcagcgacgggttttaaagaaaccatccccattgccccggcaatcaaagtcccaactaaaataccaatcagaatcgaaacggatttcatgaagccacgtgcaaacacgctaattaataaaataattgcgatggtgagaaaaccaatgccaagtgcttgcaagttaccgaaatccttggcactggtgtcgccgccaccaagattttggaaggcgaccggaatcagcgtgaatccaataattgtgattagcgatcccgtaacgactggtggaaagaggttcttgatctttgaaaataagccggcaatcagaaaaataaaaataccagcaccaatgattgagccatacatggtccccagcccatatgttttaccgatttgaatcaacggattgacggcttgaacggcacagccaagcacgacgggaagcccgattcctgttagtggtgtacgttttaattgtaggaacgttgcgatcccacacatgaaaatgtcgattgagactaggtaagttaattgttcttggctgaaatgcaaggccgcgccaatcaataatggcacgagcacatcacccgaatacatagctaacagatgttgaaaccctaaaatggccgccttaacattggtaattttaggtgctgcggatacttccttcaaatcaatcttcctctctcgattaagctgatttgcctataaaaaaagtcaccccggcaaacgggatgacctcgtttgcttatagtccaacctttacggggttgggtagaaactcgtcaaccatatcatgacattatataggcaattaccacttatttgaatgagacttattctagcacagatgaaaaccgaatacaaatgtagccgaataaattaatgttcgtgaaaacgatatttttttggaagatgaaaatgaaaacgttcacttttgtgattgttgattatgccaaagtagcactgccatttctagtgtttgggtctgttcaggatcgtccaagttcaacgttagcattttttcgatctttttaaggcggtaaatcaccgtattgcggtgaatatctaggtggccggccacttcggcaatgttttgatggtaataaaaatagccatacagggtcgtgagtagattaagttgttcattcgcactgacaccactgacgagtccacctaaaacccgttcgacaaacgatcgcgcttcattttgtggaatcagtgaaattagttccttgacgtacttgggccgatagatcgtgactgcgtgggtactgtttttgctgagtgccaaggcttctgccgcttcattataggttgttgcgagttcggttagtggtagagtcgaataactgtaaccagcaatcaaacgcgcctgtctgtccaactttggctgaataaattgaacgagggcggtcagaaagtgctgggcattttgctggtcattgattaataagaccaattgctgctttaatgaaaaaacaatgacggatgcttggtattctttaataaaccacagtgtcagttgctgaacctgttccaagagatggttacttaagagggcctggtgattagtcgtgactaaaatggtggcgcagtggaacttcgtactcggatcaatattgcgggctttcagagtcttattcacgaggtcgtttgaaataccgccatccattacgtttaagtagaaaccactttggttgcggaatgcggattcgtttaacatgtccacccgaccattgacgaaactcaaggtgtttaagacgacttgcgtcagcatctgatcagttgagttggccgggtccaagtcgacgacgcctacaaaggccttattttccttataagccgaaaatagtggcatgatggtcaggtcatttgcttggtaagggagaatgacgcgggtattgaggttgaaatagtcgatatcggtttgattgcgtaaaaaatcagtcaaggtattgcgggtcatcggtaaatcttgggaagcactgaccacccgaaaatgactatccattaagaagagaggatgatgaattagctcgctacatttattcaagaccgtggtgttggttgggtctttgagcaacaaatccgctagtgtttggtttgccttgacgatgcgactgagctcattagtttgtgactttaagatgatgctcagcattttgcgcatggtttcagaaatcaactcatcaccgggcgtaataatgattggaaaagcgagttcgttcgctaattcaatcactttttttggtaaatggtcaacgtaacgatgatccttaaatccgagaccagcacagttggcattgtgcatcgccttgatcaaagttagtgggtcggtggttgtattgacgaagggatagccgttcgtaatcaaaaactgaccattagcaaggtagtcagcaatgtcaggtgactcgatcattccgatattactaatttcgcgtttgagaccgcgttcacccgcaattacccgcatatgttgcattgatggtgtttgtaatagtgtttgtaaacgcatggtaagtccccctacaattagttatctttaacaagtagtataccgataatttggcagtttgactataattaaatgaaaaatagattaaaaacaaatgaagcgtcgaaccagtgttatgggttaaggaatttaagtattggaaaggtttatcctcatttaagcgcaggagtagccggcgcaggactgctgaagaaagttttgtttagtgtaaattcacctggttagggcgttggatgccgacatacagaaacgggattcgctcgggttgagacttccagttagctaagtgaaagttcaccccctcaacgttgccgttgagataatcttcagtttcaacccgtctgaacttcaccggcttccagtgctgagtattgtcagcaacgcctttcagtcgaggtggtgttcaagtgatgggtggacttaacttttgctgagtttgttgttgctcataaagggtagatttcgcatataatgatattttgatagaccatttgttgctaaattagcacgttaagattgaaacagtcattaaagtgaattgatggtctcccagctttaattgaagttctaatatcaacggattcaacgaccaatggtactaatattaggcgaccgctcatcatttattcttagaggccggaataagacgatcacgtgtcacgattggaaatctattgaactcgccaggttcctcaatgatgcttgtcaacataaagggcaaatgaccaaagtcgtcagataattaacgcgacttaagttgattagtccttgacagttgtggtggagttcgttacacttagtccaattaaacaagcacctttaacttagtcctgtgaggctaacaaggggaacggtcatgtagggtctcccacgcttttcgcaggaaaacagggtgactctttttttaccccgtggattaaggtgaaattacagaaatggagctgacaaactaatggcacgagaagtcgttgatgcaatgaccatgcgccgcgcgctgacgcggatcacttatgagattattgagcagaataagggtgttggtaacctggtatttatcggtatcaagactcgtgggatttttttggcccaacggttagcgcaacgattgaaacagttggaaggcgttgacgtgccagttggttcgttagatatcacgttatatcgggatgatcatcatgcggttgatgttgccggtcaagcgaagctaaatggtgctgatattccggttgatatcaatggcaaacacgttatcttggtcgatgatgtcttatttacaggccggacagttcgggctgcgctagatgccttgatggaccatggacgtcccgcaaagatttcgttagcggtcttagtcgatcgtggacatcgtgaattaccgatccggcctgattttattggtaaaaatattccaacggccttggatgaacaagtcagtgtcgcccttgaagaacacgacggacatgatggaattagtattgaaaaattagaagaatgatttaattgaataaaaccatttaattgtttccagagaggaacgaaacggtttggtcatgcgtgaccacttaatcggagtctagcctctttgcaaacatttttgcggaagctagactttttttatatacaaaggagacggcaatagccatgaaaacgagtcaaaacctagttagtgttgaacaatttagtaatcaggacgtgatggcctacttgaagttggcccaagctttcaagaatgggaaaacggtacaactgtcacagccaacgtttgcgatgaacttattttttgagaatagcacccgcacacatacaagttttgagatggccgaacgacgattaggattacaggtgattccgtttgacccaaagactagttccgtgactaagggcgaaagcttgctggatactttgaaaacgattgaagccattggcgtcaacttggcagtggttcggcatccacgcgatcgttattatcaaccacttctcgacgccgggtttgacatgagtttgatcaatgctggtgatggtagtgggcaacatccgtcacaatcgttgttggatatgctaactatttatgaagaatttggtcattttgatggtttaaagatagctattgtgggtgacttggcccattcacgtgtggcccgttccaatatggcgttactgacgcaactaggagcccaggtttactttggcggccccaaagaatggtatggccgtgactttgaagcatacggcgaatatcagacgatggaccagttagtcgcaacgatggacgtcatgatgttattacgtgtccaacacgaacgattatcgcaagtgaacaatcagaccttcgatgcgtctgcctaccatcaacagtatggtttaacagctgagcgcgccgcacgaatgcccaagcatgcgattatcatgcatccggcccccgttaatcgaggtgttgagctagcgagtgacttagttgaagcgccgcaatcacgaatttttcagcagatgacgaatggtgtttatattcggatggcaatggtggcgagcgtcctcgctcatcaaggattaatttcagcaactcaagtggaggtttaacgcatgacaacattaattaagaatgctcaagtgtggcaagcagggcagttacaaacaacggatatcctgattgccgagggccgaattaaggcgatcgggcatcaactgcacgatcagtttggaccggcggatcacgtcatttgtgccgatcagcactttgttagtccgggctttgtcgacgtacacgtccatttacgcgatcctggtcaaacagcgaaggaaacgattgcgaccggaacgttagccgcggcgcatggcggtttcacaacggtcggagcaatgcctaatgtggatccggtacccgatacacctgagcgggtcgcgacgatggtggcgcgtaatcagcaggaagcacatgttcacgtcgcacaatatgccagcattacgactgggcggactagtgaacagctcgttgactttgccggcatcaaagctgagggggcctttgccgtcagtaacgatggttccggtgttcaaacggccggaaccatgtttgcagccatgcaaggtgctgctaaagttgggttgccattagcggcacacgttgaggatgattcgctttatcatcatggcgtgatgaacgcggggcccgttgctgatcggctaggattgcctggtatcaataatgtttcagaagcggcccaagtggctcgtgatgtcatgttggcggaagcgagtggggttcactaccatgtttgtcacgtctcaacagcggaaagtttacgcgtgattcgcaatgcgaaagcagctggcatcaacgtgacttgtgaagtatcgccccatcatttactcctttgtgatgaagatattacgatggataacccgatgttaaagatgaatccaccgttgcgttcagccaaggatcgcgcagcgttagttgcgggattgttggatggcacgatcgacatgattgcgacggaccatgcgccgcatactgatgccgaaaaacagggcagcatgaagacggcagccttcgggattactgggattgagactgcctttgccacgctatatacggcgctggtcaagacccggttactgacgctcggtcgtttaattgaactgatgagcacgcgtccggctgaactatttggcttaaatacagccggccggttggtagtgggggcaccggctgatctaaccattattgatttagatcatcaatatgaaatcgaagcggccaccatgttatcgaaggggcacaattccccgtttatcggttggcccgtttatggcaacgtcttaatgacactagttgacggtaagttggcatatggaaaggaaacgcaagcatgaaacgatacttagtacttgaagatggtacgatttaccccggcacggggtttggtgcgacaacggccacggttggtgaattagtctttaataccggcatgagtggttatcaagagtcgatcacagaccagtcttataatggcgaaatcttgatgtttacgtatcctttgattggaaattacggcattaatcgggatgaccatgagtcaatcaagccaacttgtaagggcgttgttgttcacgaagttgcccgacgagccagtaattggcgtaatgctcagtcgttggacgattatctaaaacagaatgcgattcctggcattatggatattgatacgcgggcggtcactaaacatatccgaacgaagggcgcgatgaaggccaccatcgtcgataacgtcttaccagatacggttgaccggctcaaagtcacggaattaaatcgggccgttgttgcccagagctcaacgaataacgcctatcccaacccagcgacaggccccaacgtggtcgtcgtcgactttgggttgaagcattcgattttacgcgaattagcaaagcgtcaatgtaacttgacggtgttgccgtacaataccacggcgagtgaaatcatggctttgaatccggatggtgtgatgttgacgaacggccctggtgatcccaaagatgttccgggagccttagagatgatcagagaagtggaaaaacatgtgccgctatttggaatttgtctcggacatcaactttttgcgctagcaaacggtgcggacacgttcaagatgaagttcggacatcgtgggtttaaccatcccgttcgtgagattgcaactgggcggattgattttacgtcgcaaaaccatggttacgcggtggatcgggattcattagcgcagactgacttgttaatcacccatgaggagattaatgatggtaccgtggaaggcttgcggcatcgcgactacgcggccttttccgtgcaatatcatccggacgcagcgccgggtcctcacgatgctgatcatatttttgacgaatttattgatttgatggcggctaatcaagcaacccagaaaggaagccaattcaatgcctaaacggacagatattcataaaattatggtaattggttcaggaccaattattattggtcaggccgcagaatttgattattctgggacacaagcttgcctggcattaaaagaactcgattatgaagtggtcttggtcaattctaaccccgcaacgattatgacggacaaagaaattgcggaccaggtctacttggaaccaattacacttgaatttgtttcacagattctccgcaaagaacatccggatgcgattttgccaactttaggcggccagcagggcttgaatatggcgatggaattatctaaatcgggtattctcgatgagttgcacattgaactgttaggaacgaagctcagcgcaattgatcaggcggaagaccgggaacagtttaaggcactgatggaagaattgggcgaacccgtgccagcttctggtattgcgcggacggttgacgaagcgttggctttcgctgagcaagctggttatccggtcatcgtgcgaccagcctttacgatgggggggactggcggtggcatcgccgagacgccccaacagttacacgacattaccgaaaatgggttggcgttatcaccagtgacccaagttctgatcgaacaaagtattgccgggtacaaagaaattgagtttgaagttatgcgtgatgctgcggataatgcgatggtcgtctgcaatatggaaaattttgaccccgtggggattcataccggtgattcaatcgtctatgcacctgttcaaacgttagcagatcgcgaagtgcaattattacgggatgctgctttgaagattattcgggcgttgaagattgaggggggctgtaacgttcagttggccctcgatccgaatagttttaattactatattattgaagtaaatccgcgggtcagtcgctcatcagcgttagcctccaaagcgactggttacccaattgctaagatggctgccaagattgcagtcggcttacatttggatgaaattaaaaatccggtgacgggaaccacttacgctgaattcgagccagcgttggactacgtggtttgcaagattcctcgctggccgtttgataagttcacccatgctgatcgtcgtttgggcactcagatgaaggcgaccggcgaagtcatggcgattgggcgcaatattgaagaagccacactaaaggcggtccgatcactagaaattggggtgcaccacgttgaagaacccgctttgcgtagtgttgacgatgatgtactcagcgataagctcattcatgcgcaggatgatcggttattctacttaacggaagcaattcgccgcggttacccgattgatgaattagccgaactcaccaagatcaacgtgttcttcctggataaactattacacattattgaaatcgaacaagccttgcgtacccatacggatgacatagagacactaactgtcgctaaacgcaatggcttcgccgatcaaacggtagctgactattggcacgaaacaatcgatcaggttcgcgacttccgcttagcgcacaaactagcgcccgtttataagatggtcgatacttgtgccggtgagtttgcttcggagacaccttattactacggcacttatgagtttgaaaatgagagtattgtcacgaaatgcccatccgttttagtgttagggtcagggccgattcgcattgggcaaggggtggaattcgactatgctaccgttcactccgttaaagccatccaaaaagctggctatgaagcgattatcatgaatagtaatccggaaaccgtctcgactgatttctcagtatcagacaaattgtacttcgagccactgacgattgaagatgtcttaaacgtgatcgaacttgaaaaaccagtgggcgtgattgtgcaatttggtggtcaaacagcgattaacttagcgaaaccattggctgaccatggtatcaaaatcttagggacgagtgtggcggatgtcaaccgcgcggaagaccgtgacgaatttgataaggtcatcaaagctttagctattccacaaccggctggtgatacggcaagtgatgaagcaaccgcgctagctattgcggataagttgggctatcccgtccttgtccggcccagttatgtccttggtggccgggcgatggaaattgtcaagaagcggaccgacttagactattacatgcataacgcggtcaaggtgtcgcacgaccaccccgttttagtggacagttatttggtcgggaaggaatgtgaagttgatgccatttgtgacggtcaaacagtcttgattccgggaattatggaacacatcgaacgggcgggtgtccattctggcgattcgatggccgtttatccgccacagtcactttcggcggcggtccaagcacaaattgtggattatactgaaaaattagccattgcgctcaactgtgtcgggatgatgaacattcaattcgtaatccacgacgaccaagtttatgtgattgaagtcaatccgcgcgcgagccggacggtgccattcttaagcaaggtcacgaacattccgatggctcaagttgcgactcgggcaatccttggccagtcattggctgaacaaggttatcagactggcttggtcacaccgggtcccttagtacacgtcaaagcgccggtcttttcattttcaaagttgaatcgtgtggatagtttgttgggaccagaaatgaagtcaacgggtgaagtcatgggcagcgatgtcacgatggcaaaggcgctttacaaagcctttgaagcggctaagctacacgtgccgagccatggtaacgtacttttgactgtccgggatgaagacaagccagaaacagtggcgttagccaagcggttccatgcgttgggttaccaattgctagcgactcggggaacggcgactgctctgaccacacacgggttacccgttacgaccgtcgacaagatcgatagtggcgagcatgatttactgcatcgcatggaagctggcgaaattcaagtcgtcattaatacggtttcggatgaagaacaggctgaaaatgatggtaccctgattcgaaacacgtcaattatgcacggtattccgttgtttacggccttagatacggtcgcggcaattttgcaagtacgagaatcacaatcatttgtaacgcaggcgctctaaatcaggacacccgccgataagcttgatcataggaggaaaacgatgggacgattaacagtaaatttagccggtgtcacgttcaaaaatccggttatgccggctagtggtacggcggcatatggtcaacagatggctcaacagttagacctgagtgcgctggggggcttggtcatcaagtcgaccaccgccgaaccgaaagcgggcaacccacgaccaacgaccgcggaaacaaccgcggggtggctcaatgcaattggactcaaaaatcccggaattgacaatgtgctggccgataaattaccgtggttagcgactcattatccggatttaccgattattgggagtgtcgcgggggcgagctttgatgaatacgtggcagtcgcacgaaaaatggcgtcggcacctaacgtcaaattattggaaatcaatatttcatgtccaaacgtcgaccatggcggcctagcatttggaactgatccagcgacggtaacggcgttgactaaggcgattgttgccgcggtcgataaaccagttttcatgaagctgaccccgaatgttactgatattgtcccaattgcactcgctgccgaagctggtggagcggctggactgacgatgattaacacgttaacgggtatgggcatcgatttagccacacgtcaaccgatcttagcgcatggtacgggcggtttatctggaaaagccattcatccacttgctgttcggatgatccatgacgtgcgtcaacataccaagttgccgattattggcgttggtggcgtgttcacgccggctgatgtgttggaattttacctggctggtgcaaatgctgttcaagttggggccgcaacgtatggtcacccgactgcttgtacagacattattgctggattaccggcggcgatggatcagtacgggatcaccagcttgcaagcgttgattcaggaggtccaaggatgaagcgaccaattatcattgcgttagattttcccaccgccgaacgggccttagcttttttagaccaatttccggctgatttacatgtcactgtcaaaatcggcatggagttattttatgcagcgggaccgagtattgtgacggacgtgcaagctcgcggccatgcggttttcttagatttgaaactacatgatattcccaataccgtcgaatccgcaatgcgggtgatcgggcggttaggggtaacctatacaacggttcatgctgcgggtgggcacgtgatgctttcagccgccaaacgaggattggtcgcgggtgcaatggccgctggagtcactgcccccaagttattagcgattacgcagttaacttcgactaatcaagctattttgaatcaggaccagcaaatcatgggaacgattcgggcgagtgtcgtgcattatgccaaactagcacgggcgagtgactgtgatggcgtcatttgttccgcccaagaagttcaggcgattcatacggccgtcggtgccgattttctcggaattacgccgggaattcggccagcgtcggcgcagtcagatgaccagcaacgggtgatgacaccggctgccgctgctaaggctgggagcaacggtctcgtcatcgggcggccaattacgcaggctgcagaaccagttcaagcttaccgagacattatgacagaatggagtaactaatatgagtgaaattgcagcaactatcgccactgatttgttgacgattaaagccgttacactacgaccaaacgacccgttcacctgggccagtggcattaaaagtccaatttatacggacaatcggctgacgatttcttatccggcggtccgtcagcatatcgcgcacggaatcgccgccatcatcaagcgtgaatacccggcgaccgaagtgattgcgggggtcgcaacggctggcattccccatgcagcctgggtggcggaattgttaaatctaccattgatctacgttcgtgctaaacccaaggatcacggtgctggacgccaaatcgaaggggtgttaaagcccggtcaaaaagttgtcatgctggatgatctgatttcgacgggtggcagtgtgttacaggcggccaaggccgttcaagcagcaggtggcgatattcaggctgttggggcaatcttcagttatgccttggatgcggcaacgcaaaattttgccgttgtgtcattaccgctgttcagtttgtccaactatcctgaactaatcaaagttgctcgccaagcagattacattgatgacgaggaattagcttcgctgcatacgtggcgtcaggacccagaacactggggagtgactgattaggattacgcgccataaatggctggcatatttaaaatagtcatgaaaattaagctggattatccagatgattttcatgactattttagttaccggctcgtgctaatattaacctgtgacagattgttaagacaagataaagaaatgagggaatattcgatgttagcaattttagttggcttagcaatcgggattgggttaccaatgcaaacgagtattaattcgcgattgcgcaattcagtgggatctccatttggtgcctccctaatatcttttgctgtggggacgttgtttttggcgataatgacactaattgatgtccatactttaggattttcgacgacgttatttacgagtcaaccggtttggatttggctgggtgggctgttgggggtcgtctacttaactggcaatatcttgttgtttccgaagctgggtagtgttcaaaccgttattatgcccgtgcttggtcaaattttggccgggctattgattgataattttggttggttcgactcaccccaaagtacattgacgatgacccgatttttgggtgcaattttagtcttggcgggagtcatcatcaccgttgcggctcaggggtggctcgaacagcggcataatcgaatcactgaaacagcggaaaaagatacagctactgacactgacactgaccaaagtggccttggaatttggcgtgcactaggtgtggttgccggaatgctcagtgcgatgcaaactgcggtcaatgggcacctaggtcgggtgcttggctccacagtgcacgcggcatttgtttcttttttagttggtactctggggctgatcgtcatcgtgttagtcttgcgacctcaattcaaattgattaggccaactaagacgcctaatccttggtggatgtggattggtggcatgattggcgcgctgtatgttttgggtaatgtttacttggttccggtcgttggcactggtttagcggtcgtcattgttttagtcggactgatggccggtagtttaatgattgaccaatttggctggtttgcttcaaaaaagaacccaatttcgggggtccagttgatgggcttgctcgtcatgattgtgggggttgtgctaattcgcgtcttttaagcactctgaggattggcgagtgtcaccgggtgatcggtaaggtgttttgaggtcgagacttgcagccggatgaataagcgaccgtgcgagttgaccacattaagccgtgaccacgttcgttaaagcttctaaaatttcaaatcaggatgacaaaacggtactggatgccgggcacgataagccattataaatccgacgcacatctggcagcagtggccgtcaacgttgagaattaagacgtgcagcacacgggtcgcctggctgaataacgtggtatttaatggacgcgataataaacatctaacttacgggttaggtgtttttttagccggttaaatatgcgataatgagactaacttaatgagaacgtttgttcagttcagaggaggaattagtggtgagcttacaatttgtattgggaccagccaagatggaccatcgccgtaccatggtggcgcagttagtggcaaccttgatggctaagccacaagatcagtttttttatttggtaccgaaccatattaagttcgatactgaagttgacgtgttgaaccgcttggcacaggcatttgggcaaccagatttgtatgcccagactcaggttcaggtcttttcatttacccgtcttgcttggtacttgatgaagaacgaagcagcttatcaagtaccacgactctccgctgctgggattgacatgctattatatcgcattctacaacgacatgccgatgagctgcgattgtttggtggtgaaatctcgcaaacgggttttgtgactcaactagctcgtgaaattaatgagttacagaccgctaatttgcaaccagaagatgtggttcaattggcagcgaatgctcaggcgggtgacttgcaggctaagctacatgatctggcgatcgtttacaaagacttcgtggcggcgactgcagataagtatcttaagcccgctgatattctcgttcaattgaatgcttacttacggcgtcaagacttgcacggaacgcacgtttatgtggaactcgctggctttgcccaattaccggcccaggaacagggaatcgtcacgactatgctggaacagggcgcggacgtgacaatcagtttgatgctcgatcacaaagtcgttgaccgggcgccagaaaatggcacgctgttttatcaatctggtcggctttattatcggctttatcagtatgcccgtattcgtcagattccggttagccaagatatttatgctgaaacgccgcgcgtggctcccggcttagtggctctcgatgatttttggcgtggtcagccccaagcggctaccggttacgaggagccgaatacgaatgtgcatttattccggaccgatagtcgacagaccgaattggcacaagttggccgcatgattcgggcaatggtcgcgaaaaaacatgccgatcccgccgacgattatcattatcgggacttcttgatcatgacacggcacttagatgcctaccaaacgatgttagcgccgacttttcatgaattagaaataccatactttgttgatttacagcgttcaatggccgaccatccgttagttgagttgattaacgcgttgtttgatatcgacgcacagcagtatcaatatcgtgatgttatgcgagtgttgaaaaccgagctgttgatgccaaatatcaatgggcaaccgatggatcggcaagcctaccgccaagcagtagatctgaccgaaaactttatccttaaaagtggttatcacggccagcggtgggtacaaagggaagattggcaatactttcaattaaccgagggtgatgccggggtcgagacggaccaaaatgctgaaatttcgcgacaaatcaacttgattcatcactttgttgctgaaacgttaccaccgttttttaaaaaaatgcggcaagcaccggatggcaaagcggccgtgacattgctggtcaactttttgacaagccagggcgttacggaccagctattagcttggcgtgatcaagccttggatcgccaagatgtccgggcagctgccgagcctgagcagacctggcaaactttctgtgggatgctagatgaatacgtgacgattttaggtgcagagccatttgaaattacggactttttggcactattacaagcgggctttgaaggtgctagttactcgcaaattccgtcgacgttggaccaggtgttaatttcagagagcggaatggttcaaagtcaggaccataaagttgtcttcatggttggggcaaccgatttagtgatgcctgaccggattatgacgaacaacttattgagtgatgtggataaagaaaatttgcaaccaacgctcagttcgttagatggtgaccactatttaaatgattcagctgtcgttcagctcggtgatgaaagttgtctgaattatttggcctttttaagtgcccgtcgacacttgtttttcagcgccccgttaaaagatgatcaagaaacagatttaaattggtccaactatgtgcggcgaattcaacgccagttcaatttgcgagaacatacttatcttgggacgcctgatccgactaatgccgatgcgcggccatttgttgggactaagcgccggacgattagtcatgtgattcaggtttaccgcgatgtgttaacgacgaatactgaccgtaatcgtgttggcgcaccattacaacctgctccggtgtgggtgtggttacggcaacaattgacgcgtgacccccaattcggtgagctagcacgtcaattgatggctggattaagctatcgcaatcaacctgtcaagctgacaccagccagcgttgaggctttgtatgggcatcaaatttatacgtcaatttcaaaactagaagaattttatcgtaatcagtacgcttatttcttgaaatatgggctcaaactgcgtgagcgtgatgtgttcgagttatcagctgctagtactggggagtttttccacgctgtcttagatgggctcatcaaggcgttacggtctgatcaaatcccattggcccaagccagtgatcagcagttaggacagtatttagagactgtgacccgtcaaatcttagatcaaccacagtttacaattttgacgagttctaaccggatggcttacttgcaacggcagttaatcaacacagtccggcagattgcatttgcgattcgcaatcaaagtaaactgtcagccgctgaaccgaagcaaaccgaggtcttatttggtaacgttggcaaggaacacggattaaaagcgctcgattttcaaattgatgcaacgcatagtgtgcacgtgcgggggaagattgaccgtctcgaccaaattcaagtggcagatcaaagttacctgggaatcgtcgattataagtcatcccaacataaatttgattttcaagaggcttactatggtctcgcaatgcaaatgttaacttatttggacgctgtgctgcataacgagcaagctttagtcggttctgatcaagctgcggttaaattagctggcgcactttacatgcacattcaaaatccaactctgaaaccaaaagatattcagggcggttttgaagcagcactcctaaagaagaacaagtataagggaattttgctcgatgatccgcagttattggaacatttagatagcgaactacaacaaggtaacgggacctcgaaagtttacccattcgcacgtaaaaaggacggggcgtatagtggggggcgtgcagcttcactggtgacgaatgaccagttggaacgattattacagcataatagtcaattgattattgcagctgctgaagcgattttcgctggagaaattcaactaaatccaattcggctgaacgataagacaactgctttacagtattcgccgtatctatcaattatgcagtttgatgcaatgttggcagaaaatgcttatcgggatctaccgccattatcagccaaacaggttcttgatttactgaagacacagaaaggtggagaaaaccatgagtgagggtacaaactatacacctagccagcaagctgttatcgcacagcagggaaataacttgttagtttcagcttcggctggttctggaaagacgaccgtattgatcgaacgtattatgcgcaagatattggccggcacgaatattgaccagttactcgtggtgacgtttacaaacttagctgccaagcatatgaaacaaaagctggaatcgcaaatcaataagcgaatatcacagttaatgacggacaatccggcgcaaaccacggcgtcaccagcgattcggcaattacggcagcaattaaatttgctcggggtagccaacattagtacgttggatgctttttgtctccgcgtgattcagcgttattactacgttattgatttggatcctgtttttcgcctattgacggacaacactgaggggttactcattcgtgatcaggtttgggacagtgttcgtgaacaattatatgatgaagatggtacgttatttgacttattaacagcgaatttttctaatgatcgaagtgatgatggtctcagtcgattgatttttcggttatttgattttgcccagtcgaccccggatccggaaggctggctgagcaagttaccggaaccttatcaggtggatgaggaagcgttaacggccagtgccttttatcaacaacaattattaccattgctcattaatgaagtcgatgggatgcaaatgaaattacgacaggcacaaaaagttgcgacggatgctgacttagtcccgaaaacgcttgaggtactcgctacagcacaaaaaacgctgacgacgctccgtgaacaattggcaacggcaagttggaatgagttacgtactcaagtcgctactttcaagattggagctctcaaaaaaacttataaggacgagccggagaagactgcgcgggccaaaactatgggcacatttgtggacggtgtcaagaaacaaatgaccacccttagcgagacctattttgcggccgatgagcagcaagtcttagatattatggtaggggcaaagtcaattgtgactgagctagtggatgcgaccaagcagtttaagacggcttttgcagctgaaaaacggcggcgacacgtcctggacttttcggatttggaacacctaacgttgcaaatcttaacgagtgacaatgaaagtggtcaggcagctttggcgcagttacgggcccaatttgaagaagttatggttgatgaatatcaagatattaactctttgcaagaaagtattttgcagctgttggcgcgcgaccagccaggaaatatgttcatggtgggagacgtcaaacagtcgatttaccagttccgattagctgatccgttattgtttttgcacaagtatcacgattttgggacgaatcccgaacacggggaacgaatcgtattagctgaaaacttccggtcggtggcgaatgtcgatcatttgactaacctaatctttagtcagctgatggacgcgccggtcgggcaaattgattatgatgaagcggcttacctcaagtatgggcccaaggattatccggccgatatgccacaaacgacgaatctattactttaccagacggaaactgacaagtcgacagaagatgtctccacggatgaaaccaatttttcaattgatgatcctgccgttgggagtatcacgatggtcgcccaaaagattttggcacttaaggcccaagataagccaatctatgaacgtgctaatggggaataccggccgtttcgttacagcgacgtggcgttactagtaccaacacgtaatcataatttaacaattattgatgttttcaaacggtatcacattcccgttgtggtcaatgatgcccagaattattttcaaaccactgagattcgaatcatgatggcactactcagtattatcgataatccatatcaagatattccgttagtggcggttctacgctcgccaattgtcggattagacgaaaatcaattagtttatttgcgtatccagaataaaacgagtgattattttcaagccgtccaggacttttatcatcattatccgactggtccggcgactgaatatggtgatcaagtttatgctaagatcgagaccttcttgacacaattgactgaatttcgagatctggcacgacgtaatcaaatcgtaaccctgatttggcaaatctatgaacgaactggctttttagactacgttggcggcatgccggctggtaaacagcgtcaggctaatctccacgctttatatgaacgtgcttatacgtatgaacagggcagttttaagggcttatttcagttcgttcgttttattcgccggatgcaggaaaaggatcaggacttggcagctgccgtggccgagactgatgcggaagcggtcaacgtaatgacgattcatggtagcaaggggcttgaataccctgtgattttcgtgatggatatggataagcagttcaatcagactgatacgcgctcgagcgcgctattggaccgagaagcggggattgggattacttatttggacccagaaacgcgtgtgaagtacccgaccttgccacaagttgtgactaagcaggtagtcagcaagaagatgcgcgctgaagagatgcggaaactatatgtcgcgatgacgcgagctcaacaacagctctatttggttggaacaatcaaggatattgataccgcgaccgaaaaatggcggcaggcctttgctagcgacgggcgcgttttgagtgctcaggcacgaattgctgcgactaatcaattagattgggtcggtatggccgtgatacggcatccggccatgaaggcatattggggagatgaatggcccaattacgaattgacggatgatccgaccaagctagccgttgaattgggagatgccaccaccgtcctggcggagcaaagtgaagcggtaacggatactcaacctgatgcgcttgaactagttgaacagcaagtcaccatcgatgttgatcaagtaacgcgtgattatctgaccacgttactgaattttcattatccacaccaggcttccacgacgacgacggcatatcaatcggtatcagaagtgaaacgaatctttgaagatccggatactccgctgatgaatgcgaacccgactgttagtcagcggcgttcacgaccgacatcccggtttgtgacagggtcactggagttaccacaatttttacaaactatgcaggcgccaaccagtgcggaagttgggagtgcgacccacttagttttagaacaacttgatttgaccaaaccggtcaatgaaacgacggttcaaagtacgattgatgggttagtggctaaccgggtcttaacgaccaatgtcgcgaaattgattgcagttgacaccatcgtggctttttaccagagtgcgctgggcagtcaaattttggataatccggcgaaggtgcaccgcgaagtgccattctcgttactgattccagcacgtcagattttcgatgttgatgaacatgagacgggaaaagtcctgattcatggaattattgacggctatttagaaacggctgatgggttaaccttgtttgattataagacggaccacgtcaagcggcctgaagaattgaagacgcgctacgctggtcaagttaaactatatgcagcagcgctagcgtcgatgtatccaggaaaggtgactaaacagtatttgtactcactgccacaacaggtgtttgtgccagttaattaagtttggctgtcaggtggtgtttacaaaattggaaaaagcacgtcagaataatctggcgtgctttttgttgagtttggtcttaattaaagcgtttgtcatgtttaaagccaaatgccgcgtggctgacaaatattaggatagtagtaactgataagcattccgttgatcgttgttgtcatgattcatgtagacgataccacggtattcgaagccagctttggtaataatgtgttgcattcgcttgtttaacaagtgcgtatcaattcggagttgacgaaagccgagttggtaactcatggtaatgagattgctaaagtaaaagtcagtcagatgttgtccgtggtaaccattggcaatagcaatacggtgaatcgaggcatagcggtggttctcagtaggcgcccagctgccatcataaataatagcgtaattggggtcaggtgttgttagcagtgcagccgtcccagcaatctgatcatcgacaatgagtacccaggcaattctagcatcaatgtcagcctgaatatcagcagctaacgggtaaccatcttgccattggggaatctgatcggcagccaaggcgtgtttgccctgttcgataatagccatcatggctggtaagtcagcactagtagcttgacgaatatattttgacatgaattatcactactctcgtttagatgctcatattataagccaattttgtaaactggacaaatcaggaacagaatgatacttttttgtcctggtaagctttataatgaaacttaactaaaggacaggagtgacccagatgaaaatctttgtgattggtgcccatgggcagattggtaagaaaatcgtttccaagttagttgcccaaggtgaccaagtgtacgcgggtattcgccaaccagaacaggctgaggctttcgaggatgctggtgcgcagccagtacaattcaatttgatggctcagcctgaagatttagcgttggcttttaatggtatggatgccattgtttttgcagccggatcaggtggtcaaacgggttatgatatgactttaatgattgacttggatggggctgtcaaatcaatggtcgcagccaaaattgccggcgttaaacgctacgtaattattagtgctgaatttacaccggatcggagtcgttggccacgagcattacaaccgtactacgtggcaaagtattatgctgacgaatggttaaaaaacagaacccaattggattacaccattttacaaccaggtacgctgatcaatgatgccggtactggcaaagtaaccgttaaccctgacgttggcggtgagattacgcgtgatgatgtcgcaacttttacagttcaaacgctacacacccctgcaacggtcggtaaaaccattgcgttgatcaatggcgataccccaatctcaaaggctgttcaacaagcttaatctgaggttgagacgggttagcgaccatgataggttactaaaacttgtctgtttaatgacctgcatttggcgacctaacttgacgtacagtcgttataaaatccaccgtgtgagcttatcatattgataaacttacacggtggatttttaggtgctggttagtatgcgtgccaatcgacggattgaaaagcagcggtcagtcgttggatcaggtcggcttgggttggactaaacgtcattgagtggcggtacgcaacgccgacattgaacgtgggcgcttgcgcgtcagttagggggagccgctgtaatcccgccggtaattggacggcgttactcaataaggcaatgcccacatgctgacgaaccacgtttaagatactgccgatttcgttggattcaaagacaatcgttggccgaacatgattttgatgactgagttgacgaaacgcctggcggtggacaaagttatctttgagcgccacaaaatgctgatgacgcaacgatctgaactgaagttgtgagttggttgctagcggatcgtcagttggtacaacaatactaaatgactgggtgtcaaacgtcgtgagttgaatggtcgtatccgtgaattcattgaggtaagcaagtacggctaagtctaattgtccgttttttaatcctttgagcgccgcgagtgaaccttgactgataggttgaatctggctgaataaagcctgtggtaattgacttgcaatccggggaaagtagttgatttcaatgattggcggcatcccgataacaagttgatcggttgtggtgtgggcaacttcttggcacatcagttggtgctctaataggatctgattggcgtgtcgttggacttgaatcccggtcgtggtgagtgctacgggtaagtggggattagcccgaattagtaattgtgttttcagttcggtctccaagcgccgaatagcagccgaaatggtcggttgactaacgtgaaattgggctgcaactaatgaaaaatttttcagctgagttaacgaaacataatattgcaaatctttaatattcatcttaaagtccttatttaattgatgcttaattgttagtattatgatttgttattataacatggttatttgactatggtaatcgttgtggctattgtagggctattaagagagaagggaacgttgtacatgtttacgttcggagagttaatcgttattttagtcgttgttgggattgttgcgggtatcgttagcactgcagcggggttagcgtcgctggtttcgtacccggtcctactggcgctgggactgccgcccgttacggctaatgtcactaacaccgtgggtttagtctttactagctttggagccgtgccggcctcacgccgggaactacgggggcatggtcaggaattgaagacgctcatcccgctgactttagttgggagtattgttggggcaattctgttattattatcccggcagcgacctttgcgaaggtcgtcccattttttattttgattgcgggaattttagtgctgattcctcgtcatattcatattaaacagcccggtgaaattgttgtgacacctaaatggatgacggctttagcttggttgggcatctttttagtcggggcttatacggggtattttggtgctgcgggtggtgtcttgatgttgtcgatcctgtctttcacgagtgccgcaccattcgtcgtctataatgctcagaaaaatctggcgttgggattagccaatattgtttcagccgtcgtttatggcttgcaaacgccaattcagtggcgctatgtactacccttaggcattggttttctgattggtggtagcctaggaccacgaattgtacgccacttacctgccagattacttaaaattgtgattggaatcggggcattgggactggcggccagtttgttcaaatcggcttatggattgtgagtgaaaatgaagttagtggggacaaactcaatagcaatgttaaggctggtaaacttacttacgttactgtcttgaaattaagtcatcgagtctaaatcagcgtttgggctgatgctatcaggcaaaactgcaggtaacctgaaatggggagggcttgacccggttggctgatccctgatgatgaaacaaaaaagactttcaagccgtgccttgaaagtcttttttgattatcccaatgagaactttaatcgtgatggcgtgaacgtgtccctaaaaagtaagcaccaacggctaacagaatcagtaagctgataatgcccaagccgccacccatccacataaagggcataccgccagtaaaagcccaaccgcacatcatggtcaccactttcctaattattttaggttcagtatacgcgcttttgccaggtactaccaaccgttctgcattattttaagctgttgagtagttgactttgttcattggtggttaacggtaaaattggtaggcgtgtgcttccgactaaccagtgttgggcgttcagcgccgctttgacgggtgccggtgagggttgtgtgaatagtgctgccatcttcggcattaaacgtcgttgaatttgccctgcttgggtgatatcgccgtggttcaaggcgcgacgcatcgtcgccatttcatttccaaataaatgactcgccactgaaattgttccctgaccacccaagacgagggtggtcaagctctgagcatcttcgcccgtgtaaacgagaaaatctttaggcgccttttcaacaattgcggccagttcttcatcggaaccacattgtttgatcccaataatgttggggttgtgggccaacgtgagaatcgtcgtgaccgtcatcttaacgcctacgcgaccgggaatattataaattataatgggcaagtctgatttttcggcaatggctgtaaaatgcgccatcatcccggtttggttgggtttgttatagggcgggacaacgacgagggcggcgtcgatgccctcgatttgactgacaatgtgggtgaaatgaattgtggcggcagtgtcattggtccccgtattagcgatgatcaacgtggggccttcgccagtcgtgcccccgactaataagccgtccgtgccagttgcaagtaagtgttcgatcagttgctctaagcggtggaaatcaatgtgttgttggtcatcaaatggggtgaccatagcggtaatcaggtgtgcggatgctaaattcatgtggctaatcctcctgtgtggtagtttgggcgcgccataaggctaaacgatttagcccttcgcgtagtgccgattgactggctgcataacttatccggaaccaaccctcgccactcgtaccaaatgctgagccaggaacgacagcaacttgggcctcgtgtgcgagtcgggtcgcaaagtcccagctggtgccttggaaatcctgtggtagctggacaaagatatagaatgcgcccgtcggatagatataattgaatccaatttcactcagacgtttgacgacgtaatcgcggcgtgtttgatagacgtcacgcatttctgagccatcatccagaccatgggtaagtgcttcgataccagccgcttgggtgattgaactcgttgaagtaacgaggtactggtgggtcttcttcatctcggtaatcaagttacttggggccatgatgaatcccagtcgccaaccagtcatggcatgcgatttggagaggccattgattgtgatcgttttgcttggatatagtgtggcaaaagcagtatggggctgttcataggttagttcactgtaaatctcatcgctaataacgtagattccggcggtagcaatgacggcttgcaaagcccgtaattcatcatcagtgtacgtgacgccggtggggttggtcgggtagtttagaattaaggccttgacgtggtcgcgacggtgatcatctagcgcagcttgtaacgcactgggtgttaatttataacccgttgcggttgtgtcaatgggagctaattgtgcgtttgcgatgtcaacgacgggttgatagctcgtgtaagccggtgttggcaataagacggtatcgccaggattaagtaaagtgagcagggtcgttgccacggcttcactagcgccgactgttgcaatgatttgctcaggtacataggtgagttggtatttctgttgaaagtagtgactcgcagcatcttgcaaagcggcaaatcccattagtggcgagtagtgtgtccaatcattatgaatagcttgaattgccgctttttttacgtgacttggggtgggtaagtcaggttcgccgaccgttaatctgataatatcgggaatttgactgattgcttcatcgaagcgtcggatgccagagacttgaatttgttggatccgaatatttgtattcatcattaggaccttcctctcaacgtgattaccgtttataataaacaacaatcgtccggttagaaatagacaattttgataaaaatgaaaggacagttgtgtgatgccattaaatcgtcagtcaacgacaccgttatatattcagttataccagcagatgcgtgatgactatgatgctactcaagccaaccaccagttatggtcaattcgtaaaatggcacaaaatttgggagtttccaagaccactgtcgaacaagcttacgatcagttgctagcagagggctatgtttataccgttcccgggagtggctacttttatcgcgatcggacacactggccagcagctaaacaggcgctggagactgtgccacagcccactaaacccagggcgttcacttatgattttcggtatggtgtgactcagttgttatcgccaagttggaacgcttggaaacgggctgtccgactagcgttgcgtcagactgagcagcaaccaacggccgtttatccggatgcgcagggcttaccggctttacgtgaaaacttggttcgatttttgaaaacgactcgtggtgtgcggtgcacagcggaccagattgtcatcacgagtggggctaaggcaggtctcagtattctacttagtatcttgccacgcggaacggtcggaattgagaatccaggctaccgcggtttatccgaattggcggctagttatggacagacggcggtccccatcagagtgacggaagatgggctcgatttgacacaagttcgtgcgcgtaatcctcagatcatttatacgacccctggccatcaatttccattaggagtcgtcttgcccatcgagaaacgattagcgttgttacaatgggcggggactcagcatctcatcattgaggatgattatgatagtgaataccgatacagtgcgcacccattacccgcgctacagtcgctagcaacggctaatcaggtggcttatttggggacattttcgcggggaattgatccgacattacggatgggatatttggtcttaccaccacaactggtggcaacttatcatcaacggtatcaatatcgggctgaaatggtggccggcctgttacaacaagcaatggctaattattttgaagatggggcgtattatcggcaccttagtcgaaaccgagctgctaatcgacaaaagtatcgggtactttgtcaccagttagcgcaaactaagcagatccgaccaattgcaaccggcgcgggggtacacttagttgttcagattccaggcattgcacaggctaaattattagaagccctagaacggcaacaggttcggatttatccgcttaactccaattggcgcgacatgcccacggcggactattacttgttagggtttgccgggctgacactgtcagagttgacgaccggtgtcaaacggttgattcaagtttgtgaacaactggtagggtaggcgtttataagcggaatgggtggtgttagggattattgcgacgctagttaagctaatccgcaggcgcaatcccgaagagcaaaataaacgtgtattgccgatgggcagcaacccatccaattgttaaagcgatataaaaaggaccagttatcaacacgttgttaggcaagtgttggtaactggttcttttaattaagccatttaagtgaatacgctaggacggctagttgcggtagacccagcggtgaccatcttgacgtaataattcatcggccgcatctggtcccattgtaccagggcggtagtttggaaattcgggttgatgttcatcccagtatttttgaatgacgtcaacgaatttccacgaatcggcaacctcttgccagtgggtaaagttggttgcgtcgccatttaaggcatcgtgaagcaaacgttcgtaagcttctgggctaccagccgtggcttcagcatcgtgagaataattcaacttgaccggggtggttgcgaagccttggccgattgctttagcattcatgcggagctcgaagccttcagtcggttcaacgttgattgtcaagatgtttggatcgagactggttgctgcgtcgtcattagctcggacgtcttcatgattgaagatattgacgactggccgtttgaacaccacgtcgattcgcgtgaacttatcggctaagcgtttcccagtccggatgtaaaacggcactccggaccaccgataattatcgatcatgactttaccagcgacgaaagtatcggtgttagaatctgatgaaatcttatcttcgtcgcggtaagctttagcatcatcgccggcaccgtattgaccacggacaaagttggttgcgacttcttctggtttaagtggtcgtaagctccgtaaagccttgaccttttccacgtcgatatcattttcagtgaattcaactggttgatccattgttaacagactcaaaatttgcaaaatgtgattttggaccatatcccgcaaggcaccgctgttatcatagtaaacggcccgttcttcgacacccagtttttcacttaacgtaatttggacattgtcgatgtaacggttgttccataatgattcccaaatattattgccaaaacgaatggccgtgatattttgaatcatttccttaccaaggtagtggtcaattcgataaatctgattttcgttaaaagtagccgttaattggtcgttaagttccttggcactttcataatcatgaccaaaaggcttttcgataatgacgcggttaaaaccgttatctgtcagaatattttcggaacgtaagtgttgggcaatcgtaccgaagaagtttggtgccattgctaagtagaagatccggttgccttgtaaaccatattgggcgtccagcttttctgataattttttcaaagttcggtaatgttcagcatcagtaacgtcatgcgattgataataaaaatggctcgcaaattgcgtcaccgtttcctgatcagcattcagatcagctagggagtcactaataacttcatgatagtgatcatcagtccaaggacgccgagccgtcccaataacggcaaagtggtccttgagatagcccttttgatagagcttaaatagtgacgggtacagtttacgctgtgcgaggtcaccagtaccgccaaagatggtgaataaggcaattttttcgttactcatcaatttcacttctttactaagaatattttaaaccaagtacttgttcataagcattaattcagattaaactaccgtattaatattaaaccatacgtggtgatggtcaattataaagtactaatgttgcggagattttgggaactggtgtttcagttcacgctcagttgcaacgttttgcatgatcaaaccaaccgctaaggcgatggcttgaaaattaaagctttgcaatagcggaatcttgaacagaccaccaataatcgcgccgattaacaaaatggaaaagatttcgatgccaaacattgaatagaagcgttgtgcgaaccgccatgtttcctcattttcaatcgcacgtcgcgacatgtagccagcgagtgagcgcatcttaggcattcgcacgcgttgatagatccagagcaacagaatcactaggaagcctaacgccaagccaaagttgttattcgccatgttgtcacctcaattgttgaaagattacaccggttggcagtgtttaattatattataacaatcatcaggggtggtagtcgacaatcaggttcaaaaaccggacatttcaatattaatttttatggattgtcgaattaatattagtacaacctggttgagacagtttgaacttagtccaaattcatcatggcatcgtgaattataactggttgttaagtgtgctgggaagtttaaagtgattcattaaattaaattggttggtttgttaccaagtgtgccatggttaattgggccgctaaaataaaaatgaacgttcagaagtccttcgaactctgaacgttcatttttacagtgggactagctactaagaatggtgccggaagatatttattgagtagcaggattggttaatccgtcacgtgaatgacgattttacccgtcgtatggcgactttcgatggatcgatgacccttaatgacattggctacggagaacggtaatgtcgcaacggttagcttcacttgaccgctgacaactaagtgggctaagtcggctaggtcttgtgatgagccttgggtgaactgaaaggcaacttttttctgttgatcatgttgctgctcgtccgtcggttgaccggcaatggttgcaagctggccgtcagcttttaggaccttgagaccagtatcaatatcaccaacggtgtcaaaaacggcatcatagtcgtgcaagacggcggcaggatcggtttcatggtaatcaatgacttcatcggcccctaggcgagttaacaagtcacggtgattagcactagcggtggtcgcgacgtaagcgccaaaggctttagcaatttgaattgcaaagaggccaacaccaccagctccaccctgcaccagaatcttctgtccggattgcagcttaagattgtgcttcatgccgtaataagcggttagtccagcgattggcaaagcagcagcttgatcaaatgataagcctgctgggagatgggctaattctttagtattaacagtaataaattcaccataagtgccgttattagctgcgtgggcaggcgcggcggaaccaaacacagcgtcaccgatgttaaaaccagtgacggccttgcccattttggtaatgacaccagcgaaatcccaacctaagaccaatggaaaggcccataagtcagtaaaaggtgaggatagggctcccatccggccagcaatatccatgggattgagactaaaggcgtgaatcgcaacttgaacttcatcagcttgtggttcggtcgtgggcatgtcgaccatcgtaaattcatctgcggaaccgtattggttaatagcaattgttttcataatatcgtaaccttctttgattaagtgtgccgttagtataaactatggtgtccacacgatagcaagtaaaaagtaaaaaagttggttaatgatttggagaagcttcaaagtaagcaatcttatgtgctaaaaactgatcagttgcctgtaattgagcgatttgctttttcacagtagcacgatatgcgctcagttcttggattcgctgggcccggtttggaatgttgccgtcaccgctgagtagttttagatcaaggcctaattgccgaaaagtggcaacgaattgtagacgctctaaattttgacgtgaatactgtcggtagttgttgtggttgcgtggtacgggcccaatcaactgttgttgttcataataacggagggcgtccttggtcataccggtgatggcgacaacctctttggtactaaatgccgtttgttcggctggaatggtgaaaagtctcatgtcaattgctcctttttgactttagtatacacgtggtcagtgcttctcggaacaatactaaaacggatgaaacggatccgcggagtgggggccgcatttagaatgcaccaaatggtcaaagcacgggcctaggctgcgactacagcgttgcgattgtaaacaacatgcagtgtaagacttgatgctaagcgcggcttaagtaaaaatgatttcgtagactactcagcaccttttgcgacctgattggtaggtaaaaacggtcaggcggcgtatactatttagggtattgttttctcaatgaataaacttaaatcagaaatgtggtgaggagatgcaaaaagaagttcggttacggtggctgtttctagccaatttgctgaataatgcgggtgccgcttttatgtggccattaacaacggtctacatgcataattatctcaaacaaagcttgacgttttcgggaattattctttttttgatgtcgttggctatgattgctggtaactttattggcgggcgcttgtttgatcactggcgaccatattatacagcgctacttggtggtggtatttcgaccgcaattttaacaacgttgattttctggcatagtttgtggccttacgcgattggcttgatcattgtcggctttggtgatggtatcagcatgacagtcgtcaatgcctatgccgcaacggtaacgactagatccaaccggtatgtttttaacatgctttatttagcactcaacgttggggtcgttattgggacattattggtcggttacttgttggaactaggtatcaatgtggtgttcatggtggcaacagtttgctaccttggccttatggcgattacgctaagtacctttaacgtcacaccgactgttcggacagagaaagctgcgccgcagaagcgggatgtgacgcctaaaaatcaccgtcaattaatctggatgatttgtttgatgattttcaccatttatctgagttatgccttatgggaaagtattctttccgtgcacatgaccaacttggggattccgttccgccggtatagtgaagtttggacgattaacgggctattaattattgtgagtcagccgatcgtggcgttattcaacgaacgatttaagattggcactcagattggcttgggcattacgctatttgccttatcattcttgggattagtgtttgcccggcaatacgttgattttattattatcatggtggttttaacgatcggtgaggtcattggcttaccgattgcacccgcctgggtcgatgatgtggcggctgatgatcagcgcggaaaatatcaaggtcgatacaacatggctttgtcattgggacgagctgtgggaccattgttcggtggcatgatggtggctcagttctcctactcgttattgtttattacggtgactatcttaatgttaggtagtttggcgttagtcttgtggcgcgcccggcgagaacacttattaaatggttaaggagcaggtgggccccgtgatattaacaaagcttttaaggtcaaatgccttgaaagcttttttgattctttgaaagtgatgatggagacgattgacgatacaatttgagcattatcggatagaataaatgaattaattaataaaatgaggtgagtacgtgaatttgatggtttccagttttattctggtgttggctgcggttgttagtatttttatttcccgggtaatgccgcaaatatctgtgaactacttgagtctgatcgtcggtattggcttgttttttattccagttttgagcaatcatattgaaaacttcaattctgaaatctttattggcctgattgttgcgccactcctgttttttgaaggacaagccactcgactgaatgctgttggtaaggaattaaagcacattatccaaacgacagttggactagtcattcttgccttaattgtcgcgggatttagcttggcagggctgggattagtcggcttgccgttagcttttattctagcggctatcagtacgccgaccgacgccacggcaatggaatcggtgacgaacggtttggagatgccatcaactgagggaacttttttaaaaatggagtcgttgtttaatgatgcttctggcatcatcttattgaacatggcggttctctggtatgctaatggctatattaactatgggcaaacgattattgattttattatttcagctgtgggtggggtactctttggttttgtcagtgcctggatcatggttctgtttcggcaagtattgttacgctcttcgtataattcgttgaatgcgtcgctgttgatgtacgtgattacgccctttattttgtattatgctgctgaggcgattcacgtttctggaatcattacggttgtggttgcgggattagtgcataatgcggaagcccaacgaagccggttaattaatgcacaacaagttcattttgcttttgacttggtgagcatgattactgaaatctttaatagcatggtgtttgtggttcttggattcatgtttatcaaaattcttgttaacgaacaattcgggcatgggtccttgaactttttgttgattgggcttgttctgtatattagcaatgtgctggtgcgttacagctacggtcggttgcggttgagtttcaaaaatcggcccgcatggatttttgcgctaggtggcgtgcacggtgcggtaacgctggccttagcctatacgttaaccgatactgcggtcggacgtggtgactttaacttggttctaatggctgccagtacgttgattattctgagtatggtcgtgccgacgattatttttcgctggttgctaaagccggcgttgactgatgatgaggcaactagtgagattgatcagattcgggtggcgatggttcaccacgcgattgatacagttcagaaaatgtatttgccgccgaatgtgaaagaatccgtcatttttgatttgatgacccagaaacaacggactaggactcgtgattttgcacgggcctgggttgacgttgttcggcgaccggaatttactggtgcagaaaaagaattagagatgcgggcatttatgaatgcgctcgaacaagaacggcaatatttggatatgatttcacaacgagaggtcaagtatcagaagtacgtttttaaattgtacaatgaaaccttattagcggaatcactagtcatcggccccacgatatttgataaggataaggcaacggaatagcgtgaaatcgtcgttactgaggcgattggtcaacttcgtgctgtgaacacaatcaaggtccaagttagcgaaaactaacttggaccttgattgtttggttaattcgattaaaaggtttgattgtctaaataggcggccaaacggtctttcatcacgttatagacgcgttcagtatcaacggcagtcccgcgaagctcataatccgcaatcatgtccgtgtcaagttgttcagcataacgccgagcggttagacagtactgatcgttaaagttacggttaccagaaccaacaactccgagacagaaccgtgagttttgatcgtagttaagatattcacctaacacgttggtcatcaattccttaaccccattgtcaatgccgttaccaccgtcaaggtaggttgggacaaaggcgaagtagggttcagtctcaatggcaaagtctgactgttcggtgatttcttttaaggtaattaacgggttgctatcatcagctgcatgctgggtcttggcgtaatcctgcataccggtgacaaatgagcgggtattgccttcaatggagatataaatgatattgattgttgattcactcacagcagttcctcatttctgttttacattagttttagtttacgctgggcactacttaattgcaaacgactgcggctccgaatcgtcgcagtttgtcgtgataacggccggcttaagataaacttaatttttagtaggctttcccttaaatcaaccgcatccaatttatgtacaacaggttagtggcaattcacacgacttatcatataaaagtaccaaagttgaccagttgaagttcgccggatacaaaaaaatggcccctaagaaatcaactttcttaagtgccattttaagtagtgcgtgtaaatatttagtcttgtgtttgatcgtcattatgatcgtcaggtgtgctatccgtctgggcgctaacctcaaaccaattgatataagcattttcaaaatcaagcgctttgaaattgaagttaccgatttgaatcgtatcaccggcttggattttaggaaaattatccaaaatataaccggtcaaagtgacaacatcggaatcttcaaattcttgtaagtcggtcttgaagtagcgttcaaagtcgtagatggtcatcttaccactgatgcggtaagtgccatcggcctgcttttcgatgtattcgttagaaacattgtcgatttcgtcattgacggttccgaaaagttcttcgtaaatatccttatcagtgacgatcccactggtcccaccatattcatcaaccacgacgacgatcggcgtttgtttgtcgatcatcttttggagaatggcttgaatcggtgtagtttcaggaattgtaatgatattacgcaataacttattgacccgaatatcatcgtcaacttcaccttggcgaattaagtcatagttataaacgtaacccagaatcttgtccttatcattgttagctacgacgggtaagcggctaaagcgtttctgtaaataaacgcgaatggcttgcttgacggtatcgttgatatcaatcacaactagctgagtacggtcgatcatgatatccttagcgatcttgtcattgaactcaaatgcccgctccatgtaaaggtaatcgttacgttcaagctcaccgccagttacggcatttcgtgatagattaagaatttcggcttgtgaataaacatcgttatcttcattcgcaactgggatgcctaacattttgacgacgccagctgatgagacattcaacaaccatacgaaggggtagaacatcacgtggaaccaccgtaatggtgtcgtaataaccgccattactttgagtggcatgtcgattgcgatatttttaggcacgatttcggttaagaccacttctaagtaggtcagtaggaaaaccccaatgacgatactaatacctcgtaataccgcggttgagacggataggttgaagagggataagaaatcaagcacaaaatgttcagttgtttgttcacctatccaacctaaaatgataccagctaacgagactcccacttgagtggttgaaagatactcgttaaggttgcggaccatgtgcaaagaagttgcgatccgttttgacggtttatcacgttttttttgttcttcttcgagagcgctagggcgggtctgaacgagtgcaaactcacaggccacaaagaaagctgcgacgaagaacgtaatgacaataatgactaaatttaaaattatctggccactgtccaaagaaacattcctcatttcataaatattagttactttaagtataacgcgaagtagctaatattataaggcctatcacccgttttgtcagcccccgtgacggttaattaattggtctatcgtagtcagcgggcctgctggcaatcttttaagcgccaataatgcaatcgcgagaaagatggttaacgtttccaatgaatggtgctaaactaagggtataccaagtaaagggagatctttaatgatgccagtagaaacgaaaactaagattcatgaggattcgaagaaattggtttatcaagatagtgatgtcaaaaaagcgatggatttaattcgtgaccgtggttacgtgacccgtgcagatttcaatcagatggacgatgcggattgggcggccggttttgatcaaaagattgaagccgctttcctaaaagtggaaggcgaagacccgtacatctacttcgaacaatttgatttcaagggtggcgacattgactcaatcatctttgatatggatcaagttggcacgcgtgaccatgccttagatttacttgctgaagccattcaccaacaggcttactaagaattgatttgatacggaggttattgacatgcgccagcaattattcggtcatcatctggatgatctactaaagcccaccaaattattgaagcgggctcaccgggaagcagagaacgtcttaaacgcacacgttgggatgaaaacggacgtggttgaacatgacgatgattacaccgtaacggcagaattacccggttttgataaggacgctattacggtgaagtatgctgacgaatggctaactattcgggcgcaccggtcgcaagacgatcgtaacgatgacgggcgcgtactccatcgcgaacggatggacgcggactttacccggaagtttcatctaacgaatgtcgtgcgcgaagagattcaagcgcattatcaagcaggactgctgaccgtgacgttgccaaaaaccgttgcggatagcgaaggtaagatagaaatacaataaataaaagcatcgtcagcgaattctgacggtgcttttattcgatacatacacattgatggcaacggatttttttgcacacttaggggtgctgttagcaaggtgctgtctcaactagttgacagagctagcaatcagtcgtgacaacctagtgagcacgaatctgaaagtctgtagcataaccaggtaccaattcagcgcggggtagtcagtgaacatcggtcaccacctgagcagcttattagcaatcatgatgtgatttaaagtgcgagcctacttttgctcatcagtcgcatcgtcattggtgtcttcagctttattagcgtccgagatgctcatttgaatcgtacggggacggtctttgataataacaatcgtcccatggccgaggaagtctttgggcccatcataggccatttcatattcattggcgaatgagccggatttttgaagtgtcatgaagaaaattttattgtcttcgtagtcgtcactgaacatgatggccatcgtgctatcaatcaataatttctctttgcgcatcgctttgagacggtcccaaagtccggcaatcactgcttgtggaatcaattctttaacatcatcaccgacacggagctttttggtcatttcatacatactacataacctacttttcatttgtatttgcattaacccataaatgataccatattcagaaattaatgtgatttacaatgtcatctagtttacaagactagttaatctaggtataattaatgtaacctatttatcagaggaggacgcagcatggcagctaatgagacttatgcagattggcaagcccgcatggcaaaggtgattctgccgaagtggatcgagttaccgaactttgacttatatatggatcaggtcctattattaattaatgaaacgttgcagccattaggtgctgatccagttactgccgcaatgatcaataattatgtcaaacataaagtgatcttgtcaccagtcaagaagaaatatcaaattatgcaattggcggatattattgtcattagcttactaaaaccgagttatccactggataaaattcgtcagggaatcgaccaagtgactgcgactggctatcccaagcgagcttacgacaattttattacggtattaacgaatcaacttcatcatcccgatgatccaattacgatttctgatcaggatctcagtcacagtttaacaaccgcagcggctcaactgattgttaataaattgcgcacggatgaattattgcgacttaatcaagtacagaccaagccacaacaaattgaaaaataagctgaatgcggtggaccaagtaatgtcagttatttggtccatacgtgtttttttggttgctggaatgacggggctttagtatcatataaaatgattgtaagcaatttaaattgggatagagtggatcaacagtggtttgtttgttaatctgctttacattgggaagagtgattgatatgaaggtgtttatcagtgacgatcaagaacaacagcgtctctggttaaacgacatcattacggcacagctggaggcattgcactttaattatgagttagtctcagtatggcagccgaccgatgtgttagcggcggtaaaggatggcggcggaccaaatctttattttttagatatcgttttacaacgcgaaatcaatggcattcaattggcctctaagattcgtgattatgatcctgatgggtttattgtctatgtgacggtgcgtgatgacatgatcccggatacgttgagtgcgatgacaacaccaaccgggtttatttcaaaaacaaatatgttcgataaggcaaagtttgttccagaagtacaaagagtcctacaagtcgtaaaaaaacggttaggtatgttacagcaatctgctgaaccgactttaacgattcgaagtggtgcgttattattaacgctgaagcttaaagatatcatctactgtgagaaggaacatgggctgcggaccacgcgaatcgtgacgacgacccagtcctatgtcgtacataagaatttaaatacgattaaggaacaactgacagcgatgcatttttttaatgagtttcaaagttatgccctcaaccttgaccatgtgattacggttgattttaataagggcgtgattagtatggacaatcatgatcacttgacctttagccggggaacgatcaagaagttacgggcgtactaccagacccagggataggatgagtgtatgataactgaaacacaattaacggcaattcaaacgtatgctttgcaaaagcttgctcacgatcatagtgggcatggtcgcgatcatttgcagcgggtcaaccggctagcacgccggctggcaaaagccgaaggggcaaatttaaatctgactttagcggcagcttggctgcatgatgtgatcgacgataaattgatggccgacccagcgaaggcgcatcaagatttgattgctcaattgaacgcgcaaaatgttacggctgccgatcaaacggctatttttgcaattattgatcacatgtcattcagcaaatccttcaacggccctcaaaaattaagtcttgaagggcaagtcgttcaggatgcggatcggttagacgcgattggcgctatcgggatcgcccgggcgttgtattattcaggtcatgtcggtgaaaaaatctatgacccggcaattgcgccacgtgaacatatgacgcgtgaacaatatcgacaccagcccggcacggctatcaatcacttctatgaaaagttgttcaagttagcagctctcatgaatacggatactgccaaagcactggcagcccaccggacagcggtgatgcacgagtttgttgaccaatttaaggctgagtggacggcggatgataaggcgtaatggcatccctacgtctagttgagtcactagttctttgagctgagatcatgttatcagatgatgcaattaccatttatattggctaacgaaaaaggccatcacaagaatgtatcgtgaattcttgtgatggcctttttagctcttattctggttttaaggctggcaatctaaatcaggcacggttggtcagaagatgggttaccaacatgactagtagggacacgagtagtgagtaacccaagataatggcgaccattagtccccaagtaactaacgtatggatccaaccggtgataccgatgaacgtcagtaaggtagtcagcacgataatgatgacgatggtgctatacaacccgatcgcactattctgatagtcagcgggacttagatcgaagccaccaatcacaatgacgagggttagaaagagcaacattaatagttgccaccaactcgttggcgtactggttaacgagtgaaaacttgcagcccattgtggttgttcgggtgtatcagctaatttgaagatggcttgaaataggccaggagcgagtagccagtctagtccaaggagtgccgctgtgcatccgaagatgggggcgacaccaatgaacaggttaccaatgacttgataccggctgtgccgattccaagtatggttaacatagcctagtgccagatcatccgccgactcatcttcaggatggaggtgagggcgtttgagcagccggaccgattggatgccgtggcgaaaaatcagtgcgaggattagatggctaagctcgtggatgatgatgcccagaaaaccacagtagacctgactgttaataccgtagtggttgaccagattcgctttggtttgtcggttgataatcgtcagtaaccaagcaaatagtccgggtaaaccaatgatgaccagcaagacgatgccgttattcttgatcaagttatccacgaggctactccgttattggaccaaaagtgccgtgcacgagcttgcgtagatcatcagcgtcgatttcaattgaacgcccgattttacccgaagatacgagaatcttaccttgctgcttagcggtctcgtctaagtagatgggaaacttcttagtttcccaaataccaactggtgtgttggcgccgtgttggtatccggtagtccgttccaagtcctttaatggaatcatgccaacttttttgttgccggatagcttagccaattttttatagctgaggtgctcatctaacggcaagacgccgacgacgggaccggtcttgttaccaatcagcgctaaggtcttgtagatatgatgttcgtcaacaccgaggtggtcgacttgtaattgttgaacgtcgccttccgtttcggttgggaattcatattgttgatagctgatatttgctttatccaaaatcttttcaacaagtgttttacctaattgatcttttttcttcttttttgacattattgttaacctcacatttattaaaaatacggtccaattttataaatggaccggaacaattcacccaaacgccattaattctgctatacttgaggtatgaaataacctcaaaggagggattacaatggctgacctagtttatcaacaagtcatcaatgatctcaataaacggatcatggcgaatgaatttgttgataagaagcttccagatgaacgtagtcttagcgaacagtatcaggtaagtcgtagctcgattaagcgcgcgcttaacgtgctagccaataagggcctgattttcaagaagcggggttcgggaacgttcattaatccattatatcttaaaaatcaatcttcgtttaagtatgaaggaactaacctaggaattacggacagtttaaatactgagggtgctaagcccagtattcaattattagactttcgcgtcattcctgcaagtcaagagttgcaacaagacttatttttaactgctgacgagtttgtttatgaaatcaaacggctgcgattactggatgaccagcctttcatgattgaaagtggctatattccaatcaagcttgtgccccagttgaaccgacaagtggtcagtggatcgatctttaattacgtgcaaaagaccttgcacgccgcagtgaccaaatcattcttatcgattgcggccgatgcgtccaatacgactgatcaagagttgctacatttgcagccgaatgaaccggtgggcctgatgagtgggatcttctttttagatgatgggacaccctttgaagtgtctaatatgcgattacattatcaatatatgaagtatacaacgtttgtgtcaacgaatagttaggagtctgaggtgtcatggcactgattcgtattaattttatggcggctagtttacaccggaccgttcccctgatggtgtgtttaccaactgataaattggttccagatgagcagggcgtgccgcgcccgattcagggtccgtttgccaccctgtacttattgcacggtatcttaggtagtgaagtcgactggattagtggcacacgaatccagcgctgggccgacgaacggaatctggctgtcgtgatgccagcgggcgagaatagtttctatactgatcatccttggtctggggagacgtatagtcaatttattggtcaggaattgattgattttacacgccggacgtttccactatcacaccagcgtgaccaaacttttattggcggattatcaatgggtggttacggggcgctgtataacggactaaaatttcacgatacttttggggccattgtgagtttatcagccggactgaatgtgcgacccggaatggaaaagttaccggcaaagcctcagtggtttgcggaaacagtcgcatatcagcatggcgtttttggcccagatctagcagctgctggtcattcagaattaaacctgcaagtgctcgtaactaaattactggcagctcacgtcgctttacccgcgatttttatggcgattggcgatcaggacggcttaaagtcagcgaatgatgaatttgatcattttctaacgaccaaaaaagtttcgcatgaatatttggtcggttctggagcgcacgagtgggatttctgggaccgctatctattaaaagcactgaactggttgccactaactaatcagggcgccggtgttaattctgggcatattaaagctaattgatgggctgcttcaatcattctgcgtacaaattattaaaaaatatattaatctaaaagcaaggtgtcccaagggatgagccttgtttttttgttttaatttataaaattggaccgttccaattaacaaaaaggttgattttttgaaatgagttgttaaaatagaacttgtaaacgaaaacatttaaacagttagcgttcaagtgaaaagcaaattaaggagtgtttttgaaatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccatgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaacccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaatgacgatgcgacattgccagtatggccaatgattgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataagcagttaaaatcttaatttgaaaatagcgttgctactggcctgtgcctccagtagcaacgctatttttgtgcgctattaattgtgtcgattggatactgtcacaagtgctgattggtgctggaatgtagcctatgacgtcttaatcagaacctagctaactgacgtttaatcaagaagcaacttgcaatgactagcataatgtgaattgtgagcatattttaattggtttttaattattcctgttataataacgctacctaagctgatactagtgatggtgattagttaaggatgaacgggtctgacgcaatcagctcagcctaacatcgtcgattccggttccatgaaccgagtttatgtggaaaggagcgactggttgtttaatcgccagtcaacgatgctaatgaaaattttgataacagtcgagaatttagtgatggatggtgtcaaacgagcggcgacggtcctcggcaatgcgttgacctcgcaagccgaagttgccttttactccttggcccaaccccggtctttctatgaactgagcgcaccgcttatcacggcgcgccggcctgcaagtgcgacggtacttaattactttggcgctgatccgttgaccgtttatgcgcctcaaatagatgatttactcacgacgattgggtcgggagcttacgatgccgttattctcccgggaggtttactgacgagttttgctccggcaatcaaacagcgttttccacgggtcaatgtcattgcgtggatgcacaataatgttgatatctacctcaatcagtattacgtccaaatgcaagatgaactggtcgcagggctcttagcggctgatacggtcgtgacattgaccgattatgattgggaaggctactcacgttttaacgcccatacggtcaagttctataatccaccgaccatgcaagctcatggtcagcaggccgacttggcgcaacatatcattgcctacactggtcgtattgacctgcaacataaggggctcgattatttgttgacagttgcgcgagccttgcccgatgattggcaaattgcagtcgcggggactggtcccgaagaccaattagcaacgttcaatcgattgatggctgaactcgatgttcgtgaccgcattatttatcggggtgcactgaaagatactgagttacgggcgcattatcaacaggcgagtgtcttcatgatgacttcgcgttgggaagggatgccattagttatgggggaagcgatgacgatggggttaccgatcgtctcaatgtggaatactggctcagccgagtacttgcagggtggccagtacggtgtgttgactccggcccgcgatgtgaatgctctgattactggcttaatgccactgttaactgattttgaatgtcgcgctgaatatgccgcgcgcgctcggcaacgcagtcatgactttaccttgagcaagattgtccggcagtggctggcactattgaatcgccaatatgttccgcaaacggtcgtcgaatcaaattggcctgcggatttgagtagtgggggacattagcctgtcatagcggtcatgataatcgctcagtacctaggacctgaatggttggtgctgagcttttttgtcattgatggtggggatttcctttggatagaactattatataaaaattatgaattctattaatcaatttgcaaacgcgtgacgactttgatacactcaatcaaaaggtcagccgtgcctgaccgcattggaggagcttgctattgaagacaacgtggctggctagtttactagtcacaatcttttggggcgccgtattggggctcgttgtaacgtatttaggtggggcgatggtcgaggctttgaccgccacccccatcgttcgtgaaccactcaaagccatggcggtgggtatcatattggcagtgatgagtgggttattagtgacaacgcaccattaagaactgtatgctggctttaagagcgcttagccgaccgttaacaagcttgataaattaaaaatgattcgccttcttgtcagaggaaggtgaatcattttttagtgtagatgaatcacggggttcaatggtgaactaactgtccggagtgcgttgcgcaaatgctcacgatttggatagtcggagtagtttgagtaacgtaccggcaagttcttcacgttgatgggctggcagatcactcaggtagtcgagtaatgcaacaacattaggtgattggagaagctcgtcgcgaaagaagtccgctatttttaaattcagagtttcagcgattgcggtcaaactttgtagtttaatgttatcgaccttaccacgttcgagtcgagaaattagcgagattgaaacattcgattgttcggccaattgctcgatggtgatgccgtgttgctgtcggcgttgccgaatgattttgcctatctcggttaacatgggaatcctccttaatccattaagcgtcttagcactaattttagaggtttcgctatgcttgaaacagagctgtaagtaccttataagtaccgttataaggtcattaaagcttttgatacgtgatgctaattaaatcacgttactttgctttcagttatcgaactcatgctgaatttgtgatccgttgaatgtgacaaagcaattattaggttacggttaatgataaaatagcaacatactataaaggtctttaaatacttcttttagtcgtatataatgttattaaagctttgttataacgctattaaataattagtatagcttgcaaagcagaatagaaatcagagtgttgggaggagcttatttcatcggatgtcaaattaatggaggagtgtaccaaaaatgaaaatatgtccaaattgtcagcatgaaaatgaggctgataatgttttttgcgaaaattgcggagcggatctgactcatattgacagtgctgaacgaacgcaagccagtggaacggagcagaaactcggggattcaaggcaatatcaagctcataaaccagctaagacgcagcaatcaaggtggttgcgaatcagtggaaacgtgctcgcagtcgtcattattgtgggaggtggatttgggttttatcaatatcacactggtaaaaatcagcagattgccgcggaagtcgaaatgatgactagtaataagcccacgacattgtcgaaacacttagttagcgataatactgggttaaaaatcacaaaacagtccgtaaagcccttaatgacctatatccaaaaacatccccagtacgcacaagatctgaaaacagacttacagcataacggttattctagtgatcacacgtttgttgttaagcaaatcggaactaagtggacactattcccaacttacaaattacgcgtcaccacgatgcagccgttaatcacgaccaatctaaaaaatgccacactggaagcaaatgacatcgaattggtgaccaccgaaagtgcgcatgccacttataaggttggtccgctgtttccggggacctatatgtttaaactaagtaattctgacacgacaatcacgcacaaggttaatctgatggggcacgcgaacgtccatgaattaatttcgttagttgcgaataaaaaggcagcgacaacgtcaacggcgaatactgacaccaaagctaccactgccagtgatgaatcagactcgagtttaatcaacagcgagaatgaatcgcagagtggtacgggcagtgcttatgatgatttgtctagttcagctcagacagctatgtcagaaattgccgcggctaccggtggggatattagtgattatgattatacggcgagtgaaccacacacggatgtgtatgaaattaaatgctatgttagtggtactaatgatttagcagatacttatcgatatgatgatgttaatgatattctagcgcgctacaacacgagtaccggtaagtttgaaacggtagattcaaatgattaacgagaaatttatgattaatttggaggatgtttaaatgaataagcaggcacttttttgctcgcagtgtggcaatcaactgaaagccggggcgaagttttgcccgaaatgtggtgctgtggttgccccaaaccaggaaattccggatcaagggcagtcagttgccgaatccgagaatacggttgaacgtagtagtgatgataccgtcaataaaattttgaccacagataccgtccaacatgtcaaaaagttctctggaagctacttttcgtggtttaagatgacgatccggcatcccggtcatccgattgaaccgactaatcggtactttggactaacttcgatcggtcttgaggcctttttactggttttatcaattgcgttaatcttacgtaaggcacaaaatgtcgccaatgattttactagttcattgactggtggtagttcggaagctgcgattcatgctggcagctttatcctaaaaacgagtatgctggtgtttttcatgtttcttgggatatatgcgatttatgttagcattgcctatgcctttcgccgcgttgttaatactggttcgatgcaatttagtgattttatcaatcaatttgcagcaattacgaatttgattctaatctttaatctactcacgttgcttttgacgattctcactggaactggtaatttttctggcatgactggattgttcttctttatgatcccaaccatcgggattatgaatctggcatttatttatatcattattgataatgttgtgaagccccatattgacaaattttatgcgttaatcattgctgaaatcgcattaggttttgcactatctgtttatgtcatgatattagccgttttaggtggcaatatgcttttctcacaactatcgtcactattttcgtaagcgttagtaccgtcggattaccgccgtgacggattagttaatttttaaagagacgatgccatggattcagagcggaaaaaaaggggaccagattttgaaaaaaagtgaaactgtctgtatcagtctgctgttactgttatttattagcggttgtggtagctcacagcaggcctcgcaagcgtcacatgcggataagaagcatggcgttagtgtggtcaaagtgaagcccaaagtgattactgataaggcgcacaaaacaaatgatgcaactaaggcaacgagtacgtcagtcaacgcaagttctcagtcgacaaaaataacgtctcaacaacgaggggctacgactatgaatcttaatgagatcagtcagggctcctatgggagtttgttaggtgactggaaggaagttgctagtagtgtcaataagcatgatactaagggcgatgtttggcaatctcccgaggctggcgctaaattaaccgtaaaagacacgaaaatcagtgacggtgaaatggccttagcaagcgggaaatttgaagatgcgaatggtgatgaagaggctgttactactaccatcaaacaggaaaaaggcgcactgcatatcgatggtgatatcggtgcagctgccgtcacgtactggttttatccaaagggagttgcaatcagtggctggggtgataacgttcctgccaccattaagacggatactgagcgaatcataacgcgcacaagtaataattcttatgtaaaagtttttgaacgtcaaacgaccgccgccaatacgggaaactgcaagtcgacaatggcgctcggccagattaaaactggtgattattcaagtttgaatgggacttggcaaaatggacaaggaaatcaaatcaagattcataatcagcggatgaaatttagagattttggcctgacgcaagacgctactccggggacgattactaaactcaaaatggatgtgccatcattagatgatcagcaaggaaattctaagacggttgatggattgaagtatcatcaacaattaacttatcaaacctcaaacggtgccagcatgcttcaaggcagtttttcaatatcaggctcatctggcggactttatgatgtggtatttatgcccggtggaaataatgctgacctaaataatggtgatagtagtcgggaccgtattgcggcgttaggaacgcaaaatgatccccaaaacattccaagtgataagatttattatcgctcaaattaacagtttagaggcataattaagctctttgtggctaagataaatatgcaggtgtcaaaaaaaggaagctcactgagcttcctttttggacccttcaagatagatactttcataacagtttgatggcaagcgtcggtagccagctgaatgaagttgaacttgcttagtcagtagcgctcaattaaatgcggactattaaataaacttggcaatggggccggtaccgtcacccgtgtggtgctaaatggaagttgtagatccaacaattgggcatgtaacatcagccgaggtgccgactccgcttgcgagtcgtaaagtggatcaccgataatcgggtggtcactggcggccaagtggacccgtagctgatgggtacggccagtatgcagggtcagtttaactaaactctgatgggcggttgttgcacatacttcgtagtcggtgagtgctggctgggcatcggccgtgttgacccagcgtttgcgtttgtcggtagcatcgtgaccgattggcgcggtgaaatgcccagttggcgtggcaaagtgaccacgtacccaggcataataagtccggcgaatttgcttgtcactgattaagcggtctaaaatcgggacgacgaccgggttcaatgcgactagcatcgcaccagaagtcatctggtcgagccggtgaaccatgtatggcacctgctgagttggttggagtgtggctgctaggtcatttaaaattgatccggtttcacctggttgattaggatgcgatttcacgccagcgggtttatcaacgactaacagatcgctgttttgatataaaatcgtggctggggccgtggcagccgcaatatagttcgaggtcggagtccgaaagtcactggggataaacgtcagcgtcaggcaatcaccagtattgacgagttgtgcaatcgacgttggtgtaccgttcagctgaatccgccgcgtttggcgtaactggccctgaatccgctttggaatcagccaagtccgaaggcaagcccgaatcgactgttgattcaaactagacgggatagtgagttgataagtccaggtcatgaataaagctcctttataacggggaagaagacgggcaacgcacggaaaccactaaaaaagtctggaacgtatccagacttttttgttagtcttcttttttagcggtcggcttaacgatcaaaacgtcacaaattgcgttgcgactgacgtaggtggttacggaaccgaccatcaaacgttcaacggcagataagccggttgaaccaatcataattaattcattatggtggtcagcgggaaattcacgcgcgataaccgttttgggattaccaaaacgaacatggacatcaacgtcggtcaccccagcgtcaattgtttgttgcttgagttcttccaagcgcttttgaacgtcttccgacaacttgtagatgacatcaccactgaccgcaccgccgtacgtgtcactaaattggttgacttccaacacgtttaaaatgtcgagatgggtcttgttacgcttagcgacttcgatgccccgccgaagaacttcgtcggtagccttggagccatcaactggtaccaggatattttgatattgttgtaacataatggttacccccgtttgatatggctagttaataactatattttagcattaattttcagcaatgtaagcatttaaaatcgatttatgattaggtacgtttagctggagtgtctaagtaggtagcaattgagtaacaatagcaaggaaagcatttttcgaggagtattagcaccagtgatgattatctgcgagtgaagagattgggattgatgtagctgttattactcaacttttagcaaacaaatacgtaattatgaagtatgtactaaggaaataccgactaatatattgagatacggttgtttgaatgttctaacaatagtggatagttatggtgttatattttgcaattgtgacgtctcaaaacgatgtcacaataacattatatgttttgttaatcataaatattaacagtgagtagtttatttaggctattaaagtgctggacttttattttacgcaaattggcaatcgtaacgggccgtgataaggtttaaactaaagttgatatgtttgctttacgtaaaatgtaagtatttataactataacgaagaaaagaaacttgtttgttgttagcattaaaacatctgaaatctctaaaacatgaaaaagatcgtcaatgtaagcgttgacatatcgagaatagggtggtttaatattgatgtaggttgttataacaacatgacaagtcgtggagataaaaacaaaatggctagttcaaaaattgttccactttatcagagcatgcttaatgatttgattcgtcagattgagtctggtgagttggtagaaaatgctaagttaccatcagagcagaaacttggtgaaaagtatgatgtttcccggattactgttagacgcgcactagcagagctggaaaataaagattatatttacaaaaaacaaggacaaggttcgtttgtaaaaaacaaagaggacattgatttaggtattcattacctagatgtccgcaaagcaattgaaaatatgaatgctgttccagaaataagacttgaagcgtttaaattgattgtggatggttcggagtctgatgttcgaaaagtaatggaaataaactccgatgtttatttgtattatctacgttatatggtttatgcagatcatcgacctgtcttccatgaacaagtctatttaccttttgagcgcttcccacgtatttttaacagcgagattgttaataatgatttgatgccttttttggttaaaaagtatggactaaaggctagtttcttttcacatactcaacctgcgttaattactaaaagtaaccggaaagaatttgacttaaatgttggcgatccaatgatttatatgcagacacgtggaatagaagagaaagaaataatttactatagaaaagcagccgtggtaggaaatctgattatgtatatcgtaggttaattactatccgctgtgaatagagggataaatatgagtgaaccaaatattgtgcttacaagaatcgataaccgactagttcatggacaagttggtgttgtttggacttcctctgttggagccaatttattattggttgctaatgatgaaactgccaatgatcaattgcaacaagagctgatggcagcaactgctgaaacatctggagttggaattcgattttggacaattgacaagactatcagtactattcataaagcaagtccgcgacaacatatctttttggtgattcgcaatgctcaagatgctcgtcgattagtagagggtggtgttccagtaaaaaatctgaatcttggaaatatgcatttttcgaagggaaaggtccaagtaaccaagtatacttatatggatgatcaggacaaggctgatttaaaatattgtgcggatcatggtgtgaatgtttatgttcaagaagttccggaagataaaaaacaacctttggaagaggtgatctagatgcaagtcaccttaattcagggtctcctgattggactatttgctttaattgcaggtattgatttttggctagagggcttgtatatatttcgaccaatgatcgtatgtacagtgactggtgctattttaggtaatctgactcttggtattattgctggtggtttaacagagttagcttttgctgggttaacaccagttggtgggacacagccacctaatccaattatggcaggaattatgacagtcgtattggcgtataccaccggaaaaacaccttcaacggctattgggttggcactcccatttagtattttaatgcaatatatcattttgttttattattcggcgttttcagtccttactaaaaaattagatgcatatgcggcgaatgttgaaactaaaaaattcacaagattagcgctgttacctacagtacttgttgcattaacatatggtgtgattgcttttctgtgtgtttatggtgctcaagaaccaatgaaggcattggttaattctatgcccgtctggttaagtcatggctttgaaattgcaggtaatatcttacccgcagttggatttggattgttgcttaaaagtatgttaaaagctgaatacgtcccatatttattacttggttttacagcggcgtgctttattaagtttggtaatttgatgccggttgcggtaattgggatttcacttgcttttattgagttttatcacaataaaaaacaaaccgataacgagaaaaaacttaaatcaatgattgaaagtgccagtggaaacggagatgatggcgatggcatctaattcaccaatatcagaacgaggtagattaacgaagcatgatgtacgaatgcttggttggcgatcactgtttaatcagtctgcaatgaactatgaacggatgcaggcagatggttggacattggcaatgttgccatcactaagaaaaatttatggtaatgataaagagggcctagctgctgctcttgaatcaaacttgcaatttattaacactaataattatgctgcaccgctgttgatgggtttagaagcatctcttgaagaacatggcgaaaaaagatcgacaattgacggactgagaattgcattgtttggtccattggctggtatcggggacgcgattacatggttcacaatcttaccaattgttgctggaattacagcgtcttttgctaaacagggcagtattcttggcccattagtttttttcctagtctatttagcaatgtttgtagcacgggcgccaattgcattattgggatacaacgccggcacaaaagctatttcaaaaattcgcgaaaattcaggaatcgtatcacattgtgctagcattctggggtgcactgttattgggggattaattgctacttatgtacaaattgcggttaaaacaaagattccagtttcagcagggcatacgattgcaattcaaacacaattttttgatcggattttccctaatttattgccattagggtataccttcttattgtattggctattaaagaagaaaaatgtgagtcccgtagtcttaatattaggaacatttatgttggcaatccttttctcatggatgggggttctttagaatgaagataatagttagtggacacggaaattatgcaagtggactacaatcaacaattcatttgttagcaggtgatattgccaatatcgagtatatagattttactgataacatggatgatattcagcttagtgagcgatttcaacgtgctgtaattggtgagaataatgttgtctttatgtgcgatttactaggtggtacgccattcaaggaagctgttaagttaagtcaagtgagtgaaaaagatattgcggttacaagtggttgcaatgttggtgcattgcttgaagtgggttttgagcttacaacatattcagctccggctaaaaaattggctgaaaaattagttaaaatcagccaggtacaaactaaagtttttcatcatcaagctattcaagttgatgatggggtagaaggtatttagcgaaatatacagattgtccgattaacaagttatctgttgatcggattttttgtttggaatatgttattttgaatagaaaaagtgcacattataaatattttgatgaagataaagaattatgacttttttggttacagagtgtttttttaaaattaacaattgtgagtgaagtctattggataaccagctatctttaattagtttcaagtgtttaaaagtgaagttaattttaacaaagttaatattatcaagggatttaggcaagtaacgatactaataatgataactaactggtaattggttaataatttaaaatgataacggtgtcaatcaattgatattaataaaataattcgaagcgatctcgtttgaatgtccctcttcgacatgctaatattattctgtaatagcaggtgctacaggggaattaaatcggttgtgttaacagctaactcacggaaagtttggggattttaaaattgaaaattggaatgacaaaaaaagtagtaacttcattattgctaagtaccgctttgctgccgatgttgagtggtaaagctgatacggcaagtgcaaatcaaaaactggcagctgcgactaagggaaacagcgctgcttcagctgcaagccaacaagtgaccttaagtgctggcagtcagacggaaacgacagcggccggtgcgactgaccaatcagttgccagtgacggtgccaagactgacgatcaagctgaatcgaccagcacgacgacggctactaccagtgcaacaagtcgtgtcacagtgcgggcagccagtcaagccgctaaagctgacagtacaggaccgcaaagccagtcctccgccagtgaagctgccaaggataacgcggctgctagtgctacggcggactccacaactagtgctgttgatcaacttgataaaacggccaaagctagtgcagccacgagccaagccagtcacagtacgactaatgagacggctaaagccagcgcggccgcaagtcaggatagtcatgtcactacggaccaatccagcgcgactgtgacgagtgaagtagccaaatcagccgcatcgtcagccgcacctaagcaagcgactgagcaggcggtagccgcgaaaatctcaccaaagattgagacggctgtggcggctgatgcggtccagtcatcagcgatgatggcacggtccacgcgggcaatgactagtcaggaaatcttcctgagtcagattaaagcgggggcaatctctggttggaacaagtatcaagtcttgccatcagtcacggccgcacaggcaattctggaaagtggttggggacaatcacaacttgcaactcagggaaacaacttattcggtatcaagggaagttatcaagggcaatcaatctacttcccaacccaggaatggaatggctcacaatacattacgattcaagacgcttttcggaagtacccgaattggtcagctagtgttgaagatcatggcgcctttttggttgtcaatccgcgttacagcaatttaattggggttaccgattatcggcgcgttgccagtctcttgcaacaagacggctacgcaaccgcgccaacgtacgcgagttcgctgatcagcatcattgaatataacaagctacacgagtgggatcaagaagcgctcagtggtcaggcaagtggcggaaatgataataaccaagttcagcctgatcaagacgtcaccccaaccagtggtacacataagtttactaagacaacgacaattcacaatgcgccggacgccacgagtgccgtagtgggtacttacaacgctggtgaaacagtcaattacaatggtaagttaacggtcggtaatgcaacttggttacgctatcagtcctattctggcgtatcacggtatgtgatgattagtcaaacaacaactaatgataataataaccaggcgacagttacgccagctagtgggtcgtataagtttaccgcaaagaccaacattcgatcagccgcaagcaaaacggctcaagtggtcggcacttataatgctggtgagacggtttactataatggcaagattaccacgggtgggacaacttggttacggtatttatcctattcaggcgctcagcattacgtggctatgagtggtgatgaggttggtgctgtggctaaaccggacgtggttgcaaccagtgggtcgtatcgtttcacgaaaacgacagcaatcaagagttcacctgcaactagtgcgacaacggttgggtcttataatgctggcgatacggtctattacaatggtaaggtgacgacaaatggtcagacttggttacgttacatgtcttactcaggtgcccagcattatgtgcaaattagtggtgagagtacgtcgaccaatgttgataaaccgcaagtaacgcctcaaagtggtagttatcgctttacgcaaacaacggcgattaagaatacaccggccggaaatgccccaagtgtcggtacctatagtgctggtgatacagtctactacaacgctaaggtaacggctaacggccagacttggttacggtatttgtcttatttgggcgcccaacattacgtagcgattagtggtaatgccgctaccggaaatacgacgtctaagccggtaacaaacagtcaaggggcgttccgcttcgtaacgacgactaatattcgtacggcgccaagtacgcgcgcaagcgttgtcggtgaatataacccaggtgaaacggtttattacaatgggacggttcaagctgagggttacacgtggctccgatatctgagtcgctccggtgcaacgcactatgttgctaagcttgaaggctaggcatattagttgttccggcgtccaaatggctttatactaaggatattgaaatggaatagcgattacgaccgctattaatgtttcggcaacctagttggcttcggctgactaggttgtttttttactcggtttgcaatcgcttacattgtatgctatattggatttatcggaagagtcacaggtcagtatcaaactgttacccaattgttgtaacaaacccgtcaagtgatagctagtgcagtatagcagcgtttccgctaatttcggataactgactggcccaacctccatctattgatggcacggttatgtccacggagaacggattgccgccaatcaaacgttcacggatgtggatagtgaatcagtcatcttgtggtgtgaagaatgccacgccaaactttttgtatgattcttccaaaaaatggggtcacattgtgggtccttttttcatcttgctgtatgattaaagtaacctaaagctgaaggagattttaaaacatgtattatgtcgcaatgaaagatcatgagattggccgtaacttggcaaccgaacaatatttaatgaataacgtggatttcgatgaaccattagttttgttctactatgaagaaccgtgcatcattgttggtcggaaccagaacacccttgaagaaattaatgccgactatgtccgggaacatcacattaccgtaacgcggcgtctctctggtggtggggctgtgtatcaagatcttggtaacctctgcttcagctttgtggtggatagtgacagtcaagagtttggcgactttaagacatttaccaagccaatcattgatgcgcttcacgatatgggggcgacgacagcgacggtcagtggtcgcaatgatttgctcgttgatggtaagaaattctccggtaacgccatgtattcacggaatggcaagacgttctcccatggcactttgatgttgaatgttgatttaaacgttgtcccacaggcgctaacagtcccgaccgacaagattgcttccaaaggtattaagtccgttcggagtcgggtcacgaatttacggccttatttagcgccagaatatcagaatatcacggtgccagaatttcaggatgccctgttaaaagagttgttccatgttgattcgttggatcagattgcggataaggaatatcacgtgacacctgaacaacaaaaagctattgataaaatttacgaagactattatgctaattgggattgggtttacggtaaatcaccggaattctcggttaagcggcgtcaacactttgatatgggaaccattgatgcgcggatctcggttgatgacggcttgatcaataacattaaattttatggtgatttctttggtagtggcaacgttcaagatattgaagccgcccttaaaggtgtgcggtacgaccatgaggccatcgctaaagcgctggcagatattgatttaaatcagtacttcacgggaattgaacggtcagccgttattgacttaattgcccaataataggagtgatttgttgaaactgactcgcttagttgcatttgcgtttgtgtcctttttttgttacggtatcgtcaattggatgatgtcgactagccattttcacctgcaggcaaaaaatatttcggtagcggaaatgtggcaggggttgctgattgccctagtcttatattttctaggcgttctagcagtgtatattaatcgtatgctgggtttttacgtcctagggttagttgtactgatatatagcttaggacttgtcagcgccttaatgtcgggctatcagagtacggctggcatggaaattaaactggcgttagaagttatgggtgtgattggattgggaatcaacttttatacgttggtgttactgactcgctggcgacgtgcaaattaacgaaattgaataatgaatgagggataatgttttatgcaacgaaacgtacaagcttttattgatgatgttacggctgacaaggttacgcaggatagcttgactggtacctatgccaaactagcgaccaaggttaagccttggctggcgaagctggtagcggcactcaatgccgaccagcttgcccaagtgacgctgacggctaagcatgagccagctatcagctttcggttggagacgagtgttattaatttgccactggctaatctgaccgaaattggaaaggttacggcggcagaggatacgctgccaatcaacgtttacatgattgcagaatccgatgcgttaccgtcaggattgcgaattgatgagctgggaagcgttgccgacgtgctcgctgatcaagccaacgctgaaaagttattaaccgattggctgacggctcagactgatcgcttagaccagatcacggcggcggaagcttaaacgtaatctttacgagttaattactaaatctttacatgactatggtaaggtaagaattgatattggagccaagccaaaatcaaaataccaatggaattgagtgtgtcgttcattaaatcgaacgggatactcaatttttttggttgcgaaaagttaagtactgcggcccaactgtggtgagtaggagccacgaattttgtggcggtgcgacttgcattttatcaatgaagatgatatggtagtccatgcgatgagtcgatagagtcagatcgttagcaataacggttccgcgcgagcggctagtgactaatattgatagcggggcacgtttctctgacgtatttcagagtgtctgggtcactgacattgtggagtgtcactcccgctggttttaccagtgccgcgatgaacgcgtgttaaccattttcggatggctgacacgcgttttttttgcgtacagatcacgcataagactttcatagggtggactattcggcaaaagcggtggtcgactggatagtcgtaaaataaaacggacggccatcaggataagattatcccggcgaccgtccgtcaatggactgaaagattagtcctcttcgttcattgcagctgctgactcggtgttagcagttgcccgttgcatttttccaagcacaccgcgggcgattgggccgacgatgatgagttggagtggtaatgcaacaatcaagttaaagatccaagtgtgaccgtaagtcgctaaaacgtgacttccggacaattcaccttccactgcaatcccgaagagggacatgcaagttaccatgccaagaaccatcaagacggagatggtaatcccaatcaagacaacccgtttgcgcatgtaatcattaatgatatatttgaaagctaatcgtttggcaattggtcccacgaccaataagtctaaaatgatggcaacgaataaaccgagtgggtagccactaaggattgccattactaacccgttgctgaaaccttgagcaagggtaacgttataggcggtcatcacaaagaccattaaaccggccataatggcggtaaagacaacttcttcttttaaattacgtggcattctattcacacactcctagtttttttgtatcggttgattactatagcatgcgaagggggcctcacataagtaacaatttgatgacaaattatgaaacggttacattgttagcctgttttgggccgtagtcgggtgtcatttacgatatacttataaggggcagtatgatggcaaaatgaactttaaagaaataaggttgtggaaacagctttcaagttaacaaaattcatttctgctgatgccacggttgttgttgaggagatacgtagtcaagaaaaggatggcacaatgaatcttaggtgcccaaaaatggaccaactgagccaaatataatttaaagttaaatttcgatccagaacaggtaaacgttggtaaagtgagacaacatagcgtatgctgtagttagcatcagacaattaatctttggggagttgattatcttgaaaaaaatgttagttagttcagccgtgattgctgggatcattgcgctgggaggcggttattacttagaagccgaccatcagtctagtcagtcgcgggttagtgaaacacaatcagttgtgtcaaagactaaggctaaaaaagacgcgtcatcttcagcaaagtcgacgaagcaatcgacagctgctaaatcgtcgtcaactaaagcatcgtcagtttccacaacttcagctaatgagtcacaatccgaagctagtgcaacgactagtcagggtagtaagacagctactgcagctagctcgcagggacattcaaataccactgcaactagtcaaacaactaccgggcagtctgcatccgcgacctcatcatcaactagcggccagcaaacgaccaatccacagcagttaacagctagtcagattaatgattgggcttggcaacaagtggctaaggactatcaacaaacaaccgccaataagcaaaactttgtgtttaatcagtatcaaagcggtggtttagtttacgtggaagtttatgaaaataccaacgccgatgtcgcacacttagcgggtcgttttcggattaacgcccaaggtcaattggaacaacagcagttggctaaggggaacgtatggcaagttgttgcaacacagccataatggcgtcgtttagcaggttacaattgaaaaatagttattgccaattgggtgttcagcgggtgtcaattttgaacacctaatttttagtatcatcatggtcaatttggtagcttgattcagctgttatcacgggtaagtgccggcagggcccaaggtaaggtatgacaagctagcctagtgatgcctcagtaatttgaccaggatattgtaaccgccttcttgctcattgtgaccaaatacggcatactgaaagtagttcataaagattggtggctggtttgatggcaaaagagaaacatgaaatttatgacgaacaggataagcgactgggccgcttgattctgaaaatactggggatcgtcgcgattgtcagcggcttagtgggaccgttcatttacttattgaatgcaaactggggccgtgagctaggaaccttggccgtgatttgtggcggcgttgcgatttgtctgggccctaaaggtcgaactgcagggggccagtggttagccctcttgaagacgctggggttgagtattttgattttaggatattttgtgattgtcttgaaattattgggatagctaggcagtgtcgaatgcgtttctgtaaaaatggtggtcaggataatgctggcaccattttttattgtgctgaaataagattggggcttgcgctcctattattatgagagtaagatgaaaatatcattaaataacatgttgatgagaagagtagtcaggttatacctttgacagggagccgtggggagtgtaaagcggtaaggtagcgcctgatgaagatgaactcggaatgcccagttgcggtcgcaaggctgtactggcgggactggccgatactccagtgagtcaataatgacttgatgagtttaacggggtgacccgtaattgaacttgggtggtaacacgcgaccggcgtcccttgaagatggcggctttttttgtagtcatttttacactggcctctctgtagactgcccgaccataactagattggatgggattgagattatgacaaaacaagctgagaaattacacattgaaacgcggttagcacaagctggtaatcggagtgatgatgagaagaccggggcaatttcggcgcccatctacttgtcgacagcatatcgacatgctggtttaggacaatctacgggatttgactacccgcgcgaggcccaaccgacccgctgtattttggaacgagtgctggcagagatggaacacggcatcgctgcgtatgcgctgacttctggcatggcggcaatccagctcgttttcacgcttttcaatagtggtgacaaaattattgtgtctgatgacttatacgggggttcgtaccgcttctttgacctcttacacgaccattatcatttggattttgctgtctgggatgggcaggatcaagcgacattggcagcactggcagacgatcaaaccgttgccctgtggttggaaacgccatcgaatccaaccatgaaggtcatagatattacggccacagcggctaccgcacacgcccatgacctcaagttaatcgttgataatactttctatacaccgttgattcaaaagccactggatctaggcgcagacatcgtcgttcattccgcaactaagtatttagccggtcataatgatgttttagccggtgcagtggtagtcaagtcgcaggcggatgctgatgcgcttgaatttaatctggtgacgactggtgcggtccttgacccgttcgacgcttggctgctcttacggagcttgaagactttgccattacgtttgcatcagcaggaggctaatgcgcaggaactcgttacggtccttgaggcagatgaacacgttgaacgtgtcttatatccaggacgtggtggaatgattagtttttatctcgctacgggtaccgacgtcgatacctttttacgagcattgaacgtaatctcgtttgcggaaagtcttggcggtgtcgagagcctgttaacagttccggcagttcagacacacgcagatttaacggaagagcaacgacaatcaaaggggatcaccgctaacttattgcggctatccgttgggatcgaaaatagtgccgatttagcagcggatctcaagcaagcgctgatccgagcaacaaaataaagcaaaagactttacttacttttagtatgtggtaaactataattattataaagatattggaggcatttttcatggcaactgcaactttaagcgacgaagaaattcgcgaacgtatcaagacgggtaaacacatgttattctttacggcggactggtgcccggattgcgcttttattaaaccagtaatgccccaaatcgaagcgaagtacgatcaatatgactggatcacggttgatcgtgacgccaacattgaaattgcccaagacatgggtgtgatggggattcctagtttcgttgggatcgaagatggtcaagaaattggtcgatatgttgacaaattccgtaagacccaaaagcaagttgaagatttcttagatacacttgaaaagtagttttgaaaggcatgacgttagctgataactaaccgtgttaaaacgagccaactcgagtgcgtccatgatggttaagctttaaccacgatggacgcgtttgggttggttttcgtttgggcttctgctacactattaactattaattttggaaacggtgataaacatgacaacaaatttatttgaagatgtggtggtgcggacgaccaaatttggtgatttgcccgtattacacgtgtttgcagctagtcaagcacaaactaaattaccaacgatcatcgattatcatggttggacaaatcagacagcgactgaactgggtacggcttatcagttagtacgcgcgggttttcgagtcattctcccgacagcgtatttacatggcagtcgaaatgatgggactgatctcgatcggcatcctgaacatttttggtcgattgttggacattcagttgcggaatttccacaattagtcgcggccttagtggctgctggaattagtgatgctaataaaatcggtgtcatgggaacttcgatgggcggtattaccgctgccggcattatggcaacgcagcccacggtagttgctggtgtctcgttaattggttcaccagaaccggtggcctttgcaaccgatcaagttgcacaattaccagcggcattacaagctaagctcccagcagaactaattgaacaaacttatcaacaattggcaaagtttgacttatctgaacacccagaagcactggcgggacgaccaatgttctttttcaacggtacggccgatcaaatggtaccttatcagtatatgcgtgattttaagcaccgttttaaagatgagccagccctgaaggcaactgtctttaaacgcgctgaaggtggcgttcaccacgtacctcacaagattcaagaagctgctgtcgccttcttggagaccaacattcttaaataatgcacacagcacccacactgttcataaaactgaacagcatgggtgctttttattgccatcaataccataaccgtcggacactatgatagcctaaatcgcctaaaagtagtggttctgacagtaacattagacaaccgcgttccagtaagaaaatcgcgagattcatctcatcatcccagcgcgcgacccgttcgttgagccggcagttgtatcttgagcttgcctttagagccagtgaattcattttgagagggttgtggcgcaagcggggaatccggatgaggagccagggataggctagcaggtcggaactgatcagccaataaacggggagactaaaggtcagctgccactgtccggtcggtttcgcggtaagcgcatagtacgtcattattaaaacggggagtgctgacagttcggcagtcagaatattaattgctttatctttcatcattatttcaccttgctgattggttagattaagccgatggataagcgttcgatattttccagaacaacggcaggctaacacgatttcggaccagtgtcaggtcatcgaatttggttagttaagaaaatatttataaaataatgattgtttacaattgaattttgaacaatttagatgtattctgataaccgtaaatgaaaacgtatacaataattttaaaaagaaggcatttactatggcaaagatgattgaagcgtctgttgcaatgttaaaagttattgaagcttgggatgttaaacagatttacggctatgctggtggatcgtttaactcaaccatgcacgcgttggatgttgagcaagaacggctccaatatgtgcaggtacgtcacgaacaagtgggggccctcgctgcggcagcggatgcaaagttgacgggtaaaatcggggtcgcctttggatcggccggtcctggtgccgttaatttactcaacgggttgtatgatgctaaggaagatcacgtgcccgtacttgccttggtgggtcaagttgctcacactaatatgaactatgattatttccaagaattcgctgaagaaccgatttttagtgatgtggcggtctttaatcgaaccgtcatgacaccagaaagcttaccatacgtcgtcgataaggccattcggacggcttatcgtgaaaatggggttgcggtggtgacaattcctaatgattttggatatgttgaaattcctgatcttaattacgattcagcaagtgtccctgctaaactgaccggcattcctactattgatgatgaacaagttaagacggtattaacgatgatcaagaacgccaagtaccccgtcttccacgttggtcaagggacgcgtggtgcaaccgaggacatgatggcgttagcggagcgtctgcaagtaccgattattatcactgggttagccaagggcgtcattcctgatagttttgatggtaatatgggaagcgcttatcgggcagcctcgaaagcggcggatgaactgatggggattaccgatttggtcgtttcagttggcgcagattattcgttcgcacagattatgtacacgactcacgacttcaaatatgtgcaaattgaactggatcctggcaagtttggtcggcaccatcatttggatttcggggttaatggcgatgctaaagtcttcatcaaacgggccttggcattaagtgaaccagcgtcaccgtcgccatactaccaagcggctaaagcagatatggctgactggaaacagtatttgaagaagctgagtgaacggacgaccgatccacttgaatacgaacaagtctaccaagaaatcaaccgggtcgctgccgatgatgcagttttctcaatggatgttggcgacaatacgattaatagtttccgtttcctaaagatgaatcccaagcaaaaattattgacttcagcactatttgccacgatgggtgccggtgttcccggtgcgattgcggcgaagatgagttatcctgatcggcaagccttcaacattgctggcgacggggccttctcaatggtcatgcaagacttattgaccgaagttaagtatcacttgccaatctttaatattgtcacgtctaaccaaacgttgaactttattaaatcagaacaagaagatgtgccgcaaccatattatggtatcgacttgattgatgctgattttgctaagatagctgaaggaatgggcgtcaaaggtatccgtgttgaacattttgatcaactgcacgcagccttcgaaactgcgatgaccgaattaaaggctggtcgtccggtcctaattgatgccaagattacggacaaacgggggttaccagttgaaatccttgatgttgatccaaccaagacatcggatgcttctgtcagtgccttcaaagaaaaatatgacgcgaacgaattgaaaccactaaccagttatttcaaggagttcaacgtcgaatagtcagtgtgaacgagcctgcaatcaattgattgcaggctttttcgttctaggataggtcaggaatgattgttaaaaggttccggttaactcgattcctgttcgtcagccggtgcgcgtcctatgccgactggaaggcgtttcggtcaatgctcagcggtgaaatttcacttagcaagcgtcctttgcttggttagtggaagaccagtatttaagacgtgggttgcggcttaaatctgtgtccaccgcgttccagcaattgacggaaatgcctggaagtcggcgtaggacgcgtttaaccaagcatgtttacgctgattcgaactttttccagcgggcctaactggttacttttgatcttaaaccggaaccttttaacaatatttcgtgcagaaaaggcttggtattatgcggatataattttaggcgtcattctgcttggtctgggagttttaaaagcggataatgaagctaattctagggggagtgatgaggatgaagcgacggttaattgcagcgcctacgggtcttttattggtgggatggttgattggctggggcttgcaagcaatgcaccaaccgatggggacggcttggacggcctacgcgtttacgttattgatcttatatacaattttggcgacgtttatcactagtatggcggatgcctatcagggaaatcatggtcgaacagtaccggaaaaacaattttactggtatatgtgtacgttatcagtcattttgacaattttagcgatttattggatggcacacaattagggggattaatgctaatgcaagatgaaagtgattggttaatgcggcagttacatgcgttcgcaacggggttagggtacacgcttagtcgtcataagggaggcacaactgaggtggtgtttccgcaaaatcaaaatcagccgttgccacatcaagtcgaattggcacaactcattgacagaaaggcttatgctcaagccgctcagcggttgttagcgttgcagtttgcaatgacggaagctgaattcttgcagctcggaatttggttttatgcgacgcttaatcaatttgacgaccaaagtctcgctgccgggggaatttcacgaacatcgttggtggcgggattggaacaactgcaacaattgaaaatgtgatgctaagatttaagcaaatcacgaatgaatttggcaaaaaagagattcagctatgacggaaaaattaaaagtcgtgctctcagaatttaatcctgaaagcacgacttttaatttaacgcgtgttcaattatcggatcacatagacgtggtcgtgaatcaggtcgaatggtcggaaatgagcatttaacttggtaacggcctcgttatcctgataattagcgtggtcccaaaattgtttggaacccgtggcgccgtatttttcgccaatgacgatcaatgggatatcgtaaggactttgccgcatagcttgtaacaagtcccaatcaatagtcaatttgtccggtgaccaggccataatgacgtatttaatagttgcggcgtacttattgaaggcactgacggcatccaacgcttcaatcgtcgtgactgggtggcgtcccgtctgattgccagtttcgtgtgtccaatcctttgaatccgtggtataaattggctgaccaggatggagacgtttgaggcccttggaaatatagccgttaccggccatgacttccagaactggtgcgctgccggtgaagtcagctaggtctttcagaaatggcgcactgatgtaggcccacatcccatactgatcttcgatatagtctcgaaagttgcgtagaagttggtcaacttttgggagagcggctgatagttggttccaagccgcatcaccagcaggatcacccatggcatattgctgattgatgcgctcaaagagatggtcctgaaaatcatcagggatttctaagactggcaattgttggggagctaagccggctgccagcaagcggtcactttccaagacattattgatcagcactagaatttggggatcatccttaaataagtcgcggtacttcattaactgttgaatatacggggcaccggcttgctttttgacccgcttttttaattgttttaacttcttgggattcataaaaaactcctagtcatcaaagtgtaagtctaattcttcttggccggtcgcatccgttgaaactcgatgctggcgaccatgtaagtaaccatccatcaactgaaacagttcatagcggtcttcactggataattgttcttgattaaacgtcaacggcttgcccgataaaaagatgcgaccgaggtcatactcttcttggtctgatttacctgacaagtaatcggtcgtgacgttgaaaaattcggctaatttacgaacttctaggtaggacggggtccgtaagtcccgctcccagttaccgatttgagccgcggtattttgacgagtcgtcttgtctgcggtcggcatttgattgagggccgccgcgagttgagcgagggtcattttttgcccccgacgtagtgctcttaaacgttctggaaacatgtgctcacttccattccttagattaacggtgcggataacgccatgaattcatcgatgtcccgcttgatcaaagctacaccagcttgccagaaggctggtttggtcagatcaacaccgaggtgtttggcagctagggcttcggtcgacatgttggcggtgtctcgcaatagggcaatgtagcggtcttcaaagtccgattgtgttttagcttgagcatagataccgagactgaaaaggtagccaaatgtgtatggaaagttataaaacgggacgtcggcaatgtaaaagtgcaacttgctagcccaaaacatcgggtggtaagtatttaaggcattaccataggcgtctttttgggcggttagcatcaagtctgacaaagtatcaggagtgacgatcccgtgctgacgggcggcatagaagcgcgtctcaaacaggaagcgggctcgaatatccagaaacatggctaacggattttgcattttagcatccaataaagttaatttggttttggcatcatcggccgctttgacactggcgtcagcgacaatcagttcggcgaatgttgaggcggtttcggccacgttcatcgcgtaatcttgacgccaaagtggcagatcttgaatgacgctgccatgaaaggcgtgccctaattcgtgggcgagggtggctgtgtcattaggtgaacccgtaaacgtcatgaaaattcgggattcgtgggtctctggtagattttccatatagccaccaggccgcttattagggcggttctcagcttcgacccaacgatgttcaagggcgtgttgggctaaagcgcccatctttggactaaattggcgaaagttgttaatgacaaaatcggcagcttgatcgtaagtttggttaggaagttgtcccaaggttagtggggcttcaatatcttgccaatctagttgatctttaccgagtaactgggccttacgcttcaggtaacttagtaaaatgtccttgctgtcagcgacaacttggtacattgtgtctagtgtcgcttgactcatgcggttgagttctagtggtttttgtaggaagttcgtcgtaccatgcgcacgataattggcaagtcggaagcccgccaagtggttcaacgtatcagcaaagggagcggcgtgagtttgccaagcgtgctcccagttgcgcattaattcggcgcgttgagcgttcggcatggcggctgctaacatgttttgagcttgacccgcggataggggctgggttattccgttttcatcggtatagggcacttgaatttggctaactaacgtgtcgtagtggtcactccaaccctgaaaaccgtcgagtgctaagtcattgattagggcttcagtgtcgtcatctaggagcgctaagccttgctgacgcatttcggttaagttaaaggcgatggcttgtagtgacggttgttgcacgagcgtgtcaaaggtggcttgatctaacttaacgagctgcttcttgaagcgggttaataaattgtttaactgattatcaagttgataaatttggttcaatagtggggcggctttggtgtcgtccgcatgtgcggattgataagcaaccacgaaaacggtagcttggtcaataccggcttgaatggcttgcagactgttgacgagttgggtaaaccagtcggcgtctggtgtgtcagcggcagcacgccagtgaactaaggtgtctgctgtcgtggtcaactgctgtttaatcgtggacatttttgcagttagtgctggggaatcaatgccaccagcaaagatactgtccaaatcccacgtttcggaatagtgcataaaaagaagcctcctcaatctggtctagttatctttaattataacggttattatgaagtagtggcgaaattttcccgctcaaaacagatttttgtctcatcaaggagtgaattttaatgaagaaatggtggaacacactgggggtactcgttgttctggtagcgggagctgtgattggtgctggcagttatttttaccacgtggcaattgcccgtggtgataagtcatttgttacgcagagtacaaagctatcgaaaaaaagttcggtttatcaccaaaagtattggtatttacatgcgcgtaagcaaacttggactattgagtcatcggatcatttacggttggttgcttggtatattccagttaaaaattctaagaggactgttgttttggcacacggatttgctgggaataagggtttgatgggtgcgtgggcggggatgtatcatgaactcggctacaacgtgctggttcctgattcccgagcaagtggtgcgagccagggaaaagcggtcggctacggctggctggagcgccgcgacgacttgcagtgggccaaaaccgtcgtacataaaacggccacaactcaaatcgtgatgagcggtatcagtatgggtgcagccgggatgacgatggccagtggtgaacggcagttgccacagatcaaagcgtacgtcgtcgatagtccgtttacgagtgctgatgcgattattagttatcaagcggggcaactctatcatttacccgcgtttccgttagtcaacgtaaccagtctcattactaaattacgtgctggttatagcttcaaagaggcggatgcaatcgctcagattcgtaaaaaccacttgcctatcatgattatcagcggcacccgggatgattttgtcccgactagcatgggcaagacgctgtaccgcaatgctcaccaacccaagtctttatggttggtgaagggagccggccacaccacggccattactcagaattaccaacgttacaagcgtcacgtcgctgcattcttggaacaatacgtgcagtaatgttagcttgcttgaattagcactgatttgtcatgaatcgtgatattaagaggccgtttgtttgattcctgttcgtcagcaataatcgtccgattccgacctctggggctgggtgacaattgctggaacgtaagccgacgtcgatttgagcccgtgcccaacccgccacgttccggcaattagcagaaatgcctggaagtcggcgtaggacgaactaactaagcaaggttacgctaactcgcactttttccagtggtccatagctggctgcttttgtccttgaaagttagcatcctaatatcacaaaagctcccaaatcgattcgatctgggagcttttgtgatattaagataattatgcccggtatgggacctggcaaggtacatcgacgccatctttgagtgtgatcaggtataactggtcaagcacggcggggccttgtgaatgacgagccccccaagtagttagcaactggtttaggcggctagcgacttgatggtggtccgcaacacagtctaagtcttgtgcggccttagctaaggcttgttgtaattcgggaattgcgcgtacttcggggtcactataagcgacatcgatggcgcgaattagcgcaatggcgttttcgttttttaacatgctaccatccctctcctgtgatgtggcgaacttagtccacgtcctaatttaagtatagcgctcctaaattgagattcaagttacaaatgtaaccgctatcacaagtaacggtagatcattattgtacttttggtatcagctgtgttatattgtaatagaaaaatagaacactaaggaggccgttaaattgaaatttgatgacaaggttccgatttattatcaaatcaaacagtatatttatcataaaatgattgacggaacgttaccaccaggggcaaagttgcccgcagtccggcagcttgcgttggacttgacggttaatgttaatacagttcagcgggcactcagtgagatgattacggaaggcactctgacgtcccaacgaggtaaggggaatttcgtaacggaagatcaggcgcatattatgcaattgaggactacactggtgaacgagcaattagcattagcgtacgaccaattgcacgcactaaatttaagtgacgccgaaatcgtggcgagtctgcaacaatacattgcccaacgagaggagcacaatcatgacagcattgacgattaaggatttacgttataaacataatcaacgaatgattttacaaaatgttcaattaaccctggcgcccagcaagattgtcggtttattaggtgaaaatggggcggggaaaacgaccttgatgcgactaattacgggtagtgccaagggtcagggcagtattgtgatcaatggcgcgacaactgccgtagcccgtaagcagcaggtaagtttcacggatcatttgactggttttagtgccggtatgaaattacaacaaatcgcgcaattttatcaacttgtttatcctgattttgacgccaaacgctatcaagagctggttgactttctggaactcaaccaacaacaaaaattgggtgagttgtctaaggggacccgcgagaaattaatcattgcgctgaccctgagtcgcaaagtggctttgtacttattagatgaaccgtttagtgggatcgacagtatgagccgcaaaaaaattattaacagtattatcaagtggacgcctgccgaagcgacattattgattagtgatcattatgtcactgaaatcgcgccgattcttgatgaaatcgtggtcgttaaggaccaaacaattgttgttcatcagggtgcagatgagattcgcgacgaacatggcatggaacttgaagattattatgagagcttatatatgggaggtgtgacggatgacaagtagttggtcactatttaaggccctcagttggccacgctttaagcaaatgagtttattgattggtatcgaagctttggcggtgattgtcactagtttgtggactgccatcaaaggaaacttcacagctgccacattattctataatttatgtgcttggatggcgttacctttaatcgttgggtttatcttattggcagtttcaaatgaaaaattcttccgggcggggacgttctggttattgccaattagcgattggcgacgctatacgattaatttagtcgtttcgttggttgatattgtttatgtttggttggtccaagtgattttattctgcttaactctgtggattggttggaatgaactgatgggaggcttaacatcagcgtcgctgttctttagccagtttgatgcgggtagtgccgtgcagttcgcactcggaacgttgctagtcttagttcttgtgacgattctgatttggagcacgataacgctttgccattttgttacgaatgcgaccaagggctttttaccacgatttcggcaacggttcgtcaatgtgattatcacggtggtggtcatttacgtagctttccgcttagctaatttgttgattagcatggtcagctttctctccagtcagctagtcaaccagggacaaatcgattctttatgggtcggtagtctcgtcatgttggcagttatcttagttgaaggtgtgttaaataccttgatgttgcaaaaatgggttgagccaaccttgaattaatttagtaatcctaaaaaatcactcattcgtattgaatgagtgatttttattgcgcattttttaaacgatggttgcacctaagctgtttttgaagtgacgcaacgcccattcgtgaccagcggcgtcaaaactagcaacggcatcctgatgaatgacgagttggtaacccaaattataggcgtcaacagccgtgtgaaggacacaaatgtcggtacaaacaccgactaagtgcagggtgtcaacatggcgttctcgcagacgtaaatccaagtcagtacccgcaaatgaactgtaacgcgtcttgtcgaatgcccaaacattatcggcggcttgatgatcagcgtaccaatctttgagtggcccatagagttcacgaccccaggtaccccgaacattatgaggtggaaacaacttgctttcgggatggtaaggatcatgcggggtatggacatcggttggcagtaagacccagtcgcttgccgtagccatttggttggcgagtttgacgatcgttggtgcgagcgcttggccgggttgcccacaagtgagtgccccgccgtcagccacaaaatcattcgtataatcaataatcagtaaggcttggtgacttgccataataaaggcctccaatattaggtttgagattggttttactgtaaacaactctgatgggactgtcaattgtttaactagcgttggattgactaaataattatattaatgagatttggagctataaggacagcagcttgctgaaagtcttttctgaacaataaaatattaataatattttgtggccgaccaaggcgccaggtatcgggcgttaatataaataattgcgaatggcgacttattagccggtgttctgtttgctaattgctgatttttgccccaaattggcacagtagccgccgtcctgttttcccaatcgttaaactgagattgggttattgtcagttaaatataaaaagtctagccagcgtgttgagttcgacaacatactggctagacttttggtgggtaaacgaaagttgagtcgctggcctgatgattattctgctagttgatcagtaattgccgtgacaatttggtcaggggtcagcttaaattcatgccgcagttcattagttgtttcacggtcattaaagcgtttggcagcaccaaagttcagaacgcgcatagcgctgttgccatagtagcgactaactttttcaccaaaaccaccgctgagactggcttcctcaaccgtgacaactaactgatggtcggcctttaagttggccaaagtcgtcgtatcgggggcagaaatgtcccggggatcaatgagcgtcgcgtcaatgtgttgctcagctaattgttgttgcacggctgttgctaaaggcaggagactgcctacaccgagtaaagcaacttgctgaccagcgtgtaatgtgtgcatcttagttgcgtcaaaatcaggcgctagaggtactgactggacgtcattacttggtacccggatggcaaccggaccgttattttgatggagagcccagtgcatcatggcttgaagttcttccttggtcgttggcgctaagtaagttaagttaggaatattactgagcatggcaacgtcaaaggtaccttgatgagttggatcgcctgcgttaatgcggccaccggcaaccatgatcgtaacgggcaatttattgatgccaagatcatgagatagttgatcataggcccgttgcaagaaggtaccagaatggaagacgattggccgtaagccttgttgggcctgtccggcagcaaatgtaatcgattcttgttcggcaatgccgacgtcaaagtaccggtctggatattggcgagcaaagcgtttgaggtcataagttcctggaacagccgccgtaattgccgtgataggcgtcttggctgctaactcatcggctaacgtggcatgaatgacatccgtatacgtttccttggtgttgggatgcaacgtctgaccggtcgctaggtcaaacggcacgtgccagtggaaagcttctttattagtgatcgcgggttgatagccgtgacccttttcggtatggacgtgcaacacgattgggtggtcaacatccttaatttccttaaaagtcgttagcatggtctcaaggtcgttaccatcatcaacgtagcgataatcgaggccaaaatctttgaacaagttatgggaacttgtgccgttagtttcgcggagttcacggagattttggtaaatgccaccatggtcttctgcaattgccatgccattatcgttaaccagaataatgaggttagactttaaggtggccgcgatgtttagaccttccaatgctaaaccaccggataatgagccgtcaccaatcactgccatgacattgcctgttttgccctcaaggtcacgagcaacagccatgccagttgccaaggcaatcgaggttgaagtatgaccaatattgaaatagtcgtgggggctttcttctggggcagtgtagccgctgacatcattataatgagcggggtcaagccaagcttgctttcggcccgttagaatcttgtgtgtgtaggattggtgtgaaacatcccatacaaccttatcaactggtgaattaaaaatggtgtgaaaggcaatggttaattcgactacgcccaagttagggccaacgtgaccaccagtttgactaactttattgagtaggacgtgacgtaactcgcttgcgagttgtgttaattccggcaaggataattgtttcagatcggccggctgatcaatgcgtgctaaaatcggtgtttccattatctatcgctcactttctcattcatgaatacttttatagattagcaccttagagccactctaagacaagtgttttgtttcaaaaatatcataaaaaatgacgccgacaagttgtcaggcgtcattaggttaccatggtcacaagattggggggcttgttgagacgttcagttggcagttcgaccaatggtacaacgttagtgtaacggacccgatgcccaaatagtggtgtggacagttggtcacgttattgacattactaaacgaatttagtcggtattgatcgattgcaagtaaactaactgatcagttgaaatttgttcatagagttggttaccaagttctgagctgaatgttttattggctaattgggtctgaatgaagttatattccaactggaatgcttcaattagaagctcattttgagtttcctggaaatcccgttcaccagataggcggcgatgacgttcatcataggcgcggcgaacgatcccgatagcttgctgattgtcagcagtaatcgtgtcggctaaataagctaacacggcctcatacggcttttgttcgatctgtcgcatttgttgccacatttgccgattacgagtcatgagctcagttcgactctgaccaccacggggccggtattgtcggaacattttacgtcgggcacgagcttttttgctgagcgaccatttgctgagtgtaaaccggaaaaataatttcaagcgttcgaagaaagtttgttgattctgcagacgcgtctgactagcgacgcgcatgtacttttcggcggcatggggcgtgatttcattgttggcaaccatttcatcaatagtggtttgttcaactttgaaagtggcgtcgaacaagctcgccagttgcgagcgcttaggacgaccatctagtactcgttggccggacagaatcgcaatcactttactagtgccagcattattaccatggcgtgcttgcatgagatcaatagcgtgagttaccatgtcagctttggcggttgccaattcatcttcagtgaccttaacaacttgttttggcaacgtcaacggtaacaaaagtgttggcaccagcagactagttagaatgaccactgcggcaacgaaaataatatcgttgcgataaggaaaagtactgccgttgagtgttagtggtaatgaaaaagccatcgccagcgtaatcgtgccgtgaacgccgctcagacccatcacgaatgcattacgggtcttttcatgattatcccacgcgcgaatacgggctaagtcgaagcgcgtccagagaaaacgggcgaacgtcatgattaggtagagcaagattcccagaccgactaataccgcgaccgaactagtatcacgttgctgtaagtggttgatgacacttggcaacgacacacctaataacacaaagacgataccgttcaaaatactagccacgattgaccaagtcgttgtcatcacgatttgtagccgggaagtggtcaaccgtaattgatcggactggacaccatgaatgagaccggtggcaacaacagccaagataccggaaacgcctaacgattcagctaagaaatagacgacaaacggtgtcagtaatgtgtaggggacgatcacagaaggtgtatcgacccgcatgcgaatcagcataatcctgacagcaacaatgacataaccgatgattaggccgacgaagattccaccggcaaagacatataaaaagttagtgattccgtgccagactgaaaacttaccagtgacgatcgcagcaatcgctaagttaaaggccacgattccggaggcgtcattgaacagtgattcattttcaagcgtcgtcatgactgctcttggaatcgcaactttagtcgtaatcgatgagaccgcgacggcatcggttggcgtaataatagcgccaagggcaaaagcaagtgccagcgaaaactcaggaatcagtaagtgagtgaccgtaccaacaattaggatggtcacgatggctaacactaccgaaagcgaaagggtcgtgccaaactggtgactgagcttgcgaatgttggtgttttggccatcattaaacattaaaatcgaaataatgacgaatagaaaaatttcaggttccaattcaaaatttcgatacaacggaatcagagacaagattaacccagccccaatttgtaaaaaggcgactggaatttgattgaaacgtgcgtagacggcgttagcaacgacgacagccgcaacgagtaataagactaagaaaacggtttgcaaaccaaatttcctcctagattttgtaaagtagtttaattttaacgcaatcatatgaataaaagtattatctgcaatgattaatttggggctggacctaatgtttaaaaaaagaccgattagaagttaattattgaacgttttgacctaaagtatgtcattagcttggcgtgacgttctaagtcagtataatgaaattatcaacttaactggaggacatcgcgatgttaacaattgcttatatcggcaacggtaagagtgctaaccgctatcacttaccatttgcactgaaactcaaagatcaaattaaggtgaagaccatctattcacgttcaggacaccagaattggcaaccaattgcgggcgtgcattacacgactacgttagcagatatttatgaggaccctgatattcagctcgtagttgtttcaacacctagtcatacgcactattcggtagctaaggatgtcttgaaccatggtaagaatgtcttggtggaaaaaccatttacggaaacatcagcggaagcccgcgaactttttgaattggctaagcaaaagcatttgtttattcagtgttaccagaatcggcgctttgattcggactatttgacgacacaaaaggtcattgaaagcggcgtcctcggtgacttgctggaagtcgaaatgcactttgattatttccggccagaggttccaaccaatgttgaccatttttcattagatacgagttatttatatggtcatgcttgccatactttagaccaagtgattgcatacttcggggagccggatgacgtgcactatgatgttcggcaactattgggaagtgaccggatgaatgattattttgatatcgatctgtattacggtgccttgaaagtctctgtaaaatctagctatttccgcattaaatcacggccgagcttcgtggtttatggcaaaaagggcatgttcgtaaaggcgactaaggatcgtcaggaatacgatctgaaacatttttacatgccgaatcacgctgactttggcattgatcaacctgaaaactatggcacgttaacttatatcgacgatgcgggtcagtatcacgaagaggcagtcgtttcggaagttggtgactacagtcgggtttacgccggcgtttacgacagcatcatcaatggacaacctaagttagtcaaagatgaggaaacgttgttgcaagtgaaaatgttagaaactggtattcaacaatgccgacattagcgcttcttgagtgttgcactagcccagctattggtacgtgtcagctttagattgttgttcggctaccggtgtgcgtcctaggaggttggtgccaattgttggcggtcggcgcaagccgacgctggctaagcatgtttacgcaaacttgagcttttttcagtgggccttagctgatttcatttggccggtattaattcgttaatataaattatgaggaggattatgatgcgattaggaattttaggaacaggcaagattgttcaggacttcttgccaatggtgaagagcattcccgcgattgaattggtgggattgctgtcaacgccgcggagtgtggcgcgagcacgcgagctgcaagccacgtatcgtattggaacggtctacacagattatgcagctttgctagccgatacgacaattgatacagtgtacgtcgctttgccgaattcgttacattatgactatgcgaagcggggaagaacgtcatttgtgagaagccgtttacgttagtggcatctcagttaacggaactaatcgaattggcaggtcgccaagacttagtgttaatcgaagcaattacgaatcagtatttggaaaactatcaggcaatcaaacgtgatttgaccaagttgggcgacttgaaaattatcgaatgcaactattcgcagtattcatcacgttatgatcagtttaaagccggaacgatcttaccagcttttaatcctaagcttggtgggggcgccctgatggacttgaatatttataatattcattttgtggttggcttgttaggcgcaccaacgcacgtgcagtatttagctaatgttgaacgaaatattgatacatcaggcatcttagtgttgacctatccgaatgttaaagtcgtttgtatcggtgccaaggattcgacttcaccggtacgttccacgattcaggggacgactggttcgatcattgtcaacggtcctactaatacggtcgaaagtatcactgaaattgcacatgatggaacgacaactgatttagcgcttaatcaagctgagcatcggatgtatgctgagtttgtggcgtttgaacgtcttattgctaatcacgatatggtaaccgttaagcggcaattagatcattcccaagcggtcatggaagttgttgaccaagcgttagcgagcgcgggattgcaattgggctaatgcgtcgttgctaatgtggctgcacaataaatagaagagattgtaaaaagcgtgtcctagaaactgtaggacgcgcttttgagccgttagatgtgttattttgtggtgagcgggccgtcctggattaggtgctgtttttgtcgcaggtcttgtaaatggtgatgaaaatcatgtgcatacatgactgcgaaaagactgtctaagacgtattcaaacgccgcttgggatgcaaaagtaccgattttggcaaaattatattcactctgaacggtgagcaagtgctgggtcgcttgactgatgagtggtgattgtggattacctgttaggacaatcatgggaatttgatgagcgtgaaaataggtggcaacttgctgatggattttagtagtaccagcatatgaaataatcagagcacaatcatcagctgttaagttggctgcgttccaggattcgtcagcatattcttcggcgattatagcaaaacgattgattttgacgagtttattttgaaaactacgggcccgtagttgtgagtcaccttgcgagaagataaagattcgttttgatcgcgtcaataagtcagcagcttgggctaattggttcgtatcaagttgctgctgggctgtctgaatggcccgaatattcaaggcggccatcttttggctgattgtggcgaccgaatctgtcgccgagaacggaaaattggcatccacagtggcggcttgatgtgcctgggcaatgctttcggcagtcaatttccgttggaaatcgcgaaagccccggtagttcaatttttgggccaacctaatgattgctgaatgggatgtgtacgtcttagcggctaggtctttgatcagaatagttggcatttgatctagatgtgccagaatatagctactgatccgctgttcagtactagtaaagtctgactgttgttgcaaggcaattaatattgacatgtcatcgacctccatagttagtatcatacggttaatattggaaaaaagcgacgattatcataaaactgagtaaaatcagcttgacctggtaccggtttcataaattatggtaattatatgaaacaacgtggtatcatcaattgagagaggaagttctgtgatgacgaatatacatgatattgcgcgactatcgggttattccgtctcgacagtctcgcgggtaattaaccatcagaagtacgttgcggatgataaacgggccaaagttgaggctattatgcaagaactggattacgtacctaaccgggtcgctcgtgatttaagtcgggggcggacgaagacaattggcgtggtactaccgtatgcgaatcacccgtatttcgcacgggtagttgatggtatcgtcagtgcaggctttgcggcgggttataaaatcatgttgctgccgactaattatgatatgacgattgaacgccattatttagaagacttaagaagtaaagcctatgatgcgctgatttttacgtcacgtagtagttcactggatacactggaacgttaccgcaagtatggtcaaatcgtctgttgtgaagatccaggtgatgaccgggcattggccgcagcttatacggaccgcatggcttcatatgttacggcattacggtgggcgaagcaacaaggttatgcgacgatgggcgttattttgagccgtaataacgtcattagtgctagtacacgggttacgcggcgagcctaccacgaagtatatggtcagttggatgacgagcgactctataccggtgctgccacttatgaagacggttaccacgctggtaagtattttgccaatcaagcgtctcgcgtggccgcgatttttgcaaatggcgatgatattggggcgggcgcctatcaatattttatggatcacgggttagcccccattccagtgattgggcaggagaacttgctgacgagtcgactattaaagttttcgacgatcgaccatcatctagaatcattgggtcagtcagcatttcgattggcaatcggcaagacccgtacccatgaattgattaaatcagaatttatcccgcgataacttggaggagcaattaatatggtagcaagattagcagtttttgacattgatgacacactattggctcgcaataagcaattattaccgagcaccattgaaagtattcaagcacttagagatgacgggattcatgtagccatcgccacgggtcgcaatttagcgatggcccggccagttattaatgccttacaattacaagattatgtactgtgcaatggttcagcagcgtttgctggtcgccaacaaattcatcaacacaccttatctaaagacaatgttggcaaattggttgcggcggcggataaacagaatattgatattgtggtcgaatcactggatgggctacatatccacacacatccgtccaccacgacgcgccaggtgttgaacacgtttcgggcacctgagttggattatgcccctgattactatcagcaccatgatgtgtatcaggccatgatgttttacccggatgtccaaaatcgattgttgccgcatccagatgagttttcctttgttcgttttcatgaacgcggggttgatatcattcccaaagtgggatctaaggcgcaaggaattgcaaaactggcagcggcacttaatgtcgattcgagtaacgttgcggcctttggtgataatgataatgaccgagagatgattcagagcgccggtattggggtcgctatgggtaacgcgaaagctgagattaaagcattagcagacattacgacgaccgattgtgatcacgatggcatcgccaatggactaaaaaaaattggttggctataaattttaatgaaataaaactgtgatccaaacagttgacttgcggaattcggttccagcaatcagtatgttggggtcacagtttttgattagttatcgcgtagcatcttcttgatcgccgctactgaacgggcgacttgttcgggatcaactggctttttttcagctggtgtcgagcgtacagtggccgattgattagacttagttggtgttgggttcgacatagtcggctgtggcacactagttttagctggctgtggactaattttagcaccagtcgaggcttgagccggctgaccagcgtgcatttgatccatagtttgattcaacaaatgatcgacaaagacattgccctgattggtagcgtggcccttagtccagcggtaattaagtgcagtgaatgctggaagcaaccggtcgacttcacgccataactcagcgttaactaacggaccattgctgcgtttccagccgcgtcgtttccaaccagccagccagcccttagtgactgcgttgaggacatactgtgaatcaagtacgaacagaatcccagtcttagtttggccaagctgttgcaattgttcaagagctcgtaagaaggccatgatttccatgcgattattggtggcaccccattcgccggcagagtcagtgacgagttggtcgggcatttcaatccgataagcccaggcagccttatcatcttggtgcacgtgctgaccggcaacgtttccggtatttcgcgaaccgccatcagtataaacagtaatggctgcgttgaccggcgtttgattagatattgattttgagtgagctagtcgggttggactggccttaccagccataaaatcctgagcgtctttctcgcttgtgaagctcttgtactgtgcttgtggataaccgctaacttgcttttgagtttcgggccaggtgcggtaaataccaggttggcgtcccttacgaacagcgtaatatttttgtgccatggcgatacctactttctgaatggtgatactgctaatttaacataaattgccggggaaaaatgaaaaattagcagacttgtaaataaataataacaaccggatcacggaagcgaacttctgtgatccggttgccatgatgaaatataactaatgggctttaaataatgtcgtcaggtaattcatgaatgtcttcaaataacgatccttgtcgaccgttaacgcaaccgtgacgttagttgggtcattgagtcgcgcagggtcaccaattgtccggccataatcttcaccactagcctggacgtacatattcaggtctaacgtggtgacaaaacttggatcgagtgaaacgccgactgccagtggatcgtgtaaggcacaaccgtgtaagtcaggactcgtaatatcgtaagccgcaatgtaatagtcaacaatgtcagcaaatttttcgcccgcagttgtctttaagtcccgccattgttgtgtttcagtcttggttaataatgtccgtaacgttacgtcgagtccgaccatcgtaagaggcatcgtactggtgaagacggcgttggccgcttcggcatcttgattaatattggcttcagcgtagtgactgacattacctggaacagtcagtgcaccacccattaaggtcacattaccaatggtgctggcaatgtctggtgctttttcgagtgcttcggccaagttggttaagggaccggttggcactagggtcagatcggcgccatattggtgaacggcatcaattaaaaagtcgacaccggactgcttttccacggcgcgtttcggttcaggaaggttcacgtcgccgataccgttcatgccatgaatctgctgtgaaatcggcataacgtcaaagtgttccgtcgtactggagtggggttcacctagaaagacgggtacgtcagtggcacctagtagttctagaatttgtaaactgttaatcgccgcctgatccactaggcagttcccataagaactgataatcccaattaaatcaacgtcgggtgcaccgactgcgtaggcaatggccattgcgtcgtcaatcccggtgtctaagtctaaaatcattttacgttttgccatgtaaaacatcctccctgattaggtctgaagcgctataaagctatgttttaattgtaaacgtttcagttgatgctgacaacggctagcggcgaattaaattaacattgaacagaaaaatgttcggaaatatttcacgaccacgcttactggcgaaatgttgaaggctgttttatactgacaattaaggaaggtgaagctgatgacgacgaatagtccattagaagcaatcatgaatgcgcgccattcggttcggcaatatgacggccaaactaaaattgggcgtgaagaaatggccgcgatgttacagaccgcatttttggcaccaaccgcattgaatcaacaaccgattcgggcgttggtgattgaggatgcagccttgcgacaacggttgtgtgccgcgactggtaataccagtcagttaactacggccagtgccgtcgtcttatttgtgctggatcgtgaaaaccaacaccaagcgccagcgtttcagaccagtcaggggcaacaatttgatactggtgacgagaccattggcgccctagatgctggcctggttgcgatgcaatttatgttagtggctaaagatcatggctttgatacgaatccgatgaccgggtttgatgctgccggattcacgtctattttggaacttgacgcccagcggtatcggccactattgctcgtttcaattggcaaagcggccgttgctggcaagccagcagatcatcaaccgctagcgacattagttgattatcgataatattgaggggaagctagaacgtgaattttgaaaagcactaccgatatactggaaagcaaaaattaggattaactaaattagcaacggcggttgatccagaatttgaagacgaaaaggtcatcaaggcgcaaatcgccaagaatattaagcaactgactgaactgcaaggtaagttatatgcacaagaccgatttggtgttttagtcatttttcaggcgatggatgcggcgggtaaggacagtatgattcgccatatcatgagtggggtcaacccccaaggctgtgaagtcacatcgttcaagcaaccaactactaaagaaattgcgcatgattatttatggcgaattcatgatcgggtccccaaacgcggcatgattgggatcttcaatcggtcgtattatgaagacgtacttgttagtcgagtccatccggaaattattgtgaatgagcacgtcggtgagattaacgataagaaacaagtggatgatgctttttttgaacgtcgttttaacgatcttcggtactttgaagattacttgcaacacaacggctacttagtgctcaagttcttcttacacatgtcaaaggcggaacagaagcaacgttttattcgccgtattgaaattccaagtcacaactggaaattctcagctgccgatattcaggaacggcagtattgggatgattatcagcgtgcttatgatgatgctatcaccaagacggctactaaagcgacaccgtggtacgtcattccgtcggatagtaagtggtattcgcggctctgtgtttcggaaatcatcaatcaacgcctgtcggaattgccattagcgtatccctcactggatgcgagtgcgcaagcacaattaaaaacggcgctggagcaactagatcgtgagaccgactaacaaagtatcgcgcagtgttactagcagcaagttgaaattataaaaaatgagctactcacaccgttgatcgtcagttcaacgcgacgtgagcagctcatttttttgacggtgtgacaagctaattatgaatgccgatgcttagttcggcgtgtcaggacaaaagcgctaccgagtaatccaatcaataaggcgagaccgatagctactgaccaacttgccgagtgttcgttagtttgtggcaacgacttattcatcggtgctgagcctgcaaaagctgtagctgccgatgctggtaagggattagttgccggaaccgttgtggcggtcgtgttagtcgaatttgtcgctggattggcaggtgctgacagattaccactgacgcttggttcgggggtcgatggagacgactcatttggaacggctggagtgacggccgttggtttttcaggtgttacggttcctggattggtgggcttaggaccactcggctgttctggtgagacggtacccggcttttctggttcagtgaccccgggtttctccggttcagtagtcccaggtttttctggttcagtgaccccgggtttctccggttcagtagtcccaggtttttctggttcggtgactccgggtttctcaggttcggtagtcccaggtttctctggttcggtgactccgggtttctcgggttcggtagtcccaggtttttctggttcggtgactccgggtttctctggttcagtagtcccaggtttttctggttcggtgactccgggtttctcgggttcggtagtcccaggtttctctggttcggtgactccgggtttctcgggttcggtagtcccaggtttttccggttcagtaactcctggttcctcatcttcatcgggatctgttggttccgaaatacctggattttcgggaacgtccggttcggtgactggccgtgaaatcgtggctgtcgcggatcccttgttgccgttcttgtcagtataggtgacattattttcaaaagttgcgtcgccagtgggttcgttagtcttagtttggtaggtcaaagctaactctgacgtaaacgaccctgtggcattaaacgtcaattgattaccattcacgctcgtattgacgggaataatattacctgtctcatcgcgtaggacggcgctgccattgacatacgtttggttcggactcaacgtatcaacaaaggtgggatcgacgagctgattgttattaggcaagacacgaattgtccagttgatccgccgtggattagcttcgtcagcccattcagctgatttctctaataaaattggggctaagttaccaggatgactaggaacggttccgaaggcgtccaattgaacaaaccctttccgattacgtggtctggtttgataggcctgattaaatgtgacgagacccgtatgtgcgccggcagcaatgaagaaggttccgatggtacctgcagtggttcctttcattggaaaagcctcgtcatgcggaatacgaacgttttcggggacttggaaagccatcgtgtcgcccaccttgatcttgaggttatcagggatgcgccagttgtaattgactgtgtattcttggtcttctggcaattgtgcatcgtgagccattatcttgcccttactatctttgataaccgcactattaacatcgttgcccgttgcttcaattacgttgcgggcctgactaactaagggtggcccgaacatcaaaaagaaaattccagtgagtgctaataataaccatcgccattttttgcgcatggtaatcgcctccattaagatatacccatatattaccaccattgtacatggaaatcgctgacaaaacaccgtttgctagcttaactaacggtatgcggccagatttagcagacttttttgtgattgcgttattaactgatatgtgatgttttaggataccagaaaagacaccatttgccatcccatccaagggacgtaagggtgtccgaatcttgttaaattagaagtgtggcgtgcttcaggttgattggcagcacgcctcgatgaattgatcagttgccgtacaagaactggatgatgagtaagtcgacctgtggattgatatgcaacattgagtggctggcggtcaggggactaccgtgaatgatttgggtttttggtgaccaaccagctgccaataattgatggctgaatttaagtacggcttgtaaattgacgccgccatcaccacttgtatgccaaacatggccggcaatattcaatatcggcaaggaccgtggtaaccggtttaactgctgagtggtcaagcccggataggtcgagccaatggtcacaaacttattgatttgtgcgcgctgggggacttgcgctgtcagataatcaaagatgatattacctccagatgagtgaccgacagcattgtagcgggtcacgtggtagcgttttgcgagcccttgcatgacagtagcaaactgccgagcttgacgtttcgcatgatgattatcggcaaagataacctgaatcgttgggttgttttttagtggtccgaactgttggacagtcacgtggccggcgtgactaacatggacgaccaatcctttcgtcatcaggtgtgccgcggttaagcggtgcacaaagccgtcggtagaaaatgcgcgcgcgtaatcgccaccgacgaagatggtcggaatactcgtttgggcgacccgcgtttttcgtaatggggtcaagcgatgttgccaataggatccaatccctacgaccagggtcgcactaataatggccatgattttaataattttaattcgtcgcatcactgatccacctcgcctttgaatcctattatagtcgaattagtaaaaattgcttttgcaaaccttcgccgaatccactagaatgagaagcaataagtctacatagaagagagctgggaaacgatgagtgcagaatatgatttaacaattattggtggtggcccggtcggcatgtttgcagccttctatgctggtatgcgtaatgcacgggttcagttattagaaagtctccccgaattaggggggcaggttcaggctttgtatcctgagaagatcattcatgacgttgcgggatatccggcaatcaagggccgcgaactggtggcacaacttgaaaagcaactcacacaatttccaattgacattcaattggcgagcccggtgacggatgtcacgggagcgatgggtgatttcacgattaccacggcgagtggacagcagtcacattccaaagcgattatcgtagcgactgggagtggggcttttgaaccccggcgcttagcagtcgataatgcggctgaatttgagaataagcaattattctaccacattccaagtgtcaagcaatttgcggatcgaacggtactagttgcgggtggtggcgactcagccatcgatatggccttgatgcttgaacccgttgctaagcacgtttatatcatgcatcggcgtgatcggttccgtgggatggaacacaatgtggacttgttaaaagcgtcttccgttgaaatcaagacgccatttttgattaagcaacttgcagagacggctaccggacagttacagctgacgatgaaagaggttcgcggcacaactgaagaaacattggccgttgatgatttgattgttaactatggctttatcgcggataataaagtcatccgaaactggcacgtgaccccaaccatggcccaccgactcatcaccgttgatacggagatgaataccgacgtacctgggattgcggctattggtgatacggtgacttacgcgggcaagttaggcttgattgccagtggcttcggggaagctcctaacgcggtcaatcagttaatgatgaccttgtatcccgaacgacggagtccactgcatagtacgaccgtgtttgaaaaaatgtaagtttaaaagagctgcgatataactggcgctatacaagcaaataggacgagaaaccgaatcttggtttctcgtcctatttgcttgttcctttaagaacccgctttattggcggcctgttgtaccatgaagtggtagaaaggcaaatgtttttttcaatctagatagctttggtgtgtcttaaaataaaaaaacaaccggtcgctccgactaaacttttacaatgtataagtttgtacaaaaaaatacacaaaatttactgaaaattgataacgataaagaaacgctgttgttaagataaattcgtaacatactgcctgttgttaacgtagaatttgagaggatgattctgtttatggcaaaaggttccattattgatggtgtgttagtttagatgattagattttatatgtcactaagtgttgtgaagcatacgatactttatttgtgttttatttttctattactgtatttaaaaaagcgttatccagacaatgtaattatcggttttttttaaaatacggtggtgttttattaatagtatgcttcatttacattttatcgcaatttggattgccggttaccgcaatcgatgttccaatagttcttggaattttaggtatttcggttgttgtgttgagacacaagcaaaagtaggacgaactgctaccaatctgttgcttacggagtcatgataactcatggctctttctggtttttatctaatattgacgtccctgataacgtactgtcatcaaaggacttcatggttcagaccctgtttctgggtcattccatatgagcacctaattggcggtaaaagtattaaaaatcagtggctgatcaactatcggcattcgtgcgctttagaaattaaaatggcagataacccggagcgctgagcactttaatacagttttttaccaacatctcaatcaccgcgacggctaatcagatcaaaaaaagcgctatccaaatgcacttatgcattcagatggcgcttacgattcgtcatcagctggaagtcactttttcagcaacgacatcattcagaattttcgtggttgctgaatgatttatgcactcgctgtgacagcaactttgaaataatgtggattactcgttgctagttagacttaattcattcataaaagtcaataagagtttggcatagctgggatggtcggtgttgctcttaacttcttgctgcatttccgttagattatcagtgactacgccggtgacgcccatgaacatcatttgatccatttggtccgtattatcaatgtcccaggcgtaaaccgtcttgtgattgcggtcagccttgtcaacgaattggtcgtttaatgtggtgacctccatggtgtagccgttcgcgactgtatgcgggaacgtgagattataaggcaagatgtaactaacgaattgtttttgatctaagcgtttcaagtcacgcatgactttgaaactaagcgtatggacttggtcatgatgagccagtagggtcgcaccataacgatcgatgaaccgtttagtatcggcggcggtgtaagccgagctggtcttgatttcgactaatagtttttgatgatgcttgtgagccgctttcaggtaagcatcgaaacttggaatctttgcctgatagccattttcacgaacagtaattttttctagttgttttaatgttaattgagatggctttttcttaacgccagctaaggcttttaaggttggatcatgcatgacaacgaattgatggtccttggtgacttggatgtccatctcaacgtaatccggatgttccttgctggtcttgatcagtgcaggaattgtgttttgcacgccgttaccgttatcgacgccgcggtgggaaatcatgattggcttggtaattactagtccatttaagtagactaaattaacggcaactagcaaacttgtcgctaacagcaagccaattgcaacactcgcccgagtcaatttgcgcaaccgtggtgcctcgttaaagtattgcggttgttggcggaggagtgtaaagtcttgacgatagcaaacaataattaacatcatgaagatggccgtggtataacaaataataatttcggtgattgcttccatgataaagagattaacagtggcagcggccatggcaaaacttgttttatcgaattgaagctgggctacgtaaatcaacgtataaatggtcgtggcgatcagaaaaatcataaataaggtcacaatcatggtccataagtagcgccaaagatggtggcgcgtttgttgccaactacgagtaacggccgttttccatggaagccgatcgacaatcattagcggtaataggctaattaggcgaattccaaggtaaccagccagcaagtagaagcaccccaagccgagcgtcatccacgggttttccatgagatagctgacaatgaaggctggaattttggccttgttgagtaatggtgttgtaaagatgaaacttccaaatggcaaaatcacaataaagtagccgataaagaataagaaagtgctgggtgaggtgccagtcagactagtgaccgttgaccgcaagaccgcgcgtacagtttgtggtcggccacgaaagatattcataatacccagtagcagaaacgcaaattgccaataaactaaaataataatggctaataagatcgccaccataccgagtgcggccagtggttggtgaataataatactaccgatattcgtgtacgagacataactgacccgttgccacttgagtaacatttctagcacccaattaaaaaaaggaattgctaggtaactaatgaccaaattggtactaaatatcagggcaacgtaactgccccagttcttataaaaacggcgggtactatcccaccaaaaacgccaagcgcccatgcgtggtgcctcctcccttgatccggcattgacgaatcaagtcattattaattttattgtaacacgcattgtgttagttatttttatctaaataattgcttagattagtcactctaggaaaccactttcaactaagcataatggggctaccgagcacgtttcggtaatccgtgcgaatggctgatgaacggccactgaacttaagagatggcacgtgtaatcatcgttaatgcgcaagcatgagacaagccgtaatcagtattttatcatgaaaacgatgccagatgggtgagggcagcgtcatatttaaaggagatcataaaaaggcgcgatggcaaataaattgccgtcgcgccttgcattgtaaatggaatgcttgttgctatttggaactgctagagctagtcgtggtactatccgtatcatcagggttggtaatcttgatacgagtagaatcagtcttcttatgcgaagcttccggtgcgtcggtcgtatacaacgagtccgttgacttattaccattcttcgagtagagactggttgacttgccagctaatttattttgaatctgaatttctttttcaaggccatcggcgtaattgtaattagaagcgtcgactttcttgaagcccttaggggtgtagaaacgtaacaaatttttattgttaagtgaatcagagaggcttaattctttgtcgactttcttctgatctttatcaacagtcttctgaactgcctcatcatcatcaatcgtttcgccagttgcgttgtcataaattttgccgctaaggacggtgtatttagacgtgacgaaatcgcgatttctaaacgcaacggtactatcgtgttgtttagagaagaggtcggtcccaaactgaatataacgtttgcttgaaatccctagtaagtgcagaatcgttggtaggacgtcaatttcaccgccataagtcgattcgactttaccactcttgattcctggaatattgatcatgaatggcacacgttgaagctgggcgctatcaaaggaagtccaatcgtccgcagatttaccgagaataggtgccaaggtcgagttttcactgttggataagccgtagtggtcaccatagagtacgatcatcgaattctttaataaaccagccttttgcaagtaggtatagaattctttgacggattgatcgaggtagtgggcggtctggaagtaaccgttaatggcggaatcactagtatccgttgtcttaaacgtcgtgtcttccttatcaagtgtgaatgggaagtggttcgttaccgtgatgtatttgacgtagaacggttgttgtagccgttcaagatactgaactgaattcttaaataacagcttatcctttagaccatatccagttgatttatcaccagtcgtatcgaaataactggcatcaaagaaatattggtaccccatattcttatacgtgttatttcgattccagaaactggccacgttaccgtggaagacggcggaggaataattggcccgttggtttagaatcgcgggagcggcctggaacgtattatctgagcctaattgggagaacaatgatccagttgagagcccgtaagtactagtttcaagcatattttcggcatcagaagttttcccttgaccaacttggtggaaaaagttcttaaaactgtaagttgagttgctatgatacagtttatttaagaacggcgtaacttccttaccgttgactttctgatcaataagaaattgttgaaaactttctagatgaatcacaatgacgttgcgacccttcgccagaccgtacatcttagcgtttggcgcggcatagtgtgattcagtataatctttaacggtatctaattctgatttctttgcgctggcgcgttgatgattggtctgttcatccttgataccatcatagactgtaaaagcatctataccaagatatttgacgatataagtgcggtcaaacgttctggttagtagttgtggtcggttggattctgctaaggtcaagttaagaccgaaacctgcaatcgcggcagaggtgtacgcaaaggccgtgtgtttcttaattggtcgtgtgtcttgcttaatccgatgaagaatgaccaaggccagaatgacaataatatccgcccagtaaagaacatcgccccaactcgctagggctaacgatgagccggtaagtccctgactgaccttggacacgccggtaatcgtactaacagtcatgaaatccgtgaattcacgatggtagataacgttggcatacagtaaaatggtgtcgagtgcatcaatgaatagcaaaatatagtaatatacaccggttttacgaatgtagaacgccagactaaacagaaagaccgtcgttgcaatcgggttcacgagcatcaggaatgcctggagtggatcggcaacgcctagtgaaaattcggttaagtacgcatagatcgttttggcccagaataagaagactagtagccaaaaaaatccaattcgcgtgttaacgtattggcgaaatttggtaaacatcgataaagacctcatttttaacaaatttggatatgactcgataaccagtcatcaaatcattttaacataatatcggaactcgtaatcgctaacaattttaagaatgcgttaatttcgtttcgagttagtttgacgataaccggtgaaacgcgtattctcaaagtatttcagaagaacgggtgataacgtgatgcagataaaaatgagtaaccaggttgattcatcagtttatgcggatgccattgcaatccggcgggcagtctttgtgcaggaacaacatatcgatgaaactttggaaattgatacggtcactccagcgacgtggcactacgtcttgtatgatgatcaaaagcaggcggtagccacagcgcgagtgacacctagcgaccaatggacggggcatgttcaacgagttgctacgttgaaagcggcgcgagggcagggctatgcacgacaattgcttcaacggattgcagcggatgggctgagccgtggttggcgacagttggtactaggcgctcaagtcactgcacaagggttttatacacaattagggtatcagccacaagggcgcccgtttatggaggcgggtttgcgacatcagacgatgatattgacattgtcgtaagcatattggcttaactttcagttggttaggttgttgattcgagtcatattccagaataaaggggccttcagcttaaggcttagctttgtggttattttttagcgagacaatgtaaatggaatttccggtagacttctaggcatagttctaggggccttttttgctaaacgattagttcggatagttcgcaaataaaagttttgattcgtagtaaactagttggttgcagtattgtacatatggagctgattagcgtgaatcactaactggtggccgaccctgacaatcatacgcgactgtgagggtgtgttgggttgtgagaatgacaaagacaaagctttttttgaatgggggaggagcgtatgcgaagaaagctagttgggtatatgctaagcatgttaacggtaatattagcgctatttatgctggggagtactgcacatgctaaagaaatcagtgttacgggtttaacggctggcaatgccatcgtacttgatgcgaatggcaagcccgttactgacacaagtacgttgaatgataaggctggctaccaattaacgtatcattggagtattccagattctgaagtgattaaggccggtgatacagcaaccgttgagattccaacgtacgtcagtatcgatcatgatgttgtgatgccgttaacagattctgccgggcaaaccttgggcacgtttacgtatacgaaaggtgccagtactgggacaatcacgtttacggatgcgttgggtacactcaatagtcgggctggcacattgagcatgaatgcgaagggcaatgcgacggcgacggaaggatcagccgaaattgctaaaagtggcttggttgtttcgtcgggaagtgatggtgcgccaacggtattggggtggcacattaccgtgacaccgggcaataactcgacggttgtggttacagatacgctagggcccaatcagacattcattccagattcggttgcggcacaggccgtgcaaattatcaatggtatccaagtgccacagcaaccgttaacaccgactgttgcaactaatggtaacgtgattacttttacgtttaacaacattcattcgccgtttgtgattacttataacactaaggttgagaattttaatccggctgacacagctaaatggcataatacggctgcactggacggactaggcgttgatgcgacggccgatattacctatggtggcaatggaacagcagggatgacctataccatcgaattaacgaagcatgatgcggcaaccaaggccgtgttggctggagccgtttatgaattgcaagatagtacgggcaaggtaatccaaactgggttgacgactgattcgcagggacaattgattgtcaaaaatctacgtgctggtgattatcagttcgttgaaaccaaggctccgtttgggtatgaacttaataccaccccagtaaaatttactctcggcggtattaagccagaggttgcttttcaggtaagtcaggatgatgtcaagcaaccagttgtgccgacaactggtgatgtcacgttaaccaagactgatgccacgaccaaggcggcattggctggggccgtttatgaattgcaagatgccactggcaaagtgctcaagatgggattaacgacggataccactggtcaacttaccgtatctggtctgaccgcgggcaattatcaatttgttgaaactaaagcgcctagtggttatcagcttaatgcggcaccgttatcatttacaatcaagccgaatcaaacggcagtggtaacggtagcagcaactgatgaaccggtcactgaaccaggaacaactgaaccaggcaaaccaggtgaaccagggacgactgaaccaagccaaccaggtgaaccagggacgactgaaccaagtaaaccaggtgaaccaggaacaactgagccaagtaaaccgggtgaaccaggaacgactgaaccaagccaaccgggtgagccagggacgactgagccaagtaaaccgggtgaaccaggaacaactgaaccaagccaaccaggcaaaccaggcgaaccaggaacgactgagccaggtaaccctggaaccacggggccaaccgcgccacaaccggaacgaccagctgtacccggtccaagccaacccgctgcacctaaaccgggacaatctggattaggtcaaccggcattaccaggactgatcaagcaaccaagcacgggtgtcaatggtgctggtggcactgtgggtaatggtgtgacaactggtatgaacggctttggaacgccaactggtagtgaccaaagcacatcagctggctataaccacggaactttgccgcaaaccagcgagaagcagtcgccgatttgggtgatttttgccgggcttttgggcttgttaattgccgcggtgggaatcggttatcgccgtcgtgcttgaagacgcatgaattgatttattaaagtatcatgtagggattgatgatgccccagaaattttatggcttctggggcattgttttggttatgtgtagagctaacattgtttacgggggcagttcagaatttcaatcaataaatttgaatcatcgtgtgagttacgattaagcaatatggtctagctagctgatgtggagattgttagccgtgtggtggcacacgcaaaatctttggcacagtgaatggcggatggcgatgaccttattagtctttgtcgttgctagtatgacgatattgagttagtcagcggtgactatcagattaccggtgctcacacaatcattaagtataaacgactggcagtttgctacgattcaatttagtattgtaaaaaagttgcgtttccagatttgacgtctggaaacgcaactttttttactcaaagattaggctaactaattgctagcggttggtagatgatgggcgaaagtgctgccaaagcgtggctatagctggtggctcattagcccaacgtgtccaccctgaaaatcccaatggaacgatgaggttacttatcgtaatcccaatgagactcatgagtgcaagcccctttaaggttggtgcggtcgtcaaaagcagtggcagtaagtaggtcaattcaatcattgttaccgggcaaacgaatcgtccactagtataaaagtgctgttgcagatgagcgggatccaagtgccgtaaccaactttgacggtaaccggttgcggtggtaatcattagccagtgcagtgtcaacaacatcaagctaccaagcaagacactgctactgagcggcccggtttgcaaccagcgtgttaatattaactgagtccaaccccaactagttaacgtcacgccagttaagcacgcggtcattaacagactgaaggtcaatgaacgcaggccgaaccataaaacaactatgccgatgattaatccgagtgtgagccatctcagtgcgtgggtcgcaatcagggtatgctgatagtgctgttgctgtgttaccccggttgttaggattttggcgtgcgctaagggcgtggcgagtaggctgtcgtgggtgactgcctgaagtcgttgcagggtcctgcgactagccgcactagccggcgctgatttcaaagtgaccgttagctgtgtcatgcttaaatcactactaatattagtaaaaagactgttttgataggcctgattagtagccgcgttagcaggcaggtaaaaactccggccaacttgactagcggctaaatcatgtagataggtcttcgtatttttcagtgaagcgagtaaggtggttaagggttgaacggtctgcttcaatgattggttgacgtggtgaacacgctgatcaacgtgtccagcttcggttgcgaccgtagtttgggccgttaccacgtgatttagtgcggttgtcatgcggtcagtcaggtgatctaacttggtgacctgctgattgactttggttaaatcgggttcagcctcagctgatgtcgttagcgtcgtgtcaatagcctgtaattgccgttgcacttgatcattcagttcagccaaatcattgatgcggtcggacaactggtcgaccgacttggtatggcgactagtcgctgcttgttccagactttgttggtcagtcgtgagttggctcttgagtttcgccatactcgtcagtttaccagccaaatcaatgttgatagtcgcaagttgctggttaacgtagaaattacttagtggttggccggtgggctgggtcactgagatgacttgagccacatttggtacggcccgcagtttagtcgtcaggtgatcgattgtttgtaatgattgctgctgcgttaaattctgcggtgctcgtagtgtaattgtgattggcgccgtggcaccggtaccgaagtgagcttggactaattgctgacctaattcagcattactaagctgattttggcgccagggtcgtaagttgtcatcggcaaactggccgttagcaagaatgaggccggggagtagtaacagtgcgacggccaagctcccaagcgctggctgccagtagccgaacttgctcaattggccctatagattgcgtggacgggtcggccaagccgttgttcctggccaaaataaattatcactgagccaagcggtaaaggcgtaattgagcggcggtaccgccagtaaggtgattccaagcgctacagtaatggcccaagcagcggctaatgagatgaaggcagtccagtgtaaagtgatggttatgagtattaatgggataaaaacaagtgcccactgtcgatattgaagtgtcagaattttgagactgacagtggtcggtgcggttggtgcgctcgattgccaatacgcgtacataaagtgccatgtcaatagactagtcagtattaaactgattagactagcaaggctcagcgcattagccgtcagtggccaatgccaagctaaacgcgcgttagtgataaagctaatcgttgtgatcagagtgaccacttgacacagtaagttcagtaatggcactaacagtgagcggaagatgaggccgagaatgattaaactgagcagactaccgacaagcatgctaatcagcaagttgcgacgttgttgttgcacgtgttgttggtagatcaagtccgtactggtgacactcgtattgaggtcggcgattgcaatcgcattattaagttgatttgcaatcacagataggtcagcccgggatgtctgaacggcgacaagggctaattcggtggaaccatcattggaacgtaataagtgccggtcattagtcataccggttggcgttcgaagctggttaatgccataatcatcggctcggcgattaagtttggctagggtcgtggagatttgttggcgttgctgtttggataatttaccatttgaattgttgaagactaacgttaaggactggctgttggttaacccgtgaccccattgttgttgatatttaggactcgttgttgcatcttgtggcattgcggtttgttcattcacaaacgtggtaatgttcggtaaaatcagaatacttgcaaacaccacgattccccagaaaaataagaacaaccactttggttttaataattttcgcattcgtcttgacgcccccacatcaattactttattttgacttaatcttaccatatcaggtgttagagaagcggtttggtcgtcagtttgaaaagttaattacagtaattacttgtgagttatggtatcctaaaacgctgtgggaggtgctgattttgaaaacagatcgatttcaggcgttcagtgatggtatttttgccattttaattacaattttagtcttagaatttcacattcctgattaccaaccgggacatttactggcggcactattagcgcaatggccgttgatcttgtcgtacgtcttttcgtatttctacgttggcacgctgtggttatttcatcatgattatttcaacatgctacaacgaattgatcgcaacgttaatatgctaaacttattaatgctctttagtatcaccttattggattacccgatgtcattagtggcagatgcgttgacaactggtaatcgacaggatatgcaaacggcatttattgtttatgatttggttgccctgtttatttcggcgacattttatttcatgtacgcttatctgcatcatcaccaggatctaaagaagccgggaatctcaatggctttttataccgcaattaagtttgatccggttcgaagtgtcacgatttatggcttagccatcgtggcaacgttttggtcggtatggttaggtgcaatcttactagcaggtggcatcatttttcactttttggcctacttacggatgagtcgccagctagaacaggcgaagggagggacggcataatggattattcaagtttattaggacctgatcgttatgatctagccgtgacgttagccaagcagtatcatcttgaccccagccaggtcttgttcggctatttgcaagtggttagtcaagttacgggtggtccgaatgcagcgcaagctgatttacatgagccccaagtacgagcagcaatcaatcaggaatttgatcattttttgaagcagcgtcattaattaaaaatcacgatgtgagttcagtctcaacatcgtgattttttagtttcaatcggcaggaaagaggtacggtgttcgccaggttgttgccatttcaggtgttagtgtcagtcgttgttcgtgaccagtcgtgcgtggaataaagcggtaagtacgagtcgctaacgtgatcaaacaacgatagtgcgtgtagttgtggctgatgagatggcgacggtcggcgtggtatggtaagcttacttcttgtaaccagcggaataaagtggtcggcacttgttgcggtgctagctgcggtgttcccagtcgtcgaagtgccatgtgaatgaaacgatcagtgggaatcggcccgctcggtaatggttgcttagtctgaatcacgtgctgagcagcctgacgagtggcagttgtaatctggttgccagatactgctaaataacgatttagtcggcgctgatggtcgcttaggactggtgtattggtcaggacgccggctggattcggttgcgccgtcagtgggccaccagtgggttcgatgacggcactggtgtgtgcatcactgagataccagtgaaagggatagacttcaccagtgtcatcaccccaggacgcaccgaccaggttaacacttggcagatcggcgatcacggctgcgactgattggtgttcacctaaagcccagttgatgaaggcttggggtgttaaattaatttggttgacttgtggttgagtggcgtattcaacggcgtggggcaagtacagttcagcacacaccaaaccagcttcgttaatgccgtcagccatcaaacaagccttaaagtggtcaggtagccgaccaccaccgagaatggcatactgcgtcatacgcgtcgtcgctaacccagttggccacggataacggcgcggcaaaaaaattggccgccaaggtgtcgttgttggaaagtccatggtgcgggcgaagtagcggtgattgtcagtatcaagataagttaagctggtacacatggcgcggcctccttttaattaggttcattatacgtcaaaatgggcgacagctaaatgactgtttaattaacgatggtaacggttacttttttgatgatctgcgtgtgcaaaacagctggcagtgcaatcagtgacagattaatttatggtcggatggaactcattattttctaatctttacaaacgtgctataatgaggtttcaataactatcaaagcgaggtcttcatagtgagtggatataacgtcgcgattgtcggtgcaactggtgcagttggcgcgcggatgatcaaaatggtggaacagacgagtttacctgtcaactcagttaaacttttggcatcaagccgttcagccggtaaacaattacagttcaatggtcaagccttaactgttgaagagaccgttcctgaatcattcgaaggaattgatttagccctcttctcagcgggtggctcagtatctaagaagttcgcccctgaagcagtcaaacggggtgccgtagttgttgataatacgagtgctttccggatggacccaaagattccgttagttgttcctgaagttaaccctgaagcgttgaagcttcatcatggaatcgtggctaacccgaactgctcaaccatccaaatggtcgttgctttggaaccagtgcgcaaggcatttggtttgaagcgggtcattgtttcaacctatcaagccgttggtggtgctggtaaccgggccttgaaggaattgcatgatgagacggaagcctacttaaaaggtgaagagatggaagctcatatcttacctgttgcgggcgacaaaaagcattatccaattgccttcaatgcgttaccacaaattgacgtgtttgaagaagatggctacacccatgaagaatggaagatgatccatgaaaccaaaaagattatgtgtggcggcgacatggacagtaaggatatcaaagtaacggcaacttgtgtgcggattccggtgccagtgagtcactccgaatcagtttactttgaagttgaagatcctaaggcaactgtcaagggcattcaagatgctttggcagctgcaccaggcgtggtcttacaagacgaccctgataaccaaatttatccgcaagcgcataatgcggaaggttctaaagacacgttcgttggtcgggttcgtcctgatcaagaaacgccacaagccttccacatgtggaacgtttccgacaacctcttaaagggtgctgcttggaactcagttcagattgcggaaacaatggacaagatgggcttattgcacatgcaataaaactaatttgttaagggtaatgaaaagctgatcgctagaatcaatattctggcgaccagctttttttgatgtcgaattattcgagcgttagagtcagataaaatataataagcgtcatgttgaaattaggttcgttttagaaagcaatattaagaatttgttaagctaaaactgatgagtgtcctttatccttgtcctggagtcagctccagcatataagctaagtttattcaaagttagtgaatggtcaatgagatgtcatgatgttaatttgctagctagaataaaattttaacgcaaatatggaggaattaataatgaaatcaattaattggtcaacggactatttaccagggcatactgataatttcgtgtcaaacgaggtcattacagacggtgtgactttagcggctgtttggaaaaacttagtcgatacatcgaagtggacgacgtattatgacaatgcgactaacattattttggatgatcaaacgaatactgaactaaagtttgcggaacatttccgatttgatacatttggttttcctatcgatgcccaggtcatggaactcgttgaaccgacggatggtgaaacagcacgactagcatggcatggttggcaaaatggtgatgcagatactcagtttgatgtctatcacgctttcctaattgaaaagttgacagatggccggattcgattattaacacaagaatcgcaagttggacagcctgctaaagacttagctaatcaaacacccaatccgatgttaaatggtcaccaaagctggttagatgggttagtcaaggctgctaaaaggactatgactgagtaaagtagtagctcagcaagattaataggagtgattaaaagatgaaaacatggttcattacaggaacttcaagtggttttggaaaggaactcgcgacaattgttgcacggcagtctgacactcagctgattgcggctgcccgccacaccgatgatttagcctacctagatgtttttgacgcgacgcgtattgagaaagtaagcattgatgtgacaaatgaatcacaaattaaaactggggtcgctcaagcgattcaacgttttggaactattgatgttttagtgaacaatgctggcttaggctatttttcaacaattgaagaaagtgatatggcgaaagttcgctacatgtttgaagttaacgttatgggactcgctaacgtgactaggaccgttttaccgaccatgcgggcacaccatgctgggataattattaatttatcatcggcgttggcattgacgacactaccaactatgggcttttacagtgcgacaaagtatgcagttgaggggtatagtgataccttgcggcaagaagtaaaagacttggggattcaaattatgacggttgaaccaagtggcgctcgaacgcagtggtcagggcggtcatcccaaaagatggtaccgacaattgcagattacgccgcgtttagtgacgcgattacgacggtatcggactcggttactcaggcaccgggcaatccgcaccgaattgctcaggttatgtttgatcaggccaatttggcagaagtaccggcacacttgccattaggtgaatttgcctatcaaggtggactcgctaatttacaaagcattgttagtgaaattaagtcacgtgaggacctttcattatcgacagacgattagctgcgttaagatagtggttaaacgacaatcgaggaggttcagttcagtatgagttattcaatcggacaagtagctgataagttaggagtgacgattgataccattcgttactatgataagtcgggattactgccattcgtgaagcgtaattcaattggccggcgtgaatttactgataatgatctacatttgatgaggaccattgtatgtctcaaaaatgcgggtgtgtcagtagctgacattgctacttttattgcgctcagactcgaaggtgatacgacattaaacgatcgttaccaattactcaaaacgcatgagcaggaattacaacagcggattaccgacttacaggatacgatgagttatttgaagtttaaggagtggtattatgagaccgctacggctgccggacatgaggatattcattttgtaccgggtactaatgaagttcttcccggtcttgaccaggaatatgatgcgtatttgaaggcgaccggtcaactggttgagctgtctcgatttgctaatgtaaaggattatcggttgcgcaagcgatagtccttagcagtttcagtttaatcgatgaaactgtacagaaaaactggttttgatagcttggatattggataagaataaccaaaataaaaggttctgaattgtcagttgtttgacagttcggaaccttttgaaattaaaagcagcgtatatttaagcaattagttgtaagacttgtctaactagcgccactggtacgggttgatccaggccaatgttcagccgcttttgaccggttgcgtaaccagcagttttagcagcagtgagggtcgcatcgtcaaggtcggctgaaatacttagactgacgtgggcctgataagcagcaatgctaacgtattgtttgtcatgttcatagaacggcaaattccacttgattttagcagtaaagtcaagcaattccgatgtaatcagttgggcaagggtgctcaagattggttgtgcagcgattgcagctttattgatgtaatcgttggtgtccgtgactttaactcgactaggcatttttaaaacctcctttatttacgaaatgaattgcgtcgtagcaaccaaatggttagggcacatagtgcaacggcgatgaataccgtaatctcccaaccgaatggattcttcatgaacggtaagtcgacgttttgcccgaaaaaaccgaagacaatgttgggcattgtcaggacgatggagaaaatcgtcagcacccacatcgtgttgttcaaactgttgtctagaatgttcgagtaggcgttcgacacccggccgattatgtctgaggcaatgttggccatttccaatccttgttgtgcctcgacaataatatcgtcgagccgttctaattgggccgccgagaatttgaccggtacaaaccgtttgagtgactgcaacatgtcgttattacttttaagggacgtgaggaaatagactagcgttgtttctaagtccatcaattgaataatgaccgaacgctgaatttgctttttcatcttcatctgaatgtcttggcgttgtttattgatcttgttgatggccgaaaaatattgccgtgatagcttgtacaagacgttaaagatatggtcgtatggatgcaggacatcttcccaatcggcatcgatttcgtctgccaacatatcctcaacgaatattgtgttatcggtcgtaaaagtcagtagggtgtggtcaatcaacatgaaactgacttgggcggtataagtaccttcctcaacgtcttctgtgaccacgtcaaaaataatggtcgtgatggcacttttggcgtcatattccaaccggcctcgttcgtgttgatcggttgcgtagcctaacatttcgtcggtaacgtgttcctcacttacgagttgatgataatcattttcagtgtaattattaacagcgacccagcgaaaatcgtcgcttagttcatggacttttatcattgtttttacttccagcgttttgagatatcttcaatttaacatgagttgcgagacaacgcaaaggaagttttaaggccacctaattatttaacagttgttctacttaacttttcacaccataactggtgactgcgactgaaaagcgctaacaataaatcataactgataatcagtaaaatgactgaaacgacgacgaggtagacatccaggcggttaagggtggcactaggaacgttgcctagacgattgaataaccataaatccaagaataaaagtggcaggccgattaggtagagcccactgtaatggataagcagttgccagagattggcctggtgaccactgatggttacgatctgactattgagcaggcgaccaccaatggttttaccatgccaacaccaggcgggcccaatgaagaagaggatgatatcggccaggtatagccagcgaaaatcatgtggtaatggccaattaaaatgtttgactaagacgaagtagacggtgtcaaaggcggcaattgcgagccaatcgatgaccaacgccccaatgcggcgccaattgatggggtgttcctgccaattcaaccgggtactgtggtcgcgattgcgccactgattaggaatcagatgtagacacccagcaccgacaatcccaccaagtgtgttcatcattaaatcgtcgacatcgaacatccggtaggctcgtgagtagtagccgtataatccggttaactgcgtggtttcgaagaacaatgaaatcgagaagctcgtcagggtgatcaaccagagcggccagcggtgccgccactttaagtaggcaccgatcggcataaataatagaatattgaagaacggctggaagaacgtgtcagatttgaaggcggctaaccaagtactggggtccccgagttcaaacggcgtgagtgccttcaactgggtgagaaagtagaagggttgtaaattatactcagcagttgttaggctagccacggatgagcgagtcgggagtggcagaataattagtaagtaggctgctgccaagtaccaaataaacgaataggtactgatcaagttacgctcactcagtgtttgacgtgttcggagctggatagtcaggataatcatggcgagtagtaaggtcatgatgggtaaagctaagataacgatgtgcacgggttccagcaacgtactgacaatgtgactggaaagtgcgagttgataaagttttgtaatgagttcgtgcatggctggtccccccttttttgggaatagcgctgttctttaactaatgttgactatatcatggtataaagaaattgtgacgattaatataaataaataagtaaattgttagactttcgccgtgactgctagcgtattgtcgcgaatgaccgtttcgaccatacttgcttatctaaaaaaaatatgattgaataagcataaattatgagagggtgatgaggatatgctaatggatgggcatacccacacggaactatgtccgcatgggagtggtgaagcaacggaaaaaatgattcaacgggcgatacagctaggttttcagcggtattgtattacggagcacgcaccgttaccaccggcatttcgtgaccagtatgaagggacgccggccggttatactgaggcgtcgttgcgtgagaaccaagtagccgattatttggcactggctaacggactgaagaccaaatatgccgggcaaatcgagatctcagtgggttttgaagttgatttcttaccagagcatgttgcttggacgcgtgattttctgaatacctatggtcctcggacgcaggaaagtattttgtcagtccatttcatgcgggggttacggcagcatttctggtgtgttgacatgtcaacggatgattttgcagccggttttgggcagtggcttaagacgccccaacgtgtttttgaacagtattatcagacggtcttggcatcagtacaagcagatctgggcccttacgcaccacaacggatcggccacatgagtctcgtccgcaaatatcaggattactttggcttgactgaacccttggatgtccataatcttcaattagtagatcagacgttggcgttagtgaagcagcaacggcggcagttagatttgaatttggctggtctctacaaaccgtattgtaatgatttttatcccggtcaacagattctacaacgcgctcaaaagcttgacattccgctggtttatggctctgatgcccatgacatagccagtgtggggcgtggctatcatcttataaaaaaattaattgagggttgacagccgtcagtttagtgattacaatgaattataaattaaacgactaatcaaattttaataaacggttgtgattagaacaagtaattaagtcttcctcatccagagagcccgggtagctgagaaccggacagacaggcttaacgaacacacatctatgaactgctaaggtgaaccagtctcattagccttagccgaattggtttcgttatccaagttgacttgatcaacatgaggtctgccgtgcgaacggtagatgaaataaggtggaaccacgcgtaaacgtccttttagcaaattgctaagggggcgttttttagtttcaccgatccatgcggtaagtttgcgtgacggaatcgcaagtcgctccggttagcatgtaagcaattgattaagcacgttgataagtaacgatatgaattaaactgattagttttaaaaataacgacgttttaggaggcgtaaattatgttgaaacacttattaccactaggaacccgggatgaatttggtcggcgggcacgtaccaaacaacacttgatcgcggtgatccaagcccattttaaacaacgcgggctcgcgccaattgcaacgccgttattagaaaacgaagcggtgtttgatccatatcagatgggtaactaccaactataccgcttatttggcaacgatggtcgcaccttggtcttacggccggacatgaccttaccagttgctcgcttcattagcgcgacgaatgtccccttaccgcaaaagtttggttatgtcggcgatatctttcgagtaagccgtcaattatcaggttcatataaccaaatcacacaagcgggagtcgaattagtcggttacgcatcgctgaaagccgaatttgaatgtttaacgattgccaaccagctttcaagtgagctgattgccgatgctgttgaaatcgaattaggagatgcccaatttgcacaacgggtcgtggccagtttgactggtgacgaaggcgaacaacaagccattttaaccgcactgttcgataagcaagtaccacgctacacgaagttgattgccaagtaccgcgcacagcctttatataattttctcaaagcatggccgcgtttgttcgggcgtccagaacgtatcttcaaagaattagcggcagcaccactacctgaaacagtccaaccaagtctgaaacggcttcaaacggtggtggcctggatgcaacaaacgatgccggagcaggtcatctcggtggatttgagtagccaagcaccacaaaaatactataccggcctgacttttcggggttactcacaagcgggacctggctacctgttcagcggcggccgttacgacaaactgttaacgaactttcaagctgaagcagaaccggctgtgggaatggggttagacgttgacttgttaacgactttagccaccgaccaacagaccgcttatgctgaacaattgatttactttgagcctgaacagtggtcacaagcggaggcatacttagcgaaacaaccgcacgccattttgagtttggcggatgacttagcaggtgcgcgcatcgaagcacaacgtttgaatgcccaactgattgatttaactggaggtatgaccaatgactgaaccacgtttaaagattgccttgactaagggccgcgtcgaacaacaagtcctgccgttgctggaagaagctggactggattgttcgcaagtccgcaacaagcaacggcggttgatttttgattctgagacgcaaccatatgagtttattttagcgaaagggccggacgtgacgaccttcctcgaacggggtgctgctgatatcggcatcgttggtagcgatattttgactgaacacgagagtacccaatatgaactgttagacttgggggttggtaagtgccaatttgtgctagcatccacggccgactttgatcccgttgcaccacgacgcaaaatcatcggcaccaagtacccattgattacccaacggtattttgatcgcttgggccaagatgttgaaattattaagattgaaggctcggttgaattagcaccactgactggcttagccgacgccatcgtagatatcaccgagacggggaccacgattcgtgagaaccatttacaaatttatgactatttacaaccagtctcgacccgcctagtggtcaaccggttagccttaaaacagcaacaagccgccatctttgatttagttgatcggttggccacagttgttgatacgaataatccaaaggagtttgtctaatgaaaattattaatgaagatttagctagtttaaaacgcttagttcaaacgaagacccaacaattgactgacttaaaggttgaatcagcggttcgcgaaattattgccaatgtgattaaaaacggggatgccgccgtcaaggattacgaaacccaattcgataaggtcaccttgaccgactttaagttgtcacaaactgttattgatgatgcttataacaatctggacccgcaagtgaaggacgccttgttgttagctaaacgcaatatcacgagttttcacgaaaaggaaaaggcgactggctttattgatgctgaacagcctggcgttctacgagggcagaagttaatgccgcttaatcgggttggcttatacgttccaggtggcacggcagcctatccatcgactttactgatgagtgccttgcccgctaagattgccggcgttaatgaagtcattatggtgacgccaccacaagtcgatggcatcaatccagccgttcttgctgcagccaaaatcgctggcgtcgacgccatctatcaagtgggaggcgctcaagcaattgctgcgttagcttatgggactgagtcgattccagcggtcgacaagattattggtcctgggaacatttttgtggcgactgctaagaagcaggtctttggtcaggtggcgatcgacatggtggccggcccgtcagaaattggtattttagcggatgattcagctgatcctcggcaattagcggctgacttattgagtcaagcagaacatgaccgtcgagcccggccaatcctaattacggatagtgccgacttagcgcaggccgtcagtgacaacgtgacgtcacagttgaaagttttgccacgagaagcgatcgctaccgacgctgttaacgaaaaaggcttcattgccgttgtcgcaaaggttgaagaaatgtttgacttgatgaatacggtggcaccagaacacttggaagtgcaattgaagaatccaactcagtacttgaatttaatcaaaaatgccgggtcggtcttcttaggacgctacgcctctgaaccactcggtgactacgttgctggtccgaaccacatcttaccaacgagtggcacggcccgtttctcatcaccacttggcgtctatgatttcgttaagcgaacgtcctttatccaatacactaaggacgctttggctaaggaagctccggcgattaccacgttggcacgggtcgaaggtctggaaggccatgctcgtgcgattgagagtcgttttgacacctattacgattagggcgtaattagtagttgatactgattgtgattacagccggtagtcgttttagcagatgaggaggaaatgaacatgcgacaagcaacgattaaacgtgaaacgaaagaaacccagattgaaatcagtttgaatttagacgaacagagcggtatcgaaatcgataccgggataggctttttgaaccacatgttgaacttatttgcgaagcacgggcgcttcgggttggtcgtgaagtgtcacggcgacctcgacgttgacccgcaccacactactgaagatacgggaatcgtgcttggcgaatgctttaagcaggcgttgggtgataagcagggaattgaacggtacgggacggaatttgtgccaatggatgagactttaggtcaggtcagtgtcgacctaagtggacggtcatacttagtttttgatgccgagctcacgaatccgcggctcggtggcttagatacggagacagtcgaagatttcttccaagccgtggcctttgctgctgaaatgaatttgcacgcacgcatcctgtacggccgtaacactcaccacaaagttgaaagtttgttcaaagcgtttgggcgggcaatgcgcgcggctgtcacgattaatccagatattcagggggtcaactctacgaaaggcgtgatttaaatgtttgcaatcgtcgattatgatacgggtaatacccgtaatttgaagaaagcttttgactacctgcaagtgtcaaccatcttaacggctgacccgcaacaattagcggccgctgacgcagttattttacccggtgtgggagctttcgcagctgcaatggccgctttaaaagaacgccagttagtcggcgtgttacaagcattggcgcggagtggcaaacccgttctcggtatttgcttaggcatgcagctcttgtttgaaagtagttccgagtacggcgagcatgctgggctaggcttgttaagcggccgggttagcgctttgccaacggacttgaatgtcaaagtcccacagatggggtggaatcagaacgagcttcggcgtcctgatagtccctttgccagtattgacgcggcctatacttacttcgttcattcgtactatgcggtatgtccggcaactgaaatcgtggcgacagttcaacacggcgtccaggttccaagtattgttcagcatcaaaatgtgattgggatgcagtttcacccggagaagagtggtcgagtcggattacaacaactagcagcttttaaggaaatggtgagtgcaaatgatttttccagcaattgatttacgagccggtcagagtgtccggctctaccaaggtgattttaaacaggcgacattgattaatcctgatcctgtcgttcaagcccaacaaattaacgcagcgggcttgcagcaattacacatggtcgatttggatggtgccaagtcagggcgcccagaaaacttcgcgacaatcacggcgatccggcaagcatttaccgggacgatcgagctcggtggaggtattcgaacctacgagctggcgactcgttatctcgaattaggaatcgatcgcttaatcttggggtcagttgcgttgactgatccacgactggtcaaacgactgttaagtgagtttggtggtgagcgaattgtgattgggttagacggaaccaatggttatgtggcaattaaaggctggttggagcagtcacagaccaagatgagtacattaatgaagacaatgactacgagtggtgccaagcactttatcgtgaccgatgtcgcccgtgatggcacgatgcaaggccctaaccttgcgttataccaagaactacaagcacaggtgcccacggccaacctgattgccagcggtggcgttcggaatttgaccgatgttcaagtgttacaagccagtgggttcaaggatgttattattggcaaggcgttagctgaaggcggtgtgacactggccgaattagcgggggtgactgaatgttagcaaagcggattattccgtgcttggatgtggcggatggtcgggtcaagaagggcgttaatttcgtcaacttgacggatgtcggagatccggtggcgattgcagctgcctatcagcaacagggcgcggatgaacttgtctttttagatattgcagccaccaatgagcaccgcgagacgatggccgccatggtcgaacaagtctcagctcaggtcttcatgccactgacgattggtggcggaattacaagcgttgctgatatgcaacgaatcttacgtgcgggtgctgataagacggctattaattcggctgcagttgccaaccctgaactgattcgtgccggtgctgaaaaatttggtaaccagtgcattgttgttgcgattgacgcggcgtgggatgcggcagctggtcaatatcgtgtctatacacatgggggtcagcaagcgaccgacctcgatgcagtggcgtgggccaagcaagcggtcgccttaggggctggcgagttattggtcactagcatggatcgcgatggcactaaggcggggtttgataccaagttatatcaggccctgggagcaacggtcaatgtgccaatcattgccagcggcggtgcgggtaacttacaagactttgtggatgtttttagcacaaccccggttgatggtgcattggcggcttccgtctttcactttggcgagttaacgattgcagatgtcaaagcgacattaagaaaacaaggagtggtcgtaagatgaaaccagactttgaaaagggtgacggcttactgacaacggtcgtcaccgacgcggatacgaaggatgtcttaatggtcgcgtggatgaacgcggaaagttatcaacggacattggcgtcgggccagacgtggttttggtcacggtctcggcaagaactttggcacaaaggcgctacgagcggcaatttacaagatgtcgttagtatgacgttggattgcgatcaagatacactattggtcgcagttcatccgcatggtcccgcttgtcatacgggacatacgagttgtttctttaacccggttgaactagaacagggcgcctaaggattgatgacgatagccgaatgagttgggagttagatggctgattggttggaaaatgcggtcccaacggtcgataagcaggattgtttttaacccgtattaaattgatgaatatattatagaagaaagtggtgtcgaatatgcaaaatatggaagaattatacgaactgatcaaacaacggaaggcaacgcctaagaagggctcctacacagattatttatttactaagggactggataagattttaaaaaaggttggtgaggaatcaaccgaagttattgtggcggccaaaaatcccggtgacgacgaattaacctatgagacagccgacttgttgtatcacgttttagtgttattggtcgaacgtggtgttagttttgaccagattaagcaagaattggctaaacgtgaaggtaagatgagtgactataaggatcggcccgaaattaagaacctataggaggtagccgaatgaaagctagtattgaacagttagaaccctatgtgcccgaaaagccgttggcgaccctccaagctgagttaggattgacagaattagtccggttatcagctaacgagaacccgtatggcacctcgccaaaagtggcgattgctgtgaagaattgggacttcacccagagtaatcgttatcccgatgccgacgcacaggagttacgacaagcagtggcccagcaacagggaatcgacccgaatagcatcgtttttagtgtaggtcttgatgagatgatcgtgatgttatcacggacgttcttagccaccaacgaccaggtgctagtgtccgcaccgacgttttcagaatatggactacatgctgagatcgagggggggcaattaatcagtgtgccaacgttgcctaatgaccatgtgaacttcgaaggcttaatgaaggccattacgccccacgtgaagatggtttggctgtgcaatccgaacaatccgacgggcaccgtggaatcattagcggcaattgaagcgttcgtccagcaagtacccccggagacgatggtcctgattgatgaagcctacattgattttacaccgggcgcggctcaagtaacggccatgcagttaccagccaagtacccgaatgtagtggtcatgcggacattctccaaagcatatgggttagctaactttcgaatcgggtacgccgtttttaataccaaatatgccgcaacgatgcaaactattcggcttccatacaatgtgaattccttggctcaagtggcagtcctggcggcaatcgatgatcctaattttgtgaaacaaacggtccaaaaaaatgcgacggaacgtgctaagtggatggcattctttgatgatcagggtgtcacttacgatcaatctggcgcgaacttcattttctttaagtatccgagtgccacgcaactggctgactatctagtgcaccatgggtatctgattcgcactggcttacggccagggtggttacgactaacggtcggaacggctagcgataatcagcaactccaacaattaattcgtgagtttaaggcctagaattggcgcaaagaaacctgagtaatcggtttctttttttgttgccctaactgctgaataaattcgaggcagctggtccgcaaggatagttgtcaataacacctgctaaaccattaactcaagtgttgacttcgacgccactctaagcagtaaaattagggtgataaaatacaggagggacaacaatgtcagaattagataaattagcagccggggaatggtatcaatttaaagatgctgaggtggccgctcaaaaagcgcgggctgccaagttatgtcaagagttcaatcagatcgatgcaacaaatccagatgcgcaaactgccaagattcaagagattcttggtagttacggtcgcaatctttccgttcaagcagactttaattgtgataatggtcgtaatattcatgttggtgataattttcttagtaattataacttaactattttggatatcgcgccagttcatataggggataacgtgatgattggccccaatgttgatatttatacggtcaatcacccgttgacggctagtggtcgacgtgctaacttggcccagggtcatccagtcacgattggtcatgatgtttggattggggggagagcggtgattacgcccggcgtgacgattggtaataatgttgtgattgcggctggagcagtcgttactcatgacatgcctgataatacgttggtggccggggtaccagccaaagttattcgacaattagaataagaaaggtcgcaattggctagctttttgggcacttattttactcattggcatgatgagtcgtaaatacgacgaaaataaggtttatttttgaaaattagtccacgtaagcggcaccaattatttttacaggtatacttagattaacaaactaatattaagagaaagaggatgccgtttgttacatttaatcgaacagttgtatggacccttcttcagtgcgactaactggggtaacgtcatcacatctgctaatgactggttaatcattttatcgttagcaattattgagtgtttactatcagttgataatgccgttgtcttagctgctcagacccagagtttagataatttacaagagcgggaaaaatcgttattctatggcttgtggggggcctatatctttcggtttttaatcattgggattggcacgtatttgatcagtttttgggagatcaaagtgttaggtgcggcttaccttgggtacttggtgtatcgatactttagtcagccgaaaaatggggccaaggtggcacagaaacccaagcaacaacgacgcttcttcggactaagcaacttctggtcggtcgtcattcagattgaaatgatggatatcattttctcaattgattctgtattggcgtcattggcaatttcggataatccggtgattgttttgattggtgggatgattgggattgcctgcatgcggggcattgccgaggtcattatgcgcttaatgcgcaagattcccgagttggaaaccatggcgtattgcttgattgtcttgattgccatcaaattatttatctcaattcctgccattggttgggatattcccgcaacggcttttggtggtatcgtattagtagcatttattattacgttgctgattcatttttggcgtcggcgccgcaatgaacagtgcgtggaaggaaaggtgcgtaaatgatgaaattaggttggattggtaccggcgtcatgggggcagcgattgtccgtaacctgatgacggccggctatgacgtaacggtttataatcgaacaaaaagtaaggcggatgcgctagttgcggcgggggccacttgggctgatacaccggctgccgtggcagaaacgagtgacgtgattttcaccatggttgggttcccacgggacgtcgaacaagtttattttggtgatcacgggattttcagtggattggccgctggaaaaacggtaattgacatgacgacgagccaacccaagttagccgttaaaattgcgacgtacgcgcgtgaacatgacatgcacgctttggatgcgcccgtgtccggcggtgatattggcgcccaaaacgccactttgacggtgatggtcggtggcgatgccgatacgtacgaggcgatgttaccattatttaatgtgcttggtcacaaggtcaatcattttggggatgctggtactggtcaacatgccaagatggccaatcagatcatgattgcagggacgatgactgggttaactgaaatgttattgtataccaaggcagccggtcttgatccggaaaaagtcttggcaacgttatctagcggtggtgctgacaactggagcatggataattacgtgccccggattctgaaggacgattacacgcccggcttttttgcccgccattttcttaaagatttgcggattgctttgagtgaggcggatgcgatgggacttaatctggttgcgacggcgcaggctaaacgactttatgaagtaatggtcgatgtcaaaggcttgggtgatcaaggaactcagggattgattaatatttattagcgcgtggctgacttgatgaaagtcgctcaaacatcatatatttattgaaataatagttatcaaggcggggattcagcgagtttaatctttctgaatccccgccttttattaacatgatacgcattatgcgagttaatttgtcatgaatcgtgattaaaacgtgccagttaaattactgttcgtcagccggtgcgcgtcctatgccgacctccggggctgggtgccaattgctggaacgcagccgacgtcgatttgagctaacgcataacccgcgtcatctcaaatacgagtcttattctaagccggaagaaaaacacttccagctaagaataatttggctactgagcattgtcacccagcccctccagtcgggaagccgctcaaatggcaaatgaacagccacttaacttggtacaattagtcgctgactatattttttactggaaatttaaacataacgttagggtggcgttaaccactttgtcgagacgtttaattattactatggtgatttgggaatagtaaattatcacaatatcattttctgtctgacagttgattgacaaagttatcgtttataaaaagcaatgacaagtccatcaatgattgggtacatccatgtccgccattcgaacactgtcccgactggaaagcgtttcggccaatgctcagcactgccaagagtgtgaggttcagacgggtgagactgaggattagcctagctagggcgttaagcggtgaatttccgcttgacgtcatagcgtagctaaccggaagtctcagtctgacccgagcacgtttcactaatatgccattaaagcgtggaagaccagtatttaagactggtctgcggcttaaatctgtgtccaccgcgttccagcaattggaagaaatacctggaagtcggcgtaggacgcgccaactaagtaattttacgctaactcgaactttttccagcaggcctaagctggctgcttttgaactgacataactggcacgttttaatcacgattcatgctaagtaataactagtacaacgtctagcatggtattttatgaaacgatatctgaaaataaacttggtatactgtcaatcttgatgactagcattttgatgcattaaaaaacggattcttcagcgatgtgtggctgagggatccgtttgatgtattaaggcttaattgatttagtttaaggttgcggctgctttttgggcagcgaggttgatgatgttccaaggacggtcaaagcctggttggaagaagaagtccgtgtaagctaagtcagcaacagtcagtttagcttgaatagccactgagatggcgttgatgttagcagtaacatcgtacttcgacatgatttgcgcaccaagcacgcgaccatcagttgggtcaaaggttagtttgaaccaaactttggtgttgccagcatcttcagagacaaatttaggccgaatggtatcggtgactaacacggatgccgtcttaacgcccagcttgtcagccgtgccttctttaacaccagtggaagcaaagtggtagtcaaagacggaaagtgcggatgaaccagaaacagcaggcattggtacgttttcgccaagtaagttcttagcggcaatccgaccttgccgacgagcgttagtggctaacgcaatgcggttatccttgccagttggggcaaatgggactaaggtcgcgtccccgacggcgtaaatgtcagtgtcactcgtttggaggtggtcgttgatcttgatcaaaccgtgatcatctaagtcgacaacgcctttcaagaaaccagttgctggccgaatcccggcggcagttacgaccaggtcagctggatattcgccttgatcggtcactactttggtgacgtggccgtcaacaccttcatacgctttaataccttggccaactgcagcatagatgccgtgatcggccatcgtcttagtcaagatatccgtgaattcttgatcaaggtaaagactaagtaaacgtggtaataggtcgataaccgtgacgtgcatgccagctttggcaaagacttcagccgcctcaatcccaatataaccggagccaatgacaaccacattcttaacgctagggtcaacggtcttggcctttaatttgatggcccagtcgcgtccacgcattgcgtagatgttggctaagtcatggccgggtactggtaggtcaaatggtaccgcgccgacacttaggactagtttgtcataagtttcatcacgttcgtcaccagtggcgtggtcaatgacgtgcacactgtgactagcagggtcgaccttactaatttcactatttacaaaaacgtggacgccttgggcttgcatgccagcaggagtggcatagctgacggagttaacgtctttaacggcaccttcgaggtataattgcatcccacatgagaggaatgacagaaaatcacctttttcataccattgaatttcagtatctggttgagcggctaaaataccgcgaaccgtttcataaccaccatgagaagaaccaacgacaataactttcataattgtaaagcctccaaattttagtttagaactgttctaaatagaatataacacgaactaagtttgtcggcaagggcagtttgtaattattctaaattatcagtgaaaaatagctgtgcccgtcgacaccatttagtttagaaatattctagttagaatatagcactaaaataaattgttcacaactaaaacggttacaattagctgcaaaaaaacacccaatcatcaaaaaattgatgactgggtgtcagtattaatagggatggacttaatgattattcaataatatcgaagaaacttagcaacttttctttggtcaattgggctttttcctcatcacgaacatcatacttaatctggccctgatcaaggacaatcaggcgattaccatagcgaagcgcatcgtctaaatggtgggtgatcatcagacacgttaacttttcctccgtgacccgttgattcgtttgtgtcattagttgagcgctggtcttaggatcgagtgcggctgtgtgttcatctagtaacaagagatcagggcgctgctcggtagccattaaaaagctcagagcctggcgctgccccccagataaattttctgttgccgtgttgagccgagctgaaagaccgttgccatccatcgtttccgttaaggcttgaaagtggggcaggtgctttttcaattggcgtaattttaacgtacgtcgcttaccacgttggctggcaagcagtaagttttcggcaacggtcatccggggtgcggtgcccatcttggggtcttggaaaacgcgcgccaggaaagcggtccgcttttcaacggatagtcgggtgatgtcctggtcacgtaactggatggtgccactatcaaccggtaactcgccactgatcgtgttgaagagggtcgacttaccagcaccatttgaaccaagtacggtaataaaatcaccatcatagacgtctaagttcaggccccgcaaaattttgacctcattcggggttcccgaattaactttggtcacgatattttttaatgataataatggggcactactgttcgtcataacgggccactcccttctttaaaacgtgattaagatgtagaactttactgaattgcggtaacattaagcagattgccagaattaatgcggataacaggttcatgtcgttggtgttgaagcccagttggaggactaacaggcgcacgaactgatacaaaatactgccgagggtaaccgcaacgagtcgttgattcaacgttaattcaccaaagacaacttcaccgatgatgatcgaggctagcgcaattacgatgattccgattcccatgctgacatcggcataaccgttattttgcgcaattaatgcgccgcccaggccaatgataccgttagagaccatcaatcccatgatggtcatgttatcggtgttaataccaattgaacgtgccatttcacgattgtcaccagtgacaatgaaggcttggccgaggttagtttgcaagaagacaattagaagcacggtaatgatactgatcactactaggccaacaaagacgctgtcaaaatatttaggcagtgattccaaaaagtgattagaaaaaatagtttgtttgcctagcaatgaaacgttggaactgccgcccataatgcgcaaattgattgataagcacgcggtcatcactagaatcccggctaagagaatgggcactttacccttggtataaagtaggccggtgaccaggccggtaatcgcgcccgcaacgaaggctaacagggaagcggtaacggggcccattccatggctaatcgccatgacaacagtggccgcaccgagtggaaacgtcccttcgacggtcatatcaggaaaatcaagaattcgaaatgtcaaaaataatgcgacgcctaaggttgcccacaagaggccttggccgatactcgatacgatcatactcatttgtaaataacccctttcgctttggcttctttaaggacacttgctgggaacttgatgccgagctttttagcttcacttaaattgatggtcatcttacccttagtgatgactttgattgggtagtcgctagttgctttgccctttaaaacttgggctgccatttcaccagttagtttaccaagttgatactggtcaacggataaggttgcgagcccgcccgctttaaccatcgtatcaacggctggaatgactggtaccttagccttatttgtaacggagactagcgttttcatggcacttgcgacgccattatcttgcggcgcataaacggcgtcgacattggcggccatggtttcagccacttgctgcatatcgttggtgttagagatagtatataacttgtatttcacaccttcttgtttacaaatccgtgcaaactttttggcgttatattcaccaccatgatctgaagtggtgtaaataattccgattgttttagcgctgggaacgagcttccgcaacaagtctaagtgggatttcaatggagattcaccagaagtccccgtaatattggcaccgggatgttggtcgcttttaattaggccgctacccgatggatcagtaatacctgctaacataacaggggtttgcttgttagccgcagaagcgagggcctgcgcggcgggggtggcaattccgactgttaacgcggcgttttcgttcatgaatttttggctcatggttttcaagttactttgatcgccctgggcattttgatagtcgattttgaccgtcttgccatcgacataaccatattcctttagaccagcgaccacgccacgatgaatcgcgtcgagtgcggggtgggtctggagttgaagaatgccgaccgtcggcactttctttgtactggtcgtcttcgtggcggtggttttgcctgtcatgacaaaggccactcccagaaagacgatcaaggcactaatgaatgcaatcatacgtttcaatctaatcacctcaaaaaatttcttaagctcgggcaagttcaaagccaataaaaaagggcaaaccagtaagctctggtttgccctttacggaaccgaagcctgctgtgttaaaacccatgcagacttctttgaatatcaaagtgagccggcacagatacaaactgtttgccagattgtatccgtgtggacggcactacaatctgaacggccggctttgccatgaactgttcaagttagtaactgactttgacatgcttggttcctcgctttcgttattgaatgagttcagtataggcaaagtcgaaaaaagtgtcaaggataaatttcaccaaatattaaaatttgtggtgaaaatcttgtgagatgcggatgcttggtcgtcggcatttgttcgttctagtccgacctccggggcggggtgccaatggctggaacgcagccgacgtcgatttaagcccgagcaaaacccgcctggtctcaagcctgtgaggggccacggttgaagccgaacattgtctagtaacggattaatacggttttgacattagtctgttggcgtagcaagcacagaatttagtggtaccgaacacgtttcgggaaaccgctcgaatggctgatgaacgaccaccgagcttagcgcaacttatcggtgcctattttgatactggcactttaaacaaagcgttaggttcattaaagcattctgttgagagattaaatcttactacaccgattcaggattagtgagctatctcaatatcactttcagtctgacagttgattgacaaaataactgtttataaaaagcaacgacgaattcatcaaaagttgagtacatctttgtccgccattcgaatactatcccgactggaagacgttccggcaattggcagaaatgcctgtaagttggcttaggacgaaccagcaaagcatgtttacgctaactcgcacgttttccagcgggcctaagctggctgcttttgattttagttattcagcaagttttgaataagcattcaagtaaaacataacgaaaaaacaataaaatgagttgacaatgaataaaggcggtgttaaattagttttaaattaaaaacagattaagacgttgaagagaagagtaatcgcatcactgatttgcagagagcttcgtaatggtgagagaagtattcaggagtgcggtgaagatgagcttggagtcatgatgcgggtcgtagtggctacgcatgcggtggcaaccgatatattgcggggtttcctagatttttcagggtactcgtcgaggttgtgatcgtgagatggcagcgaacaacggtggtaacgcgaaagctttcgtccgttagtttctaacatattagagactaatggatgggagcttttttttgtttcaatacaggtgagagggagcggttagatgacagtcacagcaaataatggattattagcggcccgtggagaatgggcgaacgcaacgtgtcaagaaagtcatcaggcacaacagattttaattttaaacttgatgccgactaaggtaacgacggagcggcagttcctaaagcgttttgcagccggtaacacagatgtggctgtgacgtttatgtatcccgcgagtcaccatttcaagagcctgccacaagcagtggtcgcggcacattacgtgacgttggctgatattcaagatcagtattttgatggcttgatcgtcaccggcgcaccagttgagacgttaccgtttgaagcagtcgattactggaacgaattgttaacaatcattgattggtcacgacagcacgttagccagactttatttgaatgctgggcagcacaagcagggctatacgcacagtttggaatcgcaaagcgcgccgttgctcacaagatattcggtatttatagtgcgactagtactgatgttaagtcaccgctgattagtggactgaatgcaggaggtttgctaaaaatgccacagtcacggcatacagcactagtgatgccggaacgcttacccgctggattgcaggttgtcgctgacaatccgaaggtgggaccgctcgtcttatctgcccccaagctgcacgcggtctatgtgaccggtcatcctgaatacgagcgccgcacgcttgccgatgaatatttgcgcgaccgacgtaagcacttgccgattcagttacctgaacattactttgctactgaacaattaacaacagttgattacagttggcaaacttcaagcaatcaactgtatcaaaactggttagcaactttgaatttaacgaaagtaggttattaattatgacaacaacgaatcctgaaaattatcactttgagacgttacaagtccatgcgggccagacggttgatgaaacgggcgcacgggccgtgccaatctatcaaacgacttcatacgtctttaaggatgccaagcaagccgcgggtcgctttgccctgactgatgccggcaatatttatacacgactgacgaacccaacgacggacgtggtcgacaaacgagtggccgccttggagcacgggacggctggggtaacgctcgcaacgggttctgctgcgataaccgcggcaattttaaacattgcgcaacagggggatgaaattgtggcggccaacaccttgtatggtgggacctatgacctgtttagcgtgacgttaaagaagttgggcatcacaacgcactttgttgatcctgacgaaccggcaaattttgagacggcaattaacgatcatactaaggccttgtacgttgaaagtatcggtaatcctggcattaacttagttgattttgaagccattggaaaaatcgctcatgatcatggcattatttttattgttgataatacctttgggacaccatacctagttcggccacttgaacatggggccgacgtggtcgtacattcagcaactaagtttatcggtggtcacgggacgaccatgggtggcgttattgttgaaggcggccaatttgactggcgtgcgagtggcaagtatccagatttcacaacgccagatccgcaatataacggcctcgtttttgccgatttgggcggggcagcctttacgactaaggtccgggcggaaacgctgcgagataccggtgcaactatcagtccctttaattccttcttgttgttgcaaggtctagaatccttgtcattgcgagtagaacgacacgtgaccaatacacgcaagattgttgccttcttaaaagcacatccaaaagttgcctggatcaattatccagaactggaagatagcccgtaccatgacttagcaactaagtacttcccgaatggggttggttcgatcttcaccctgggcttgactggtggtgaggctgctggtaaggcattaattgaacatctacaactcttttcattgttagcaaacgtcgctgatgctaaatcattaattatccatcccgcttccaccacgcatgcgcaattaaatgaacaggaattgttagcagctggtgtaacgcctgacttgattcgaatttcagtgggggtcgagaacgccgatgatttaattgctgatttggatcaagcattggcacaggtttaataggtcggaatggtcgatgattgaaagtatatgaaacggagggtgcgacaatgacaacgacaattgaagtgggcatgttagggttaggaactgtgggtagtggggtggttgaacggttgacccgctcggctgccaaaattgaacaaacgcagggtattcggttgcacctagcagcagttgccgttaatcatttgaacgcgcctcggactgttcagttaccgattgggacgcgcttgaccgattcattaacgaacgttgtttgtgaccgaaaaatccaactagtcattgaagtcatggggacggtcgcaattgctaaaaaggccattgtggcagcacttaatcagggtaaggctgtcgtgaccgctaataaagacttaattgcaacggcgggacctgaattggctgcgttagccaaaaaacagggctgtgatttattttacgaggctagtgttgcgggggggattccgatcttgcggacattaacagatagttacgtgacggacaatgtgcaggcggtcagcggaatcatcaacgggacggctaattatatgctaagtgcaatggcaaccgggcaatcgtacgaacaagctttagctactgcacaagcagccgggtacgccgaagctgatccgactaatgatgttgcgggcattgatgcggcatacaaattgatgatcctcagtcgctttgcttttgggcaagagttgagcctgccgcagattgcacccacgggaatcacgcatttaagcgcttcggtttgtcgattagcagctgaaaatggctggcagattaaattgctcgcgcagattcagcgacacggatctggtttgtattgtcgtgtggcgccagtggccgtgccggttgatcaacccctgagtcagatcaatggggtccaaaacgctgtagctgttcaaagtgaagccattggtaccagcttgtataccggaccgggtgcgggaagtacggcgacggctaatagtgttctaaatgacgtcttagtagcggccaagcaccttatcaatggttatcgaatgattcgtaaccagaaaagaagtgtctcgttaacggtcactcgatttgaccagttaccacaaacatacttaggcattggtccggtcgcaccagaagccgtgaaatattacgctaatgaagctgatttctcagtaaaaacgattgccgatgattgttatcagattactggattaagtgcggtgaaacgcaaaaagctgcgtgcgaacttgccactgactttgataccaattgccggtacaacggactggaagcaagtgaccgaaaattcaataacatctcccataaatgttgcaatttgaaaaagaatgctcaggtacagtatactgtatctgagcgtctttttttgatgctaagttcccatgggatatccatggctaagtggatgagctaattgaaatgagttagcgagacgtggcagttggttgactgacacgatgaggagtgaaattatgaaaattgcggtggtgaccgaaagttctgctaatttaaaagcgcaggcggtgaaagactaccaaattacggtggtgaacgacccgattatgttcggtaatcatgtttaccacgagaacgtagatatcacgacggatcaattttaccgattactaaaagttgaaaaagaaattccaacgatttctcaaatttcaatgccagagatgcaagtcgtttttgatcagctgcaagcggcgggctatgaccaaattctagttattgggttgagtagtggtatcagtggctggatcaataatttgaagacctatgcgccgtcagttgacggtattgacgtgcgggtgtttgattcacgaactgcttgcgcggggacggcgaacatggtgaagctggctgcggccatggcattggcggactataccttagatgaaattattgcgcaactgacgcgcttgcgggcggctacgacgacggtcttaatcgttaactcgatgcgccatctagttaaaaatggccggatttataacaatagtagtctggccggaacgatggtgttgcgcaataagccgattattacgttcaatgggcatgggaagattcaacttttaggtaaggaacggacgcttaaaaatgcacaacaggctgttcaagatgaatttagtcagtttgtgatgaacagtcaattaccagttcggctggacgtcatcagcgctaatgacgcgcagattgccgaagattgggcgagcgaactacgttatcagtttccagcagtccgggtcaagactggggttatcggtccagttttaggcgtcttgactggagaccatgcgctcggaatgatctggtcattagattggaagccattgttgacgaccctcaatcaggagcaaaaacaataggccgttggggttgcccgtgtgcggtttgctgatgatactgtcgtatacagacagctgggttttaaaaaagttttgcatcgaaggttgacattttactaaaatgatattatggttataacattaaaacttgatgaaaagctataatgctttaaggagtaactgacttgtgatgctcagaaagcgccgttgctgtgaaggtgtgatgacaagtgagtaaaagttaaaggattggcgtgaattttacgagattcactggtagcacccattattgtgcacgcgtttagttgttgtgaacgcgatgagtagccggatgtgagttcggttagcaataaggtggtaccgcgcgtaagcgccctttggataatttgatcgattattcaaagggcgctttttcgtcaagtgacacatagcattattttttagttaacacatagtagtcattatttaggtcgcgcatcgcggttaatcatcgtaaacacatagttgttcgacatcacgtgacagcacatagtagatcgtaagcacgggcccgtttattggaaaagcactgaagcgagcggggaacatatacacatagtgggcaagacgaaaggatggttttacttatgaaatatggcattattggcgcaggcgcaatgggatatcggtatggtgtaatgttacaagaaaacgccggtgttgacgttgattttatcgacacgtgggaaccaaacgtcgcaaaggtccgtgagcagggcggcgttgatgtggcgcgtgatcatcaaaatcaccatgtcgttccaatcaatatttattatcctgaagaatatcagggtcatccagatgtttggattgtttttaagaagcaaatgcagttagccgatgagctcaagcgcgatgcgtcgttatttcatgaggaccagtatgttttcgccgcaatgaacgggatggggcactttgaaaagattgcacaatatttcccagaaaatcacattattggtggtacggcgatgattgcaacggtcttgaatggtccgggtacggttgattttatggggcctaagggtagtgaggcgatgcatatgagtaagtatgcaggtcctattgatacgactaccaagcaagtgatggccgattttaaggcggctgatttaaatccgatttggtctgataattttatgggcatgtgcatgtccaaagttgtgtttaacgcggtcaccaatagtttgtgcacgatgttcgagattcagatgggccaattcatcgaatatccgggcgtcaaggatatggcgactcaaatgttcaacgaagcctatgatgcttgcgaaagggcaggcatcaaactcattgagacgcggcaagaagaaatcgactcggttgaaacggtcagtcgagcctataagtaccattatccatcaatgtatcaagacttctcaaagggacggccaaccgaagttgattatattaatggctatattgctaagattgggcgggaacatgactacgtttgtcgcgtgcatgagtttgtgactcacgaagtccatttagcagaaatgatgcggcaataccggcacccggaaatccccgttgctgaaaaataagattattaatgaaaaagttctgagtattttcagaactttttttgtgggcggaaaaacttaatttagtaaggttgaaatcggtttctttaacattggtctatacacttagatgaccttgtaaacttgcaatgaaaacatgttgtgataggatttataacgtgcttaaaaagagaatgaggagaaattggtatgaagacatattttcagaaaatcggtcagtcattgatgctaccgattgcaacgttgcccgcagcagcgattttggttgggattgggaattacctgccaaaacagtggctgtttgcaaattacttgattcagggtggtaacgttgtcctgaataacttagccttgctgtttgcagtcggcttagctatcgggatgtcagtcaataaggacggcgcggcagctattgctggtttgatcgcgtttgaagttccggtgatggttttaaaaccagcgacattagcgacgatgctgaatgttaaagtgagtcagatcaatccagcatttagcgcgttagataacaatgtgctgattggaatcggtgctggactgattgcggctgcgctctataatcggttccacgaagtaaaattaccaatggcgctctcattctttagtggtaaacgcctagtgccaattatggctgcttttgtgatgctgattgtgacggcggtattgtaccttgtttggccgtttgtctacgatgccatcgtcctctttgcaacggggatttcaaaattaggtttcgtgggggctggtctatatggctttttcaatcgtttattgattccgactggtttgcaccacgccttaaattccgtattctggtataacgttgcgggtatcaatgatattggcaatttctgggccagccatggtgttaaaggaatcacagggatgtatgaagctggattcttcccaattatgatgtttggcttgccagctggtgcgtatgcaatttatcgtaatgcacgaccggaacgaaaaaaagaagtgggttcattgatgttagctggtgcgtttgcgtcgttctttacgggggtgaccgaaccgcttgaattttcattcatgttcgtggcatggccgctctacttattacatgccgtttttatgggactatcattaggattcgccgcgttaatgcactggaccgccagcttttcgtttagtggcgggttagtcgattatttattgagttttcggatgccgttagccaaccaaccctatatgttactggttcaagggctggtgatggccgtcatttattactttggttttgactttgcaatcaaacggtttaatttgaagacgcctggtcgtgaagttgtgtctgcagatgtcgatggggtgggtgcacctgctagtccagcggtggccgttgcagcaacggatgataagtatatgcgccaagcaaagcaaatttatgcggctattggtggtcatgacaatattagtgtgatcaacaattgtacgacgcggctgcggttacaacttaagaatacggaaaaagtcgatcagccggccgtaatggctgctggcgtgcctggtttgaacgtactggatattcataacattcacattgtgattggcacggaagtccagttcgtcgcggaggctttacaaaaattattttctggtcaggtggcgacgaccccggcatctgatgctgaatcaaaggccccggttgaaccgcaaactgctactgtaacggaagcgccggtgacaacgattttgcgggcaccggcaacgggacaattaatgccgattagtgcggttgcggatgagacgtttgctggtaaactcttaggtgatggttacgctgttgaacccgaagatggtgaagtcgttgctccggttagtgggacagtgacaagtgtctttccgaccaaacacgctatcggtttgaagacgacgagtggtttagaagtcttattacacatggggatcaataccgtggaaatgaatggtacgccgttcaagttacacgtggcaacgggtgacgaaattgcggccggtactgcggtagcgacggttgacttggctgctatcaagtcagccggtaaagcgacaaccatgatggtcgttatcaccaatatggattacgttaacaaactaacccttaatccaactggtcatgtgactagcggtgatttgattggcgcagctgaataagttacgcgctgtcgacgttgggtttattgaaaaagtttcgtctaaatcttttcgatttaggcggaactttttttgtcgcattggttatcgaggcaacggatgacagcaaatgaacagcttgatgcggggacagtgcgtttgattgcttcccgctgactcccacgatatactattggcattataggggggcggtaacatgattgacgaagtattagtattgaactcaacgccaacggggattttacagaattcagtttcaggaagcatggtgattgacgcggcacttgatgcacgactagtcaagcgactaatgcaggcgctaactcaatcgatgcttaaggtcagggttgcaaccgcggacgacttaccggtgaccgaccaccaattgctggtcgtcagtcgaccagtggcagccgtgttggacttacaagctagtgcgcgagttctgatttatccagaagcaacgggactgacagccgctggaatgacacagctagcagtgcagattgatcaacgattgactaaaatatccagataacgatcaaaaaacgcccagggcagttgttcgcaagttactgaacagttgccctgggcgtttttaatgattagtctttgtggtgttttttaatgatagttactaatttcaatcaagttgttatcaggatcacgaacatacagtgacgtcaactttccgtgggcaccagttctttcaaccggcccggcaatcacatccacgaaataactctttaagtgatgctggatatcatcaatattatctttcgcaatcaagcaaagatctgcactgccgggtgtcggcttagccgcaatgggttggtgtggctggtcagtggtctgaaagttaattttttgtttacccactaagacagcttggcggtcaccatcgaaggtcacaatgggaaggtcaaatacttcatggtaaaaccgtaatgaccgtgcaatgtcagtaacggttagggtcaaatgatcgatatcgcgaatattcacaagctcaaatcccttcaaaaataattcattattaaacgtgtcgtactcatcagatttggcttgaaccatgattaaaatgtaccagttagattgctgttcgtcagccgttgcgcgtcctatgccgacctccggggctgggtgacaattgctggaacgcagccgacgtcgatttgagctaacgcataacccgcgtcatctcaaatacgagtcttattctaagccggaagaaagacacttccgactaagaataatttggctactgagcattgtcacccagcccctccagtctcaagcctgtgcggggccacgggttgaagccgagcattgtctagccaacggattaatgcggtttgggtattagtccgttggcgtagcaagcacaggctttagtggcaccgaacacgtttttggaacccgctcgaatggcagattaacggccacttaacttggtaaaatttgtcgctgactattttgacaccggaaccttaaacgaaacgtcagggttccattaaccactttgtcgagacgttcgattattactatgccacttgaggaatagtgagctcccacaatatcactttcagactgacaggtaattaacaaaattaccgtttatgaggaacaatgataagtccatcaaaggttgggtacatcttcgtcagccattcgaatactgtcccgactggaaggcgtttcggccaatgctcagcggtgaaattccacttagcaagcgtccttggcttggttagtggaagaccagtatttaagacgtggtctgcggcttaaatctgtgtccaccgcgttccagcaattggcagaaatgcctggaagtcggtgtaggacgtcgctaactaagcaagtttacgctaaatagatctttttccagcgggcctaagctggctgcttttgaacttacccaactggtatgttttaatcatgattcatgccaataataatgagtataagacggtgttattcagtataccacgattgataatgggacggatgtgaccgtatttgggaagcaactcaaaaaataacaactgtaaccgttcacaccggacgcgacttttgacaatgcttgcttttcatagtaatgtaggtgttactataagaaggagggctattcgtgataacaattcgaccagccgatcaagacgacgcgggccagatagcaccgctaattaatatgatttttgatgaaatgcaacttgaggaactagacgacattcctgaacctgacttagagcaggccattactgccgcttaccggacacctgattatttgtctggtaaggcaacgacagtagtggccgaggccgatggtcaagtggtcggggtagcgtttggttatcctgacaaaaatgaggacgcggtggacgacgtgttagcacgagttactgcgaataatgatgcgtttggttcagcatttgaagctgaagctgaaagttatgagcacgaatggtacctggattcgattgcggtcgacccgaattatcagggtcatgggattggcgggaagttactcgccgccctgccaagatacgcgcgacaagctggtcaaaagcggattggtttgaacgttgacatggctaatttaggagctaagaagctctatgaccgttatcattacgaatcggtaggaattaagcctatcggtgatcggatgtacttccatatgcaatatgaactagataaagacttggtgctagcttagtatcagggctatcgcaacgggcctcgtgatatgacggggcccgttttaatacgggtcaaaatgaaagtgtaggttgaaaacaacatggctttactagaagtaacggatttatcgcaaagctttgcggaccgtaaattatatgacgatgcgaattttacgttggaacgagcggatcatatgggtatcgttggtcaaaatggggcgggtaagagtaccctaattaagattttaactggccagatcttaccattatctggtcagatcaagtggcagcgcaacgttcgaactggctatctggatcaatatgccgatattccagccggcatgacgctatacgcctttttgaaaacagcttttcaacgcttgtatgatttagatgcgcagatgcaacaactttatgcggattatgctgaaaaggtggatgaccagttattggaacgtgcaggtcggattcaggagaccttggaagccaataatttttatgatattgagacagaaatggaacgggtaattaccggactaggattagatgaaattggtcgggatcacgtcatcagtgagatgtctggtggtcaacggtcgaagatcatcttggctaaactattgctggaaaacccggatgtgattattcttgatgaaccgacgaactacctcgatacggcgcatatcagttggttggaagattatttgaacggctttgaaggggccgttatggtgatctctcatgactatgatttcttgcaacaggtcacaaactgtatttgtgacgtggcattcggtaaaattattaagtaccggggcgattttaaagcggctatgcggcaaaaagaagcacgtaaggaagcccaactgaaggcgtttgaaaagcaacaagttgtgattgaaaaagccgaaaagttcattcgcaagaacaaggccggttcaaagtcaacgatggcgaagtcacgggaaaagatgctatcgcatttggatcgggttgatccaccgagtgaaaatgaacacgccaagtttgcctttccataccttgatacgggttctcaaaatgcattgagtgtgacgaagctgtctgttgggtacggaaagccgttgttggaacccgtgacttttacgatgaccaacggtgaaaaattagcgtttaagggctttaatggggttggtaaatcaactttgatcaagtcaattttaggtgtaattccagcgttaagtggtaagtcagatttttcgccatctgctaaaatcaattatttcaatcaagatttggaatgggataacccacagttgacaccgttacagacgattcaaaatgaataccctacgatgttaccgaagacaattcggactaagttggctaagtgtgggattaatgcggcgaatgcgatgaagcccatgcacttactcagtgggggcgaacagactaaggtcaaattagccttgcttgaattggttccaagtaacttcttaattatggacgaaccaacgaaccatttggacgatgaaactaaagaaggcctcaagcgtgcattgcaggctttccaaggtaatctaatcttggttagtcatgagagcagttttgtgaatggctgggtcgacaaggaattgaacgtcgagaaactcagtttgaaagaacgacaaggctaattcttatcctttttaatagcagtccatgcttgggcttgtctgtggacagacattcaagcatggactgtttttggatgtcctgattaggagaaaattatttttagctgactagttaatttgaaaatggactgctggcgattcagtaattattggaccgtcagcgcgccattgtccccatcggtaatcgctaaacccaaaaaggccgttaatttgtaaatcgggaacgaatttacaaattaacggccttttgggaacaattattaatccgttagtaattgactttcaaccgtggtctggtcgcgaccggcctgcttggactgatagaggtagtcgtcaacgcggacgaaccaatcagtgaaagtctggtcggttggttgcaattctgaaataccaattgaaacggtcacgttcaacgtttgagcgttaaatttgattggcactgttttcagtttacgctgaatcgtacgcattatttgaccagtttcaagcgctgagatgccacgaaaaatgatgacgaattcttcaccgccatagcggaagatctgaccgtgagtgctgcgctgattaagttcaagttcaacaaaatgcgccacgtgtcggagtacggcgtcgccagccagatggccgtactgatcgttaaaggctttaaagtggtcaatatcgaacatgaccatggtgacgggccccatttgatggtgctgatacgcggcaaacacttcacgcgcatgcgtgtcaaagctggcgcggttacgaataccggttaattcatcgtaattgacttgttgatcaaaggtgagcacttcattgaaaaacttttggacgcgattgactgctaaacgaatcaaccacatgtaaaggacaaaggctagaatgatgacgagtgtatggctcaatttgaacggatgaactgaccaaataacgccccaccaagtgccactatatagtatttggaacaggagatacttccattgaatagcgtgtaattcttgatagttatgagtaatatagacgactgtactaatcaagataatggccatggccagaaaaactggcaggtactgcgtgctgtggcccaaccagatggcctgaccataaatgaacaatggcattaacaggttaataatttcaacggccaggttgcgcatggtgttaaggctgaacagaagaatcgttaattgaaccgttgcgtaggtccaactgataatgctacctgaattcagcgtaatgaatatttgtcgtaataggatcatactaatgaggacacttaaagcctcggcaccatgggccacaatagtccaatatcgattttgacgacgatggacctgttgctctaggaggtaggtcagaatggtcattagggtgatcaggccaattgtaatgagaacgacaattagcattttgatattaaaaagatctcggcctaagctcgatagcgtaagtagatgtaacacagtgcgcccccataattgttgcgtttaattaatttgtcctttaatcataacacgttacgcaggtaactgttaacagcagtttgcaataatttaaaaatcatcaaacagtctttactgaaaaataacctagtctttacataaatatgatgatgatttaggcctcaatacggcatacttaccatgtaaggttagatagcaaacgcaataaaaaggagtttgtaaaatgctgcatggaacgttctatggtgtgatcttgattagtttcttgattggtatcggcgtgcagtggtattttcgtgaatactttcaattattagtgttcggccatagtgttgagattttatttatgatggtattaggttggtaccagttcggcatgctcgttttactaccgctgttagttttatggggaattggacttggtgcaatttatgtgatgaaccgattcgcgtaattagtttgtgtcgtggaggtgcccaatgagacgatggtttgtgagttacacgctaggaatgattgttggtgcggtgttatttttgtgtagtttagttgccattcattggttgggaccacaattatgggtgggcgtggctttaggtgggagtctattggtaggctgtaatattggcttagaagttctcaagcgtcattatcaagtgacgacaccacaagcgatttttaggttattgaattggtcctgaggtgcccataactgatagttgggtttgatttgaagcgggctaccgatctctgacattgcaattggaattcattaaataggcgcaccgagaaactaacatggtttctcggtgcgcctattaagctacagtttccctgtgcatgcggattaatgattaattttagacatgtcgtgatcatcgggcaacgtgaggccacggttagggacacttgttgaaaagacgatctgagtactcgtttttccaaatgtttgtaattggttgacaaactcgtctaatgcctgcgttgattcgaaaatcactttcaaaatttgagagtattcacccgtgacacagtcacattccagaatattaggaatgccggcaacaaatgggtaaaagcgctccttttgcgttggttcaagttggagttgaatataggcttttatgtggtaattgagcttttcaaagttaagatttgcttgatagtcacgaatgatgccactctttttcagacgagtgatgcgagcggaaattgcgggcgaagaaatgaagcattgatcggcgagcgcttttaaggagattcgcgcgtcggcctgcaaggcgttcaaaatcttcaaatcggttttatccatcgttaaaacgcctcctaagtaattattagtatcatagcatactttcacagtgatttttaatatttagtgtaaagtttctactgaaaggatagcttcttaacgtgccgaggtgccacggcggtgtggggcgatcgattaaagttaaaatcacttcaaggtttgaccaggaagccagaagtggttccggagatatggtaaactgaaaaaatgaggtgactagaatgcaatcaacacggatcattgcggccgttgcgaacgtgtggcggcagccaaacaatacgtccatcgatactccggcactagcaaatgtcggcttacaaccatggttggcgcagttatcagatgaagatactgtggctttggaacgcgacaatcgcatcgtgacgcaggcgttatttaacgacgtctttttagtcgaacagtttgtcaatggctgggcctatggttacgttgttaatcaggccgactcccggcatccacaggggtatccaggatgggtatgggcggcgcaattgtcgaccgtcccattgccggttcaaactgggccgatgattacgatacggcgtggttttacgccgttactatgcttagatggccgtacgttcttaaatcttagccttggaacggaactacccgttattagtagcaaagatcatcgttattatacggtccagaccccactcggaacgggcaaaattgcaaaacgtgcgacgcagtttgcatttagaaccgcgcgcttgacaccgggagcgacactcgttcgcctcggtgaagaattcttggatttacgctacctatggggtggcatcagtgcttatggtttcgattgttctggattcgtctataccttgcatcgcagtctaggtattcgcttaccgcgcgatgctcaggatcagatcaagcaaggagtggcggtcgacatagcaaatgcccagcttggggatctgtgtttctttgctcataatcatgggaacggtgcggtacaccacgttgccctatatgccggtgatggctggctattacatgcacccacgcctggcaaatacgtgacatacttgcagttagcaagcacttatttacaagatgagttggtcgctgtcaaacgaaattggtaatgtgagttcaattgacttagatttaattaaagtagaatatttcaaaatattaatggggcggataaagtgaaacaaattaaatggtggctgttggcagtcttattagtcgttggcttaaccggttgtggttctcaaaccactaagaaacaagcaacgcaacaggcggcaagtactaaaaaaatatcgccgtatgtgaatcaacagacccccacattttacgtccacgggtttcaggggagtgcgaagtcaacgaataccctgattgcgcatgctgaaaagactgctcatgctcacaaagttttggtggcaacggtcagtaccagtggtcaagtgacgttgacgggtaaatggcgtggtcgggtgcgtaacccgataattcaagtcgtgttcaagaacaatctggcccagtatgaccaacagagtgcttggctggctaaggtgattaccacggttcaacaacagcacgcgtttaaacattataatatcgtcgcccattctgcgggctgtgtcgctagcgttaatatgctgatgacgcaacaaacgacgacttttccgaagatcagtaagttagtaacgatcgctggcccgtttgatggggtggtcggggaagatgatgttgctaatcagaactcgtttctgacttctgggcaaccgaaatatttgcatgcagcctatgaattattggcagccaagcggaacaattttcctaaaaatgtacaactattgaatatcgtgggaaccttgaacgatggtagtcattcggacagcttggtcaccaacgtgtcggcccgttccatcaagtatttattgcgtgggcgggatgtcgattacaccgaaaaagacttttatggggcccatgcgcagcacagccagttacatgaaaatactaaggtagcactggcagttgaccgctttttatggcatcgatgatatgactggggctctgctaatcagtagttggtttgggattgtgagtcagtcacgttacgcaattagaatcaaaatcaaacaagctcatccggccttagtcaggtcagatgagcttgtttgatgatcgtcatcctgaagtcagcgggttggtctgggctagagaaagaatagaatataagccgttcgaataaggtggtacaacgcatatagggtaattaaataaacaactgagataccgccatatacggcatatttataattgcgcatgtaaaaacctcccttataatattacctttagtgtaaatcggaatctgtttttacacaatgcaaacgccttcattattagggctaaatttaaattaagtcaaagaaagagcattctgttagcgataacttcaaaaatatgataaagttagttgttagttcggtggacttcacgctgccggattaaatttacctcagattttggataaattaatttttagtatcatgtacttgccccagtattgagtattagaattatttacagatttcctgagcattaggaaaggatgtaattcaatgcgcgttaccattaatcgcggtcaagaggtctacactgatattcccttaatgaccgcccgacatcgctatatcaaagcggatgtctgggaaataaaaaaagcaattattgaaaagtcagccattaacgggtggacggttcaagcgctacaagcaatgaattaaaaaataaacaacggccacggcatttgccagtggccgtttttgtaggaggacgatttgaatggcgcatgaagtcagttatcggccattaatcagtattacgaacgtaatctggagtttcgatgcagtgaccaagcaactgctggtcctgcttattcagcgtgatcacgctccttttgagaatacctggggattaccgacgacgtatttgagaacggatgagagtgcggatgaagccgcattgcgattagttcgtgagaagttgggcgtccagcttgcccaattccatacagaacagttagggacgtttaccgcggtcgatcgcgtgccgggtgaacgctcactggcgttgacgtatatggtttatttgccagtcaagccggaactagttccggggtatggtgcgcgcgatgtcaagtggtttgccattacgccgcgggtggatcgtgatgatctggtcgctgatggtttggcatttgctggtgttcccgattcgcagacggagcgggagttttatcaacgaatcgccaagcagttgttaaccgccgatcatggcctgatcttaagaaacgccctacaacgtgtgcgcaatcgcctggactatgctcctacgatcttattagtgttaggtgagcagttcacactcaaacaggcgcgccagctgtatgcgattttgtggcggcagccagtggcaaccatcgacaattcaaactttcgtaaaacccacgttcatttatttacagaggtggggacagcccgacctggctcttctggacgccccgctaaggtataccggctaaagtagttcatttgacacgtccaagtcggtatgctacttttatagcaccataaaggtaaaaaatacctaaattagtggaaggctaattaggaaatttgggagagtattggaatggtcgaaagtaaaagaaatagtgctaagctattatgggtcatcgggacggcctggctttttgatgcgttagacgtggccctgctatcatttgtgatgccggttattaaagaaagttggcagctaactgcaggacagttgggagcagtcagtgcgatcaccacgcttggcatgatgattggggccttggtatgcggctatttagcagataaattggggcgtaagccggtccttattgggacgctactgcttttttcgcttggtaatttgttattgacgattaccccgaacgtcgagtggttcttagtcgttcggttgttgactggcattggtctggggggtgaactaccggttgctgcgacaatgattgctgatcattatacgggaacacagcgctcacgcatgctagtcctggtagatagtttttgggcgtttggctggattgcagcatcgttattggcctttttagtgatgccacacattggttggcggatgacggtcttaatcaccgccttaatggggttgtatacgttgctgttacgccgacacttacctgcagaacaggaggctaatcggccacaaaaagttgattttagacaggcattgcggcaagtgtggtccgctaaatatcgacgagctacgatttgcctcagcattctatggtttgtgattatgtttgcctattacggtatgtttttatggcttccaagcgttttggtgttgcgcggattttcattagtacatgggtttggctatacgatgttgatgagcttggcgcaacttcccggctattatctagctgcgtggttgatcggcgtcgtcaagcgtaaggcggtattggcaacttatctgattgggacggtcgtcagtgccgcagcttttgggacggccaataatccaacgatgattctgattagtggtgcatggttgtcgttctttacgctaggggcgtggggaattatgattgctttcacaccggggcaatttgcgcccgcggtacggggaattggtatgggcgttgcccagtcaattggtcgcattggcgcaaccatcggcccatttttagttggtgcgctgatggcaattggatttggcattccggcaatttttatggtgttcgtggccgtactcttactcggtgttggggtattgctattcgggttaccgaatcaagagacggatgattaagtatcggtggcagatataaattaaatcgtaagttaaaattacttatatggaatggactagtgatgtgggcgctgttgctgaatttgaattgaaatgattcaataatattttttgtgaaagttaaacgagctcagtgatgacgcggctttgagggtgtcattcgttgcgaagccaaagcgaaactcctatgattacactgaggagttgaaaaaaatggcaaaggcaaaagcacgtacgacccaaccgaatgaacgattaagtgcccaactagcacttgccagcatggcaattgagattcgaagcgatgttgtgttgaccaggttagttgcgcgggctcgtcgccggcttaatcgtagtggtgacagtattgctatcgcgcaccaaatcgctgttgatctaggttattatttagtgtgtcatcaatacaaaatgccccgagctgcttatgatttgttagcagttgcgtatgaagtaagtgttgagacgcccacacgagcgactattattcagttaccgtcacgaaaaaaatagactaggactatcaattgattcacacttatattagaatataatgataaatagatgtgcaaaattggagggaattgaatgggaaggtctgaacaattaaaaaagctcgtcttggcagggttatttgccgccattatttttattggtatcagtgtattacgaattccgttgcccgcgattgttgggcggccatttattcattttggtaatattttgacagtgctcgcagtgatgttgcttggttttggctatggtgctacggctggtgcagtggggcttggcttgtttgatattctgaatgggtatgccgcaacttcgtggttaacaattattgaagcaattattctggccgcgatggtcaacctgagtttcaagtcaatcggctatcgcgaagatcgtattggccggctttactgggtatcgttagtcgcagggctcacaaaaatcgtcacttcgtggtgtacaggcgtgattgaagccttaatggtggggacaacgctcaaggtcgccatgattgggtccttcacgagtttattagcagcgaccattaatgcggtggcatgtgtcatcattgtgccgttattgtatcggatcttagtacaggttgggtttaaccgccagcgggtcggtacggtctaaatggccgcatgctaacgcagctggattagtgccgtgagcacttattattttaacagactggttgcaatccactttaacaccgttggctgtggcgtttataattattggacagattttggttgatcaggttaaccatggttgtattatcggtaaaaaaagccctttccaatttggaaaagggctttttactgaagtagcacgctaatcaaaataggacaaaaaaagctatcccgttaggatagctttaatgaatattgatataacaagtgttctggagcttattacatcactttgaaactcaataatggagatggcgagagtcgaactcgcgtccaagcatattgcccctcggatatctacgctcatattcatactatttaaatttcatcattgcaaacgccgtatgacagggcacccagcaatgactaacctgattagtctcttctcgcaactccaggtggaagctttgagcgtaagtccactaaatttaggacccagatccagaacatggacgatcctgggaggatctacgttaagcgcttattaggcagctaaagcgtaagaattgttattattttttgcagttataatttaaactgagcgtttttacgtagacgcaacctacgaagcgcaatccgaactcaaactatacctgtcgaatccagaacatccccaaattcaacaatcctagtttagcacagctcaactgttctgccaactaatctgtctactggtcatgacaatcattacagcagtttaagatgaagagtgtgctcggcggcgccgcaaaaagtgcaacattttatgtgtgttcagtgaaagtgccatgactgccaagataatcagtaagccgccgataaaatcgaagctagtgagttgaacgtttagaaaagtaatcgagaaaaccgtcgcggctaagggctcgaaggcgtccatcaaactggccgttgtcggtagaatatcgcttaaactacgcgcaaacatcaggaagggggccaccgttcctaagagaataatgacgattaacaagcctaattggggccaggtaatcgtcaggtggacacgccacatgggttgtaacaaggttagaaacagacccgcaatcagtaacccccagccagtgacggttaatgcgccatactttggtaaaatggttcgcggaatcaaggtgttcgtggcgaccccgatggcggataagccgccccagaacaagatgacgggtgaaattgctagactgtttaagtgaccgtgtgtcacgatcaatagtgtcccgataaaggccatgatcataccaatcagttcgatacgactgggtgtcacgtgcttaaataagaagtaatagatgctgataatgaatgggccaagaaattggataatcgtggcaatcggggcattaccaacgcgaaccgcttcgaaatagcaaagttgaaccggaatcagccccagcaaaccgtaactcaccgctgtccaagcggcatggcggtgatgccagattttaaagggatgtttaccagccaccatcccccagacgagtaaaatcaagcctgcactgatcatgcggacctgcgttagccacattgcggttagatgcggattattgatgaagagggtactcgcagccacccctgagataccccacagaatacaggcactactagcgagtaagacgccccgtaaatgattttgttgtgtcaaattacgactcctttctgaaaataataagcaattttcattatagcaaaggtgcgtctgggaacctatgtttatgaggaatctcttattattctcatgggttacttcatcaaaagtaacgggtgcgtttcagaagagctcatgctatgatatgaacaatcaaacgcgaataatgatgcgtctaacggaggctataaagatgaaagcaattattaccgttgtgggacaggaccaagtgggaattgtcgcaaaagtagcgaacgagttagcacgtttaaaaatcaatattgtcgatatttcgcaaaccttgatggatcataattttaccatgatgctatcggcggaatgggatgaccagcaattaagttttgcggcggccaaagaggcgttagaatcgctcggtgaggcatcagagttaacgattcgaattcaacggcaagcggtttttgacgcaattcagaagttataggaggcggccatggaaagtcgttcaattttagaaacaattcagatggtggccgaggaaaatcttgatattcgtacaatcacaatgggcatttcgctctttgattgtgttgatagtgatggtgagcgggcccggcaaaaaatctatgataagatcacgactagcgcgaaggacctggtcaaagtggccgctcaaattcaagaagagtacggtattcctatcatcaataagcgaattgcggtaacgccgattgcattgattgcggctgcgagtcaggatcaagactatgtcgcgtacgcagtaaccatggaacgggcagctcaagcgctaggtgtcgatctcattggtggtttctccgccctggttcagaaggggtatcagagtggggaccgcaaactgattgcatcgattcccgccgcgttagctgcaactagccgtgtttgcagttcggtaaatgtcgggtcgacacgggctggaatcaacttggacgcggtcggtgaaatgggtcgtattataaagcagattgcggctgacgatccggtcaattgcatgagtttagtggtatttgccaatgcggtcgacgataatccgttcatggcgggcgcttttcacggtgttggtgaagctgatcgagttattaacgttgggatcagtggccctggtgtcgtaaaacgagccttagaagaagttcgcggtcagtcgatcgacattgtgtcggaacaaattaagaagacggcgtttaaagtgacacggatggggcaatttgttgggtccatcgcgtcagaacggttgcacgtcccatttgggattgttgatctatcactggcaccaacgcctaacgaaggcgattcggttgctgagatcctggaagaaatcgggttggaaagtgtcggtgcgccgggaacaacggcggcgttggccttactgaatgatgccgtgaagaagggtggcgtgatggcctgcgaacatgtcggtggactgtcgggtgcctttattccggtttctgaagatgctgagatgattcgggcggtcagtgctggtcgtttgaatattgaaaaacttgaagcgatgacagcagtgtgttcagttggtctggatatgattgcagtacctggtgatactagtgccgcgactatcagtgggatgattgccgatgaagctgcgattgggatgatcaacaacaaaacaacggcggtgcgcgtcataccagctaccggcaaaggtgttggtgatgcggttgaatttgggggcttgttcggtcaagcaccagttatgccggtcaacaccaatcaaccaacgacgttcattaagcgtgggggtcatattccggcaccaatccactcctttaagaattaggcacagtggacgttgtgaaggggcgaaccggcagtcatcctgaacttaaatggtgacttcacgctcgcaactcgtgaaatgtaactgaatgatgcacgatttcctggtcggtatgaacggcagaaaatcgtgctttttatgtcagtgagcatgactctggtatgatgtgtgactgatgtgccaagattattaagtgtccctcaatgatgggatgacacagttatttcacaaatcgtgcacgctttgttattaatttgttgttatactagggactgtctgaaaactaaaaattcaggtataatctgaggaaaaacgaatcgaggcattccgatgacaacacctaaacgatacgaactggaaga

SEQ ID NO: 9 - DNA, 156703 bp, synthetic construct
  source 1..156703: mol_type = other DNA; note = Lactobacillus plantarum PDG8 - Contig 9
aaggactccaggacaccttggaagcatcatttatttaagttagatacatattatatgtacgaaggcatttcatttacacaagattcttgacactcccctactgttttagtaaataaaacgaccagtactgttcaggttgctgtcaacagtcgggccgttagcgtaccgggtgactgggaagtttactataacgacaaactgactgattcgattgtgtataaagtaccggtttcttatacaacgtattctacggccgttgatacgagtactgtcggtaaatatacaatcacattaacagacgcggccatggcaaccttagctcaactgaatagtagcactgtatttaataataccaatgtcggtgatggtgtggtacttgtcaaagagagcaatgcggtcactatttcacccagtaattatggggctaaagcaagtgttaataacaatgtaacagcagcgtcaattcaaaatgcgcgggataaaggaattaatctattgtatggtcagggcctttacttggtcctaccactccttaatgtcgcacaatccgaaatgacagtggataaccttacagaatatgtcattattccagctggtttcaaagtggcgacgaccggtaatggggacactgttcaggttgcaactgatccggtcggggcgttaacggctgccattgagacgatgatgacaaagaataatgtgacttatcagggattagcggtgacacagttaactgattataatgggcgccaaacgttcaaggttcacctcgaccagacggctgcttacagtaatggtcttttcgagacaatggtgtacacgctcttaccgactatcgcggttcaaagtagtggcgtgactagtggcttaattggcaaccaagtctcaagtcctgattcagcggttatatatgttaccgatgatcctaatgaaaataatggtagttattcgttaaaagatcaaaactatcctaatattgataaggtagctaaagcgctaggagtcgcggatgcggtgactataagtagcagttttactgattacttgtatacctatacactgaaggcagctgaagccgacgatatatatatgttgcaagccccagatggcagttcgttaggtattatcgtagtatccggcaacgtggggacgacttatgttcctagtcgcgaattgcaaacgataacttcttcaggtaacgattattattacttgaatccggactcaataccgcgtacacgaacttacgatagtcctgatcaaaggacctatacgctcacttaccagcgctacgtcacaacgacgactgatactgcggccaagataacgattgcactagcttcaaaagtctatgataacaacgtcacgactgatccaagtcgctatacggtatacttgccgactgaatatacggccccaagcgattggactgctgatagcgcggcgacggctgtggatgggacgacggcgtaccaagtcagtaccgactaccttaacaccactgcaatcgatcaaaacgtgggcacttacgctgtcacgctgaatagcgccgggatggcagccttatccgctgctaatccagatttcttgattgcaggcgatgtgaatgttggtgggactctgacgattactcaacgtccagtgacgattactttgccggatacgattctgtgggccaatggtcaggaacaaaatattacgccggtcattactggtgttgttgcggtgcaaagtttggattacacgttaacgtcagggttaactgatccggacacgacaaccattacggccacgctgacgaatgccgctgctaatagtaattataaattgacgaattcacctagtggtcagttgacggtgggcgccgtaacggttgtctatcagtatgggtaccgcgacaaagcggggacgctacacgtggtaacaacggctaatggaacggcgacgcacgggactgatgttaccgctaaggactatttgagctacaccacgagtgatacgactgctacgcatgccaaaactggttatacgttacagccagaaagtactggctaccaagccgatggtactttagcggacattggtggtcaggtcgtgtacacctatttagcgaacacagaaaagattgcggtcgtttacgtcgatcaagataagaacaacgtgattttatatcaggtccccctcagtgggagctttggcacacacacgaattatacgacggtgcaggacattgcggcgtatgaaaaattaggctacgtgctagcttcggatgaggtcccagcgcagcttgagtttgatcaggatactgaacagacctactacgtatacctgaaacatggcaccatcacggtgacggttgatcagccaggtaacgtggccgttagtgatttgatgaagaccagtcagcgaacgattcattacgtttatgctgataacacacccacggacttagcggatgtgcttcaaacggtcacgtatacgcgcacggcaacggtggatgcggtggatagaacggtcctttcgtacggtaattggacgaccactgtgaatagctatccggccattgagtcgccgaccattactggttacacggcggatcaaacgactatcgcggcggctgtacccgctagcatgggcgagactacggaaacaacggtccgatacagcgttaattctgaaacaatccgggttcaatttgtcgatgggactacggataaccaggtcttaggttatattgatttgaatgggaaatacggtgatgctgccgactatacggtcactgctgacattgcgaagtatgcaaaattaggctatgaaccagttcgctcggatttgcctaatcagctgatttataatcagaatgcccaagtttatacggttatactagcgcatcgtcacatgacggtcagcgttgatcatccgggccaacctggtcaggccatcgatgctgattatccagccggtcctaaatatccggcaggaactggtcgtgattcgttggaacaaacagtgactcggacgattacgtatcaatatgcgtcaggtgaatcagcggctgaaacggttaaccagtcggtcacgttcaatcgcacggcaactttcgacatggcaacgggtaagcagctgacttacggtgactggacagtggcacctggtcagtcagcactattggccgcggtcacgtcaccaacgattacaggttatcaagccagtgttacagaagtcgaagcagcgtcggtcactagtcacgataagccgcacttgattgcaatcacgtacacggccaaatcacagaccgcaaccgttgcgtttgtggatgtaacgagtggtaaaacactacctacgacggtagtaactggtgcttatggcactacgaatgattattcacccgtttcacagattactgcgtatgaaaaactgggctatcgattagtttcgaataatgttccgacgactggcatcatttttgatcaagatgacgtcattaagtcatacacggtcaagctagcgcatcaaatgacgacggtcacgccaactaagcctggtcaaccaggtcaaccaggtcaaccagttgattccgctcatccagaagggcccaagtacccagctggtactgggcttaaagatttaacaactagtgttcagcgagtcattacctatgtttacaatgatggtcaaactgcggcgccaaccgtcacgcaaacggtcagttttgagcgcaaggcgacctttgaccaagtgacaaaggtggtgacgtatatggattggcgtacacctgaatcagcgttgacggaggcatacgcagtcgttgaatcgccaataattgctggctacaccccgaacgcaacccgtgtggctagtgtaactgtcagtgccaaagatactgagtcgcgacaaacggttacttaccaagcaaatctggaaacggcgacggtgacttatgtcgatgccacgacgggccaccgactgggtacaagcgtgacgttaaccggacgattcggtacgcaagcggattatcaaccaacgacaatgattgcgcagtatacccaggcaggctatgtcttgatggggagtgattatccggcaacgggtgttacttttaatcaggcgggcgtcgttcagaagtatacggtgtacttggctcataacaaaatcgtgattacggcaccagatcagctcaccaaaacgatcacgcaaacggttcactatcaggatcaggctgggcacacgcttcaagctgatacgatccgggcgctgacgttcacgcgttctgggatgaaagatgcggtgactggtgtggcaacgtatcgtgattgggcaccgaccgggttgaactttacagccgtgtctgcgccaacgattgcgaaataccatgcgttgacggcgaccactcaggccgtggcaatcacggctgctagtgctgatgatgtccccaaacgctaacatatgcgctggacgtcccaacaccgacgaaaccggtcaaaccgactaagccagccaaaccgactaagccgacaacatcggacgatttaatcaagccaacgacgaaaccaatcacggctgctaaaccaactcaactcactgagccagcaacggttgtgaaggattttcaagccacaactggcaaccagacgccagctaaatcgacaaggacgttggtatcgagtcgcattaaggctgtcaaaacagctccggcatcagcaatcatcaagccgggaagtgaagtaacggagccggctcacaaggctcaagcagatacaacgagtcgattgccacagaccggtgaaacgcggcggtctgaagcagctgctgaaacactagggctcacactagcaacattattgctaggctttggtggtttgaagcgtaagcggcatgaaaagtaatgaatttatttaactgtgcataataaaaaacgcttaacatcctagcattggcaaaaagtcaatggaaatagggtttgttaagtgttttttgttgtgtttaggtatcaatggattgatgttcaaagtagtcgattttagttgccaataactgatcgattgcttccagatgccggatgcgatcccgaatgacttgttggtactgcttgaaagcgactacttttgcttgaccatctagtgctagatgggctggtgtcaatagacttaaatcgagatctaagtcccgaaatattttaatgacttggagtgtttccaagtttttgtgggaatattgacggtaattgtattggtttcgctgaacatcaggcagaatgccaaggtgctcgtaatatcgtaacgcatctttagtcattccagtaatcgtggtgacttccttcgtagtgaagtagtgctgttgttcaggaattttaaacgttaacacgagcgtctccttaatattgagaactgagtcgccataagtcgttggccttagaacgagtgtactgcttagataacggaacttgacgtaggcggtcatcgtagaagtgtccacttgtgtgagtgagttcgggagcagtagctaaccatgcaccaatcggggaatttttacgagagaaactttcacccagtatccgaccagccaaacgactcacccaactaccgccagcaccaaagttagaatctgggacatagccggggtggaaaatgttgattgtcacgttggttgctgttaagcgttcactgagagctaacgttagtagtacgcgcgcagcagtggcctgggctgtgacggtcatggcattgtacttggatgtggccggggcgtcaaagtctggaagactcactttagcatggttaatcacgaatggcagggcaccaaccaatagaatgcgcgcttggtcactgtgctttagcaacggtaacaaggcttgaatggtccaaaaatgggtgaggtaatttaaaactaggttcaaatcataaccatctgccgataaatgtcgctcaggtagcatcacaccaatactattgagtagaatatcgatgtgatccgtcatggctgcaagctgatgagcaaattgttgaacaccagttttggtactcagatcggccaaagccaattggacagcttgattgccagttgcttgactaatatcggcttgagcctgtcgtcctttgtcagcccgactgccaacaataatcacatgatagttttggttggcaaggtcaattgcggtgtgtttaccaacgccagaagtcccaccaataataacagctaattttgattgcatgtcagtcactccttcaattcgatgattatgcacaagtataaactatggggttgacccgatagcaagcattaaattaattatgacgtgcagtagctattggcgatttagaacataatcagcagagttcttctatgctttaaacctatgaatgtgtatttaacataagcatttcacatatatagtgaacgctcgtatactgaatttaacttaataagggagggacgcatcatcaaagcaaagtatttagatcaagattatctgcaaacaattcagccaattgtcgatgctaatcagcgccgcattcaagcgttgaatgtaacccgggaaccaagtgaaattcgtgaacgtcttgcggagataacgggtcaaactatcgatatttcagtcgagattcgcgtgccactgtggacagactatgggcggaatttaaaaatcggcaaacgtgtttttattaatgataatgttcagatcactgatttaggcgggattgaattagcggatgacgtgctgattggtccgggtgcgatgttactatccgttaatcacccgttagatcctgctaagcggcatgcggttgaagttcagccaattcacattgaacgaaatgcctggattggtgctggtgccaaggtattagctggcgtcacagttggtgaaaatgctgttgtgggtgccggcgcagttgtgacaaaatcagtgccagcaaatacggtggtggccggcgtccctgctaaagtgattaaaacaattgagcaagtagattaacggaggttttataaagatgagtattaaaggtaaagtggttgttattacgggtgcgtccagcggtattggtgccgccacggccaagttgttagcggctaaaggcgctaaagttgtattgggggcgcgtcgagaagagcggttacaggccttgagtcaagcgattggtgacaacgcggtctatcaagtaactgatgtaacagatcggcaacaagttcgcgctttgattgacttggccgtttccaagtttgggcgtgtcgatgtgctatataataatgccggtacgatgccccagggtaatctgagtgaccgtgaatacgataagtggcagatgatgttgaacgtgaatattatgggggttttgaatggaattggtgaagtattgccaatcatgcaaaagcaacatgatggtttgattatcgcaacggattcagttgccggacacgttgtttatcccgcatcagcggtgtataacgggactaagtatgcggtccgggccattatggaaggcttgcgacaggaagaaaaggaacacggaattcgttcaaccatcgtgtcgccaggtgcagttcggacggagttggtcaatacaatcggcaatacgcaaattcaggccggtatcagtgagctgatgaatgcggacgatcgtcaaggattggctttaaatccggaagatattgctaacgcggtattatttgcgatcgatcagcctaaacacgtcgccattagtgaagtgttagtacggccagcacaacaggaagtttaatcattaaatcaagtgatttaaatagtcgcggcttatctgtaagataggtcgcgactattttgataggtgctactgattagataagtctacatgtggagtggataataacgttaaatacaacgacatttttagacaagtgtcgctatcgtgaatagtatggatactttgttgctgtctttgcgctgtgatcatcgttaagatagaaggcaacgaaagcctcgaattaggtgtgtcacaagtattgaatattgaggattaattaaaatagtgtagatgagcggagatggttattgatgaaagtgtttataacaggtggtacgggatttgtaggtagtgcggttgtacaagaattagtcgctaatggttttgaggtcgtcggactagctcgttctgagacgagcgctcaaaaactcattagttggggagctcagcctgtacgcggaagtttgactagtttgtcaacgttggcgacggctgctgctcaggcagatgccattattcatttgggctttaacaatgattttcggcatttttttcaggctggtgcaatggatcggcgtgccattgaaactatggggcgtgccattagtgggactaataagccgttggtcgttacgtatgggacgacgggtattagaaagcatgtcgagacggagcatgaagtcgcggatactgggctactcaaatggctcacaccgagaaaatctgagatcgtcgcacgtcagttaatggctcaaaacatcaatgcgtttgtcgtacgcttatcaccggctgttcatggtgcgggtgataagggctttactagaacagtgattgagcgtgctaaaaaaagccaccgtgctgagtactttggcttaggaacacatgcttggagtgctgttcatcggttagatgcggcgcacttgttttatttagtcacgatgtatggccttgagcatccaacaactaacgagcgtgttttcaacgcagttgccgaggaatcgatcacaaccgcggccattgcgcgtacgattagtcgtaagttaaatgttccattaaaggctaagtataatccactgagttttggcgacacagcgatgctttacctaatcaattgtccgacctccagtcagcttacacaacaaatattaggttgggttccagtacaaccagatttattaactgatattagtagttcacggtattaagtgggttactaaaaatattgtccaaggtagccgtatccgtgaatatattataaggcgcattgcccacggttatccataaggtgagtcccttgatacggccaacagctagaaaccggactagtcgttgatcatcgtcaacagtatctttacacagatggattagataattcaggaatgcatcgcgaaaggcgtcatcgttaaattgatgacgcaatgtttcttgaaaacgcgcattgccgaatgagttgagcgtttcaaaaggatgtgtgaagatctggtcaatagttagcttcgattgctgccgcttttgttcaaatagggcttccaataaatcgtactgatcttgaaagtgcttgtaaaaagttgaccgatggactaacgctgcatccgaaatatcttgaacggtgatttttcgaaagggcttgtcactcagcaggttttcatatgccagtagaatcgtggcctgcatccgttgatttctttgattagccattacgaatacctcctcgaaatttaatagaatacgattagtataacctgtccggtgtgccgatacaaagatgtggtgtaagcatttgaaattcagagcgcttataagcatgtgccctgcggcggtatagtcaagggactagaattggtaagccaaccaaatattttaatgattaatcgtaaaaaaacgagtgcaatagttggtatgttcatgcatacgacacgattgcactcgttttaaggtttatttatctccgcactaacaggtaaataaaatatggcgctccaatcaatgcgacgagcacgccggctggcagttcagtggtcgtggtgattagttttcctaaggtatcggcagctagtaataacgtactccctaacagaccagctaacggcagctgatagcgttgtcgggaccccacgattcgtcgtgccaggttgggggtaatcaggccaatgaaactgataccgccactaatggcgacactaacgccggctaacatggcggccatgctaatcaatcccaattgttggcgtttcaagttgattcccaatgtttgggcagtggtcgtaccgagtgtaaaggcgtcgagaacgggtaattgaatgaatagaataccactaccgactgcgagctatggaagcgcccagccgatataagaccaatcagtgccccacaaactaccggccaaccaattcatgacaaattgatagttatcaggtgataattttaatgtcatcaacaccattaaggctgaaaaacagccggacaaggcgacgccgaccagtaacaggcgcttagacgagatccctcgttgacgctgattcgctaataaaaaaatcagggccgtacttaaccacgccccagctaacgcaacgataggtaaactcagcgttaacgaagcgttggtgcctgcaccaataatgagtaacataacggctagtccagcgccgttattaattccgagtagactagggtcggccattggattgttggtgaccgtttgtaagacgttaccggataatgccagggcccagccaaccatgatagcgagcacgatccgtggtaagcgaaagttgactaagactagcatgtcggtcgcattaccgcgaccagttaaaattcccagcagagcgggccagctgatggtcattgtacccgtactaaggttgagaatcgctagtccgagcatgctagcagttaagagcagtgaccaaataattaagcgacgattagggctcatgctttcatcggctcctttcgtgcaaggtagatgaagcacggtaccccgattaaggagataatgatgccaaagggcgtttcatgtggcggattaactagccgtgcaatcaaatccgcaccgaccgtcagtgttgcaccaaggatcaacgttaatggcatgctattgcggtaattagcgcccactaaccaacgcgccatgtggggaatcatcaggccaacaaaagtaatcgtgccaactaatgccactgagatcccggataaaatgacggcacagatgagagctaggcctcgcagtaatgggagacttttccctaaactctgtgcattgtcgtcagtaagataggctaagtttagttgcggtgcgagtagtagggtcagtagcaatcccaagactaatcctggaccgagaaactttaattgtgtccagctgacggcacccaggccaccgaaataccagaacgcgaggtcctgtttgagctgcaacacaagggccagcccttcgctcagagctgttaataggctactgattgcaatcccagcgagtaccagaatcgtgggatcgagttgaacatggcgggcggtgctgatactgaaaatcagtccggcactggctgccgcaccaataatggcccaaccagtcgtttgtaaagttgataactttggaaaaaaggctaaacacagcgttagcattaagcccgctcccgcgttaatccccagtaagcctgaatccgctaacgggttacgcgtcactgcttgcattagggcgccgctaccagcaagagctgccccaatcaacgccgctccaaggacgcggggcacacgaatgtgccggataatttgttgatcaagattgccagtgtgtgtggtcgtcagggcgtgccagacggtggccgtacgcatctggtcagcgccaaatcgcaaactgagccccatgacgagaatgagtacgccggtactaagtgccagccacccccaatatctggacgttgacttcatgcgggggccacttcctgacagccgttataggtcaaaatcagtggggtaccgtggtagtcaacgagggtggcatcaatattgaaaattgtttttaaattagcggccgtcatgacggtggacacgggaccgtgggccaaaacgtgaccgtccttgagcgcgattaattggtcagagatgcgagccgcgtggttcaagtcgtgtaatgccataatgatagttcggtgggcctgttcgttgagctttttgacgagttgcatcacttctaattggtgagtcaaatctaagtaggtggtgggttcatccagaataatcgtgtcagtatcttgagcaacggccatggcgatccatgcccgttgacgttgtccgccagaaagggtgcttaggggccgttggcgtaaatcttggaggctggcctgagtgagcgcccattcgattttttgatggtcagttgtggtgagcccacttaacggccgccgataaggtaagcggccaaaactcaccagttcttctacggtgagatcgttagccgtttggttcgtctgtggtaagactgcaatctttttcgcaaaagttttgcttttgatttgttgaatgttttgatgatccagtagaataacgccggttgttggtggcaataggtgggcgatggcacgaatgagggtcgatttaccgctaccattcgggccaatcagcgtagtgatctgaccatgcggaatcgtaattgatagctgatcgacgataaccttgtcgccatagccaatactaatattttgggcttcaatggtattcacaaataggattcctttcttaaagttaagcgttcaaggaggttcgcttaataagttaactaattttgtttagttgtgcacaatcttattttgctagcttgtttgttgggaaatgcgattaaaacaactgctaactaataattagtgttcaattgatagtcttatcttaaatgtttttattgacaattgatagtgttttcactaataattttggtagcgcttgaaaggtggagacagttgtgacaaaacggtggcaaattgtaaaattgggattagtattggggttaacgggaagcctactattaggtgcgtgcggtgcgaagcagccgacaagcacgacagttacacgaaccgattatttgaagcataaggtcaaggtgccgaagcatccgaaacgggttgtggcgagttatttggaagatgatttagtggctttaggcattaaaccggtcgtgcagtggtcggtcaaaaatggtagtggtacgcaggcttatttgaaaaagcagttgaaaggggtgccgctaattgactattcgttaccatatgaagcggtgaccaaggccaaaccggacttgattctgatggggacgagtagtgcggtcgccaatggcaagtatgcgcaatataataaaatcgccccgacctacgtggtcaaaaatgggactacggtaacgtggcgccaaactttccttgatgtggctaaggtggttaatcgccaggctaaggccaaaaaagtccttgctaagtatgacgagcaggtccaaacgacgcgacaagcgttgaaaaagtctggtcagcataaagtggcggtgttgtgggtcaccaataataccgcctacatggtcaatgacaattcagccagtggggccttactgtatcaagatttacaattgggtgaaccaagtttagttaaacaagtgtctaagtcggccacggcggattggtcggcggtctcgttagaaaagctagctaagttagatgcggatgatattttcttagtgaatagtcaaaagagtgcgtcgctatttaaggacccgctgtggaaaaatatcaaggccgtgaaaaacaaccatctgtaccagtatggtgacagtagcagttggcagtattcgggaccaattgcttattcacaaatgattgatatggtgaagacggacttgttgaaataatagttagtcaatcattataacgaaaaataataggattgagataaaaatttaaaacgcgtaaattactcacagtaaaataagtaatttacgcgttttattgtctatagacagcggtaatcatcagcccaacgcgtgttgataggcggggactaataaatcatcgacaagtagatgaagggtggcatcagtaatcggttcattagcaaaagcacggtagcgaagccagtcgaatggcatcagttgtaagtcgcacgataaagttcccgtacgcagttccccacgttgctgtgcacgctgacacacgcgttcaatcgcatgggcatcaatctttttcacagcattgagcaagtccttaacttctggatttgcttgttgatctaggtggtgaaaccaagtgataaccaaagcttgattgaatgtattaatactgacagtgaagcgcttgagtacttggaataaatcttcagaaagtgtctgaccggtcaagttcacttcgtctagttgaccatggttttccgtaatgatttggtcctggatagccgcaattgcaagctctagtggtgaacgccagcgtcggtaaatgacaggcttactggtgccggcctgttccgcgacgttagcgaacgtcaattgttcaagaccatcttgatttaagatgtcacgggcggcttgatagatggcgttttcgagttcagcgccacgacgacgtgttttagtcatgtaatccctctttttaaataagatactttaagtttcttattgactttttctttatatagcgtattataccagttatgcaaataagacacttttagtttcttaattaggaggataatatgcaagcaaaagcaaaaatttcaaaagcaactatgacgattgcctgggtcgtagtgtttggtgcgatggcaccattattagattcaaccatgataaacattgccattaacaacttagtgactagttttcatagtagcgtgacgacggtccagtgggcagttacaggttatttactggcaacgggggtcgcggtgccattttccagttggttactcaatcgatttgatggtaaagcagtctttgtggctggtgagattttgtttggtcttggctcgatatttgcagccgtagcaccgaatattcaactattgattatcgctcggttagttcaaggttttgcgggtggcttgattatgccactcttgacgaccttgcttgtgcaaactgcgggtgcagcagtgatgggccagatgatggcaacagttgggctacccatgattttaggaccattaatcggaccggtcattggcggaatcattatcaaatttgcatcgtggcattggattttttggatcaatgtcccagtagtcttgatttcaatcgctttgattttgtggaagatgccgaattatccggcacaaaatcgaacagcgaaaatggactttattggtatcttgctactaattgtgtcctcaagtgctatcatttatagtttggttaatgccgcgcatactgaccgttttaataacgcgacaagtattgagatgttaattctaggggcgatagcgttgattagttatgtcgtatgggccgcttggcaaaaagaacgggcggtagtgccactgcacttatttaagtttgcatcatttgatggtgctggcttaggattgtttatcgctgggacggtattgaacggcgcaatgttgttactaccactctattttcaaaacgttcggggaatgagcgtgattaacgccgctctagcgctattacctcagggagcgggaatgctagtttcgcggacgttaacgggaaggctaacagatcaaataggcgctaagtacgtggttctgggaagtgtcgtcatcacgtttgtcggtaccttaccgttttattggtttggtcaacagacgtcttactggattttggcacttattttatttgtgcggggaattggtgctggtggtattttaatgccgttaatggccgatgcttatacaggaatgcaacctggacaagtgccagctgcaacaattgggaccagaattatccaaaatattggaagtgcgtttggatccgctttgattacgacgattgtaacggcgtattccacacaccaagtgaatgtgtttgaacgacacctaaaagcaggaacgtatcacgtcgacgcagctcacttacaagtctttacaacaagccatttgcaagcaattcgcttagcagcgtttcaacaaggctttctagtgattgcaattgccgcaatagttattattttgccaaccttattgctgactaacaaattgaaggcggcgaagtaacaagctaggagaaaaaataattaaatctgcttgacttatagtcggctctaacaactattattagtctcgttgacagatgtttttaactttaattcatcgaaaaggggataacaattatgaagacaattcaaattggcgctagtcagctcaaagcgtctgcggttgcgctgggtattatgcggatggttcgtttagataccgatgcggcagcgaacgtcttagagatcgttcatgaccggggcgttaactttattgattcagcggatatttatggtaacggtgattcggaacggattttcgggcaggcattaaaacaatcgagtttaaagcgggaagacttttttattcaatccaaaggtggcattgtgcttgatcctgagaagagttctggtgaactagtcttcgggcaacgctatgacttttctaagcagcatttgattgcaacggtcgataagatcttgcaacggatgcagctggactacctagattcgtttctattacaccggcccgatccgctgatggatcccgccgaagtcgctgcggcgtttgatgaattgcaagctgctggtaaggtgcgccacttcggtgtttccaactttaacccgatgcaagtcgagatgctacaagcggcaatcagtcagaaattgatgatcaaccaattgcaatttggtgtcatgcacaccggcccaattcagtttgggttgcacacgaatatgcaggatacggccagcctcaatcatgatggcgaaattatcgaatattcacggctacaccacatgacgatccaagcttggtcaccctatcaatacggcatgtttgctgggacctttattgataatccgaagtttccagaattgaatgcgaaattacaggaattagctgatcaatatcatgtgactaaaaatgcgattgcgacggcttggattttacgtcacccggccaatatgcaggtcattttaggttcaatgaatccgcaacaccttgatgagagcattgcggggaccgatgtgacgttgacacgccaggaatggtatgacgtttactttgcagcgggcaatgatttaccttaatttgaatagtccttgtgatgattaattaatcataataggtttaggttctttcgaaacggttactagtctcgaaagaacttttttgtgtgatgcaattgtggttgttataacttggtgtattgatcaattgctgaataaagtcagaattgactttattggtagttaagcggtattaatcataaaattgagtaatgatagattataaggaggaacgattatttgaacaaggcaagattagaggcgtttacagatgcgattatcgcgattgttttaacgttattagtattagacttaccgcggcctcaaactccttcagtgcgggcactctttgcggaatggcaaagtatttatgtttatatcattacatttacactattgatttcaatttggcttaatcatcacgatttattcgtgcaggtcaaaaaaatcgatcgggttgttttttgggcgaatagtttctggttgctatgtcagtcttttattccattcatggcctcatggattactaaatttccgcattcaaaatggcccgcagtattttatattcttacgggttttgtttggatgttggcttatcagttactagtagccgccgttagaagattaaatccacacattcatcgtatgagtagtccggcattaagtgttgtttttggtggctttttagtggttctaacagtcgcgttaattaatcccgatgtgggcttgttcctaatccccgttcacgcatttgctagtgttattttggcgactaaacgtaagtggcatttacgcaagtatttttaatataaagatgaaattaaaaagtaggctcatatctggtttaggctagtatcgcaatgataacgaacgacaacgcccgcaaggttgaatactgagtccaatcttgcgggcgttgccggttagtatttagttggtgttagtaggagtatgcttatggtttggtgacgattcctaggtcaatcatagattgggcggttgcaataatcgattccgcagcgggacggggatgccaatccaacaatgtttgggctttatgattgctcgtttccgcgtaggtgccaactagtgaggcgaccattcgcaattctggtcgggccttagcggctagcttaactgctgcattggggatggttttggttggtagctgactggcaaaagctggaaaggcctgtcttaagacatttgcaacgtcaagcatggatagcgtctcacccgttgtggctagaaaacgttcgccgttagcttgcggtgcggtcatggcaagcaagtgcagactagccacgtcacgaacatcaacataaccggaatcaacgtttggaacggctttaacttggccttctaagaattgttggatttgaatattggaatgtgaatatttggcggacaacaccggacccatgacggcaacgggattgaccgttgttaattctaacccgcggccctcatggttaataaagtcccaagctgctaattcagcacgtgtcttggattcttgataaggatggatcgctttccagttgagatcagaccagtcagcttcagtgtagggggtcgtacgatttttgtgaccagcaaagatggccccgtacgcagacgttaacacgactcgtttaacgcccgcatcacgactagcagttagaacccgccgaacaccgtcaacggctggtcggatcatttcagctttgtttttgaagttgagctttggggttggggaagcgacgtcgatcgcataagtggctccggccatcgcttccgaccagtgttcatcatgcgccaggtcggccacaacaatttcgagagctgataagttggtgataccaccattggtcagcatttctttaataacgggtgctttggctaatgagcgcaccgttgtgcggacggcgtagccttgttgtaataattgacgaatgatatgaatggcgataaaaccgctaccaccagtgacgacgactaattgtttttgcatgggactacctccaaatgaatttatgaattgctgttacacttgtaacgtctgtgccagtatcttacaatggggtcacgacgaatacaaggtaatcacgagcatctgtgacagaatggaggaattgttatggcagcgaccaatcacgcgcaagcaatcaaaaaggattcacaaacttatttaaccacggccttattacaattattaaggactcatgatttagatacgattacggtgacgcaagttgtcaaacgagctggggtcagccggatggccttttaccgtaactttacgacactcgaagatcttttgagcacgtatttcgccccggcgattgcagcgcggtttcaggacgtcttgcagcatgtaccggccaatcagaagttattagcgatgggtcaatttttcagtgattttgcgccgacgttacgactggctgagcaacgtggttttgaaaatattattcaacaactttttaacgctaatatgactaattattaccaagcaacgatgactaatggaatgctcacggcggtgcagcttaagtattggacaagattcatgagtgccggggtatacgcaatttggcgcgaatggctacttggcggacagttggagtccttaacaacgattcatgaaatactagcaactttgcagacggcaacgatgcaggcgctgactcaggctcaaaaatgagcagtggaagaatgatcctaaattagcggtgtgaggaggtcgaaacgccgattttagcgtgttgattgggtacttatgagcaattgtaaaagccacctagccatgcaccggcagagctcggtgcggttaggtggcttttttaatcaaatgagctgagattaagcatcttgggccgtggcagcaatgtcaacttcacggatattgacattttgcggcatgtcatacatgaacttgaccgtggcagctacgtgcttggggtccaaagtcaggccacccatggaagctttccatgcttcgtaatcggacagtgccgacttgctagtaacgtgggttaacagctcagtttcggctgcaccgggggctaccagcatgacgcgcacgttcttcggcgcattttcttcacggagtgtctcggatagcccgtggacgccaaacttggatgcaacgtaagcggcgtgattgacgaacgttttcttgccagctaacgatgacatattgagaatcgttccatgttcccggtcacgcatgtcatttaggacaatttgagtgccgtttaaaacacccatcacgttcgtattaagcatggtttgccactcttgtgggtcctgattttgaacatttcctagtaacattaatcccgcattattaactagtaagtcggtcttgccatacttggcttcggccttgcgaacggcagtttcgaattggtgatagttggtcacatcgactgtgtcgatcatggcattttcaaagttcgcagataaggcggctaactttgcttggcgacgccctaatagtaacagtgggtagttgtcagcggcgaataacttggcaatctcggcaccaaagccagaactggctccagtaatgacgactaatggtttcattttgtaattcctccgtaattttggataatggttttcgtttgaattttcaacgatttacagtatacttggctagattaaacgcgacaagtacgcacttttaggtaaccaccaattgagagcagggagttaataatgttaaaagaacgggtaactgcgcaaccacgctaccgaaatgaatttgatgccacgatgcagttgattcgtggtaagtggaaaatcatgattttgtttgaactggccgaggttaaagtcagccgttttgctgacttgcaacaccatattcaagcggtatcgcataaaacactggcgagtcaattgaaggaattggaacaagatgagttgatcgaacggcatgattttaagaccgctcagccgcatgtcgaataccggttgaccgctaaggggcagagcttgattcccatcctagatgcgatttgtacctggggtgatcaacatgttgatccagctttgattgaacgttcactgtgtgacgaataggctagtctaaacgggagcgtgggctttgtacggcgccatgggaaaagtacgttgtcagtcaaaagcaactagcggcgctgttttgatgaccattatttgttattcaattaactcgtgctgtttgaaagctgacagccagctatacgggctgttttataagatgaaccaactattgccgccgggatgggggtgggtcgttatcatagacgagtacaacgcggaatcgatgatttgaattaatcgattgccgttacggtgacagcgacgacatcgccaatgcttttgtggagttttgcacgaatatccttacgaatacctaagatataacaaatactaccatcaaggtttttaacacccatattaacgatagaaccgttgtaagggacctcatcgaaagtggcatggactttgacgcgccccttaccgaaaaggtcgcgaatatcgaagggacaggccacgtaagccccacctttgccaattgttgcggcttgaatcggtgcgtcaaattgataagtcttcattaattatatgacctccgcctaagcgtaattatggaacggcttcatttttataatcagatttccatattatcatagcaaattagcaattgttggtgaactaagtggtcactcacaactaattataattaaggtgaaccgctatttgcgtgaaatattaaccgggtatatcgttggtatcaaaaatatttatcgaaaagtacaattattatactaaatccccttgcgagcggggcaatcaaccgcttataattaaactgctttaagtaaattaaaaaagggtgttcacataaattttaaatcacaaaatccaattgatgcaagtcagtcggaaagattcaagctttataagtcggggaaactttggctggttgctggattaactttcttctcatttttaggaggttccgttcttaacaatacaaacgtgcacgctgatgctacaaatgcaacgacaacatcgtcttcagctgcaagcacggcctctagtgcaagtgttgcaacgagctctgctgctagcgatgcgacgactaaagcgacctcagtttcgtcaagtgctgcgactcaagtaacgagtgcggcaacaactaagacgaccagtcaagcagcgacggcatcgtcgagtgcggccactagccaatcgaccagtacagcatctagctcgactagtcaagcaactaagacggcttcgagtgcagccactagtacttctgcaacggctacaagccaagcaaccagtgtcgcttctagtacggcaaccactactcaagtaagtcataccgcaagcagtactgctgccagtgctgcttcaagtactgcaacggtcaaggctgttaaggccgcttcaagtacggtaagtagtgcggcgacgaccgctactaaagccacagctaaagttgctgccgttgcttataccgcggcaacgacgtcttcaacggatgtctggacgattggggatacgactcggccacgcgttgatgttgttgacgtggcgtcatatcaaagtaccatgacgcaatctgatttcaataagttaaaggctgcgggtgttaagacggtcatcgttaagtcgactgaaggcactgattacacgaacccagctgcactgaactaagcaaagatggctaacaaagctggcttgaacgttgatttctaccactatgcaacgtttagcacggctgatgcagctaaatctgaagcgactaacatggctggtttcttagttaagaacaatgtttcaaccaaagttctcttgttcgctgacatggaagattcatcttcatactcagttaacgcaacggcgaacttgaacgcgttctggtcaacgttagattcctttggttacaagaatcacggcgtttatacgtccaactcatacttatatcgggatgctgttgttaagacagttggtcaatcacgtgtatggcgggcccaatacccatacacgccttctgctaataacctttggaacaccaatgatggtgcatggcaattctccgatacggcactcttaccatctggttcagattataccggttacattgatgtcagcatcgattacaatggtttaactgaagatagtgccgggaccaatacattcgtaacgacaactagtagcaatgatacgacgactagtgaagtaacgactgacactagtgctacgaccaatacgtcaactagttcaacgactaagaaggcctctggttggtatacctttaccaagaacacagccatcaagagcgctgccagtgacagtgctaaaacagttggaacttatagcaagggtaaccgcgtttactataatgctgaaattacaactaatggtgaaacttggttacgttacttaagttacagtggtagcgaacattttgttaagattgccgcagctaaaacgaccacgactaagccagccgcaagcactagcaagacggttaccaagaatgaaactggcacttacaagtttactaaaacgacagctatcaagggttcagttagtgactcagctaagactttagggacttactacaaaggtgacacggtttattacaatgccaaggttactaagaatggtgaaacttggctccgttacctgagttacagtggtgcgcaacactacgttaagatcagtggtgcagctacgtcaacgactaccaccaagccagccactagttctagcaagacggtcactaaggctgaaactgggacttacaagtttactggcaccacggccatcaagggttcagttaatgattcagccaagactttagggacttactacaagggtgatacggtttattacaacgccaaagtcactaagaacggccaaacttggcttcgttacctgagttacagtggtgcgcaacactacgttaagattagtggtgcaaccacaacaacgacgacgtcaagcaagtcaacggctacggctagtgctaagacagttgcgcaaaccgggacttacaagtttgctaagacgactgccatcaagtcttcagcaagtgatgccgcttcaactgttgggacttactacaaaggcaatacggtcaactacaacgccaaagtaacgactaacggtcaaacttggttacgttacacgagttacagtggtgcgcaacactacgttaaggtcagtggcggtgccgcaacgaccacgtcatcttcagcaagtaagacgacggcggctgctggtacgtacacgtttaagaccacaacgaatattcggaccgctgctagtctaaatgcctcagttgttggccaatactccgcgggcgaatccgtttattatattggaacggtttctgcggatggctatcaatggctgaagtacttatctaactctggtgcttaccattacgttgctaagattggctaacaattagttaccaattactagtgcaataacaaaacaggctttgagatcacgtcaagcgacgcgatttcaaagcctgttttgttgtgtgattgagttagtggcctgttcatcttattttgacaaaagtcggcatagacgcacttgacaaaaagtttatactgattcgaacttctttcagtgggcctaagctggtagcttttgacactaaaagtttgaaacatgcttcgtattcaagcacgtgtaatcggtgttgtagtgaggggctaatgtttataaaacaactaagccgccagcaccgttgtcgtagtcaggtttctgagcagtgacaaccagtttttcgttaacaaaggccattaagcccaggctgcttaactcgcgaccgtagccggagcccttgacgccaccaaatggtagttctggtaaggaactgaggaaggtgttaacgaagaccatcccagtttcaatttgttgggcaaccgctttgccatgcgccgcagttccggcgaagacgatgccacctaagcccagttcagagttgttggctaaatcgatagctgcttgttcagaatcaactttgaagacttgggcaactggaccgaacatttcttcgtaaaagagggggttgtcttgatcgatgtccgttaagatggttggttggaagaattggccaggtaagtcgattggttcgttgccataagcaacggttgcaccaccggcaatggcccggtcaacttggtcttgtagcttttccttagcgcgtttggaattcatcggtgccagggtagtttgtgggtccataggatcgccagggactaatttggcaaaacgttccttcaactttgctaagaaatcatcgtacacatccgcagcgacaataaagcgttttgatgaggtgcagacttgcccagcgttgtataaccggacccgccatgctaagttgactgcttcgtcaatatcagcatccgctaagacgacgaaagcgtccgaaccacctaattccatagaactcttcttcaagtttgcaccggccgctttggcaaccgcttgtccaccacgcttagaaccagtcagtgcgacgccctggatgcgggggtcggcaataatatcgttaacttgatcatagtttaagaagaggtttgttagactaccagcgggagcaccagcttcttcgacaatcttggcgaaggccgcagccgatcccggtgtattagaggcgtgctttaaaatcattggattaccgaccatgtagttcggtgcgaagacccgcatgatttggtagtatgggaagttccaaggttcgaccaacatcaggacaccggttgcttgtttttcaatttcggcatcgcccgttgcttgagtgctgattggggtcggtgccaataattcagcaccgtgatcagcatagtaatcagcaatcatggcgcatagttcgacttcaccttgagattcactcagtaatttacccatgtcgattgttgcaattttagctaattcatctttatgttcacgtaacagtgcggcaatcttatggaggctggctgcacgggaactaacgggttcatgacgccattggtgataaagggcgtcgccggtagttaaggcctgttcgatttggtcagtggttgcgttgtcgtaagttttaacaacttcattggtatatggattaattgtttgataagccatagtaaactcctcctataaatgttcaggtgttgtaaacggttaatctgcgattgtatgggactggtaaccgccttcactattgtacgctaccacaaaagtacggacaaagtcagctaatttgacttgaccagcgctagtgtcagaagcatttaggtctgcataaagtccttcaggttcgcgctgataacgactagtttggactaatgaagcggcaattttaacgggaacaccgtggttcgtcaagttagcttgatattgttcatctgagatttgtacccattgtagatcgggcatgtttaaggcgtcgcgcagatcagcaacgaattggtcaccggtgaacgtatcactgaaggcatacttgacggtgataccggctggcgtgtgatcaattaggggataaacgacactggcaatgtcctcgggcgcaacgtatttttgtgctgaagcagcaggcgtgctggaataaattttatgttcagccttgattgttgctaagttaccgaacaagttagcataaaatccggttggacggacaaaagccaggttaaccccgtcaagttgtcgtaattcatgttcaattaagttgtaagcatgcagcgagccagccacttcatcggcatctgcgccgatgctactgaggttgacgacgttggtgacgccggcattttcaattgcctgtttccaaattttagcctgagccacggccccttcgaagggatcatcaccgataccaccagaaagcatgaggtaaaccacatctttgccagtaaaagtggtggataagaaatcaacatcagtcattgtaccgatagcggcatgggcgccgacagcttcaattgaagcttggcgcttaggactagttgagataacggtgacgtcatgaccggcttggacgagcttaggaacaacgatccgattaatatttcctaatgaacctaacattgcaattttcataattatagaacctctttaaaatttgatttttatttttaaaagatagatttatctttaaacgattgctagtttaaaagataaatctatctttgtcaagcttgaaaaagatatttttatcttttatactgaagacatgaagaaaaaagatatgaacaaacaagttaagattcaagatgcggttgcggcaatcattctcgctgagggtccagccggggtttcaacgactaaggtggctaagcgcgtcggcattgcacaatccaatgtttatctctactttaagaataaacaggctctgatcgatagtgtctatgcgcgtgagacgaaccgaattcttagtactaccgacttagaccgattaagtgcttcaacaatcgatgtgacgactcggattcgattatatgtacagcaggtgtatgactattcgttagccaatccagatagcttgacgatcattcaacagatcaaggcattgaatggacaggggatgacgatttcggcggcggatgccgatccgaataatattgtcgctaacttattaacggcggctatcgatgctaaggtgattaagcagttaccggttagtttgcatatgggggtcgtgttttcaactattcatacgcatacgacgaatatcagtaaggaacggtatgctcaggaccaatatacatttgatgatattttccaaatgatttgggacgcgatgaaacaagattaggaggtttaatgacaaaagacgcgacttaattgataggcacgagtggatatcaattaggtcgcgtctttttttgcgttcatgtagcgactagtcgtcttgaaatgacggtttagtatcttaaaggctggttgaataattcggttcattgtgtattcttttcaagtgtcggtgagtgttttaaactgtaggtaccagtttgagcaaccaatatgtaagggggactttgatggtacagtgggcaaaacgattcagtgaaacgaaggaaccggttgtattgattagtcataatcaaaataggtgtgccggcaaaatagtggcgttaatgatgagtaggctggagttgtggggtagctgatgaagattatttttgtgcaaacgctgttcctattcttgtttgttaaggtgcttttgcgtgattggcgggtacttagtatttgggatatcagttatgcggtggtcagtagcctagtgagcggctggattttttcagtaatcgggcaatatgcagcattgccattattgggactggtggtgctgtttacttggtggcatacacatagcttcagtgagtcattatttgttagcctacaggtgattatctggtcaattgtcgtcgatcatatcagttcacttttaacgtatatgttgaaattagatgacgggtatcttttgatttttatgggattacagctggttggtttaatcacattgaatctgattttaatgaatacgcatatccagacgacgttcaatcgtcccagactgaaccgggttacggccttgctgctactcgccatctatttatacattattgtcagcgagggactcgacagtgaattgagaatggtcgtcagtaacttagttgtgttgttggtcgttatggggctcgcgattgccatctatgatgagtatcgggttacgattcgggccaagtaccaggttcaacaacaacgcctgcaaatcaaaaatgatacacggtacatgcatgaaatcgaaacgcattataatgaattgcgccggtttcgtcatgattatcagaatataatgttgtcgattaatgagtatttgaaaacggatgatttggcaggcttacagcaatattatcaacaaaatattgccccagtgaccaagcgcgtttcggatgagcagtataatctcgaagatttaagtcgtgttcaggtcaaatcggtcaagagtattctatttagcaaactcagctatgcgcaatcacagggagttaaagttcaatttgacttgaagcaagtgcttaatggggtaacgacgaatgaattagacttggcaattgcgctaggtattattttagataacgcgattgaagccacggccggtcactatcatggtgagctgatgagcgccatttttgttacggcccacagtacggtgttcttagttcaaaataacgtttttgattccttgccacctttatggcagctaaaggaagcggggtattcgactaagggacaagagcggggcttaggcttgagtcagctcagcgcaattgttaatcgaaatgaaaatatgatattggaaacgcggttattggcctcagcctttgttcagcgtttaacggtaaagcgggaatgataaaatgatcaaagtatatatttgtgaagatgatactaaacagttacaaaccttgcagcaactggtcagtaaagtgattattgagcgtcaattggatatgggatttggcctaacgagtgccgatctgcatgaaatattagcgcatgtcaaaagtcagcaaccaactcaagccgtctttcttttagatattgcgttgaattcggatattaatggcattcagcttgccagtcaaattcgtgatttaggcatccgaagtaagattatctttgtgacgacgcatacggagctatcattgacggtgtttcagtatcaagtggaagccctggattttatcttgaaggattttccggatcgcttatacgagcgattaaataccgtcttacgcgtggcacaggagcgtttcaaagctgaagacaatgatcaaaatagttatatccagatcaaaattggcgagacgattcgatcgttggacgtgcaacacgtgttattttttgaaagttcaatgagtccacataagattatcgttcatttagatgatggtgaacttgaatattacggtttattaaaggatgtgccggatttgaattctgatttttatcgttgtcataagtcatatgtcgttaatctgacccgcattcggtcattggataaacggtatcgtcgactaacgatggctaacggtgaaactgtcctgtgctccgcagcggccagtcgctacttagtacggcagattggcaaaagcaatcgctgattgaaatcttagtcgatttatattgacggcagtaaaattgcagattgcaagattcggtttgctgactggtaaaataatcgtttcagcaatttgatttccctgaaacggttatttttttacgctttattcaggtgtattgaattatgaacctgagctgggccgttccaatcaattcgcttgcgtttattttgaacttatcttcaatgggccaaataaggtcttaatgtagtgtaatggttagtccgcctgtcttaaaacggccgttgcgccgggctacactaaattataattagaggcaaccagtttgaatcaagtgggttatgttcgccacaagtacggctgttaattatgatcaaggttggcttgccattatttcgcaggtcaaatcgtcgtactggacatgggttgtctgtgatttgagcgtgacttgtgattggtcactaacgataatattggtgattagtcgtaataacttaagtgtgggagtgaatagaatgtgtggattggttgggtgcttaacggatcggcgaaaagttgataatgccgcgtatgatcaggttgtgcgggaaatgactaaaatgattgtgcatcggggtccggatgatgaggggtactttgcggatgataatatcacgatggggtttcgccgattaagtattattgatttggcaggtggtcatcaaccgctgtcatatgataatgaacgttattggctaacgtttaacggtgagatttataactatgttgagctacgtgaacagttaattcaagaaggctacacgtttaagacggattccgattcggaagtgatcttagggatgtacgcaaaataccaggccaagttgacgacctatctgcggggaatgtttgcctttgtgatctgggataagcaggaaaaaacgttattcgcggcgcgtgaccaatttggaatcaaaccgttttattatgcgattgccggggatgatttttactatgcgtctgagagtaaggcgatttataagattttaaaagataagcattttgatcaagaggcgttacaagattatttgacgttccaatatgtgccggaaactgagaccctgacaaaggaaatcaagatgctggcgccgggctgttcattaacaaaacagttgggacacgcgccgcaaatcaagcgttattatcatcgggagtttcatccagtcgtccgttctgaacaggactacgcgacacggcttaaggggacgttgattgattcggttaagatccatatgcgttccgatgtcccagttggggcgttcttatcgggcgggattgattcgtcaattgtggtggcgattgccaagcagttcaatccaaatctcaagacaatctcagtgggctttgaacgacctggctatagtgaattagacgtcgcacaggaaacggctgctaagttgaatgtcgataacgtccaaatgaccatcacgccggaagcattcatggcagcctttccacattttgtctggagcatggatgatccgttagctgatccggctgctgtcccgcagtatttcttgactaaggaagccgtcaaacacgttaaagtttgtctcaccggtgaaggggctgatgaactttttggcgggtatacgatttatcatgagcccgaatccttgaaagcctttcggtatacgaagccaatcaatggggcccttcaacggatagccgcgatgatgccagcaggaatgcggggtcgttcgttgcttatgcgggggacgaccccgttagagaagcggtacgttggcaatgcgtttatcttcaatgaaactgagaagcaacagttcatgaagcactacaatcgtgaccattcgtttcaacagacaacccgggtcttttacgatgaagccaagcactatgatttaatctctaagatgcaatttatcgatatgcacacgtggttaaatggggatttgttgcataatgcggaccggacggcgttagcccacagccttgaattgcggacaccctttgttgaccgggacgtgttcaatctggcagcggaaattccagccaacttgcgaattagccacggtacgacgaagtacattttacgaaaagcggttgaagatattgtacccgcgcacgtgttatatcgcaaaaagcttggtttcccagtaccgattcggttgtggctcaaagatgagatgtacgattgggctaaaaatattattgtgacgtcgcaaaccgatcagtattttgacaagacatatttcttaaaactattggatgaccatcgagcgggtgttcgtgataattcgcgtcaattgtggaccgtgctgaccttcatgatgtggcataagttatacgtggaagctgatatgttaatggatagtgtaacggccaatcatcttgctgagcaagtcgaaatcggttaagctgttcatattaaagctaaataagaactcgttcaacgtgccaatgagaataaaaatcatccagcgacctgattgtcttaatacaaataggttgctggatgatttattttggtggttttgtagttgtttcgttagtcgatgacgactttagtgccatacttgatgttgttatagacccacttggaatctgcaacgctcagatgaatgcaaccgtgtgaagacggtcgcttgccaagatcagcagcgtctgatttgataaagtgaccttgggcatctacgggtgtggagtggaacaaatattcaccatggttgagccatgagacccagtaataggcaccttcatcaacactagcgctataaaaatattttccccgttcggcttgcacatgataggtgccacggggtgttttgcggtcagcagttggcacgccactggatgcatacattgtatagagaacgtggtgatggttcatcaagtatagccgttgtttagccaacgatacgtgaatccataagtccggatagcggttgacattgggatacgcgactgtttcggatgattgacgccagttgattggtgtgcgcatgaccgttgatttagccgtggttttggctttcgtttttgacacgactttttttgtggttaccgttgattggctaggtctgtgggcatcaccaacaactttgacagtgccgaccgccagtaagccgataactaaagtgatgctagttaataaaattaatgttgatttgcgttgcatgttgcgcccccatagttggttggttctgtctggctctgacttgatagttagtggtaatagtcaatactgaccattcaatcaagaccttctcagtaaaagtggaaaccaatcgtatattaccgttatagctttctgaaagtgaaaatgcaacccagtcgaatgctgggtaagtcggttttacgaacaaatcggggtcgcgatagtgtaaagcgggcatattcgggctttaagtcaattaacacagcctaaaatgacaataattggtcttcaaataacactgaaaataaacaataaattccaactaaaagtaggaaggccgccggtgaaaatcgggacgattcattgctagcactctgagtcgcctattaatgaggttcctgaactagtgacggttaagtggatttaaaagatagtgacataaagaaaaacactcagcctagcgataggacaaccgaattggtggtcattgttaagccgctaagcttagtgttttcgatgaccgtttaagacgactacgggtcatttagttattaattttgaacgcaatgccggtcggtgctttttgcgggccgcgctaaccaaattagacctaacaataggactaagctaacagcaaccatgatggcaccaaagatcggtgtccagcctaagccaaggttggtcgtgacttgaccaccaataccggagccgagtgcgataccgacgttaaaagcggaaatatttaacgctgaggccatcgtaatatcgtgtggtgtattctgttcagctaactgaacaatatagagttggagcccagggacgttcatgaaggcaaagattcccatcagtaggacggtcaatagtcctaaccagtgactgtacccggtgacacttagaatgagtaaggtgatgagtaacccactgaacatcttgaatagtgcaattaagggccgtgcattggcccaacgaccacccagtgtattaccaagggcgaccattaagccgtaaacgactagaatcaaaacgacagcgctcgctgaccaatgcatctgctgttctagtagtggtgataggtaggtgtaaactacgaaggtaccaccgtatcccagcgccgtgacgagtaaggcgaacagtagttgtggattagtgagtacgcggataatcccccggaccgtggctttactgggtaacggcagattacgtggaattaaccagtaatcagctaacaaaccaatgacaccaatcatgctaataaagataaaggaccagcgccaaccgcctaattgaccaatcatcgttcccaacggaacaccagtaaccgttgcgacagtcagtcctgtaaacatgatggcaatcgccgaggcccgtttggcaggtgcgaccacgtcagcggcaattactgaggcgacggtcataaaaataccgtgagccaaagcggccacgacccggcctgcaagtaagacaccaaaggttggggcacttgctgcgagtaagttaccaataataaataaaatcataattaacatcatcaagcggtgacggttaagccgaccggtgagtaatgtcatgacgggcgcgccaatcatgataccaatggcatagatcgagacggtcagcccagcttgcgccaagttgatgtgaaagttgctaacgagtagtggcattaaaccaacactaataaattccgttgacccaatggcgaaggcactgattgcgagtgcaaaaagtgtccaactgggattaaactgttttgtcataagataagcctcctgctattgctaagttgataaataatgattatactagcaagtgaattttagacaagtaccgactttaaagtgggatacccactaaaaagtaagtatggaatggagggacaattattggaaaccaaaacgtatcatattggggtcgaggccacaatggaaattattgggggtaagtggaaatcaattattctgtgccatctgcgtactcagacgatgcggacgagcgaattggaacgcgcgattccacaaatctcgcagaaaatgttagtacaacaacttagagagttggaagccgctaatattgtgacgcgcaaagtgtaccaacaagtgccaccgcgcgtggaatacggactaagtgattatggccggagtttgtccgttgtcttacatgagctgtgcgtgtggggtgaggataatattgatcgccgccgagctgcgggtgaagagattgccttgttacatcgagacgatttatagacaatgagtttaaattaaaaatggtgcgtcaagaatgaaaatattctggcgcaccatttttgattagggggagttaatgttgggtcggttgacgactaaataaacaacaaatcagtggagttaacttattgctactagctattgtgtagggatttggctaggagttcatctgcgaaactcactgggttgttactaaagaactgcgggggtattttactatgcttactaaatatatagaaattcgcacaaattctgtactaaccagatttagttttgaaacttaatattagtagtaatgactccgcttacatttttaaatggttatgataagcttagattattgacgataaatagactggagttggtgagtatgacgaaggcagttatttttgatttagatggattattgattgatagcgaggttatttcattaaagatgtatcaacgaatcgtacaggattatgggcagacgctttccatggcgacttatgcacaggaatacagtggtaagtcggcggtgacgaatatgcaacacttgattgaacgttttgacttgccgtttaatgttgatactggattaaagcgggcgttaacgttggaaaagacgtttatgcaggatggcgttgagctcaaaccgggagcacgggtgttgttacagtttttacaccggaatcattattcagtggccttagcttcatctagtatcaagtcgcgggcattagacattttgacgtcccatgatgtggcgcaatatttcgaccagtttaccttcggaccggatgtcgatcgtggtaagccatatccagatatatttttgatggcatgcgccaaactccaacaacaacctgcagattgtttggttctggaagacagtgaagctggcattcaagcggcgacgtccgcgaagattccggtaatttgtgtgccggatatgaaacggcctaaccagccctatgctgatcaggcgactgcgattgtaccgtcgttaacggatgtgataacgcatttaaaatcagttcgataagattcagttgtaattaaagcataaagattattaaattattaataaggagcggttgtccgatagaaaaactgctatactacgaggcgtaaataaatcgctgacaagttagccagtggaacgaaggagtcttgatcaatgaagaaattgatgattgctgtaactggtttagccatggtggcaacgctgggagcagcggtacccgttacagggattacagcgaatgcggcgactaagaagacaacggctacgaagaatgtcgcaccaagtttgaaggtcaatgcaatttacaataatacgacgcaaattacaggtacggcaaccaagggcgctaagatcaccgtaaaaagtacggccaacgccaagaaaaatcttggaactgcaacggcctctaaaacgacgggaaagtacacggttaaattagccaagacattgaaggcgcaaagcaatgtttatgtgtacgccacgaatccaacgactaaggcttatttctaccgcgtcatccgtgttcagactgccaaaactactgcctcttcaactaagaagacgactaacaagacaaccacgactaagaaagtggcaactaaatcgacggcggccacttcgtcatccaagaagacgactaaatcgtttaaagtcaacgcgccagcgggtacttggaagtcgaatacgactaacaagtactcccaaatcttaacgtttagcgctaagaatggatttaatcagacgctttataagaatggcaaacaagttaaaaagctggtctcgtatgcgagttatagcatgactgccaagacgccaacgttctggaaagtcagctataagtcaggctcgactactaagaccctatatttacgctatacagcaactaataagtttacggtcgttaatgctaaaaatcagatcgttaaagttaaggttggcaatgccccagcagctgtttggacgtttaccaagaagtgacgggtcgttaaatatcttaagtacgaacaattcctcggtattttggggaattgtttttttgttgcttgctgatcaattagattgaacgtggcctagtgaatattaaaataattgaaaaaacgcagatagcttatcgtcattagcaggttaggtgagcgcatataaattggccaatttgggctgttcatagtgaccatgatggaaaaggcactacagcgttggtaagtcatctagttcgctcgaaaaatgacttggtcgtgagtcacttcaaaaatgaccatcgtgcagttgtatccatgaagaatactgaataaacaagtaaatgaaaatgggtgttcgttagctgatacttatcatttaattacggttattaacacaaataatatcacggtgataaaaatttaatattcggatatctgtaaaattgtaagtctttttctgaacgtcacaaactgaaaataatgtaagataattaacgtcaagagatgttaaaatactatctatgtgaagggagcgataggcatgcaacaccggcaattatggtatcggggcggcctgggactggcactagcgctagttgtggttggatatcgtggatcacggacagttattcgggcggttccccgcgcacaattgagtgttgatcaaaaaatgccatcgactagcagtgttttttctgcttcgaaattgacgttgcaagatgaggcaaacaactcggcaccacaagtgtcacctgaggcccaggaaagttcgggacctgacaagcagtcggatttaacatcaggcagtagtaccagtagcagtggtatcagcagtggtatcagtagtggcaatagcagtggcagtacaatactggaaaacgctaaaaataatcaaacatcagaaacggcgacgaccaaagcggcagaaatggtcaatgggacggttaaaatgaccttagatactaatggcacattgcatttgagtggtgggtcatttggtgcatcgctagggtcagccacggggagttggattgtaaaaaccttgacggctaacggctatcaaccgacccaagtttcaaagatcgtcatcgacggtaagataacggcaactgctatgactaattattcatatctgtttgctaacttacctaatgttacggcgattgatgggctagccaaccttaatttaactggcgtaacggatatctcgtggctatttttgaactgttcacagttaggcgcgttggacttgaatagttgggatgtcagcagcgtcatcagaatggagggaacgtttcaaaattgtgccaagttagttacgttgaatgttgccaattggaacacggattcattacagtatctaattgacactttcaatggtgacagttcattaacgtcgttaccagttggcaagtggaataccagtaaagtggcgacgatgatgcgaacatttacggattgttcttcgctgacgtcattagacatcgctaattgggacacccgtgtcgtaacgaacatgtccgcgatttttagaggaatgtcgaaggttaagagtttacccattgataagtggcaaacgggacgcgtggttaatatgcagttagtcttttcaggtgatactagcttggaaagtattaacgtcgctaattgggatacgagtcgggccactgcgttggatgggacttttgctaagcttcctaatatcaagtccctgccactcgacaactggaatacaagtaacgttcaaacgatacggagcacattttatggcgatactaacttgacccagctgccgattgacaactggaatgtcggcaaagtctttgattttaattcaaccttcagtggctgtgccagtttaacaactgcaccggttgcgaattggaacacccagagtgccaccaatcttggttatacttttgagggcatgactagtctcacctcgttaccagtagataattggcagactggtactgtcacgaatatggccggaactttttctagagttagtcagttaaagagtctcccgattagtaagtggaatacgaagaatgtacaaaatatggcggggactttttctgaaatgagtagtgtcacggcattatcagtagataattggcagactggtaatgtgacgacaatgaggggcatctttaccaaagttagccaagttaagaatttgccagttggtaagtggaatacggcgaaggtcgttgacatgggacaagtattttacggcaacctccagttaactagtctgcccattgaaaactggaatacaagttcagccacggatttttcacagctatttgcggaagattcgggtttacaaaccttgagtctaggtgcttggaatacgaccaaagtgactaactttgaatcagttttccaaaataccagtctagacaaattagatttgactggctggaataccaacagtgcgcaaacttataccaacgctttcagttcgaagttgccgcctaaacgtctattgttgggccccagttttaacttttttaagagtgaaagttggcacttgccaaatcctagtagtgaggcaccttatattgggaaatggcgtagtttaaataataaaaaagtttatacgtcagctgatttgatgactaaatacgatggcaaaaccattgttggagaattcgaatgggccactggcaacacgattacagtgaagtatgtggacgctgctggcaagtccttggcacccgacacgaaaatcagtggtgcaactggtgatgcctatcatattaaaccaattgagattcaagggtacgtgccagatcaaccagatggggttcaaggaaactttaccgtcaaagatgaaacgattacgttaatgtacaatcctggaggactaatgtttgtctcagcaccgcagaccattaattttggtcagaatccgattactggtaaatcagaaaattacggtgcctcctatgatactgggctagttattcaagatggccggtcaataggttcaacgtggtcgctcaatgcaacgctctcagcatcaggcttcactagtaagcagtcggcacgaccattagcggctgtgctcagttataaggatcaacaaacgggtggcgagtcaattcttacgccaggtgtggcacggttgatcgtcaataaccatcaaactgtttcgaaccaaggcgtcaatatcctcggtcagaaaacggcacttggggcactatcgttacaagtgccaaccgatcgtgccttgacggatacgtatcaggcgacggtcacttggacgcttaatcaaggggttcctaatcgatgatgaaaaaaataatgattaggtaacataaaatttgtaagactgcttgattgttgttagcgagttagttatgtatatttacaatgtaccataataactattccagcttaatgattggtttcggccagggttggctttagttataccgcaaataatgatacagaggaggagtggtgttgatgaagcgtttggggttcatcacaattgccatcagtaccctactttgttgggggtggttgtcagcaccgattattggtgtggctagtacggctgagagcccagcaacgattcgcttcgacggccaggctgagtcatcgaactcagacactggcgctaatcagttacaggtgactgaagcgtcaaagtcgagtcattcgattgtgcatcagccgaatgctagtcaagctgttcatcatcagaacccggggtggttaccacaaacgagtgaacaatggtggctgagtgctttcattggtggtattgggttattggtcgttttaattggttggcaattggttaactatctaaaaaaaaggagttcattatcatgaaaaaaacattattaggacttttattctcagcagcattgattgcaacatcaggtttgaccgcgagtgcggccgatacgccacaaacgtctaatgggacagttggtttcactgggggcgacatcactattgataatggtgatacggacttagctggtgctagtcttgactttggtaccaaccaaatcaccgcagctaccaaagacgataactatgacaacacgaataagtcagcggcggtatccgttgtggacttacggggaacggctgctggttgggatttacgtgtgaagcaaaatgacgtttttaaaaacgacaaagcggttgctaataaagaattgacgggtgcgattccaacattgaatggtgttttggattcaaatgcatcgacgactggtgcggacgcaacggccaataccggtgttgcgctagatacactcaatagtgacaaggttttgatgaccgccgctgtgggtaaggggaatggtaagaacgtggctgatattgctaagtcacaactaatggttcccaagactacggcacgagctacgggaagttatagtacaacgttaacttggagcttgaatactgcaccagcgaatagctaataagtattgatcggaaaaataatggctagtaggggttaatgtcatttttccgaatcatgattagggggagaaatgatgttaacaaagagatggtggcagttaggaattggtttgctagtcggattagttagtctaagctggggacgaacgggttcggctaacacagtcggttttgaggtcgcaccggtggcttccaaatatcaaatcgataaggctgtttcatactatgatctgaaactaaagcctagccaaacaaccactttggcagtgaaagtgacgaacacaagtactcaggaaatcaccgtgcatacggcaattgtaccggcgacaactaatcccaatggggtggttgagtatcaggcaacggctgatggcaagaacattgatttgccagctgatgctagtcaactgattacgacggcggcgaataagattacccttgctaagggaaccagtaagatcgtgacttttaaggtgaaaatgccggctcagaagtatgatggtgttgtcgttggtggactgagtttcttaaaaaaggccgccaaacaacagagtaagagcgcaatggcgattaagaatcaatacgcttactcagtggcggtcgtattgcatggtgaccacgcgctcaccaagaacaagttgacattgggtaagattgatgcgacgcaaaataacgggtataaccaaattagtttacccctacaaaatcgaacggccgctttcttgaatcaagtcaaaactgatgtccaaatctatcgtcgtggtagtaacaaagtgcgctacaagcaggtcaatgaacatggtcagatggcacctaattcagtttatgccttaccgttacgggttggccgggatgcgttgaaacccggccaatataccgctaagttggccgtgaagtccaaaaagcaacattggacgttcaccaaagattttgaaatcacgcgtgatcgtgcgaaccaactcaacaaaaccgccgtgattgaacatcatactaactgggggttgtggatcagcctcggtctgctagtcatcttgttgttactgattgcttggtacattcatcgcaagcagctaaagatcaagtgattagaagaacggcttaaagataaatcataaattcatagccattagtactgttataaacggactcggtcaggttggccgagtcttttttgtgggttcggtggcaatgaatacaaatttacctttgctaacttactcattatctttttgcaggcaatgcgcagcggcttgtttctaagtataatgaaagtgtagttaacttaaaggatgtgaatgaagatgaagtatgaatggcgtaaacaagaaaaaacaacctatgctactaagaagcaaccccaactgttgacgattccagcccaaacttttatgagtatccatggaacggggaatcccaatggcccagagtttcagacgcacctgcaaacgttatatccagctgcttatgggctcaagcatgcgtataagcagtatgcgcaaacacaggcgtgtgaatttgatgattacgttgtttttccgcttgaaggggtctggtcattgacgattaagggacagcaacttgaccatcttgacaaagatgagttcagttatgacattatgattcgggtcccagactttgttcccaatgaactgattgcaccggctttggcagcggttaaagctaagaaacaactgccaactgaacaaattaacgtgcagcagttcgacgcaatgcaagtggcacagattctgcacctgggtgcttatgacgatgaacccgcgagttttgccaagatagatgaactggtcgccaatcaggggatgcatcgtactagcaagattcatcgagaaatttatttatccgatgcacggcgggtggcacctgataaactgaaaaccattctccgatatcgagtggcgtcgaattaatgcgaaaacttttgactggcattgggcgtgaagcacgaatataatttaattatattttaactcatataaaattataattaaggggtgctgatagtatgacgcaaatagagattagtgatcggctgaaagctttattggttgcgaagggctttgataagaagcaattggttttggtgacggatgatggtggtggcaagtactctttgcacgggggtgcttgcagtattggaactaaatttacgataatcgtacttgaccagccggaccccgaatacaacgtaacggtggtgaatgatcaaggcctcgcgctttggacctccacatacgatctcattttctttaacgatggtattaagatggattacgatcaggggcggatcgctattaaggacaatgctcatatgctggacaatgccgttcaaatcgctaaaggagcggaagttttagctgcttttgaacagggcgtcccagccgataacctaacttgttaattgcgatatgaagaaggcataataatgaagtcagttatttttgacgattttggtagtcccgatgtattgcgcattgctgacgtgcaacggccggtggcgacaactgcgaccgtcttagtgaaggtcatggcggtggccgttaatcatgttgatacgtttgttcggagtggggcgtttaagacggccctggcagcaccacacgtggcgggacgtgatttagtcggtgaggtcgtagccagttcgcaaccgaactttcaaatcggtgaccaagtctggacgaactcaatgggctatgaaggccgaatgggcgcaacagccgagtatgtggcggtgccaactgatcgcttgtatcacgttcctgatggcgtggcgcccatgccactcgtcgcggcggtccattcagctgcaacagccgccatcgtacttaacgacgtcatggaaattcgtcgcggccagacactcctaattgaaggtgccgcgggcaacgttggccgcaagctgattcaacttgcgcatcaaatgggcgtgacggctgtgataaccgcatcaccacgagattttgcacggtgtcagcagctaggcagtaccgcctgttatgattatcacgcggggtttgcggaccagttaacgacggatcagtggacttttgaccatgtgattgatacctcgggacgcgtaccactggcgattaatttagcgttattacgattaggtggtcaggtgacattgattacggcaccgcaggataaccaatttgagttccctgttcgccagttttacatgtctcaacaacgaatcactggttttgtgattagccatgcaacggttgaccagttagcacaagcggccagtcgtttaaaccgagcttttagcgccggactgctattggatgatcaggtcagccagcgatattttaaggatgccgctcagtgtcacgctcaattggaagcaggcacggatcatcaccagcgctttgtgttattaccgagttgattcagcataacgattgaaagcctgattaattaatcagtaatactatgtcaacaatagtattgtaattttggtgatttaaagtgattacttggcaggaggactggacagtcggctcccgcgcgtctaaagttgcgaccaatattatctgtgaaaggaccggcgtgctaacaatccgaaaggtgatcgatacggcgatctttactaatgttaatggcattcctccgtggtaatacgcagacttgaaaagaatatcgatgacgaaagtccaacacttgtcagcaagggttggactttttgtggtgcagcaccagaagcaatggcagaaaaataattaatttactacctatactagattgttgatatgaatttatttattcggatagccatcgattgttggtgaacggctttaaaggaagttcgcctaattatctcaagcaacccacgcttgataacggttacacgaacaatccgggtttgtaaatatagttaacgttatacattattagcgctgttactgaccaaccaatataatgaaaatgtggtcaaaggagtcggcatttaaattaattaatcaatcgtacaaggttattgggggaggtcacaagtgatttagtgccagtaatttatgaattgttatgagagcaatcattgttgataatgaccaccgttcttagttgatgaaagctaaacaagcgctggtaaatgaaaaagggggatttataccatgaagccaatgttaggacacttattaatggcaggaactttattattagcgggtagtacaccgattgttgccaatgctgcagaaaatcgtagtgggaatacagatatcaaagcggaatttacgaagagtacgtccacggtgacgccagttgatccatcaaatcctgatgtgccaagtactgatggcgatggtgacaacggggcggcagcaggtggcgacctgtcgctgatttttgtgtctaaatcgttaggatacgggacgcatgagctggacgttttaaatgatcaacaatataaggttgacccaactagttcatatactttgctatggcaggataagatggttgtagaagtttctgatgttcggggaaccaatgccggctggaaattaacggttaccggctccaatttaacaggaacggatggtacggctgcaaagggcgcaacgctcagtttaccaaaaggtgacgtggtcaacagcggctcggaggccaatggtgcggttgctacggcttccgaagttgctttaaatggtacggtgggatcaagtgccgtcttaaatgccgataagggcggtggttctggggtaactgttagtcgcttagatccaaaggcgttgacactgaatattaaggctaatacggttaaggcgcaggcctatagcgctaacctgaattggacattgagtgatttaccaacaaattaagcgtcatcggggcgaacggcgccccaagtacatatgtgagtaatgggggcgagaagatgcaattattgaagcgaatcatggttattgtggggacgttaattttaggcctgcaagttagcagcgttagtggattggcagccagtaacgcaagtagcagtagcagtaaaaccacgcaaagcaatgacatcgggtttagcgtggccgcgaagattccgaataatcagattgatcaacataattcctattttgatttaaaaatgacgcgtggccgacagcaacagattcagacgacgatttataacgtcaccaacgctgacatcaaggttcaaacggcgattcatacggcttatacgaacggcaatggcattatcgagtacgtgacaccaactaaaagttatgatccttctttgaagtatcgaatggaccaaatcaccaaaatacagggaccaacgaccatcacgatacccgcaaacgggtcgaaagtggtaacggcgacggttacgatgcctaagcaagcggtgaacggtgtgattttaggcggctggtattttaaacgggtcgccaataaagtcaccggaagtgttaagggttccatgaatattgccaatcagtattcgtatgtgattggactgaaatatactgctggtatagtgccacaaccacaattgaagctcgatacgattacggcgggcatgcagaattatcggcgaggggtgtttccacaattacgcaacgttactgcggtgatcgtccccaaactaacgattacggctaggttaacgagtaagaatagtggcaaggtcatcaagaactttacacagaagaatgtgcaattagcacctaactcagtttataaagtaccaattttgacagggaccaatcgtttgcaggctggttcgtatcatgtccggctagttgctaaaaataccgatcatcgatgggtgtttgataaagattttgtcatcagtacggccgcggcagataagtataatcaggcttccgttgatgattcgggaatgagcgttggctggtttattctattcggagcgttaggcatgttaattattggattaatcggtctattaatctttttctggatcaaaaagcggcggcgtgcttagttcggtcagtgaaatgggggaaggaccatgccgaataaatggtggcgattaatattaggggtaatgctcgtgctgagctgggcaataccagtgcgggcggcaacacacggtcgcactgagatcagtgtggggttttatgagactaagtatagtgctgaccggattattcccgcccgtgtgattcctgatggtggtcacccgtacgttattagaccagctgacccgggtacccagggtcagagaaatcagtcagagcgcaagccaatccgccgacaactaattatcgatggctggttgcgtgggcaatcacgcaatggtcaacaattgccccaaacgagtgagcggcttgtcattggcagtatccttggtgggatggggttgttagctagtgttttagcaggcgcgttgtaccgaatattaaaacggcaagatgggggtgaacggaatgcgtaacagacgagtaaaatggttactaattcttgtattcggtatactcggcttgctgaatttgctgtccttagagggtaacgctgcgactttgacgagcaagatgacggacgtgaaagctaatgctgcttttcaggccgtaccgggtggtaattcggttggtagtagtgttgataacggtttgcaagcgtatccagcattaggcaatgtgtccgctaactatgcggataatggtcgaattacgaggcagacgacccaaattacaatgacgatgacgggttcgattaccttaaaatctagtaactcgatgtcaaaagcttattttgatattatggctggtccggcaagtgggagctacaccggggcgacattagttacggctacacctactagtcttggcagtggcaattcgattatgattagttcttcaaaacagacgcagacgttatcggtcaattttcaaaatattaaaagtgagttgccaatctatattggcttccgaatcacagtgaatggtgaggaaggtacctatcagctggggcgtttcaacgcgcagacattatctcctaaaattacggggacactttattcgactgatacgacgatcaaaggaaccgggacacccggcaatacgatcagtagtaatgttaatggtgtgacgacgacggtcggaagcgatggaacgtacacgctgaatcttgggactgcactcggtactttaagtaacgtcaccgtcactgaggtcgatgagattaccggtgataaggggacggcgaccgcagcggtgaccctcaaaaaactaaatattactagttcaaagacggcagtcgatctatatcctggtgacttagattcactgacaagtgatagcgcggtcgtcgcctggttagttaagcaagctggcatcgttgcgacaaatccggatagtgcgactgacacaattacttacgcggccgacgagactagtttagcgagcaagttgagtagtttagccgttggtagcagcaccacgatcaatatttatgggaaaggcagttctgggctgaagtcggatgctaaggcaattactgtgacgatgcgggatggaacgttgagtctgggcacattaccagcaagtttgacgtttggcaccctgacgattccgtttaaagaaacactatatcagccgacaaatgcttggaacatcactgttaatgacacacggaagaccggttcacagtggtacttacgggcgacagcaactgccatgaaatccagtacgcggaccatgagtggcaacctgatttatctgaacgcggggaacaaacaggtgctgacgaatacttcggtaacagtcagttctggcaagaaaatcgcgggtacgacgagcactaatgctgcaagtggttggtcgagcagtcagggtattttattggatgtccagcctagtgtgcaaattgacagttacagtgggacgattaattggaccttacaggatacaccttaaaaattaatataagtggttaaaagatattgcaaaagtatgtcgatttgcaatgtctttttttatgaataattaataataagattgtaagggctttattatagtttaatgcaaatttatgtttacaatatagagtaaagggtttaatgaagccgtatttctgatatagtaaagtgaactaacaaatgtattaatatgatgaggtggttggcgtgtcagcagtacttttagcgctgtcgttgatttctggcggttatgaaatgttgtttttaatgattggttttagagaatatgtcacttggcggattgccatcatttggctaagtctggttattattacgatgagcctgggggaagtggcttcaaacttatggccccaagtccctctggcttatttttggatcatcccgattgtttgtgtgaccacctttatgagttctcggttgttgtacacccagtggattttaatgttaccggtggcaatctttttgaatgcgcttaagcgattagtaggggcgatcatgggtgtcattgccaaggctgtagcccaatctgcatcgccaatgttattacggcaagcgataggtctacattcgacagcggatattaatctctttttagcgtcgattatgatgctgccggtcattattattttagggatgttagcgcatcgctggttagtacaagtgtcggccgccgatttcttgcaacgggcgcgtgttaatattagcgattacttattagttattttgttttttgctatttatattattgcgtatgtttttgcgatggaatggtcagtcaatgcgcaaacgtatatggcaattgcggctatcgtgacgtttggcattatcgggtcgtatttaattagtaataaaaacagtcacttgaatgatgcgcagctattgctacaagtctcaaattacaacgaattattaagccaccataatcgtgatttacatttgtttaaacatgattatgagaatattcttttgagcatgtcggcatttattcagaacaatgatatggccggcttaaagcgttattttacaacggaagtaatgcctgccagagtaacccttaatcgtcagtcgggactgagtgatttgagtcgcttggataagccgacggtcagtggtctaatttatgcaaaatatgaggcagccaacggtcagaacgttcatttagtggtgacaatcttagagaaagtcacgttagcggatattccacagataaaagtagtgcggattttgggtaacttgctggataatgcgacggatgctgctgcccgagcgaatcatcaagtggcgctaactgttaaaaatcgggatgctcacacaacggtattttcgattacaaatcaaattccaacgcatgaagcggtagatttatcagttatcaagaaaagtcgatttacaactaaaccaggacatttgggttatggattgagtagtattgaacaattaactacagatcaattagttgttaattattgtattgaagagggcaactttattgcagagctcattatcaaacattaaactatgattatgaatcgaaaggatctgaatttggtggcattactaacaacattacctaatattgggccaacattagccaaacaattgcaagccgttgcgattacgacacccgaacagctaaagtcaacgggtagcaaagtcgcttttactgccataaaaaaggccaacccccacgcttgtattcaattattgtattcgttacaaggcgcaattgagaattgcgcttacccacagttatcaccggcaactcgcgaagatttaaaacaattttttagatcattgctataactcatgaatggcaatgtgagcgctggtcggagaatttaacgataagcttttagataattaagaccatacttttttcactttatgtgaattggttaacataaaaatgattgctttaaagcggttatcccagattacgagggataaccgcttttgtgtattgattgttaaataaaaaatatttgttagaatcattagtgtacagcgggattagttagcattgtaaattgtcagatggcaaatgtaaatagtattactgctagacatctgttaaaatgagcattatttttgggttaacaaattttgaccaataacgtaaaggagttacagattatggggacagaactacaatttgtacaatatttacatcaaatgcgtgattataatgatcagcacccaaccaccaaggggctgatcttattaggttacttagaacgagattttattcgattctaccgggccggaaagattgaagaaggcattcaatttgctaagaagaatctgacccgttcgcgcgatttattaaataaattatcgagtgaggaaaaacagctgcaactcagtgcgctggttgatgtcttagcttttgagggaatccaaaatcatgctgatatttatgaatttgttaagctacgtaatgattatcaccgttggttagttaaattacccgtgacgacggaacgttaccagccactagttgtgcagattattcgtgattttgccgcaattgccaaaccgaacgcattagcttataacgcacatttagagtcaacgctcgatgtgatgtactataccaatgctcacctgcatgatcaattatcggtgaaaaaggtattggcccacgtcaatgcgcggtgcaatcctgagtcagtgcggcggtcgtttagtcaagagatgcatatgtcgattcgtgattacatcaatgccaagaaaattcaggaagctgagcatatgttgttggcaacggatttaaccattcgagccattgctgctgaactctgtttctacgatgccgccgatttttcaaaacgattcaagaaggagaccggtcaaacgcccttagaatttcgacaacttaatacacgaactgattagtacttgtatttttaaagataacctttttcgcgtaaatacaaacccccgttttactcgcataaaagcaggtatactatgtctcaaaattcaaaatatgtcgatatttgactaaaattaacagaggcaaattactatgcgatatacacggggcaaatggcgcgtaaccaatcccaaggtttggttgttttctagtgttttaattttaggttggagaattgtgccgacagtggctcaagcaagtgaagctgagacggttaccatgtcgagtcattcggtgcagttagaaacggataatcaagaccaattaacagaagtagcacggatttcaaaaactgcggtaactcgtgatagccacagtgtgaccgcccagtccagcaagtcagctgacaggactagttcggagcaacctgctacgactggcactgttgaggcggtcagtccaacgactagtgaagcccaacagcggtcaacacagcaagataaaacagctgttgatcaacgggcaagtgactcaacagcagcttctgcgggtgccagtactaatcaggcgtcagccgcaacaagttctgatcaggcgccagcagccaactcaactggcactcatcatgcgattgatatggccagttcagctagcgcactaggtgctgacagtggggcccattctgaaagtttatctgaggcgcaacactcaggcgggcaaggtaagacgatcgattcagatttatctgggactgttcattcacagtcatcagtgagtactgtgacgacagctacccctgtgaactcaaattcaagcctagaaagcgacaagtttacttccacacggagccgagctgtagcggtaactgatcaaatgagtagcagggttgaaaaaagggcattgaataaaacaaatgtcactaagtcaataaacatatcagttgcaacaaagcagccgagcaagcaacggacagtcaccgcttcgtcgtttttgacaatagtaaagaacttagccgataagaactatcttgatcagtataccaaacagcatgggcaagcggctttgattgctttgatccaagattggttgtccacgtatcgaattattgcacttacaggaattacgattgtgaatagttcgtttgatggtagtgtggctacgattagtggtggtctgcacgttatcaatacgggggcgacaattcgttctggccaggatgatgaatgggagaccatcataaacggtggtttgtcagtgacaaacaatacaatcacgtttacaactaccaatggattggtggaccgtcccgtagctaatcaggatatggattttacaaagcctcggccaacgggaaatggtgcaatcaaaggtttaccaagcgttacggttgattcttcgttaatcaatgcgcaagaatttagtcaagctcagatcaatattagtgacttttatgatcaactagttactgcagggactattttatcggcaactaatggtggcacgttgagtaagatgctgattggtgagtctggaactgctgatttgggctcttatcaaggacaccattattatgccgtgaatattgatttgaatgactggcacagtggtattcggaccactggttttaataatgatgatgtggttatttataacgtcgtcacggcagcaccagcgttaaccattggtggcggtttttctagtagtacaccgaatctagtctggaacttcaatcatgacatgcgtattcagaataccacgatgataactggtaaaatcgtggcaccacatgctgtctttacaactaatcaaaatgttgattcagcggccgttttacaatatggatatggcgatggtgacagtgctattcgagagacgattacgagccaaaacgagcataattatggttttggtcaagtggttactgatgacccgttggattacttaattgcagtgattaagtcggatggtacgagcattgatactttagctggttttcgccatctactagcaaccgggcaactgaagatcacgattacagatgcggctgggacacgtttatcagggttgaatgcagttgatacacatattgcgggccagcatcgctatctaattacttaccaatttggcgatcagactgcaacgacttggttgaacgtccaaccatcgcatgagcccataatacctatcagccggataccggaatattcagcgataacgcggacgatcaattaccaagatgagcgaactggggcggtgcttgctggcccagttatacaaaatgtacgggtcgtgcgatttgccatttttaatgctaaaactcatgaattgctcggctatgatacaaacggcgacggaattgttgatactagtgatgggacaattgcatggctgttagtaccgccaacggatcaagattgggtacaggttgtctcaccagacttatctgcgcagggttatcaagctcctgatattccggtagttgcggggcaaacagtgatcattaatggtggtgatagaacgatgaatacaaatgtaattgtcaagtatcagcaacaaacgcatattgcaacgacgcagcgaacggttacccggacgattaactatatcgatggtggaacactgcaacccatcgcgtcactacatgctgttgttcaaacggttaagtatcaattattagctgtggttgctcatgacggaacgatacttggctacgataccaacggggacggacagattgagacacaattggcagatgaagcatggttgattgttggttcagggccgtggtttggcgcggttaagtcgccagatctgagccatgagggctacgcagcgccggacctaaaagtagtgccggagcagatggttgctggggtcgatgataaagatgttacgatcaatgtttattaccgactagcaactcaggccgttacggtgtatcaaaataaacggcgcgttatcagctatattgatcgacagacccatcaatcgattgccacgaccgtccagcaattggttatttaccaacgaacagcaattattgaaaaaaagactggcaaatgtttaggctatgatttaaacggtgatggattagttgatacgagtcaagctgattatgcgtggattttagttggcagtggtcaatttgccgcggtaacgtcaccaacgctagtcgtccaaggctatactgatccggacataaggactgtagcggctcaaacggtcgcgattactgatccggacctgatgacgacaatcgtgacttatgaccatcgtattattacggtaacaccaggcaatcctgctcgaccaggacagccagttgatcctgacaatccgaatatcttgtttccagatgagtgtggcgacaccgatttaacgcacaccgttactagaatcattcactatgtttatgaggatggcacgacagccgcagcctcggtcctacaaaccgtccaatttcaacgcaatgcgatgattgatttagtgacgggcgaagtgacataccaagaatgggtaccagtctcggtaacggaaatggcgggcgttatttcaccaattgtagcgggtgccacgaccacattaacagaagtggcagcccagcaggtgagtgtcacaactgccgatcaggttgtagtggttacttacaagaaatcggcaatcaaaccggaagaaccgggtcaacctgagcaaccaagtcaaccggaagaaccgggtcaacctgagcaaccaagtcaaccagaagagccggggcaccctgagcaaccaagtcaaccggaagaacggggtcaacctgagcaaccaagtcaaccggaagaaccggggcaccctgagcaaccaagtcaaccagaagagccggggcaacacgagcaaccgagtcaaccggaagaaccgggtcaatccgaaaaaccaggagaactgcaaaaaccgagtcagccagctgattctgagcaaccagatggattaagtgatcaagccaatttgagtcgtaatcaggctgaacaatcacggacgtcacagccatcacaagcagagtcagatcaaagcgttgtgcagacgaatcagcagaaaacagctgcgtccgtttcaggtattggttgggttagtgcaccggcggtatcaaaacgtatcactaagcatcatcggatgacgacccttccccagacggacgagcagaatacgcaattatcactcttggggatgattggattagcattgagttcaattttaggttggctgaagattaagtcccgcgattaacagttgtgatatgatacccgttgtgagttgcggatctttaggaaccgggattgacggggttaacgttcctttgagggacagctagttttgaatgattaatataggcaatcactgacgtttcttattaaacggtagtgattgccttttatgatatcgtcgttggtacttttgatgcggtcagttgaccggtcgaaatggcgactaataactgagcaaaggaacgtacgcggcactttttgtagtgacactaaatgtcagacatatgatagtagcaactgggtggggcgtttaaaaaattaagggttatgcctaaaaataacatttatcgttgacaattgtaaacgaagggattaatatacacatatagattacaagtgtaaacgataatgagaaagggacgaataaaatgatgattaaagtattagtcttattaattggtgggttagcaattgggtttattctgtggtggttcttcgggaagcatgctacgacaacggtcaccgcgagtgcggttgatgatttacagcaggttgatgtggaggttaagggtggctattcgccagaacaaatcgtgttgaaaaaaggggttccggcggtacttaattttacgcgcaaagatgcatctggttgtctggatcacgtggtgttcagtgatttcggtatcaatcaggaattgccacaaaatcaagttgaagcaattacgattgatacgagtaagtctggcgaatatcaatgggcctgtgggatggacatgtttcatggaaaattaatcattaaatagtgggaggaaaatcaaatgagcgcacgacaacaaatcaatattacagtagacggccattatgacccagcagaagtaacgttacaacaaggtgtaccggcccaattaacgtttacgcgcacgagtacgcaggggtgcttagagcaagtacattcaaccgacttgcactttacgactgagttaccccttgaccaaccgcaaacggtgacggtaccaactgatcgagccggtgaatttcactttagttgtgggatggacatggtgagtggcaaggtggtgattgcgtgatgagcacgacgaaacggttttggatttcattaatattttccctgccactactggctaatatgattttgatgccctttggctggatgcttccgggtggtgattggacgcagttgattctgacgaccatcattatggctgtttcggctcggccgttcttgcaaagttcgtgggcgtcctttactaagcaccatgccaatatggatactttggtggcgattggcaccgcgacggcttatttttacagcttatacgcaatggcaacggggcaagcagtcttctttgaaagtgccgcacttgtgaccactttcgttttgctcggccaagtctttgaagaacgaatgcggcacaacgcgtccagtgcggtcgcaaagctagtgggcttacaagccaaggaagcggaagtgttacgcaatcaagaatttgtaaaagtaccgttggatcaagtagtggtcggcgacattattcgggtcaagccaggcgaaaaaattcccgttgatggtgtaattacaactggccgctcaacggttgatgagtcaatggtgacgggagaaagtatgccggttcaaaaaacggtggcggacgctgtcattggttcaacgattaatagtaatgggacctttcagttcaaagctagcaaggtcggtgaccagacaatgctggctcaaatcgttgagctcgttaaaaaagcacaaaacagtcacgcaccgattcaaaagctgaccgataaagtttctgatatctttgtgccgattgtgctaattattgctatcgttaccttcttgacctggtatgttttcttgaatgctagtctcgcgaatgccttgatttttgcggtcgctgtggtcgtgattgcctgcccgtgtgcgctaggtttagctacgccgaccgcactaatggtcggtaccggccgtggtgccaagatggggatcctgattaaaaatggtgaggtcttggaagctgtcaatgacgttaaaacggtgatctttgataagacgggaacgattacggttggtcacccacaagtgaccgatgttatcggcgacgaagcccaagtactgcgcgttgccactagcttagaggcggcttcggaacatcctttagctgcggcaatattaaaacgcggcacggcccgtggtattcaagcaccaaccgccacgaacttccaagccatcgagggtaaaggtgtgactgctcaagttgagggccaattagcggtggtcggtaatcataaattattaactgatgagccgattagtgctgaattacaacgccaagccactgagcttcaggacgcggcgaaaacggtcgtgtacgtgggcttaaatcacgaaatcattggattgattgccattcaagacgtcgccaaatcgacgtctgaggtagccattgcgagtttgaaagcacgtggcttgaagacggtcatgttaaccggcgataacgaacgggtcgcacaagctgtggcggatcaagtcggtattgatgaagtgattgctgatgtgctgccaggtgataaggctgatcacgttcacgcgttccagaaggctggcaaggtggcctttgtcggcgatggtattaatgacgcccccgcgttgacgacggcggatgttgggattgccatgggttccggaactgatattgcaatcgatgctggtggcatcgtgctcgttaagaacgatctgcgtgatgttgaccgggcgttggcattgagtaagaagacgtttaaccgtatcaaacttaatctgttctgggctttcgtgtacaacgtgctcgggattccagtcgcggcgggcctcttctttgccattgggctgacgcttagccccgaattggccggattagcaatggcctttagttcattgtccgtagtcacgagttcggtattgctaaataaagctaagatcagttcgaacgcccaacctgcgtagacgatgagcagatagcgtcggatgaaatcgggcttgttaaacaagcagaaatgtgtgttaatggtacaaaatatgcgggtgtctaacgccagttcacgttgttgagctggcgttagacacccgctttttgagtcgacaatttaaggaagaaaactggctataaattcctcacaatcagtaaaaaaaagagtattagatttacactaattaagtatcatatcgttagtgtaaaattagaagaatgcccatttaacggagataagtgtggtgttaaatgcttttgtaagcgcttgaatcaaattgtgtattgtgtaacaatattaattgtaagcggtttacatactatttgaaacgagggtttgaacatgaaaattaaagcagcagtggttgataaagtaaacgatccatttgtcattaaagatgatattgaattagctgaaatgaaagcaactgatttacaaatcaaaatggttgcgactggaatttgccattctgatgaagcaattcggcggggtgatgcgtcgttaggttatccagtaattttaggacacgaaggttctggaatcgtcgaaaaggtcggttcagaagtaactaattttgaagtgggcgaccatgttattctatcattttacgctgacggaacatgtgataactgtctgaaaggcatgccaactaaatgtcggaattatgccgactataacttgagtgggactcgtcccgatggttccgaccatttccaagaaaacgggcaccatatcagtgatatgttcgaccaatcttccttcacgactcatacggtagttgaccaacgtaatgcggttaaagtaccaaaagaactagatttacgtcgcttgggacctttaggctgcggctatgtcaccggaagtggcactgttttgaacagtttacagccgcgcccaggacaaacaattgcagtctttgggactggtgcggttggtttagcggcaatgatggctggtaagatttctggctgtaccgaagtgattgcggtcgacattgttgattcacggctagaactcgccaaagaattaggtgctactcacgccattaacagtaaggaagaagatccagttgaagcaatcaagaagttgacgcatggttacggggtcgactttgccgttgatacgactggggtagaaccagttatggtttctgcaatccacgcacttgctcaaggtgggactgctgctttgattgccgttacggccaaaaatatcaccattagctcatggaacgatttgtgtgttgatgataagaaagtcattggtgttaacatgggtgatgccatccctggcgttgatattccacggttaatcgatttctatcaacatggcatgttcccatttgaaaagaccgaaaagttctataagtttgaggatattaatcaagctaatgctgattcaggtagcggcaagaccatcaaacctgtcttgatcattgatgaagattatcaaccggggaaatagctgccggctgggtgccatcagtttatgatgaataacttctaaaacggcgatgtcaaaagttgattttgacatcgccgctttttgtgttaaacacaagccgcttggacggcttgcataatttgtgattaaaacgtgccgattcttaaattcaaaaacaaccagttatggaccgctgggaaaagttcgactcagcgtaaacttgtttagttagttcgtcctacaccgacctccaggcatttctgccaattgccggaacgtggtgggcacagatttaagccgaagcccacgtctcaaatactggcctttcactaaccaagcaaaggacgcttgctaagtgaaatttcaccactgggcattggccgaaacgccttccagtcgggacagtgttcgaatggcggacatgtgcgtacccaacttttggtgaattcgtcattgtttttcataaaccataattttgtcaatcaactgtcagggtgaaaatgatattgagatagctcactaatcctgaattggtgtagtaagatttaagctcttgacagagggcttaatacacctaacgctttgtttaaagttccagtatcaaatagcgaacaacaaattgtaccgagttcggtggtcgttcattagccatttgagcggcttcccgaaacgtgttcggggccactaaagcctgtgcttgctacgccaacggactaatgccaaaacagcattaatccgttggccaggcaatgctcggcttcaactcgtggcccctcacccagccccggaggtcggaataggacgcgcaccggctgacgaataacaatctaaacttggcacgttttaatcacaaatcaggacaaattaatttgcacaatgcgtgttctgatagatattcttatctgtgtttgtcggtttattgttgcggtgtttattttgaatagcgcgtccaaacgtggggtgcatggcattgccgagtaacgattcgagttgtagagaggtcccaatcaaataatcggttcaagaatttactatgaattcttgaaccgattatttgctgtgaatgatttagttaactttgaatgggggattacttggcatcatatgcggcttggaaaatcttgatgatgtcttctttagtgcctttgcgtgggttagagaaggcgttaccgtctttaagcgcattagtcgccatgtgttcgaagtcctcgatcttggcgccaatttccttgatggaatgcggaatgccaacgtcttcgctgagttgtttcatcgctttgatagctaattcggcagcatcacgagtcgataagccatcagtgttttcgcccataattttggcgagctcggcgaaacgttcggggcacgcgattagattatattcttcaacgtagggtaagagcagcgcgcagcagacaccgtggggtgcgtcatattggccgccgagctggtgggccatggcgtgcacgtaacctagattggcgttgttaaaggccatgccggctaacatttcagcttcgaccatgtgtgtccgggcttctaggttatgcccattggcgacggcttcgcgtaatgatgtttcgattaatttgatggcctggatgcactgtgaatcggtaatcggattgtgatcgacagaaacaaagggttcgatagcctggacaaaagcatccatgccagttgcggccgtgagtcccttaggaacatctagcatgagagtgggatcgttaaaggacacgagtggcatgttacgccatgaagcaacgacgaacttataatgcgtttcttcattcgtaatgacacagtgacgggtcaattcagaaccagtcccagcggtagtgttgaccgcaatcagtggtggtagggcattcttgagtgtttcgattcctgctaacttagtgatatcgtcgccgttagtcatgatgatgccggcaccttttccggtatcgtgggcagaaccaccgccaatagtaatcagggagtccgcttgattggcttgatataaggctttaacagcttgaatgttatgaattttagggttgggttcaacttgattataaattacgtagtcaatcccggcagcatccagtgaccgccgcacctgagcaacggcgccgtctggcagactttcaagaaatttgtcggtgacgatgactggcttgtgcataccaagagttttggcacgctcgccgattttactaatgacaccaggaccgaaaaagttaacgctaggcattaagaaatcaaaattacgttcagtcatattaataacctctttttatattgtaatcgctatcattactaatttacgaatcaaattatagtcgtaataattacaatttgcaatactttttggctaattaattatatttttcacaatatcgtttagaaaaggtgcggcaatcacggcatacctgttgtaaccaagtgttaaatgacggtgaactatagtcctcatgctatttgatattactgcctacaaaaagacgactaattacaaagattcacaatcttagtaattagtcgtctttttagtgtgatccaatagaaaaattgggttagtaccagtgatgatgttgccagaaccgtttggccttgacccaggagccgtagcgcgaggcgacgtaggtattagcacgtttttcctgattgacgggtgacaagttgccgtgtaagtatgagcgcaacaattgatagcgaccgtagcagcggccattacgagccgtataactgtatccagattcacgataggcgatccaatttttggcagcgcggttggctttcgaaagcttggcgttgatcttggcaatttgctgggcttggctaagcttcttggaggcctgggcggtgattgtggtttgtggtccaagactagtagtcacgttaacgacaaccccgaagacacaactagccaaaactaatagcaacatggttttaaagttaaattttttcatgatatgtataaccccgttttatattttccctaagctgataagtgtagaatacgccaattatgtgtcagctatgttaaagaaaagttactatgttattaaatgaacgtttccgttatgaaatagtttttgtcaataactgttgcggcaattgtttagatgaataattgcgctgactatcacatgaaaaaatcataatattgttaggaaaactaaagcgctttattgccttcgttcggtaatcttaaattggaatagctttacaaaagtattaaaggagtaagtgagggagtgcaataatggcaacaaaagataatgaaaagattacattgatggcgctagtcatgatgatctttacgaccgttttcggatttgccaatagtacggtggcctattatttaatgggttacagctcgattctattttacctagtcgcagccgtactgttcttcatcccgttcgcgctaatgatggcggagttcggggcagcggttaagtctgatagtagcgggatgtacaagtggctggaagtgagtgtgaatgcgaaatttgcgttcgtgggcacgttcatgtggtttgcgtcgtacattatttggttagtctcaacgtcagctaaagtctggattccgtttacgaccatcttctttgggagcgatcaaacgcagcgctttgcgatgtttggtctgaatgcgacgcagatgattgggattttgtcctgtctatggatggtgctagtgacgttcgtttccatcaaagggatgaaaggcattgtgcgggtcacgagtttaggcggcctggcggtgaccagtttgactgcaatcctgttagtggtttcgggggtcgttttagccttgaatcacggacaattcgcacaaccgttacaacatgtgatgacgtcaccaaatccaagttatcagcatccagtcgggttactcgggtttgccgttttcgccatttttgcttacggtgggctagaagttctcggtgggatggttgataagaccaagaaccccgaaaagaccttcccacgcggaattattatttctgccatcgtcattaccttaggctatggcctgggaatcttctgctgggggattagtacgaactggcaagccgttttgtcgaatccaacgactaacctcggtaatattagttatgtcatgatgcaaaacttgggctatgttttagggcaagcgcttggtttgagtacagcggccgctaagacaatgggactgtggtttgcacggtacaccggcttagggatgttcctcgcttacagtggggcgttcttcaccttaacttattcaccattgaagacgcttatcttgggaacacctaaggaactgtggccgaagaaatttacgaagctcaacaaagctggtatgccaagttatgccatgatggttcaatgtgccatcgtgattgtgatcatcttggtggcgtcctttgcaacggcagacgcgtcagccttttacaatgtgttgaccttaatggcgaacgtttcgatgacgttaccatacctcttcttgctatacgcgtttccgaagtttaaggaaaaccagaacattgttaagccttttgaagtgtacaagtcattggcttggacgaaaattattagttgggtcgtgttcattgtcgtcttaggcgcgaatgtcttcacgttgatccagccaatcttggaaactgggcagattcaaaatacgatttggatgctagttggaccaattgtcttcggtgtggccgggattatttggtatcaagttcgagaacggcatgtcaattaaataaccaatttcaaaataccattcgattgctgactgataaaacagcattgaatggtattttttaagtgccttaatatgggaaatttagtacactcattagcaaaagctatctagggggggatggtcatgacattgggaactgcgttaaagcaggcacgcaaagccaagcaactcaatcaaaagcaagctgcccggggaatttgtgcacaatcgatgctgtcagcaattgaaaatgatcgctacgtgccgaatgcccggctattactggcgctgtgtcagcgattaggggtcgcggttagtacgttgagcctagccgacgattttgagatcagtgccgagcaagcgtttaatgaccgcgttcggcagatgtgcaatgcccatcagtatcagcaattgaaggattggctattacagccaaccactttggaacatgttcaaacggatgagcagactcaggcttactattattatctgggtgtcgcctgttggcaggttgatcgcacatcggatgctgcacaacaaaatttacggctggcaattggtatggctgctcccagctcgccgccgacaacgttgacacgcttggccttgatttcgttagccgtcgttaaggcgcaccaccatcctcaagccccagtcgcggccttagtcacccgggcactcgctgacattgatgcgagtgcatatgaagaaaatgccaacattgttttttaccttgctgggttggtggcctatgaacaacatgattcccagttggcggtggcccgtttgacgcaggggttggcctttgcgactacacacgattcacactacatgctggctaatatttatcagttgatggcgcaactcgcaatggcggcgggggagactgccacggcgcaggttgccagtcaacggtcacaagttttcaaagacctgtttaaagaacaaattaacgaccgcctgtaaattatcagtattctgattttatgttggcgtccccaccgtgtattttataatcaccaactaaatacatgtgcacttgatctaacggtccgttattgatttggagtggttggccgtaataacgatgaccgggtcaggatgaacattgggggttataaaatgacaacagcattatttaccaatcaagtattaacacaggcaactccagcaacggtgcgagcattgctagcagatccgctgaacttaccagcatgggcgactgccattaccacggtcaagccaaccgcgacggggtacgtgttacagcggtccggttcggcttttgatcagccggaacagttgcaggttacagtcggcgctgaccaggtcgtttatcacagtgaggggggccaattgggatatgaaattgtgttcaccatgacgccattggccgagcgaactgcggtccaggaagaagtctcccttacgactacaccgccgagctggctaccgttgccactagtgaagcccgtcatgcaacgagactttcagcggaagttgggtcaattggcaacattagcggaggaacagccgaatgacgattaatgatgggatgacgttaataaaagtgttagtgacgtggtggtctgtcagttggttattacgggccactttgatcggcgttgttggaataattgcctatcgttttttgaagcagcgtcaatttaagtgagttaagacgatgacagcttttatgcctaatatctaatcgtaactattattatttagtgtgcgtttaactatcatccgaaaactaattccggtattctatgggtattcttttgaaggaggaaatctcatgaatcaaccagaattacgtgacccacgctatttatataagactgatggctttgataagcaggatcaggagacgcccgcactacaagctaagatgcgtcctgaacctgattgtggtgagaagagttaccaaggacatgataagttgttgaatcgacgcgttttgatcacgggtggtgattcgggaattggccgggctaccgcgattgcttttgcgcgggaaggtgctgatgttgcgattcagtacttgccgggagaggagccggatgctgaggcggttgccgaactagtgcgcgctgcgggccgtcaagcgttattattaccttgtgatttcaaggatgttgacgttgtgaccgacctcgtggaccggacaatcgctgaatttggtggtatcgacacccttgtcctaaatgcggggcaacagatttcacaaccttcactggctaagctgccgatcgaacaggtgcgtgcgaccttcgaagtgaatatcgtcgcgatgtttgcgttggctcaggcggccttgccaaagatgcccgctggcggtagcatcgtcaccacgacttcgattcaagcctatgcgccgagtggtcatctattagattatgctgcgactaaggcggccatcaagaactttacgattaatttagcagccgaagcggccgaaaaggggattcgggtcaatggcgttgctcccgggccaatctggacgcccttacaactagatcaaggccagccaatcgaggcgctgccgaaatttggccaagacaccttgctcaaacgagcgggacaacccgcagaactggcaccagtgtacgtctttttagcttctaacgacgcgagctatgtgaccgcgcaaatttatggcgtgactggtggcggcgtgattaattaggtgttcactgcaagttaattcctgattggcttgaataaatcataagtggctaccttggatggatacattcaaggtagccactttagtgtgtttaatgatctgatgaggcgttcattaagtaatccagcgctgccgttcccaccgctttggctgcaattagtaaacagtcttcattcatcataaaatcagggctgtggtgcgggtgggactcacccggagctggttgacagccggcatagataaaggtgctgggtttggcttgtgcaaaataggcgaagtcctccgaggggtcttgggggccgcagtcgaatattttagtaatttctggaatctgagcagcttgaatactggtgatgacgcgctgtgtcagggttgcatcattcatgagtaccggataattatcatcgtaatcaagcgcagcttggacaccgaaagtcgccccgacaccgttcgcaattttaataatctggtcacggattgtctggcgcgtggtttcgtccataatccgtacatcgcccttgagggtgacttgcgctttgatcgcattgaaggaaccgacgccgtcgaatgagccgatggtgacactgccggtatcaaatgggtcaatccggcgggaaataacggtttgtaaggcggttacaaagtaacttccagcaacgattgcatcgtttgagaggtggggcatcgaggcgtgcccacctttacccgtgaaggtgatcgtaaaattagcccgcccggtctgcgtcgcatttaagtgataggcaatcgagcccgtcggcatggtactcatcacatgcagcccaatgacgttatcgatgccgtctaggacgccagcagccaacatacccttagcaccacccggtgatacttcttcagcgggttggtggataatgcggacgcgaccacgtagctgatttttcagcccgagtaaggtcttcgccagtaccatgagataagcagtatgaccatcgtggccacaggcgtgcatgacattggcgttttgcgatttaaatgataagtggttgtcttcttgaatcgcgagggcgtcaaaatcagcgcgtaatgctaactgaggtccagggtgaccgctatcgatgtcgacgacgaagccgtacccatcaccataagcggtggttgagacgcccagttcacgatagaacgctttgatgtaggctgcggtttgttcttcatgaaatgaaatctcggggtgggcgtgtaagtggcgacgaatcttgatcatttccggctccgccgccgtgagttgttgcatgagttgtgcttgaagggtcattagaatcttcctttctgattgttagtcaggtgctatcgttagtgtatcatcaaataagaagattagtggcaatcacgcaatgagttagatcaataaattatggggcgtgaggtgtattaggaacattgattattactagaagttgggaccccttatttaatattaattcttattataaagtctgcgataactgaatgacgttattaggtgggatataaccgaacatcgtattcattatttctcgcacatatactgaattattatcatcgtaatctgattttgcaaaagatatgatatattgattgtcctgactgttaatttcaggtaccctaaacaggagaccacaattatgaggaggaacgattgatgaagattttgatgccatattttaagcggtatcgactagacgtctggattgcgatgctgtcggtcatcgtcttagtgtttgcgacgttatggcaaccgcgattattgcaagtcattatggaagccattatcaagaatgatcaggctacggtattccgtgaagggctgatgttgcttggtttggccgtactgggaatcattggtgggatcgtgaatacgatatacgcagcccgggtggcccttggtgtggcgaccgacttgcgagctgacctatacgctaaggtccagtcattagcctacgctgacgtggaaaaattttcaccgtccaacttagtggtacgaatgacgaacgatattaatcaagtccaacagattgtgatggctggctttcagcagattacccggattccattactattcatcggggcactgattctcgctgtgatgacgatgcctgagcagtggtgggtcattgttgtcatgatggcggtaatcttaggggtcgcactgattgcggtgcggcgaatgactaaatactttgcacaaacgcaacaagatattgaaaacgtcaatacggttgcccgcgaaaacttaatggggattcgggttgttaaatcgtttgttcaagaaccaaacgagatcaaaaagttttcggccgcatccgatgaattaaccgctgtgaccgctaaaattgggtactggttcgctattctaatgccagcgttctttttgacggccaacgtggcggtcggggtcgccgtttacttggtcggtcaaacgattacgacgcacccggcctatttagcagctattacgagttttatttcttatttaatgcagattttatttgccgtgatcaacgggggatttctcatgacttttgcgtcgcgggccgtcatctcacttggtcgaatcggcgaagtgatgactaccgaaccaagtatgacctacgttgatggcgacgcggcgcccgtagctggtgatattcactttgaccacgtaaccttcacttatccgggagatgcgcagccaacgctaaaagatgtgacctttacggtaaaagcagggtccatgctgggaatcgttggggccactggatctggtaagacgacgttggcccagctgattgcgcgcttgtatgatccggatagtgggacggtctccatcggtggaattgatgtgcgggccttaccagaaaaagcccttcgatccacggtggcctatgtcttacaacggtccacgttattttctggcacgattgcgggtaacttacggcaagttaagccggacgcccagcctagtcacatgcaatgggcggctaatattgcgcagtctgcggaattcattgaacggttgccacagacgtacgatgcccccgtggaagaacggtcacagaacttttcgggtggtcagaagcagcgactagcgattacgcgtggcgtaattgccaatccagaaatcttgattttagatgatgcgacttcggcactcgatgcgcgttcagaaaaacttgttcaagaagctttggatcgcgagttgaagtcaacgacgaccgtggtcattgccgaaaaaattgcttcaattattcgtgcggatcaaatcttagtgttagataatggtcgcatttcgggccaggggactcaccacgaattgcttcaagatagtgcgatttatcgcgctatttaccaaacgcaaaaagcacgggaggagggcttacatgagtgatttacgcaatgctggtaaatattactggcactatttaaaacgctactggttaggcttcttactaagtgtgattctgattgccttttcgacttggtgcattgtggtcgcaccgacttatctgggacgagccgtggaggagctgacgcagtacttgcagcagtggacgaatcaagcgactcgggcacaagcaagcttgcaaccgttcaaccggaccctgatcatctacgtcttgttgtatgtcggtgatgctagcacgatttttattgcgagcttgatcttagcacgcgtgacggccttttcgaccgggacaatgcgggtaggcctatttcggaagatgcaacggatgaaggttcaatactttgatacgcatagtgacggggatattctggctcggttcacctctgacctagataatatttttaatgccatgaatcaagccttgctagaaattttattagccgtggctcagtttgttggcctgctaattgtgatgtttaatcaaaacactacgatggcgtgggtgacgatggcttctacgccggttgcattaattatcgcggcgtttgtcatgcacaaggctggcgtcgcggtgaaccaacaacaggatgatatcggtcaactgaatggttatatcaatgaacaaattaccggtcaaaaagtcttgattaccaacggcttacagcaggactccttgaaaggctttcatcagtataatggtaaggttcgccagtcagcgttgacgggtcaaatctggtcaggtattttgaatccactgatgcaagggatgtcactgcttaacacggcaattgtcatcttctttggctcatggttagcgctgaatgggagtatgtcgactggagcagctttggcgctggtcgtggtgttcgttaactacgcccaacagtactaccagccaattatgtcattgactagtttatatagtatgattcagttagcgattactggtgcacggcgggtcgatgaagtccgtaatcaaccggatgaagtgagccccgctaacggtcaagcgctcgacgggattcatgatgaattactgattgataatgtgcgctttagttacttaccaggtaaagaaatcttgcatggcgtgtcgatccatgtgcaccgcggtgagatggtggcactcgttggcccaactggttcggggaaaacgacggtcatgaatttgttgaatcgcttctatgatgttgatagtggtgcgattacgtttgatggggtgaatattcaagactttgatctccaggtgctacggcaaaatgtcgggattgtcttacaggaaccccagttgtttacgggcacgattgcggataatattcgttacggggacccaacggctagtatggatcgggtcatcgatgcggcgaagcaggctaatattcatgactttgtgatgagcctgccagatggctatcagacgcgcgtttccgacgaacagagtattttttctgccggtcaaaagcagttgatgtcaattgcccggacgattttaacaaatcccaagttgctgattttggatgaagcgacttcgaacgttgatacggtgacggaagccaatattcaagccgcaatggacaacgtcatccaagggcgaaccagctttgtcattgctcaccgcttgaaaacaatcctgaatgccgataaaatcgttgtattgaaggatggtcaaattattgaacaggggaaccaccatgatttattagcggcaaacggcttctatgcggaactgtatcgtaatcagatggtctttgagtaatgaaagtataaggagtcggacatggcagggcaagagcaacaagtgcgggtttcaatcccagtctcagcattaaaacgagccgggattgatcgcgatgatcagttacagttaaaggtgcgcaatgacgcactagtcttagagaagattaagccacgtcaaccacagtggcagcaatacttgataatctggccgctgttggttgcaatcctatcggggttagccagttacgggtactggtggtttcaaaaagtgcgaccagttccactgacaggtgcgcaatcaatcgggagtttgacgattgtggccggtgtggttaccggcgcagtgctatttgtcggctttttcttaaaaacgcgtaatgatccagaaaatcgattttcgcgccatatttattggcggaactttccagttattacgattgcgtttattatgatcttagcctttgcgctggtcggggctttctgggtattagaattattatttccagatgtcatcttcgatcgctttacatctatgttgctactggtcttgtttacgtattttgcggatgcgttcatgattagcgctgcgttgacgataaatgcgcggtcgttatcaacgattttaacggtggtgattgtcagtggctgtgttatctcaatggccgccaatggtcaacggcgatggtggcagcataatttaagctttttagggacgcatgccgctgaaaattcctggcaattcaacttgacactgattttttcggcgttattgatggtcgttctgattgactatctatttgtttcacttagtcgaatttatccgcgtacttggcgaacgtcaaccttgcggatattgttgacgttgaccgctgtcgatttcggggcggtcgggctatttcctaacaacctgacgtttcactggttacatgacttagttgctggtggcttggtcacgttgttagtcttgttgattgtgggggtgcggtggctattaccagccgtgacgaaagattttctgtggctctcatacggcgttggcgtggtgctattactactcaactttggttttcgctggtttgggtatccatcgctgacggcatttgagattcaagcctttgcgatttcgtttggctggttgctgatgctattttcacgtctacaagcgttagtcaatgaagacccggaattgttgacgattaagttggagcaggaaagtacggcagggcaataagtgccacgttgttttgaaacggtggctgagtatattaataataattgaatcagataaaactggctgctagacacggtttaaagtgtctagcagccagttttattaattatggatgattgttgaagcgggttaggtgtaattgattacttttaaatgttcacatttagcgatgctgagccatcaatttgacttgtggcaacatgttatcagtgcccggttgagaaataccaaggctggtattttcgtatgctgttggctcagcaataatcttcatgattaaatcagcaatactagcgcgtgaaatcatggttcctttgaagcgttcacctttgtaagtcagttcatagtcaattttggtatcgtcggtcatataggccgcacgaataattgtagcaggaatatccgatgattcaattattctggccgcatgtcgcgtatcgtttttagcagcgtgaccgactacctgttcgacccaagcgccaaatggattaggggtttcgtggtagagtccggatcctgtgacccaaataagatggggcacatgattgcgattcattgacgtgataatggtctgtgccaataatgccatattcccggctagatttgcatagacgatatcctgattaggcataacagtgtctagtagctgtgaatcactgacatcaccttgaataaccgtttctcgttctggtgaagtgactagtaggcgccctgcatttcttaagactagtgtcaactggacgtcagtttcggctaagagtcgttgttccacaatccgcgcaattcgaccgttagcccctaaaattaaaaccttggtcattctgatcctcctcgtattagtgaatagtgtaaccaccgtcaacagcgacggcttgaccaaccatgtaactggcagcatcactgcaaagaaagagcacgacttgagcgacttcttctggtttagctaaacgccccatgggaatttcgcggactaggtcgtccatctcctgtcgttcagtatcatccattcgggcaaccattggtgtatcaatgattcctggacacacggcgttgatccgaacattccggtcagcgtattctaaggcgctactctttgtcaggcctaagacgccgtgctttgaagcgtggtaggcagttcgatcagcaataccaacgagaccacccattgaagaacagtttacgattgcggctggtgttccctgagcacgcatctgtcgtaattcgtacttcatactgagaaacatgccttttaagttagtatccatgacatgatcatattcttcaaccgatagatcggcggtatcggtgactggactttgaatcccagcatcgttataagcatagtcgaggtgcccaaactgagcaactgcgaatttcaccattccggcgacgtctttgggatcagcgacgttacacttgaatgaaacggctgagtagccatgatcgactagctgttgggcttcgtctttaggttcatgatggccagctaaaatgacgtgagcacctgctttggcgaatagagtggcagcactcaggccgattcccgtgcgtgcacctgtaacaataacgactttatctgtaaaattgaacatgactttctctccttaattaatcttcttcaaactgcattttaatatttcttgatgaacggaattgtttcaaatcgccagcattaatgtgaccaattttttgaaggttactaatcacttcgccagtttgctcataaaaaatcactaagctgtgtcgcggtgtccagtaggcgatatcaccaactgcatagccagtagtgtgtgcctcgttagcagggagtgcctgctgaaaacgatacgtcaattcacggttataaaggttgagcatcggcagtgttagtggtagttgtgaaagtaacgctgcggtggtggcattttcttccaaatttgctgtgaagtggcggtcgttggctgttatcttcattttcttcattatctagtacctcctaagccaatgcgttatattcgtcattactaacgggtgatagccattctggtgtgcctgcagtgatggcaatgtgactgaaccaactatctttagtagcaccgtgccagtgtttgataccgtcatgggtgatcaccacatcaccaggatgtaatcgctgtgccggttgcccggcttcttggtaccagccttcgccaccagtgactaataagatttgatagccattgtgatggatatgccagttgttacgggctccgggttcaaagctgacgttgctgacagttacgttgacttgctcgtctttcactagagcgttgtggtaacttttaccggtaaagtattgttgaaaagcaacgtttaaatctcccattgcaaaaatgccgtgttggacgctattttcattattgttcattgttaaaaacacctttcatttaaaattaattgtgggctaaaatttgaagctcggcttttgttagtacgtttcccactagttgttcacggaagtcgttgtaatagaagcggttattcaacggcaagttgtgcttgagtgcaaatacggatagtgtatatcgatgaggctgatcaggtggattcggtccggcatagtgatcggcgaaatacgaatcgtttaactgataaaagcgtgacatccatgagttttgaccttgggggccctcaaaattacgactgaaatcggctgggatttctgccatgacaggaatattggtcgcgagccagtgaatgaacggaaaacccgttcgtgggacggcgtcgtaatcaatgagcgaaatagcaaacgcagtcgttattgcaggaattgatttgatttcaattggaaacgatagaatcggttggcctgagtgtttgacgttcgcgttactggtatagattagtggtaaaaagccatcgtctaaatcaactttaatttgcattaaaccgacctcctagtaaaaaccaggtttgttccaagcagtattgggttcagcgacgccaatgctacttcgctgatataattggggattgtgaataatttcagtaatcaggtcagcaacggcttggcgtgtcacctgcgtatctttgaatggcatcccctgaggaatgaccttgtagtccgtatgctggtcattattatatagccaggccattcttaaaaatgtatagttcagtccactattatcaatcacggcagcagctcgcttgatttcagtataatcacccatcatttgggcattccaaataccaaatttaccagcgacttcatcgtaaatgcctaaaccacctgcgacaattaggcgctcgacaccattttgcttcatcgcatcgacaacattttgattggcggtggtgaaatgccccgttgccaagtaaacgatatcttgacccgcgattgccgccgtaagatcagcggaattattccaattgccgttcgtgagggtaacctgcgattgggcggcgtactgatgaagccgtcgagtagcttgacgagcaaatagtgtgagttcaacatcgttttttgcaagtaggcgtggaattaaatattttgaaatgttactggtagcacctaataaaataacttttttcattgtaagaacctctcttttaaaaaataagacttaataaagttgctacgcccaaactaagtacgaggaagatgaggcaaaattgccaattccaacgtaccgagacagttgctgagctgacatgtaacagggtcgcgacaatcatgacgatacctgcaaacggtgataacatgtatgcaacgacgcttccgatattcagactcaatgcgattaatagtggtgaaagggcaatgtgcatggtcataataatcttgccaattagtgctactgatgctagtgggtgaatgccaattagggaaaccaatacgacaataatgggaattaaaacgatcaataaccagccaaggtgagcaaagcttggtgctaacgcgtgggttagttcgctactgatagtggaatgttgaaaaccgtacgtgaacgtaccgattccaacaaagaacggcgcaagcgctgcaccgcttgcaattccgtgttgccaataatcaaggctagctttttttagtgcaaatttgaaggctgtttggcccgtagtcggcttgagccctaatgccgtgacccaaatcaggacaattagtaaaccggaaagtgtaacagcgttcattgaacttacgactttgctttccattaaaacaaagctgagtattagtagggcaataacggccgccactaaactgacaagtgatgcgtgttcggtaaaacgagtctgctgcttagtattggttgtcacgggctgaatccgcatatacggttggttatattccatcaaatacgctagcaataatcctaacaggcctaaaatcaggcatggtatgaataattgggtccacccgactttagtaacggtactgattagaaagattgttgctgctccaggtgcccataatgtgccgagcgtaaatccacgggttacggctgttgccgaaaaacgggtggcgtctttgacttggcgcttgatactgtcgcctagaattgataggacaatggcaacggtccccatggagagaatacttgatagtaggtgcgtgacaatcatgacaaaggtgaaggtttgtttggggccacgaatgtgcttttgcatgaatgcttcgacagtagcttggtagttgccaatggtgacagggattaagaaaagttgcataacaactagtaacaccacgatatcgaccattgaagtgattgccatggctagaccgttgattgataaacccgtagtacttagcagtcccaacccagcaatgaaaaagatcaatgtcgcgacttgaaaagagcggcttaagctttgaattccgagaattgagaccccgattgcaagcacggcatttaatagcgtcaagttgacggggacaattaagcttagtaactgaatgattattaggcttaaaactagactgtgataaatcgtcgctttattgatagaccgttccattcatgaatcgctgctttctaatattgatcgtggattgtcgtcatcgattagccttgctttgtcgggtaaatggtaaattcattgacgttgacgtcatctggttgtgcaactgcgaagtcaacgacacgggccactgcatctggggtgataccgacggatgcatataatttattcataccttgcttagcattggtatcggtaatggtgtgcaataattcagtgttgatagctgccggatagaggctggtggtccgaatattggtgtgttcttgagcactttccatgcggattacttccattaaattgcgtactgcaaatttagttgcaccatagatgccggaaccagcgaaactcttaagcccagctactgaagatgtcgtaatgatttgaccatacttttgattggtgaaatcaggcattactgcggcgacaccgttcaaaacaccttttaagttcacatcgatcatggcattccattcatcagtttttagtgcactgattggtgaagtcggcatgataccggcattattgaaaatgacatcaataccgccaaattctcgctttgctaaagcaactaacgctgttaagtcttcaggcttagtcacgtccgttacgcggtaagtggcttgcccaccttgttgctggattttattggctaatttctgtaggcgttgttcacgccgtgcacctaaaacaactttggcaccatggctggctaacaatttggcacttgcttcgccaatacccgatgaggctcctgtaataacgataactttgttttttactgacatatttgtttcctcctgattaatttttttgtttatttaaaatgtgatggtaatttaagacgtccattgtggaaaaatcatgaccggaaagctggattttttcaccatagggtgatagtgaaatttgattgtgcccaataattttccaagtaccggaataaatattagtgacgtgatgttggttctccttccacttgtgatccgcagtgaaagtgatttgttggtgaatatctttgttgtggtgattgatccaaacaccaacgacatccgcttcggtcagatgcgagttgtccgaatgggtaacacttgtctgttgcttggtggcttggttagacttgtcggtggttggtgagtgttgctgaactgcatagacgatgacgacaagtgcagcgacggtaacaataatttgaaaaatagtttgcataaactttttgttcaattaatcatctcgtttctgatgtgctgtgcctcaactacaatgactagtatagccagcaacgtgcctcctgagaagaatccgttagttagcttagtattaacttttagtttatactagaaggctaggaggtgaccgttgtggattttaatcaattacagacgtttttacgagttagtgagtatggtagttttacgaaggcgggggaacagagttttatatcgggtactgcggtgatgaaacagatcaaccggctggaagcggagcttaacctaaaactattcgtccgaactgcgaccggggtccaactcacaccacagggtaagaagttccaaccgtatgtgcaacagttgctcgatttactaaacacggccattgaagagacgcgacgggtccgttcagacgataagcaactgattttgttgggaacttccttactacatcctgctgatgccttcatgtcattatggaaagaactggcaccaaagatgcctaaatttcagattagattagttcaattgcaggaagacttgaattcgagaaatcgtgagtatgcgatgcttggtcggagtagtgatttaatcgttgggacgttcgatagcacaactttgaagcagtcctttagtgcgatacagttgggagcgtatcactttggaattgctgtccgtagtgataatccattagcccagttggatgaaatcatgtacagtgaccttgcgcatcgtaaagttctgatggtgtcaacgggaattagtgagaaaaatgatctggttcggagtgaaatgttggcggcagaacctagtattcagccaattgatactagcgggcgttatgacatcaatacgtttaatgagaccgttgaggagaatatcgcaatgatttcgcttacgccgtggaaaagaattcatccgaatttagttacagtaccgctgaaaacgtccgtaacagtaccgtatggtctattaagcaccaagttcccgggtaagaagacggcagattttctacatgaatttacgaagttggtcccgactgaaacgcagagccactcataaaatgacattaaaaaggcaactgttcgtggtcacggtacgtgctggtggactttttggggtttgagtctaatttgaaacttgcaatcatttgttaacgaatactggcattcaacctgagttaaatgtggtctgaaaagagccccatggtattgttgaagtacgtgagtattaagtttgcattgacatattgtaaaatgattttctagaaagttgtagaagtttatatctaaatcttttgagctactctctagatgcatgatttgcaattgcaatcagaaatgatataaagtttttaaactttaggcttgactataaacgaatagacgtttattatacaagacatgcgatacaaagataacaacaaaaaagaagcgatttatcaagcaacaattctgcttttaaatagagacggcttttcatcaacctcaatgtcaaaaattgctaagcatgctggtgtttcagcttcaacaatttatatctattttgagaataaagatgatatgctgaagaagttatacttggatactaaacagaaaatgagtacccaaatgttttctgacacgacagatagtgatgcaaaaactggtcttgccaaggttattcgtaactatattgattatattgtgaataataaagatgcttttctcttcttgcagcaatttacgaattcaccttatatgagtgaatttgatgatcaggaagcaagcaactactttacgcccatgtatcaaatagttaaaagcggccgacaggagggaacatttaaagatgtggacaatgatatattatttgcctatattgagccgccaattaccgaattagccaagcgttattttagaggagaatcaagttttaccgaggaaagaattgaagccttgattaggttagcctggagtgctattaaaaaatagcactttcatttcgctcctatagtgaacgtctattcgtttattatagagctaaatttcacaatcttttattcgcatactactaaaaatgactggagatattatgatgcaaaagaaagtgacttttcagaataacgaacacgatatggctggtatcttattcttcccagatgactttgatgaaactaaacaatatgccgccttcccagttgcatcgccagctggagctgtgaaggaacaaattgcaactaactacggttcaagattagctaagtacggctttattgccttagcctttgatacttcacatcaaggtgaaagtggcggcaatcctcgtcaattagaagcaccttatgaacgtgtagaagatattaagtgcgctatcgattatttaacaaccttgccttacgttgataatgagcggattggtcagtttggcgtatgcgctggtgccggttattcgatgcacacagccatgacggatcgtcgcattaaggccgttgccgttgcaagtatgagtgatccagcatcatggattcgtgacggatttgatggtaaaagtcccgttgatgcacaattggcactactagaagaggcttcaaaccaacggactcgtgaagctaatggcgctgacccaatttatggcacctttgttccagaagaagtcactgagggtatgcctaatactttggaagaggctcacgaatattaccggacggcccgtggtcaacacccacgttcaactaaccaagtatcaatgatgtcaattgacaaaatgacggatttctcaaccttcctatttgctgatcgttatttgacgcaaccgattttgatgatcgctggtactaatgccgacacattacgtttctctgaagacttacttaaaaaagcggcttcaaagaataaggaactatttaccattgaaggtgccactcacgttgatttgtatgacaaaccagaatacgttgaccaagcagttgcaaaggctgcggccttctttaaagaaaacctttaataaaaagtaaccaactcaaatgacgaagaaaggattggttgatattgactgaatcaaatggaaaagtcgctttgattacgggcgccgaccgtggaattggatttgaaactgccaaagaattaggtgcccagggctacacggtgttaatcggtagtcgcaacttagagcgtggacaaaacgcagtggataaactaaaagcaatggatattactgctgatacccttcaaatcgatgttactcagcgctatacgattcaaaacgcagctggtcaaattaataagatgtaccataaattggatgtattaattaacaatgctggcattgccatggcggacgacgtactaccaagtaccgtgagtgaagaggttctgcgtaaaacgtttgataccaacttttttgggagtttcgtagttactcaaattatgctgccattgatcaggaagtctgatgctggtcgaattgtcagcctctcctcttcggttggttccttagaatggcaaagtcatcctattgaaggtgcaccaattaacccggcttacgctgcatctaagaacggcgtcaatgcgttgacggtgatgtttgctcgcgaattagccgatactgatattaaggtaaacgtggctgatcctgggtggactgccacggacttaaacggatttaatgccccacgtagtgtcgcggaaggcgcaaaaattgtgattaaactggcaactttacctgcagatggtccttctggtctactgattagtgaatctgggaaagtcgcttggtaagtcgtaatacagtgaggtgatcaaagtgaacgcgcaggtcgtttatttttcaaatagtggtaataatgaacgcttagctaaaaaaatttctgcttattatacaatcactgcaacaccaatcgtaccagttaacgcctatccgactagttatgctgctttaactacgcaggcaaagcgtgaacggtttcggcatgttgaggttccaattaggccgcttgaacttaaaatggataccagtatgttaattttagtatcgccaatctggtatgcagatttacctcgcccggtagttacttttttgaagcaacttcaacgatcatatcaacgagttgtttttatcagtgataaatttatggtggggttcggtacttgtggacgaactttgcgcaaatatttaccagctacaacgataattgaaaaggtagcagcaagtcgtggcaacttctctccgattatggcaacccttggaaaatagtttgagaggctgtgacataagtctctagaaacaaaacaggtctggaaaaatccgaagatttttccagacctgtttttgatataatagaaaataaaaaaagagcatcggtcgcacccgatactctacgaaattatcctcgaaaggacattcctaatatgcaagattattataacatgaatcaaaccactttgagtatcgccttggattaccaaccagaagagcatcatcctgctcgttacatcaaccagcttgttgagagtttaaaactaaaatatgattaccagtttggccgtccgcgggaatataacctcggtaccatgttaaaactggtccttttagcgtacagctatggcattttcagcagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgacctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttggataaacgacgtgataaaatgcgtgaacaccaagcacagcaagcaatctatggtcagcgtaacagctactctaagacggatcacgatgccacctttatgcgggtcaaggaagatccgatgcaaaacggtcaattaaaacctgcctacaacgttcaaatcgccacgagtaatcagttcattacgggatatcggcttttccaaaatcaaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcgacggactgataagtatggttttacccgtgactttaaagaatacattgccgaaaagtatgatgaaaatcatcaactaattgccgcggcactaacaccaaaaggatatcttaaaaggatttccgtgaacgaaaattgggaatatttcaaatcgaaacaacgagaattactttcagctccagaaactggtcagatttacgctcaacgtaagatcgatgttgagccagttttttggcaagatgaaggcttctttacatttcaatcgattctcggtgcgaggtttcgacaaggtcaccaaggaagccggaatcgtaatactggcgttaaacattatgaaactggtcacggtagggaccaactttaaaaatcaaaggcgtaagcaaatgggacgagaaaccaaaattcggtttctcgtcccatttgcttatacagaggctagttatgtcacagcctcttttacatagttaaacaagtaaaaataaaaaatgaaattaatgcttgcgttggagtgaacttcaaggtttatgatttcattattgattaacacaacaaggagtcgatatgatgaatacacaattaccgaagggccgcggcgcaatttctgacggcaaagatacaaacttaaatgaagcacctactcgtttcatcacaaagaacgctaaaactttagtgatctatttttctcggagtggtaatactgaatatcaagcaaagatcgcgcaaaaggtgcttcatgctgatagctatgaattaattgccaagaattcatatccaacggattacgatgcaacggtcagccgttcgaatcaagagcaagccggttcactgccacagttagtaactgatgatttacctaactttgatcagtatgatttgttactgcttggtagtccaatttggggtatgacacttgctaatccgatgcagaagttcttagaacaatttggtagtcaacttggtggtaaaaggattgctgaatttacgactaacgcaggatttggtgctggaaacgctcagcgagttttaaaagaactcgtacccgtttctgcgactattttgaacgattatacgattagagacactgaaattgaaaaaacaaatgaccagtttaaagactggcttcaacaaactgaggagaaataaattatgaaaaatgtattaatcttagctgctaacggacaaattgctcgaattgttgagcagcgaattttaactgaacccgcttttgatcaaattaatttaaccttatttttacgagatgcgtcccgtttatccaagtatgccaataattcacgcgttacgctaattgaaggcgacattaccgaaccgcaggctgttgaagatgcaatgcgcaatcaagacattgtttttgtcgcagtagttgatcatgatcctaaaaaccgaattactaataacgtgatcaacggaatgcgtgcaaataacgttaaacgggtcctttctactaacgtgttaggaatttaccaggaagttggtggtgaatttggccgttggaatgcgatgatgatcagtcatggtatggaaccagcaattgtttcagatcgtctattagatgcttctgggcttgactacaccactttaagattaccgtggctaaatgatcgtgacgaaattaaataccaaattacgggtaagaatgaggcttatgttggtgtttcaggatcacgtcaaagtattgctgatgcagttttacaaatcatcgcagatccaactaaatatagtcggacgagcattggattggctgatcctgataccgagggtcagggccgaccggtatattaaaacggagtttggttttattgataagcatagataacaaacttataatgacgacgattattggcgctatgtctttaatcggtgtcagtaagaaaggtggtttaatacatggttaagcgaacactaggtacgactagtccgttaacagttgatgcaattggtttagggtgcatgggcatgagttccgcttatgggaaccccaaaagtgaaaccgagatggttcaattattgcgaaaagcagttgaattaggtgaaacgacttttgacacggctgaggtttatggaccctttactaacgagctactattgggcaaagcttttaaggggtatcacgaccgtattaccatcgcaactaagggtggtatcaaggtcgttgatggaaagcaagttgtggatggtaatccacgcggtttagtggcctcggttgagggatcgctaaagcgattgcagttggatgcgattgatatgtattacctacatcgggttgatcccaaagtgccgattgaagaagttgcggaaacgatgggccaattaattaaagctgggaaaattaaacactggggactatcagaagctggtgttcaaacgattcgtaaggccaatgcgattcagccgctaacagccgttgaaagtgaatattcgctatggactcgcgaacctgaaagagagttgattcctactctagaggaactgggtatcggcttggtaccttttagcccattaggaaaaggatttttaactggaaagattgatgtcaatacgacttttgataaaaacgatggtcgtaacaagttacctcgttttcaaaaggatgctatggaagcaaatatggccttggtacacctattgcatcaggttgccgaaagtaagcaggcaacacctgcacaagttgcgttggcttggttattggcgcaacagccatggattgttcccattcctggtactactaaattatcaagattacaagaaaatatgggtgctgaaaaaatagtgttcagcccatcagaaatgaaaaatatcactatggctgctgatcaagtgcagattatgggtaatcgctatacaccggaacttgctaaacgagcgggattataaaaataattgcaaattacgcttgcgttgaagtgaactccaaggtttattctatattcatgttgttagtaaccgatacaaatttataggatcactcaaaaaaaacaaaaaagtgtttgcgttggagttcacttcaaggtttatgatttactcacttaagaaacatgtctaaaacatttaagaaatggagaatttaaattatgacgatgaaattacaagatgttgctgttgaagacttacctaaaattaacgataatccatggggattagtttaccaagatgcaattactaaaaatgaacctggtaaagtgaacatccacccaatcagttatattttaaatggcttgaagattgcagctaatgtatataccccagctggttacgatccaaagaaaaaatacccggcattaacggtggctcatccaaatggtggtgttaaagaacaagttgctggtttatttgctcaacgtttagccgagaatgggtacattgccattgctgccgatgcttctttccaaggcgcgtccgagggtaccccacgcatggtagataacccagcttaccgggttgaggacattcacggtatggccgatgccttatctcttttcccaggtgttgattatgatcgcatggccgcttttggtatctgtggtggtggtggttacaccttacgtgctggccaaactgacaaacgctttaaggttgttgccacgttatctgcatttaactcaggactagttcgtcggaatggttttatggattctgaagcaaatacgattcaggaacgtctccaaaaggcctccgatgctcgtgaaaaagaagttaggggtgaaggtgttgactataccgctgatttgaaaaaattaacacccgaagaagctgctaagttgccatacgatttgtaccgcgaaggctatgactattatgcccaaacacacgcacatccaaagtcaacctttgtttacactcaaagtagtttcatgaacttaatgacttttgatgcttctgtaaatatggaccttattaatgttcctttactgatgatggctggttcacaggcagatacgttctacttgaccgagaaagcttatgccaatgcaaccgggacttcggacaaggaactgttcttaattccaggtgcacatcacattgaaacttactggaaacccgaatatgtcgaacaagaactcagcaaattgttggacttcttaagtactcgactttaatcacaaaaagtaaattagtttttgaaggcttacaaggtcacgccttgtggccttttattttaagaaaggaatggcctggttcaccatgaatttgtcttaatgacagattctaatggtactaatcagtccctagacaggagtacggtaaattatgaagaaaatcattattacggctgggacacttatactagttggtgtggcaatattaattggtgtattgttgtatggttctcaaaagtcagcaaataaatcacgccaattgattatttacttcacgctctccggtaacaccaaaaaagccgccgaggcattacaacaagatacggacgctgatattattcggcttcgccctaaaaaagcatacccaacaacgtatgatgcagccgttaaagttgccaaaaaggaattagcaaccaagacgcacccggcaattgctaccgcaattctcaatttggaacagtataaaactatttatgttggatttcccacttggtggcggcaaccaccgatgattattcacacattatttgacaccgtaaactttaaaaataagacgattgttccttttacaactagcatggaatccccgattagcagctcggtgccgtatctacaaaagatggcagacaaagatggtgctaaactagttaaaggaattagatacacgaataacaacaatttaaaacgatttttaataaccaacgatttaataacaaaatagaaataggtgaaaacgatgaatattaatggtgtcagtaaagaatttaatgtttctaaagacacgctccgttactgggaaagggttggcttattgcctgaaattaagcgaaatgccagtggttaccgagactattcagaacgggatctaaattgggtttattacattcaggttttgcgtaatggcggcatgtcaattgaatcattaattgagtttgtgaagttgtatcgtgaaggaaatgcctcgaatgatgtccgcaaaagtttacttgttgaccaacgtgatactatgcttgaagagattgctaacctacagaaaacagttgattacttacaatataaaattgatcacttcgaagaccatacgttgaactacgagaaggaaaaattggcgttagatgataagtagtatttgggttgtcgttgtccaatatctctttttctattagaaaaggtgcccgtctattgttgaaatagcgggcatttttaatataactatgactaagatatagttagaaaagctcaccaaaaagaatgtgtgttcgtataatggaggtataaaggttggtgagtttatggaaaacattgttccccgcgaaaagtggctttacaacgatcgtggcatgatgaattggatggggtggattttggctgaccatagtgcgtaccttgaaagcgagcaaaaacatcagcaaattaatccggttaaacctgagatgacgattgctgaaatcaatcgactactgcaatcgaattggcaacagcgcatggccattacgatacagttaaacgttatccggcaggattggtacgcaccagccgttactggcaccgtagtgggctttaacgacgagtgcacatacctccaactcacagatggcgcgttaaaggctgttaaagtgcagacgattcgcaacgtttcactagcagataggacgaagtggtggttatatgacgactccatttgatgatccgagccgcttacccgttcgggacattatgtgtattgattgtaaaagcttttttgcgagtaccgaagcaattcgtcgcggtgaatacccgttggctgctaaaattgccgttttatcccgtgaagaatttaatggtgggcttattttggcagcctctcctgatactaaacgggactacggcgttaaattgggaaccaggaaatacgaaattcgaccagaaatggatattgaattagcatcaccacacatgggtgattatatccgactgaattatcgtattagtcaaattgttcagcagtttactgacgaacaacactgttttatttatagtgtggatgaaatgtttgctgatataacgcattcccatgccctgtatgggtctaatgatgaaattgcggccagattacaggataaagtatttcaggaaaccggcattgtcacaactgtcggcatgggccctaatccgctaatggctaaattagccttagataacgcagctaaagtacaagctccgtggcgtgcgtattggggttatgacgatgttccggagacgctttggaaaattgataatttgaccaacttttggtcgattggtgctaaaacagccgctaaattagaaaaaatgggtattcactcaatttatgatttggcccatgctgatcggcagcagatcaaacgaaaattcggtgtattgggcgatgccttgtattttcatagtattactctgacttagccaagtggtatgtcccacgtagcgataaccgtggctatggtaatagtcaggttttgatgcgtgattatcgaaccacggacgatattgaaacggtattatttgaaattgctgatcaggtagccacttgtttgcgtaaacaccacgttcttggagaagtaatcggactttctgttggcttttcagaaccagatgaacgtggacgtaatggctggtcagcgcaaacaaaagtggatcccaccaatgaaactaacgacttaattcgtgcagtacggtacttgtttgaatcgcggtggcaaggtaacgcacttcgtaatttaggagttcgagtaaaccgaattagtaagccgaccacctttcagacttcactttttgccgatgaaaaagtacacgaagctagaacgcactattgatcaaattcgcgctcattacggctataaagcgattgtacgtggttccagtaaaaagttctctgggactgcaattgaccgtttatacttatttggtgaacgggtgcctttttggggcttaagtctaatttgaaacttgcaattatttgttaacggatactggtattcaacccgattttaatttataattagtcaaaagaacatatgttcttttaacgacaaattattgagtcaggtttcatccaaaagtgagtatcatgggggcgagcgacatgcggctatcgttaaaattcgatcagcagcatgagatttattttggattaccagcaaaatgttaaggtgaacaacgactgcgattgtgtcgattaattggaagggagtcattatattgatggaacagcgaacatacatggcaattgatttaaaatcattctatgcctcagtcgaatgcgttgctcatcaactcgacccattgaatgccaatttggttgtcgctgatacgagtcgcactgataagacgatttgtttggcggtttcgccagcactaaagcaatttggtgttccagggcggccccggttatttcaagttgaacaacgggtcgcaactttaaatcgcgcccgtggtcgccagacttcctatcaggcggttcggcggcatcgctcaatttatcgtgatcagctcctcaaacatgctaatttgggtatcgattatcgggtcgttcccccacgaatgagttattacatgcagaagagtgctgcgatttatgatatctatttgcgcttcattaagccggaacacattcacgtgtactcgattgatgaagtcttcatggacgtcacagactacttaagtacttttcaggtttcaccgcacgcactggcaaagacgatgattcacgagattcaggccgagaccgggattacggcaacggctgggattggtgctaatctctacttagctaaggtggcgatggatattgttgccaagaagattcccgctgacgctgacggtgttcggattgcacagatggatgagcagcaatatcggcaatacttatgggcgcacgagccgttgactgatttttggcgagtcggtcatggctatgctaagcggttggcagccctggggctcaatacgatgggtgacattgcgcgttgttcactaggaaccttgtcggattctcataatgaagaacaattatatcgtgagtttggtaaaaacgcggaactgttaattgatcatgcgtggggctgtgagtcgacaacaattgctgacatcaaaaattaccatgctagcgaacatggtatatatgccagtcaagtgttgatgcgaccgtatacttatactgaagggcaagccgtgttacgcggcatggtgaataatttgacactcgaactggttgctcgccacgtggtgacagatcagttgggaattcgtattgattacgatgctaatgcttcatcagttggcacgcattatcagggtgcggtcaccgaagactactatggacgacaagtaccaaagcccgctcataccaaggtgacattagcgcaggcgagtgcttcacaacacgagctaggggctgcgtatcaacagctttatcaacaagttgttaatcgtcaattgatggttcgacgtgtgaccgttatggcgaaccatttggtcgacgaacagcaggttaggcgccaacctcggtatcaacaaactaacttatttgaaaatccagaagtggcccaagcgcaagaacgagacacacaacgccaacgtgaacgcgatgggcaattgcaacgcgccattttgaaattacaatgtcgttccgggaataagaatgtcgtcattcgcttggcagatctaaaaccgagttcaactacgattgaacgtaatgagcagattggggggcatcgtgcctaatgacaaaggaagccagtactactgcgttatttaatgatacgagtcgctatgcggatattttagagtgctcgcgacctacttcaaggcatttaccaatgccccaagcagaccgtgctgcccaatttgcgccgttcgcggcgttgactggttatcatgacttgattgaaaaacgcgctgcaatctatgcccataaacactatccaaatgctcaggataaacgagctgtggcaacccagttgaagcagattgcagcgttaacaaaccgtccattgctcaacgtcgattattttaacgataccgttggctattatcagacggtaaccagccagttggtgaagctcgattggcatcaagctcggatctatctagcggcaccaaccagtattgcgatggccaatatccgtagcgtttccatagcgaatcaatcctaataaaggacggctccaatgactaagattagtcgttagaaccgtccttttgagattaatgattatttatttcgcggtgatttgcatccgcccgtgctttttagaatgatacagattggcgtcgacgcgttgataaaaggccgttggtgattggtcatcagctgctaattctgataggccgaccgaaatcgacagctgaatctgatgatcattaactggtacggcgatatgattgatagccgcaaatagttgttcagcgaccgcaagtgcttcagttaaatcatagttgggaaagataacgttaaattcctcgccaccggttcgatacagtgcgatttgcggattgttggcacgacagacgatcgtagccacttgcgcgacgtgctgcagaattttgtcgccagccaagtgaccataggtgtcgttgacttgtttgaagtggtcgatgtcaaacatcagcatggtcaattgtgagccgtttttccgactgcttgtaacctgataattaatggctgttttgtaagctgcaaaattttcgattttggtcagagcgtcgtgattagcgaatgcaaccagattctgtttgaggtgtgcattggctgacaacatgctggcgtagatatagagtaaggaagcaaagacgagtaggtaggtccattcttgccaataagttgcccatgataagttgaacttaagcttcatgaaccaccagagaacggccccaaaaccagcacaagtgactaaataaagtgcgacttgtccctgtttcgtttggagtgggacgtgtttacgcaatcggccgagcgccgtaaagaagaggatcagtgtgacggcgtgtccccacgattcccagtagtacagagagtgattaaaacccataaagataaagacaagcggatacaagtaatagtagcggacgcgtacattgagaaagtagccacaaaaaatgagtgcgataagctggaaattcatgaaaatccaggcgtcgttctggcccacaacggcagcttgcatcccaaggacaaatatcatcatgtaaattaagccgtaccagtcagtaataacagattggtcaacccgccaatgatgggtgttgaagaagctaataatccaattttgtgagacccaaaaaagggtcagcacgcctaggatgaaaaaaacacttgtaataaatggagttatctcccaatgtgaccaagtcatacgcaaacacctttcaaatcgcaaaaactgcgttggttcgaattaaatgacgccggtataagtatatccctttaactgctaaatagcgactgtgattatggactttaattggctttttagccgttattatcaggaaaaatcagcgggtctcgcgctagatacgccgaacggcaattaaagcagcgcaacaagcctgggttaaggcttaaaatgtccgagttggtgcggtgagcgtgggggcagcatcgttgacgaaggccggggagtcgtcgtaataatacccagttggtcgggacgtgccgtaataaaaccggtgtttaccagccaagcattaatcgttaccggaccgacaaatttaaaaccaacttgttgtaagtgctgtgcgatgcgatcgccagtaattgttgtgcgcgggagttcatcataatactggggctggataattaattgttgatggcccaattgttgccagagatagtctttaaaagactgtgtggtccgaatttgttgaatcaggcgggcgttgtgaatcacggtttcgattttacgacggtttcgtatgatggccgaattgctgaggagattggtgatttgttctgggcgatacgctgccaccacctcaatttgccaggcgtcaaatgctgcgctgaatgctgagcgtttattgaacacgacggcccagttgagaccagcggcaaaaccgccaagactcagaaactcaaataattgttcatcgcgctgaagcgggataccccattcgtgttcaaagtaataccggtagccggcatcgtacggatagtaacgattgaatagtggatcatcatcaaaccagttggtaatcattaaacaagcctcatttccaaatcaattagtagacactaactaaatacggtaaatgggtcggaaaacatgtggataaaaaaacttttccaatcctcctgagaatggaaaagttaacttaaagcgtgttcaacgatgatctttgattacaaggttagttggcatgtggcgaacggttttcgtcgcgtggtcacgcttgatctgagctagaatggtcctcatactgactgtggcagtcaaatcttttttaaaagtatgcacaccaaagctgtcataagtgacctggtcatttttgagtgtgaaccagttcggctggagttgcttggcatctgccttaatgtgtttatcagaccaaaccagatacttagtttgcccctggtcagtgtaaatttcgacctgccaacccaagctgaaatcactaacttcttgccaacgctgaatctttaagtgcttgatcgcgtaataaataatgcagctgtattttaaagcaggctgtttagcaatggtcgtttcggtaatcggttgtggttgttggataacgcgtgatttgtgaaccgtagttgtggtggctcgcggggtgcggtgtaggttgcggtgtagggtgctgagaccaacaatggtaccgataataagaacagtgataatcggaatcagaatttttttcataagaaactcctaacgaataaaattgtaaaacgtaaatattactatttacaagaatggcatttattgctatcctttaaaacgtaatgattactatttaaaaagggagtggcaattgtgaaacgtttgtggctattactaggtggacttgttattggtgggggcttgttaacgggctgtcagtctaagtcaacgactgctgaatcgcataaggtcaacattgttgcgacgacgaatttttatggtagtgtggcaaaagctgtcggtggcaagcacgtcagcgtgacgtcaattatcaacaaaccgtccgttgatccccatgattttgagccaacaccaaccgtggctaagatggttggtcaggctgatctcgtcatcgctaatggcatcggctatgatggctggatgaacaaggtcgtgcactcgacgcaacgggccaaattgattcgggtcggcgaggacgtgatgcatcgcaaggaaggggctaacgagcatctctggtatgacagtgcaacgatgcccgccaccgcgaactatctcgctaatcagttggctaaaaagcaaccccagtatcgcacgtattttaaggccaacgcccgcaagtacatcgccacgcttaagccgattcaacaggaacaggccaagttacgagcgaaggctaacaagttaaagaatcggcaagtgttagtcagtgagcccgtctttgattacgcattgaccagtttagggtttaaggttgctaatcaagactttgaaaatgcgattgagaagggcactgacccagcaccgcaagttatccacaagatgcagcaggcattaaagagtcggcaagtcgccttctttgtgaataacagccaagttagtgataaattagtgactaacatggtgtcattagccaagaagaatcaggtgccagtgttgaatgtgactgaaaccatgccagctaagttgacttatcaacagtggatgttgacacagtatcgccagctcaaccagttattgtccgattaagggacggacctgcaaggcgacgacgcccgattgcgcaacttggacgggggaatacaacgttagcatttcttgaaccatctgtgttaccggcgttcccggggcactgccgacttgaacggcggtgtattcgctcagtaaggattcaaaactagcgaaacgcgtgatgtcgatgagctgagtggtgagctgctggccagtcgtcagatcgatgaaatttacaatgtcaccgacttgtaaggcttggcgttttgcatcgtttaaacggatttcaattgttttgagccccgattttattaacagccattgtggatgaatcaattgcatggtggtcattgaacgtcctcctaatcagtttagtcttaattatagtggataactaacgaaataggggcctaaataatggcaatgatgtgcctgaacaccggatattagtggtaggtagctggcgcctgtctataattaggttaacaatacaagggggatggcacaattggcaaaacgaacagcgattccagttagattacaaatcgttggcacgatgagcgcgttaatcatcatgtatgcgtggggccgctcactaatcggccagccgttgcaattgggcaatcaacagtttacttggttagggttggtttacttgaccggcgcttttctattcttgttagtggccccatggctgaccaatcgcttagcgttgacgccgtttgacttcatagcgatgacggatcatctggcaatggggtggttggggtatcttatcctaattttagtcgttccgatatggtttcagccggccaattccgggcttacactcggcgtgctttccagtgtggttggtggaatttgtatggatgttccacagaatgtgacctggggtatccgggtaccctggacgtacaactcgccagtgatctggaagaaagtcaactggctgaccggactattgttattaatcgccagttacggcatggttggcatcggctgggtatggcccacactgttcccaatctatcaagtgagtgccattgtgggaattatcgtgattgcgttgggttatgcgcaccatttagcccacttgacgtaagttgtgttggtgattattaacacggcaaattgatatacgcggatcataattaggggtcgcgagtggcacaagtcacgttaatcgtggttagttgaagcgttgttaacaatcgttgaacggcaaaaaaggctggaaaattccagccttttttagtgtctttttaatagagggcccaggcttgcatgccttgtgcatagtacaagttaactgcggcgtcgatttgttgttgaacggaaccaccactaatatggatgttttgaaataaaccgtatgcaccacttgcaccgttaacgacgtgtggttgccagttagattcacgattgatgatgtgattccaagttccggcgtcaacaccagtccgtgcttgcatttgaccgagcacgtaactttgtaagttatcacccgaatagctttcagttgccggggtagttgctggtgccgaagcaaccgtctcgttagtttgtgctggtgttgtttgagtcgtagttgcggcctgtgtttcagctggctgggttggtgtggtgaccggtgcctgttgaactggcgctgaaacgaccggtgtcgctggtgcttgactagtaaggtcctgggcgttcgcccctggaatccgtaattgttggcctggtaaaattaaatggccgtgaatgttgttggctgtttcgattgattcgatcgtcgtcttatattcttgtgaaattgcccagacacagtcacccttcttaacggtgtaagttgcgtcggcgtgtgcagaaacagttccggccaatagtaggccaaccgttgcagcggatgttgttaagattgtggttaataattttttcaagttatactctcccatttttgtaagcaatcagcgtgtcgtacaattgttgatcaacaaaaattagtatagcggcgacttattactcgcatgtgtcgctaattttaagaagcgattgcgagattctgagaaaattatggggagcaaatattttactgaatagttgaagactatcgtgacgggacgtatcggtgacaatatatcggctactaatataaaaaatatgacagaaatagcaatataataattactgaaattaccgatagttgagccagttagcaaaaatagcggcaattacaatgtttaacgtgacattcccaatattaaatagttaataccggtattgttcttataagtttaaaagggtgttgattatagaaagtaatttaccgcaacaaaaaaagtcgggaaggattcccgactttgtcttaatagttttagattaaagggcccaagcagccataccttgtgcttcatataaagcaacggcagcgttaacttgttcttcaacagaaccactgctgatgtgcatgttctggaataacccgtaggcaccactagaactgttgcggacgtatggttgccagttggattcacgcgtaataatcgtgttccaagtcgaagctgagacaccagtccgtgattgcatctgacttaaaacgtaactcttcaaattgctaccagtgtagcttgaagtcgtggaatcagttgaacttgttgaagtggtcgtcgcggttgtgttgctagttgaactagaactagtcgttgaagcacttgaactcgttgtgtttgaagtcgttgacgaggtgttgttatcagaactggctgaactcgtcttaatagatagtttttgaccaggtaagatgtagtgacccttgatgttattagtcgtttcaacatgattgatagttgtgttgaatttttgtgcgatggcccaaacggaatcaccgctcttaacggtgtaagttgagtcggcgttagcattgaggacaccggcgaataataaaccagcggctgcagctgaggtagttacgattgtacttacaagttttttcaaattagacactcctataaattttgtgattatcgattaaataagttactgacaaaaatcttaactgcgatgtcattcgcaatcaacagaacccagtctaacgcctccgtgttacttgttagtgtcgcgagttttaagaacgcaatgcaaagattacaagaatacggacttttgtaatcttcgtaaccgaactgtgactttgaaaaaggctggttaaatcggttgataggggacagtgacaagctaagttaatcaagttgaggtttgcctaaaattaacattatgacgtgaaatcacccaaaattcagccataaaaaaagccgattattttagtataatcggcttttagtgcttgaaaatggtgtcaaacacggctatttaacagtttattccgtcactggaaatggatctgctaaaccgagggcttgtttttcagacttcgcttgagcaatttcctcttgcactaattcacgcgcgtgcggatcactatataggtttaatttgtaatccacttccttcagattcttcataatttgggcttgctgagcgagaatggcattgcggtgagtcgtcagcagttctcgtcgttgtgcaatcgattggggacctgccatgacataactgatatattggcgaatagcactgattgccataccggtatttttgaggcaaataatcgtatgtaatagatgaagatcgccgtctgtaaatgctcggtagccggattcattgcgactgacaaagggaagtaagccttgtttatcataaaaacgcaaggtgtacgcacttagtccgaccttatcagcgacttctttaatcgtataggtcaaaaagattcctcctaacacttgccttagagtattgtctaaggtttatattagctatattaacaagccatgatgaaaaaaacaaccaatattccgggggaattaaacatgaataaatcattagtattagtcactggcggtaatggcttcttagccagtcatatcattaaacaattattaacagcgggctatccggttcgggcaacgttacggtcgttagataaagcagctggtgtgaagcagacgctagcgggtacacctaacttagatcgattgacatttgttgctctggatctgacacaggatcagggttgggccgaagcaatgcgtgacgtgacgtatgtgatgagtgttgcggcaccagtatttgttaatcaaggtcaggcttctgatgaggtcactagtgcggccaaggtcggcacgatccgtgttctaaaggcagcgacggcggccggtgttaagcgggtcgtcatgactgccaaccttggtgccgttggcttcagtcgtttggatcatgatcatcccgtcactgaagtggactggacccgcgaagaccaaccggggctttcgttgtatgaaaagtcgaagttggttgctgaagaggctggctgggcgtattgcaaggcgcatgctgatagtccagaattcacgacggttaatgccggtgccatgcttgggccatcgcttaatgggcacgtcacgggtagttataatctagttagtcggatattaactgggcagatgatgccaaaccttaaagtcaatgtcatcgacgttcgcgatgtcgctgacttagaggttcgggcgatgacggcgcctgcagcggccaatcagcgttttctagcagtggccgccacaccaatctcgatgcgggacctcaaaacattgattcaagaacaacggccgcagttggctgcaggcctgacgaaacatttgattccagactggtttgtgcgggggttagccccatttagtgggcaattacgcgagtctagtttgatgatccgcatcaatcacgaggtcagtacccaaaaagcccagcaattgttagggtggcaagcgcgctcagctgatactgcggtattagccgctgtcgatacactggttaagaatggtttgaataaataggacgatcaaaacggtctagcagtagtatttactgccaggccgctttttgtagctactttagtggcaaccggacttagttattttaacaaaagtatatatttttaaaataaaagtattgattttgaaatagaaataggatagtattatttcacgaggaaagcgttttccaaaataaatgacacagaggaggagtttgatggataaggagcgacagatgcccaaggattttttctggggtaattcagtgtcaagtatgcaaactgagggtgcttgggatgaagacggtaagggccgttcagtttatgatgttcgtcctgcgacagcaaccacttcggattggcatgatgccattgatgaatatcatcgttacgaggaagatcttgatttgatgaaggacttacatttgaatatgtatcgaattcagatttcatggtcacgagtagttccagatggtgatggtgagtttaatgccgctgggattgcgttttatgatcggctggttgatgcgatgctggcacgggggattacaccgatgatttgcctgtatcactttgatatgccgttagccttagctgaaaatgaaaacgggttcatgtcgcgccacaccgttgatgcgttcgtccgttttggtgaaaagatgattgcccattttgctgatcgggttaaatattggatcgtgttcaatgaacataatttatactttaccgacgaagtcttcaacatttcagggtacaccaagggtgatcaaagtgttaacgacttataccggattttccaccatactatgttagcgcacgcgcgcctagatgactttgttcatcagaactacgatgacgtgaagattggtggtatgttagcttacaccccggtttatccagaaacagctaagccaattgatattatggcggctcgtaagagtgacgaatttttgaacaacaacttgaatgacgcttacgtgcacgggcattattcaccagaagtcctgcgttacgttgaacaacagggcatcgattatgatttgcaaccaggtgatgaagcaatcattggcaaaatgaaagcggattttttggcttttagttattatcgttcaacggttatcaacggggataaaatacccgttgatgccgttccgaatcgttatctcaattattcatttgaggccaaccgctttttacaagctaatgaatggggctgggcgattgatccactcggtttccgcaacttgattaccaagttgtatgaccagtacgaagtacccgtgttcccgattgaaaatgggattgggttacgcgagcactgggatggccagcatatgatcgaagatgatgagcggattacttatcatgaagaacatatcaaggcgatgaaagatgccatgttgatcgacggcgctaaggtactaggttatctcggctggggcttgattgatattccaagttcacacgcagatatcgaaaaacgttacggagttgtttacgttaaccggagtaatcatgatctaaaagacttaaagcgggttcccaagaagtcatattattggctgcaaggggtcctagcaaaaaatggagatgaattgtaatggaaaatagtagtaatggtgctgttagcaatttcattaacaacaaagttttaccgccaataatgaagttcgttaacactaaaccagttaaagccttacaagacgggatggtctacgccttaccatttattatcattgggtccgtattcttgatcttatctaatattccaattccagctgtggctgctgttattaaggcctctggttgggcagcgttctttaaccaggcctatacagtaacgtttggggttctttcactttgggcggccgttgggattgcctatgtgtatgtgcgtaacgaagggtatgaaccactgcccgctgggttaacttccatggccgtattcttacttttgcaaacgcttaacattgccaatccattagtagctgcgatgggtaaagccggtactgggattaccaatgctgctgggaatgtcgtgatgtcaggtagcgccgtttcacagaatatcgataaattaccaaaggtcctacaaaattttgtgcaagcacccgttactggggttgttaatattacctggctaggtggccaggggatgatcgctgccattattgtcggtatcttagttggttgggcttactccgctatgattcgtaaaggttggaagattaccctaccagaacaagtaccagccagtgttgccaaccaatttactgccatgattcctgccggggtcatcttgattgttgcaatgttaatctttgcggccttcagtgctttcggtaatactgacatgttgcaatttatttacaaggttcttcaaacaccgcttcaaggattatccgattcactcggtggtgcgctggttattgcgttcttagtgccattcttctggttctttggggtccatggtgggttgatcatgggtgccattactagtgggttactgattccgaacacgttcgacaatgcttcattatataaagcaggtaagttgaccgttgcccaaggtgcccacattgtaactaatgaattctacaataacttcattaacttaactggttctgggattacgatcggacttgttatctttacgttgtttgctgctaagtccgttcaatttaagacgattggtaaagttgaatttgtgccagcattattcaacattaacgaaccattcttgttcgggttaccgatcgtgatgaacccattcttggcaattccattcttcttgacaccggttatcgtggccttatccacttatctggtcatctacttcggcattgtgccaccattgaatggtttcgcggcaccgtggacgaccccagcaatcatttctggcttcctgattggtggctggaagatggctatctggcaaacaattacgttggtcatgtcaactgcaatttacttcccattcgctaagaagtacgatgctatcttaacgaaggaagaaggcgaaaaggccgctgcggaagctgctgctggtaacgctgaaattgaaaagatgtaattatagaaaggaattaaataattatggctgaaaaaattattatgttggcatgttctgcgggaatgtcaacctcactattagtgtctaagatggaagctgcggcaaagcaagatggtgttgattacaagatctttgccacctcagcggctgatattgaccatcaactgagtcaagatccgcatcccgatgtcttgttattaggaccacaagttcgctacatggcgaatgacgtgaagaagaagactgataaggctgggattccaatggatatcatcaatatgtccgactatggcatgatgaatggtgaaaatgtcttacaagcagctgaaaagttactcggcgacagataattaggatttaaccgggaaagtcaatgcaatcgtgaatcaccaacgtgtgcggtggttgctttaacatgattgggacttgtccgagtgataatcaaacactaaccaaatcctagattgttttggtggtgggcatctcaggatgttatatatgttacgattcctcactggctaattgctggtggggaatttttttggtggtggctgtggccgcgatacggtactgcgagggtgtgcaggcgagtaagcgagagaagcatgtagtgtggacgttactttggcagtgcttaattttaaaggacggctgctgattcaaaatggctattaatcaaacaaattaaataaaacccttgacctgaaacccgttcgagcagttaggataaaggtaatcaaagaacggtagctggccagcgccattatggaaatctattcatcaaattcgggagggttttatcatgggactattttcatttggtaaaaaagttaaattatatgcaccagtcgatggcacactgatagatttagccacagtcgctgcgggtcagacggggtttgcggtgacgccagaacgccaccatatcttcagtccagtaacgggaaccgtcagtgccctgattccagaacaaaatgcgatcgaactggcagctggaaagctgacggtacggttacgaatgggtgttaataccagcgcaactccggcaacttatgttcatgaaggcgaccaagtgacaccagaaacaccactcgcttttgtggatcaagagcaggccgctgaaaatggggaggatatgacggtgttggtggttgtggataaaggtgggcaacccgctgaaaaaatcagtttatccacaagtggacaagtgagccacgaccaagaagttgccacggttgttgctaagtaggacggatgatggggctaatcgtgtgtaattgtttgcgatgagctgagtcagaaggaatttcatcgcgtcaccacagttgattgatgcaaggtcaactagcaattgcaatgcagttgttaaatacgaaaacacacttcaaagctgctacttttgaagtgtgttttcgtgttcagttgatttttgattggcggttgcaagcaattcaatctgccgcagaatgagcctgtccttgtccacaagccatcagttcagcttggtaggcatcattgatgcgattgagtgcttggtgaaattccgtgataactttgttcatttggcgctgatacttttcatccaacgaataaccgttttgaacttgagttttaggccccgttgtttgattcaagtacgcctttaagtcatcgtctggctgtaacttttcgtataaatcgacattgtctagtaagcggacgatccggttgtatttacccgtaaaggtccgccgaataatctgtattcggtgacgaaagacatagcaaccggcctgaatgacggcttgaggttctgggtaggttgtcgtttgttggtagtgttggacgatttcaggaacaatctgccgaatcgcattattgatagtcggtgtaactaaggccgccgcgattttagttgggtcggatacgccctgttcagtctgtgaggccgaactgaacaagtcactagaaagaatgttcggattggtcgtagttaggtccacatattcccatagtaggacattgaattctgaatgattgagaccaccattttgaaagacagcggtgacatattcagtcaaactaccgtataaaaggtaattagtggatacgtcaaagtatgcagctactttagcgagtcggtccgcgttagctagcgtacgtcccttttcccagtcattaattgtgctttttccagccaagccaatcgcagatgcaagtttggccatacttaaaccagcggcaattcgaagttggtgaatacgattaccaacttgttgtttatcaatctgcaatttgatttcccccctgattggttcttagtatattctaacatagggagggaagcgctcgcattgttaacactgaatatattagcactttcgatgattggcgtggtaacgacagataagtagtatcaagtgcttagtgatacttatgaataattgtcataaaagcggtgctattatttaccggccagccgtctagttggatttcataaggttgttccgtaccaggataaatatgaccgggaatcgcaaccttttgccggtggtcgtgaatgatcaggaaaaacatcgcaggtcgacaaaggatggtcacgtgtgcggccaggcagtcgctaagcgtggctgctaaatgctggcgaatggtcgttagtcccgcagccccttcattaataacgattgaccaatcgaatgccaagtctgaataggcggctaatggtgttaattgttgcatgttgaatgcctcctccaaggtattaattagactaaatattactattagcatacatgcaaatagttgtgatgacgaccatctgcgcttgttatggtcaattaataagctggcttaacagagatcatgcgacaagtgtaaattgccagcgtatactagaagtattatgtgcaaaaggaagtgtcgagaaatgcaacaccggattgctgtgctggcagatattcatggaaacttgacggcgcttaatgctgtgttggcggatgcgcgtcagcaagccgcgacggattattggttcctcggtgatctattcttacccggcccgggtgccgaaaagctctaccagaccttagcggacactgcgccgtcagtatggttgcaaggtaattgggaacaggggattaatgcggtcatgactggaaacgggcgactggatgatccttcacagatttattttgcacgattgaccgcgtatctggtgacccatctgagcaaatcacattacgctgaattagtgcaacggcccattgcgacaacgatggtcgtgaacgggttaacttttcaactggcccataatcagccggaacgctcgactggtcacgacctgtatccggatgaacgccagtctaattttgatcacctagctggtgatgcggatgtggccgtttacggccatacccaccaacaaattatgcgggtgagtcagcggggccagctcattattaatcccggggcgacaggccaaccttatagtccatacgctaagttcatggctgatcagcgtgctcactatgcaatcttaacggtggatgacgcgggtcgaatcagtgtggattttcgaaaagttgattatgatattagccttgagttgaccgttgcgcgtgaacaacaattaccatatttagacttatatgaacatcttcgccggactggttttacgagtacccatgaccaagccttattgggcaaactgaacgctaagtttaattacgctaatgaggtacgacgattttttggcatgcaagcgtgatagttagtggtaagttagtgagttaactcttataatgattgaacaggatacgaggagggttttcatgaactttgcaccatcagaatggtttggctttaacaagcgagctagacatgatatgacgtttactaagactatcaatggcgagaccagtaccaagcaagtgtacgggcactttaacgtgtgggccctgttgttcacgtggttttatgcgctgttcagtgtgcggtgtcgaaccccgtttttcttactgaaaacggcggtgccattcttaggcatgctgtcgttaaatatggtgacgcagctgttttttagtgaccaagttgtcatgagtatcgggttactaggcgatatttggtatggttttatgtttgagacgtggtttagaaatcagctggttgcaaatggctatcaacaaacggcttagtgcgacaggaatagattagcttatcaggcttcccagcaagacgtggggagcttttttgattggggtcgttgacaagcttctggctagtaaagtatcgcaacataaataatatcgtttctttacaaacatctgactaaacactttacattccttaactattcttaaaagtgcagtttgttttacgataaaaaagatggagtgataattttataatgataaagccgcgtgttttaacgaccttattagtttgttcagcaatcttaacaacgacggtgaccccggccgtcgctgcagtaaccccaatggcgactccgagtgagcaagttgccgaaccagttgccagcccggccgttccaacagcaaccttgagtttggcaattcaaaatcaacaattggttgatttaattgggcagacgcagtggcaaacctatgggcagcctgccgtgacgaaggaccctgaatttaacgaccaagtgttgaacttggatggcaaatcagcgttttacacgaccttcacggatcagcagtttgcaaagttacagaatgggatggcgatcgaggcgtactttaaatatgatccagccgccgatgccaatggtgaacatgagatcttttctagccaacagggtggtggtttaggacttggggtgcaaaacaatcaagtcgttttcttcgcccatgatggttccggctataagactcctaaaggcaccttacataaggggcagtgggtgcatgcggttggtgtgatcgataagaataagacggctagcttgtatctggatggccagttagtccaacaagtggctatgcccggtgatttaaagctggcacaaggaaccaaagactttgtgctgggtggtgatgcggttcctggaagtcacgttcagtcaatgatgaccggtcaaattagacaggcccgcttgtatgatcagacattgacgtcgcaacaagtaagtcaattgaacgttgaagcacaggtcggcaagcagccggtcgcacccgtaccagtcgaccaaacgattgcgacgaagctcgttggcccgaagcgaattgcgagtgggcacacttatggtcttaatgtacacgcccggcaaatcaaagctaccggtgccgccccaatcaccatggatgtcgtgtatgatgcggctaagtttgactatgtcggtgcagaacgtctcttacaagggggaaagacgcagatccaactgattgcgcctggccgtattcgcctgactacgacggcgaacctttcaaaagctgaatttaaaatgtatgcgcaaacgcggttagcgcaccttaatttgaaagctaaggccgctggtgagacgcagatcaagtttgagcagctaactaaagatacaaccattgaactagggccagctcaaactgttgaaattcaaggtaagtacgcgctagattataacggtgacgggattattggtgttggtgacgtggccctggcaaacgcagccgataaagtggcagccgccaatgcagctgaaatcaagccttataaacacgtggtcgttttaacgactgatggtggtgggaacccctgggatccgaagggaatgtactatgcacaaggtgcggagcaaggaactaagactcccgtatggacaaccaacccagaaatcatgaagaaacgtcggaatacgtatacgatggacttattcaataagcagtttgcaatgagtacgtcagcgcgggccgtttcaccagcggtttcggcacaaaactacatttccatgttacatggtcggccatgggacacgctacctaaggaatatcaagggactaacgcgaccatgggacaagaatactttgcagactttaacaaaccacaagcaatgttcccatcagtatttaagatgttacaagccgataatccaactcggggcgctgcggctttctcagaatggggaccaatcgtcaatagcatcattgaaccagatgccgcggtgactactaaacagtcagcttcgctgaaatcctttgatgatgtggctaactatatcggcacgccagaatttcaaagtactgggttagtctacatgcaaagtgattatatggacggtcagggacacggtcacggctggtacaatgacaattactgggataagtacgcgcaatatgatgcgctgttcaagcgagtaatggataagcttgaagcaaccggtcacattcatgatacgttagtcattgccaacgctgatcatggcggttctggcaagaatcatggtggttgggatgaatataaccgcagtattttcatggcgctcggtggcgaaacggtcgataatggccgccgtttgcatggtggaagcaatgctgatatcagtgcgctcatcctgaatgctttgcaagtcccacagacaccacagatgtttgacagtcaggtctttgactcatcggcttttcttaagcagactgacctatcgaagaagaaacgttcagttgaaacgttaaagctcagtcgcaatgatcaggaagcaaaagttcaattgactcataaccaaaaccggcaactgacggcatttgatctgcaattggacttagcaggtcgggaagtcgctgacgttaaggttccaaccggcgtgcagattttacggcagacggtcgctaatggtcaattaagattaacagtcagtgccagccaacccgtgactgacctggtgacgattaaactcgtaccaagtaagacgcgtgcggctaagaccatcatgttaagtcaagcaatggctgccactgccgacggtacagaagtgcttgtggatttggataatgataatccactgacgagtacggctaaacccgacgaaaacggcagcacgacgactaaaccagatggcaatggtactgcggtcaagccggatgaaaatggcagcacgacaactaaaccagatggtaacggtactgccgttaaaccggatgaaaatggtagcaacacgactaaaccaggtggcaatggtactaccgttaagccggacaaaaatggtagtagcacaactaaaccgaatggcaacgggactgctgtcaaacccgacaagcatgaaactagcaccacggggagtgggacagttaatacatcaggtgcagacaaaacgagcaccaacgacaatggcacttcaatgacggccggtacagctagttcgcatgcaagtacagtcacggatcgggtgacgagtggcacggtattgcctgaaactagctcgagtgcaactactaatcatggcagtcattcgacaggtcatcatggtagcggctggttaccacagacaggtgaagcggtgcaacgctggctagcagtcgccggcggtgtgttcctcatgctgactggtgcaatcgcggtttggtggcggaagcgacgcgcctaggtaaatataacttggcacgataattttggaagtaagcacggatgaggcagtttctgggaacggtgtgtttctcgaaactgccttttgtgcacgctgatcaacggtggtgatgtcggttgaagtaccagagcgaaccaggttgtaatgtcactccttaataattaatttcaaattatttagcctaatagttagtttttgctgttatagtctaactaaagtgctatgataagattcaataaaaataaggtataagattttttccacagttgtttttttggtaaacttaatgactaatagtcacagttaaagcccttgatataaataaaggggagttggcacacgatattgacgtacagtaaggtagggtgagcgaggatgagctacttagaattaaaagatattcacaaggcctattatttaggcaaggaagctttcccagtcttgaatgggattaatctaacttttgaacgaggtgaattcgttgcgattttaggggaatctggcggtggtaagtcaacgttgatgaatatcattggtggcttggatcggcaatttcagggacaagtgttattgcaaggaaccgcgttagatcatcaccaagagaaacagatggatcagtatcggcgtgaaacagtcggttatatttatcaatcatataatttgatcaaccatctgtccgtgttagacaatgtcctgatctcgttagatatgaccaagttaaatcggtcagaacgtgagcaacgagctaagcaactgttaactcaggtggggttagcggatcaaattaaaaagtacccgaaccaattatctggtggccagaagcagcgagttgcgattgcccgggctttagcgagtgatccgcagattattatcgcggatgaaccgactggcgcattggattctgaaaataccacggaagttttgaaaattttggatcagattgcggcggaaggtcggcttgtaatttgtgtgacacattcgcaggatgttgcgaatgcgggtactcgaatcgtgcgcttagctgatggtaaaatcacggatgacgagcgggtgaaacccgcttatccggtcgatgaaaatcgccaacagattgcggcacgtaagttaccgtggtatgtgccactgaacacggcgtttaaacatctacgctatacttggacttggaacttgattattatcattgggacagcgattggtttattcgcagtgatgttgtttaacgggttaggtaatggcctcaaggggtatattaatcaggaaatcaatgatatggtcaatccccgtgtcgtgacagtgagtcggtatcaaaaatcgagtcaaagtcagcgaggcggcagccaagaaggtaaccagcaggcagctgccatgggggcgagtgtggcgacgaccaatcagccaacgttcagtacggcccaactgagtaaactgaaaaaagttgcgcatgttcagaccgttcagccaattttgagtgcaagcaacgcgacaattacagttggtaataaagactacaccgcttcatcgttaacaacgtggacggcttctaaccggaagtcgattattaaagctggtcacgtggctggtaagaatgaaatcgtcgtcgataagagtagtgtggcgaagaaatggtcatctaagaattggaagcaattggtcggtaagaaagtgactgtggcttttcagacaacgaataagagtggtaaaagtgtcacggttaaacggcaattaacggttgctgggatcacggacagcacgactggaagtggtgtgaacgccgtgacctacgccactatgaaagatatgcggtcagcaaagaatttaagtacgcagccaacttcagttgcggtgaaagttgattcgcgggagcataatgatgctgtaaccaagcagattaataagctaaagattgatggcaaacgggtttaccgtgccaccagtattgccagcatgcttgatacggtcaatacgtatgttaacttagcaaccacgattttggcggcaatcgctggaatttccctactagtctcagcgttaatgatcattgtgaccatgttcatgtcggtcagtgcccggaagaaagaaatcggaatcttacgtgcgctgggtgaaagtcgccgtgatattcggcgattgttcacgagtgaatcattgatcattggggtcatcagtgcactactagctactggaattgcttatggtattggagctgccttgaataaggtcctctaccaaatcgccagctacaatatgattgagattcaggtaagtaatattatctcgacctttatcattgccctggtgattgccttattagcagccatcttaccagcttggcgcgccgctcggttgaatccaatcgatgccctcgccgctgattaagtaattgtgagtcattaactaaaatagtctgttagtaaaacggtaatgaagcccagaacgggattcattaccgttttttgtgcgtggggcctttgatgctaatttgctttacatatgtcgaaattgacatataatgaagacaactaaatagaacacacattgcgcgagccaatttgtcatgaatcgtgattaaaatgtgcaaagtttttaagttcaaaagcagccagctatggaccgctggggaagttcgactcagcgtaaacttgtttagttaattcgtcctacaccgacctccaggcatttctgccaattgccggaacgtggtgggcacagatttgagccgaaaaaccacgtctcaaatactggcctttcactaaccaagcacaggacgcttgctaagtgaaatttcaccactgggcattgtcagaaacaccttccagtcgggatagcgttcgaatggctgatagggatgtactcaacttttgctgaatttgtcgttgtttttcaatctgacagttttctcaatcaactgtcagattgaaaaagtcttgtgataactcactatttctaaattaccgtagtaataattgaatatttcgaaaaagtggagaaggcactctgatatttaactgaaagggttcagtatcaaaatagccaacgacaaattgtaccgagttcagtggccgttcatcagccattcgagcggcttcccgactggaggggctggtgacaatgctcagtagccaaattattcttagctggaagtgggttgcttccggcttaggacgcgcaccggctgacgaacaacaatctaaacttggcacgttttaatcacagttgatgctaaatactagcacaacgcgtaaagaaaagtgggtgaaatgatgcattatggggttttagcgttaacgtttttgagtgtcaatttggattttttcttgatgttagtttttttattgaagaagtatcggttgtggcaggtcttgttgggctatttgttgggcaatcttattctactaacggcaagcttctttgtgggtaaagcactgaccttatttttgccagaatggttattaggattcttgggtgtgctgccgatttggcttgcgtttcacgacgatgatgatgataccgccgatcgggctggtgggtcgccggtgattaacgtactagttacttatttggccgtatgtgctggttgtaatttatcgatctttttacctgtgctcgttggggaaagcatggtacactttgtgatgactttaggatttattggtatattgacgatgcttgtcgtgcttatcattaaccaggtggcggaaatcaaggctgttcaaaagcaaatagcggctcatggtgaacggttgatgaaaatttgttacgtggtgattggcttatatgttttctgggatagtgggctaattagccatttaatcgcattcctatgattggtgagaacggaggaattggcatggaggtcagcgggccactattaactgaggcggctaaaatatacaaagtattgagtaatgttaatcggattaaaatcctaatttttttagaacaccatgaagcggacgtcacgcaaatcgttgaacatgttcatttggcgcagccattagtctcgcatcagttagcaattttgtttcagtatcagttggtatctaaaacgaagcgggggaagcatgtctactattgtctagacgatccccatattttggaaatggttgatgccatgattggacatgtggctcatgaaattaaacatgaaccgcatcatgattaatgacgggaggaagttgtgaaggttaagataacgaaacgacagcttatcagtggggcagtactgctagcattactattaattggactgttgatctatcgctatcatggtacttgggagatcattcagcatcgggtatttgatcaatcagcactggtggcccaagttcgacggcaccgcgcgattgatattttattagtagttcccttattgatttgcttttcaattattccaggtgcccccgtggcgacgatcagtgtcgttgctggcatctgtttcggcaaagggcttggggcagtgttaaatattattggcattacgctgggcaacttgattgcacaacgctttttcggacgggtaacggctcgacgtgatcaacagccgtcaaaactcgtgacggccattggtaagatgcggcaccccttattaggaatcgtgattgggtatacgataccgtttattccaacgtcattagttagtttagcggccattgaaacggcggtgacaccccggcagctagccgcagcaacgctactgggcagcatgcccacggcgattatctatgcttggggtggcgatgaactgattaaagcgcacttcaagaatgcgttgatgttggttggactcttggtgctcttattgggattgttgtggttgatccaccatgatcgtcaacgagcagttgatttggatcattaataattgaaattataagcggcgggcccgccttcttaatcattgactaagagggtgtgcccgccgctttgcccgtagccgttatgatgcaactggctgggtatgcttgaattgattgatttgagttgtggtcagtgtaactgtcttatatggtaagaaatgttcagacagttctgagcctggatcggcctgaaagatctcgaccgtgtcgtcagctaagtctagctgatagacacgccgcgcatgcgggctgtcaacataaatagcggtagcggtgaagggccgccaggtaaaattagtcgccggtaataagtgccattgttctaatgcgtcgtaggtttcgtttggtgtcataatcgaatcccccttcagtgactattatagtatgtttaggttaatagtcaaataatgttttgttaacctaaaacccccgttttcacattgaaaacgggggttttgaggttattttaattgatttaacgaataactaaaactgaaatcggtgcgtattttgccatataagcagcttggctaccaaagtgtttggcaatcccctttttggctagggagccaataatgagtaagtccggttgaacgtgggggatgacttccttaacgatggtctcaccaggttcaccttccgcaatcattgcgtggactttggtgacgccagcagcttgggcttgcttttgatatttcaatatatgctgttcaagttcttggcgttccccatgaatgtagtctttactgagcgcttgatagacgttcatttcatcattttcaagaatcgagataatgaccagttcggcaccatcttgcttcgcttgatggattgcatagtcaaaagcaagtaaagcatcggcagaatcatcaacaccaacgagaatccggttaaatttagtcgccattatttgttggcctcctttgctgctgcagcaagttgctgttcaacgtaacgtttgttaccgcgttgtaggtcgaagacggtccagacaagtagggctaagatagcggcaatcaaaaggtaggctagaattttagaaaaagtctgttcgccagctgaaggattatcgccaaagaagcctaagattgaatctggtagaccgagtaagtttaagaaagtcaaaccgatgacggataaccaacctaaacctttgatccaaagtgagtttttgaatcgtttgcccatttctgccgcgctgtcagtcatcattaatagtggcaacatggagaatggaagagcgaaagccagaaagacttgtgagttattcatcagattattcaatgcagtatgctcgtcgattgcactcttaccactagttaatagcacgcaaatgaggacgggaataacggagatcaaccgggtcactaaccgccgtaaccagagtggcatccgcatgtggacgaacccttccatgatgacttgcccagttaacgtaccggtaattgtggagttttgcccagaagccagtaacgcgatggcgaagagggctgagagcgccccagatttagcaacactgattaaaataccattgcttaacattgatgtattggataatgcttcataaagaccgaagaatgaaggatctttaacagcgccactcttaaagacggcaacgcccataatcaataatagtgaattaaccacgaaagcgaatgaaagttggatattggaatcccaagcagcgaatttaacggtccgcgcgacatcttcctcatcgttgtggtcaatcttccgcgtttgtgagatggctgaatgtaagtacaaattgtgtggcatgacggtggcaccgataatccctaaagcaccagaaagtggcgtcataccgtttactgaacgacttgtcgagaaagtgtcagcggttgggactaggcccttgatcacaccgccccaatcagggttggacagtgcgacttgataaacgaatacgaataagataactaaaatcaaacaaaccacgatggcttcgattttccgaaaaccgattttggtcaataatagcaaaactaaaacgtcaagcacggtaataaacaccgcaatgactaacggaatgttgaacaataaatagagggcaatcgcagcaccgataacttcggcaatgtcggtcgccatgatggctaattcggttaaaatccacaagacgattccgagtgatttactcgtccgcgcccgaatcgcttgggccagatccatctgactcacgataccaagtttagccgccatgtattgtagtagcatcgcaatcaaacttgatatcaagatgacagacattagcatgtattggtagttttgaccaccggtgatggaagttgaccagttaccgggatccatgtaacctaccgcaactaaggcaccaggacctgaatacgcaaagagggttttccagaagttcagattcttgggaacctcgatggtaccgttaatttcctctagtgaggggccgttagcatattcaatcaatttatgcttccggtttggggtgttcgtcttttcgctcaattaaaagaccacctttctatatctctaaatctttgagccgttgtcattgtacaataaataaaagtaaatggaaatacttttttaggcatgcctacaaaataattaaaacagtttgatataaaacattctaattgataataatatttttaacttactaagcagtcaaccaagcagactaaaacgctatgacggaaatcattgtcgtagcgttttggttcgcgattctcaaaaaatacaacacgcgcaaatcgccggcttcatcgacttgcttagaaacttatcttgccgaacaatcacccgtcgcgtacgatgtgcttggaggtgtgaaaatgaatttttcagataatttaaaaattattcggcaacaaaagaagatgactcaaactgacatcgcgacgcaattgcacgtttcacgacagacgatttcaagctgggagaatggtcgaagctatccagatattggcatgttggtgcaaattagtacggcgtatgatttttcagtcgatcaactattgaagggagatttagggatgttaaaacactacgaggctcagtcggcaaataatcggcggcagcagcgcttggtggcaatcagttatgacttagtcgttggcctactatttttaagctatttgcactattttttgcattggaacgacggcatcgtgacgatggtcattaatggtggattgattgtgatgaccacgacgttgattatgaattataattattttgatgattgggcaaccactaaacgccaggcgtggcaattagtgggggttattacgatgttggcggttttaaatatcgcgttggtgtggccacaactagctagtcagatcccatcaacccagttcttaaatcaacatgctggtgcatatttagcggggaatgtgagcggaaaattagttggtgacttcttgcatctctttatttggacagcggcggccgtgatggcgattgaaattccgctcaatcgggcgagaaagacttcagattaggtgttcaggttgtggatggtgttattaagtgctgcgaccactatttagtagcgatcgagtcacgctcaacggtcattttggcacctatgataatgatgagttatcggctacggcaagccgtttttaattcatgattgtcgcagattttggttattcgttgatgtgcaacggccccatgatgatgccaactagctgcagaattagctgatgcggacagttaaagctggttggcgttttgtgtatgtgaattattggggtaaaactgaatagttgccatcgccaatagttaactgctgtgctaagattaagttgtgttatttttactcataaaaatgaagatacaacttaaacagaattctttcacaataatcatgtttaagtgaagaaagtcaggtgtagtaaccatgagtaagccagattcgattaaagttgatcaaaatgaggaaacggttactgaaattttagagccagcagcagaattagataaaaaaattatttcacccgttaaagaaacccgtaatcaggcgattcgctatatcttgtggggattgatcagtgttgcggtcaactttgcaactttctatacgatgtaccacctaatcggactcgaataccaggtcgctaatgttatttcctgggtcattgccgttcaagtcgcgttctgggtggaccgcttgaaagtgttcgaccatcattcacaccacgtttatcgtgaaatgggtaagttctatgcgacccggatcgtgacgtacgtcgttgaagcgattattttatggttgttgatgtcagtattggggagctcggcggtactagccaagattcttgggcaggccggcgccatcattgggaacttcttgttctcgaaactgtatgtttttcgaaataagtagccacatcaagacggaaatgaaaattcacgtctttttttgttcagtggggtgccgcggttgttagaatgacgagtaggtgtgtgaaagcggattaagattacaagtagattgcggtaatcctaaatattcttaatgattcactaagagctatgtttaagtggggtgtcatgtggtttaataaacttaaattattgcttgtcaccatgttaaaaaattaagaggagcgcacagcatgctaaaaaatctaatgcgcggaatcaaagcgctgtgtctaatcggcctcgtgttatttgggtggcgcaactatgatacgcttgccccgcgcgcggcagctttatatcagacgagtcgtcagaatctagcggctgccttgtcgggtgacttatctagtcatttgttgggtgctgatgatactagcagtgctaccgaagattcggcgactaactcaagtaagcaatcatcaggtcagcagacggataagactgcgagtgccagttcggtcactagctcgagttcgcaagcaactagttcaacaacgcaagcaacaccgattgaatcgatcgtgcagaacgccaccttaaagaagacgtattattattccttcgatcataatgttcccaaagcggcccggcaggtctttcttgaagctgtcgcgacttataaccagactgggttggtccatctggtagctggtcaagccagcgggtcacaaaattcagtgactttttcgatgtatcataaaaaaatgacgactggtgcgaccagtgttgaacttggtcatggtggccctgatattactaagcaaattagctggcgaggtatccaatattggaataacgcgacggctagtcttaacggctcatacgcctcagctttcagtaaatcggtcgcagttcatgagttaggtcatgcgttagggttggatcacagttcatcgactgaatccgtgatgtacccggtttcacaaggtaagagcacgttgtcaagtgctgatattgcggccctggaaacaatttatcaaaagaatgcgtaatttattttcgtaataccaaacaaaatttaaccacttttcaaattttgacctataatcaaggtgtatcaaaaattagaaaggaagttgttttagtatggctgcagcagttgaaatgaacagtatgttagacgaaaagatgacggacgtgtttgattggagcgactctaagttacccgtacgggatgcgatttggaatcactttatggacgctgatagtcatgatactgacaagacggctgacgaagtagcgccttatatgagtatggacgaagctaagctcaagagcgaagttgaaaaactcttaaaggcttaactagaataacgaccatgacggcctaatttttgaatgggaactgattgccagtttagtaatcagttctttttttatgcttttaatccggctgaataagctggttggtcaggggggcctctcaaccgaagctaatcaagaccaaaaataatttttttgaattactgtcgacactatgagcccgtagtggtttaccttttaattaatataaaaacaattaaaaattcacttgacttataattaaaagttaattaatctaagaaacatcaacattacaaaaacttttgaaagcgaggcgtgtcaattatgaaaattcaatctaacctaaccaacttgttgacaacccttgctgttcaaaatttagccttattattaacgaagaaggacccggtcacttgaccttgagtataactcaaaattcaagtgaactgagcccttctttcccattgtggtaatgaggctcagttccgggtaaaggcctcattcactacggtggatgaggcctttttgtgacttaaggaggatcggggtcaacaacgtagcaataaaaaaacgaaagtgggaataactaatgaaaaaatgggaaaaacaaacgatgaagattgcagcacttggtgcgatggcgttgacactggcagggtgtgccactgccaaatcaagttcaagtcaaggaaataatcctggcaagactattaaaattggggtcaatatggaattgtctggatctgcggccggttatggagaacagcaaaagcaaggcattcagttagccgtcaagaaaatcaataagagcggtggaatcaaggttggggggaccaagaagaaaattcagttggtgatccgggacaataagacatcgaacacgactgctgcttccgtggctgcccagctcgtgaataacgataaggtcgtggccgtagttggtcccgcgacaactagcgccgggactgcggcgatccctaatatgactaaggcggcagtaccatcagtcagtccatcagcgaccgatccggattatacgttgcaaaagagtggcaaagttcaaaagtacatattccgagcttgctatcagaataattttcaaggagccacggcagcaacctttgtgactaagaacttgaaggcgaaacgcgtcgccattttgactgataactccagtgattacggcacgggcctaacaaaggcgtttaagaagcagtatcggggcacggtcgttagcagccaaacgttccaagagggcgataaggactttaatgccatcctaactgcgttgaaacataaaaagatcgatgccatatatgcgcctggttactattcagaaatcggtctaatcgttaagcaagcgcggcaagcgggaatcaaggctccaatcgttggtagtgacgggatggcggatgctaaattagcccaaattgctggcaagtctaatgctaccaatgtttattacacgacgccattttctactaaggcttcggcaacgaacaaagttgcttcgaaatttatgagtgcttacaaggcaaagtatggtagtaccgcaccaactttttcagcactcgcttatgattcggtttatatgatcaaagcagccatcgaaaaggaaggctcggctaattctgttaaaatcgccgatggtttagccaaacttaagaacttcaagggtgtcactgggacgacgactatcgataagcaacataatcctgaaaagacgatttcaattgaacaattgacgaatggcgtggtcagcaaggtttataacgtcaaatagtcagactagtgaaagcgtgggggaacacatatgcagacatttggacaacaattgatcaacggactatcgctaggaagtatctacgcgttattggcgctaggctacacgatggtttatggcattatcaaattaattaattttgcacatggcgatatttatatgttgggggccttttggggctattacagtttgaagtcactacactttaactttgttgcggcgctcctgtccgcaatggtgatctgtgcagttagtggtgtgattattgaatatttcgcgtaccgcccattacgccattcaccgcgaattaccgcgctaatcacggcaatcggtgtttcattcttgcttgagaatggaatgtcatactttgttggtgcgagtgcccgttcatttccccaagcaatcaaagtggtgacttatcactggggcggattgcgggtatcgaatgtgcagctactgatcttaggaacggcgtgcctattaatgattctattggaattaattatcaaacgtaccaaaatgggtaaagcaatgcgggccgtttctgttgatcccgaagctgcacagttggtgggcatcaatcttaaccatacgatttcgttcacgttcgcattagggtctgcaatggccggcgctgccggagtcttgattggcctatactataattcgattgatccgttgatgggcatgacgcccggtatcaaggcctttgtcgcagccgtgattggtgggattggttctgtgcctggggcttcattggggggctttattatcggcatcctggagactggtgttcaggcgattggcctatccgcatacaaggacgcggtggtttactttgtcttaattgttattttgctcgtgttgccggctggaatattcggtaaacgaaccaaggaaaaagtctgagggaggcgccaaattaatgaaagcaaatttgaaaactaacatggcgtggctcggtgtgatggttatcggctttgttgtgattgacggtttagagctgatgggcgtcattaactcgtttattgaaaatatgctggtgacgattggtatcaacgttatattggcggcgggactcaatctgattattgggtttgcaggccagttctcgcttggtcacgccggctttatggcaattggcgcctacgcgactggtattatgacccaaacaatggcgacgcccgcgggattttatctgtcgatgatcgtcggcatggtgattgccatggtagcggcggtcattgttggcatcccaacattacgattgcgcggtgattacttagccattgcgacgatgggggcggccgaaatcattcggattctaatcaataatctgaaaattacgaacggtgcagcggggttattcaatatcccggcacttgcttcgtgggcaacggtgtatgtcttaatgtgtctgacaacgattatcacggtcaactttattcacagtcgcggtggtcgggccgtgatggctgtgcgggatgatgaactggcggctggtgccatgggaatcaatacgacgcgctggaagttggccgctttcgtctttggcgcggcgactgcggcgattggtgggtcgttgcacgcggcctacattcagacgattgcgccgggtgattttaatatcatggcttccattgcgattctgattattgtcgtactcggtggggtcggcagtattaccgggactttcgtagccgcaatcgtattaggagcgctcgacacgatcttacaaaacttcggtacgatccgaatgattatttattcattggcactgattttgattatgatttttaagccagccggactgttaggaacgtgggagttctcattcacgcgtctattcagacggcgatcaactaaggaggcggttaaccatgagtagccggttattagacgcacaagggttggtcaaaaactttggcggcctgaccgccgttgctgacgtttcactccattttgatcaagacgagctgattggtttgattggcccgaatggtgctggtaaaaccacgttattcaacttgttgactggtgaaacgccggttagttcgggtagcattagtttctacacagatcagggcgtggtgtcgttaaatggcaagcagcccgctacgattgctcgggttggtatttcacggacatttcagaatatccggttgttcaaggagatgagtgtacttgataacgtgcgcattgcaatgaccaatcattatcatgaacggtttttgactagcatcctgcgcttacctaagtattaccagactgagcgggcaatgacccaggcggcgcaagccttattagcgatgtttgatttgaccgccgtcgctgatcagcccgcaaagagtttaccatatggtattcagcggcgattagagattgtgcgggccctggcgacgaagcccaagttactcttccttgatgaacccgcagcgggtatgaatcccgaagaaacggcggatttgacgcgcttgattcgccgaattcaacaagaatttcatattaccgttgtgctaattgaacacgacatgtcactagttatgaacgtagtcgagcggctctacgtgttggagcacggggcgttactggcaactgggacgccaaaagccattcaacatgatccggccgttatcaaggcctatctaggaggggtgtaaatgcttaaagtacgtgatttagtcgttaattacggcgcgattcaggcagtcaaaggtgttagttttgacgtgcaacagggtgaaatcgttacgttgattggtgctaacggcgccgggaaatctacgttgttgcacacgatatctggcttgatgcgtccggtcagtggttctattcactatttggatcaacccatccaaaagacggccgctcctaaaattgtgcgggcgggtatctcgcaagttcctgaaggacgccatatttttcccggcctgtctgttcaagaaaatctacaaatgggtgcttttttacggcaggatcggggtcaattggctcagacttatcagcaagtttacgactactttccaattttgaagaaacgtcggcatcaagatgccgcgacgctctcaggtggtgaacaacaaatgttggcgatgggccgcgcactgatggcgcagcccaagctgatgttgcttgacgaaccttcaatgggattagcgcccatctttattaatgagatctttgagatcatcaaggcaatcaatcaggctggaacgacggttttactaattgaacaaaatgccaatcaagccctgaaaatcgctgaccgcggctatgtcttagctagtggacaagtcaagcttagtggtcggggttccgaattattagctaattcagaagttcagaaagcttatctagggggttaagtatgagtgttgcagattatatgacaccacgcctggtcgttgttagtcctaaaacgacgatcagtgtggcggtcgaattaatgaagaaaaatgcgattcatcggttacccgtcatggcaggtaatcgaatggtcggcttgatcacgcatggtatcattcagcgtgcgatgccatcacaggccacgagtttgtcggtgtatgaattaaattacttacttactaagacgacggtggatcaaatcatggaaacggcggttcaaactgtcgcagcaaccgctcagttagaaacagcgattgcaacgatgcggaaaaataagatcggcgtactaccagtcatgacgggcgaccaagttgtgggcatcattactaataatgatatcttggatgcgttcttaaatattgctggttacggccagccgggaatcgtaactcgggtggtggtccatcatgaccatgtcggcgtaatttttgccatcggaaaggtcttaacagaacacgatttaagtattcagacgttaatggtcgtaaatcaccaggctgaaaaagtgattgagctccacgtgaatagtgaacaggccgccgatgttaaccaagtcttgacagcagcaggttttgaagtacaaccggtcagtgattagctctggcggctattgtctattattggagattaggtggctaaagacatcgcgttgtacaaagttatagggcgtggtgaaagtgtgtggtcacaaaaaagattcaggatgattcaatcctgagtcttttttttcgacgtattgttacttaaggctgcggtcgactgaatgttttatagacaggacattcgctagctaatgggaaattacggcaactaactagtacttgtgaggagtagcgataactgattggattcgttattaccatgcggttttgagcggtacacacaaatttaagaccggataataaaattgatagcaaaccgagactgatcaagaagaacgagactgacctgaacgtcacaataaaaaaaattattattaattggattaaatccctatctgttgttttattaatgttgtacaagtattagaaaaacagcggatagaacgttttttaatgtaaaaatgatgaaacaaaaaattaatactgcatacaaaatacggccggaacagttgacctggttgattttcacgggttaacaaagaagcaactcaaagattaaggggttgtaattgttgggaagtgtggtaaattattagtgcagttaatgaattaggcaaactaaagggatgcacgatatgaaaaaagtagtaggcagtttactcatgaccagtaccattttattgggggccttaacgccaatcgttggtcacgcggccgatggtgaaaatcggagtgggacgacgaatgcaacggcaacgtttacggcaaataccactaatccagttgatccggtcgatccgactgacccaacgaaaccacttgaccctaagcctggtgatggcgataacggtgccaattccggtgctggtttgtcactgatctatgcgcccggtaaacttgatttcggttcgcatgaaattgacgtgatcaataaccaaagctataaagcattgactggtagcgatggtagcacggtcaccatggggtcaacgggtaaagttggtttacaagtctctgatcaacgcgggacgaatgcgggttggacattgagtgttgccgctgcggatggcacggatggtaacttaagtacgcttaagggggccacggtctccttacctgcagggacggtcatttcttccggatcggaagctagcaacggcagtaccggtggtaatggtgcggtcggacaagctgttgaacttgacttaggtagtcaagcttcaactagtgccggggcgtcctttacggggacaacttctgggaatgtcatgacagcagcggataagagtggggcggggattacgtctgacttgcttgatccggctgcagtcaagttgaacgtcgtggctaacacggcggccgctacgacttacaagggcgtcctaaattggacattaacatcatcagcagataattaaattaatgaacttggagatgaccacgtaatagtgggcgtctcttttacataataatcgacggggggacgcaataatgaagaaaatgatgcggtggttaggggccatcttagtgatgatcagcggcttgtccgcggtggttccagcacaggcagccaatacggacaccagtaataatattggttttagtgtcgcggcccaaacgccgaaaaaccaaattgataaacaggcaacgttttttgacctcaaaatgacggcagggcagacccaaacgttgcagacgcgaatctataatacgactaaccgggatatccgcgttgcaatggggattcatacggcatataccaacagtggcggcgcaattgaatacgtgaccccggcgaaaaagtatgatgcctcactgcagtatcgggtcgaccaattgactaaaatcaaggggccaacgacggtgacagttccagccaacggttctaagctggtcagtgcccaaacgaccatgccgactaaggattttaacggtgccctgttaggtggttggtattttaaacgcgtcgatcaaaaggtcactggtgaagtgaagggtgctacgaatattagcagtgaatattcttatgtggtgggcatcaagtacagcttagggactgcgcccacgcccgtcttgaaactaagcgatgtcgctgctggaatggttaattatcaccggagtatcgtggtgacgttacgcaatactgcagcagtgatgataccacgggttaccatgaagacgacggtcacagccaaagatagtggcaaaaccgtcgtaaaggcgaccaaacaaggcgtgatgttggcgcctaatacgacgtttaattacccattgttactcaacaaacagaagcttcaagcggggacgtatcatttacacttggttgcgcacaacagcgctcataagtggacttttgaccgcgacttcaagattagtgccgccacggctaagacgtataaccaggatacggttgatgataacggcatcagtatctggtggttgattggtctgggcgcactgggcatgttgattgtagtcttactgattttgtggttagtgcttttcttgaagaagcggcggcaatcccaagattaacagcaatcggctcggtgtttagtttgggactgctaagcgtcatgaacaattagtagctgggtaaaaaagggggactgacaaatgatacgatggctgttgatacggggcttactgggcttattaatcggcctaggaccatccatcgggggagctgctcagacggtgggcacttcgtcgacacaaatacagttctatacgtcacgttcagcggacaaacaaacgcctacgacggtgcaacaaattccgcagggcgacgttgtgtacgcaacgaaggctgtcaaagccacgcccaatcgctttgtcggtcagtggcaacaggtactagcaacgggccgtttgccccaaaccggggtccaagcgaatcactattatcagtggctcgggttcctgaccttaatggcactcttattagggtggcaggtgcttaagttaatgcgtgaaaggggggcgaacacgtgaaacgactgcggcatattaagctaggcatgctgttactgagctgcttagcgtttatcagcatgctagcgattacgagtcaggcagcggcgcccgtgacgtctgcgacaacgacaatcgctaattcgagtaataagtactacacttactttaatagcggtgatgtcgttgggttcaatatctcgggtggaattgggatatatccaagcttaaccaaagtgacggccaactatgcggatcagggacgtatatcgactaagactaccacaataacgttgacctttagtggttcgttgtttgcgaatagttcggagattaaaacgctatattacgatgtcttttataagcaagcaaccgaagaatttggaacttcactagtgaccaagactccgacaaatatggcgactggttctagtacggtatcgatgaatactagcaagactttgacagtcgatatgagtaagttaaaggataatttgccagtatatattgggtttcgattaactacagtaaagggtgagacatccacgtaccgcttggcagtgtttaatcggattagccttaatacgacgctgaatacgccaacaacgacggataccactctgacaggaactgggattgccggtaataccgtcagcacgacaattaatggtaagtcgtacacggcgacaatcggtagtgatggcaaatatgaaattaagttaaatgatggcctcagtggggtcacttcagtcacagtaacgcagacgggagaagccgattatggcgaatccgaatcggtgactaaggacgtgacgataccaccgctgacaatcaaaagtagcagtacagcggtgaatttgtccgtgagtgatctagcggcgttgacgtctgatagcgatgctgttaattggttagttaagcaggctggcgtggttgcgacgaatcctagtaacgctaatgacacgatgacttatcatgcaagtgagagcggtctggtcgcgttattcaaggggctcgctgataatcagagtaccacggtccacatctatgcgacgagcgccagcgacttaacatctgataaaattgcgctacaagtaactaagttagcagggacgctgtcgtttggtcaattaacgaccaatatgagcttcggcgatttaaaggtgccgttacaccacaagtctatcaaccgactaatccactagccatcagtgtgactgatacccgggcgaccggggctaagtggtatttgtacgttagtgccacgccgctgacatcgacaacggtcagtggacggacgttgaagggcgatttggtttaccgtgatggtagtgcacagaccgtcttaacgaatcaagcgacgttggtccaacagggacaaaaagtcgcggggacgaccgatacggtagtcactgacgattggtcgacaacgaagggaatcggattatcagcgcaaccaggtatttacgctgatacttatcaaggtaccttgagttggactttgagtgatacgccagataaataagttagcgtgtatcagttgggtgacggggactttgaccaattgcacttaaattttttactggttcgcagttgacaagttaggtgtcgtcatggtttactattagctataaattgaaacggaggatgactaatatgtcattagcaactaaccttcaattaaataatcaatttgcctttagctttttctttagatagcgtttgtattcgtttgatggatacaagcgcacgcaacgcgtttgtatctatcgagagctaaagttattcaacatgacttaaacgccaggtagatgcagggacaatctatctggaaaaatatcgggcccgataaaacaccagttagattcttcccagaatctaactggtgttttttgttttcagtccggttcatcaagacgttgatgaacgttgggcgaaccagacaatttttaaggagcgtttcaagatgaaaaaaacaactttaggggtattaattttaggtgctgggttactattagctggttgtggcaaacaagcaacgagtggtcagcaaagcgtgtcggtgggcatcttacaggtggttcaacatggttcactagaccaagcgcgcaagggcttcaaagccggattacaaaaagaattaaaagcgcataacagtaaaataacggtcaagtatcactatctaaatgcacagggtgatcagagtaatttgaatacaatgagccaacaactcgtccaacagaaaaatgatttgttagttggcatcgcaacgccagctgctcaggcattagccaagaaaacgacgacggtgccgaccttggttacggccgtaaccgatttgaaagcggcggggttggtgaaaagtgatacgaagccccaaactaatgtgagcggcacgagcgatttaatgcccgtcggcaaacaattacagttattgaagaatatgagtacaggttataaaccgttggggattatgtataactcgtcagaagaaaattcagtgctacaagtcaagttggcgaaggcttacgcgaaaaagcacggtatcaacttaaaggtcgttagcgcaacgagtactaatgacgttgccagtgttttggccggtttgacgggtaaaatatctggcctttacttaccaaccgataatttgatggcgagtgcgatgaagacgattggtcagaagaccaaggctgcaaagctaccagtggtaacgggttcgattgaaatggctgaagatggcgggactgcgacgtatggtcttaactattacgaattaggtgaacagactggaaaaatggcttaccaagtcttaatcaagaagcaaaagccgcaaacaatggcggttcaaacagctgacaagttacacctctacgtcaataaagcgaatgctaaggcaatcggcttacaaccaagtacaatcaagcaaccataagaggggagcgaggtaatatgttaatcacgagtattggacaaggtttattatgggcgccactggttatcggggtgttcctcactttcagaattttaaacatccctgatttgaccaccgagggtagttttccattaggggctgccgtgacgattagtagcatgttggccggacagtcagctatcgtggcgagtttattaggatttgtcgccggatgtttggccggttgggtcacgggggtattagatactaagcttaaaatgccgtcattattggccggaattctgacgatgacgggactatattccatcaacatgcacattatgggcaaagcgaatattcccttgcttgaccagaaaacgttgatgggatggttaccagcgagctggtctttgaatttacaaaccatcgtgattgggtctgtggttacgctggtcgtcctggccgggttgatttggttattccagacgcgtttgggactatctttgatggcaacgggtaataatcctgcgatgagtgctgcgaatggaatctataccgatcggatggtcattattggctatatgttatctaacggtttgattgctttatcgggtggtctgattgcacagagtaacggttacgcggatattgggatgggaattgggacgattgtcatcgggctggcttcagtcctggttggtgaaatcttcttacatggtcgtcaaatctgggtccgtttgactggaatggtcgtgggcgccattatctatcgttatttgttgactttggcaatgggcttaggtttccccgtcaatgacttaaagattttatcagcggcgattcttgtcatcgtcatctgcttgccactattacaaaataaataccggacaaaacggcagttacgccggtaccttaaagagattggagtcgatcaacatgccacacccaactattctgaacgtccaacacttgcaaaaagtcttctttcccggaaccagaaacgagcggcacgtcttaaaggacgtgaatctaacgattgaacctggcgaatttgtggcggttattgggaacaacggcgccggcaagtcgaccttgctcaatacgattgcaggaacgttaaatacggatgctggagagattacactagccaatcatcgtgtgaccaatcgtcccgttgcgtatcggtcacggtgggtggcccgggtgttccaagatcctaagttgggtaccgctggcgaactaagtgtggcccagaatctcacgttagcccaacgtcatacggggagcttgagtctgcgccgttatcgccaacgtggacaggaagaacgatacttaaggttgctggctagtcttaatatggggttagaagcgcgactgaatacgcaagtgaagtatttatccggggggcaacggcaagccttatccttactgatggccaccttgagccaaccagagctgttgttgctggatgagcatacggcggcgcttgacccgaagacgagtgcggaagtgatggcgctgacccaacaaatcgtgacggccaatcatctgacaacgatgatgattacgcacaaaatgagcgatgcgttgacatacggcgaccggctagtgatggtacaggatggtcagatcaagttggacgtgcgtggtgccgaaaagcaagcattgcggacggatgacttggtgacgatgttcgcagctgaggtgtgaggctgtcgttgcaaaaaacgacttgcaacggccgatgatcagttagcaggtcattatcttacttaacgaatttcgcaatcaaataaatgatcagtcctaaactgatgagaccaccgatgatagatataatgaaaattaaatcgccaaaatacattggttttcctttctagcttagcgcatgctgagcaataccaaaatataattattgtaggttcggttagtcaccgcttcgtgcaaatcatgattaaggcgtgctgttagtttagattgcagttcatcaacacgtgttcgtccgacttccgaggctaggtgacaatcgttttagcataccatattagtttcgtggcgataatattcatatgacgtataattctggaaaaataagttaattgaataatccataattgccggtaaacgttgctaaatggcgaatgagttacgttaagggaaatttaaagaattgtccggcgactagattatcgaaaatagccctctgcgtatcaaatacgtagggggctattcatataattggcgcatgtaacaagttatttcgtcgtgaccaacataatctcatcactgactttgacttggttggtcaacatcttgaatttcatcaaattgacagcatccatgttagtgatgataaccatcatggttgtggccttaccagcagccttaatcgctgccaggtcagctttggcaactacttcgccatggtgaacgggttgaccggtttggactagtacttcaaagggagcaccgttcaactcaacggtatcaatacccatatgcagcagaatttctaaccctgaatcggttttaaaaccgattgcatgcttggtaggaaagacggtgctgaccgtcccgtcgaccggcgtcgtaatcgtcccgtctgcgggatcaattgcgaagccatcgcccaacatcttcttagcaaatgtgttgtcggcgacgttttcaatatctacgtactgaccgttagcgacgctgtaaaagtcggtggtcacaccaattagtcgcagttggtgctgtcgcaacagcttcatcgctagtcgtggtcttagtaatgggtgcgttcgtgagctttaagtggctcaacacgtcggcgacgaattggacttcggtcccaataatgatttgtagattatggtcgtctaatttgttaataccagcagcaccactgtgtttgatagcggcttcattaatggttgacgtatcggctaattgcaatcggagacgggtcgtgcagttatcgacaaccgttaaattatcggcaccaccgagcgcagcgtaaatttgcttggcttgacgtgtgtatttgtcatcatccgcatcagtggcgatggctaaatcatcggcatcatcggctgtcactggttcgcggcccggtgtcatcaaatggaacttcttgattgcgaagtcaaagccaaagtagtaaatgacggctagaaccaatccttgtaagattaacattaaaggttgattagcaatcgggtttttaaggcttaaaatgtagtcaactaacccggcggagaaggcaaaaccggctgtccagtgcatgaaggcagcaaaggctagcgataaaccagtgaagattgcgtgtaaaacatagagtggccaagctacgaacataaatgagaactctaatggttcggtcacaccggtaaagaaggacgcaaacgcaccggccatcatcagggatgctgtttcaactttacgttctggtaacgcattgcggtaaatcgcgtaggccccagctggtaaaccaaacatcatgactgggaagaaaccagcttggtacatcccagtcacacccttgatccccttgtgtgctaagaatttaccaatatcattgatgccagcaacgtcaaaccagaaaacggagttgagtgcttggtgcaacccagttggaatcaataggcggttgaagaagccatagagaccggccccaacggcaccgagacccacgatgaatttgccaaaggtaactaatgcatcatagacgggcggccaaacaatgagaagcgcaacgctgactaataacatggtcagcgcggctaagattgggactagacgtttaccactgaaaaatgaaagagccatcggtagtttggtctcgtggaagcgattgtaaagagctgcggcaatcagaccagagatgatcccaatgaagacgttgccaatttgaccaaacgctggattaacagtggctaccttgatattcaagagtgtggcgaccgattctggttttaaaacgttagttggtaattcaaaggcaactaaaccagcaagagcggctgcgccatctttatcttttgacataccgagtgccaaaccaactgcaaatagtagtggtaattggctcagaacagcgttaccaccggcttgtaagaagtgtgcgacgatgtcgttactagcagatgcccaccagttaccaattcccacaagtaaagctgctgcgggtagaacggcaacgggtaattgcagtgaacggcccatacgttgcaaataattcttcatgtacaaaattcccctaaaaagatagttttgaataagtgcaaccattgttgtacggtggtgaaagcgctattacaaccgctttttattggtatagtccattggtttaataagattaacagtacaattgggagtggtctaatataaatacaaatacggaactacaagtccgacaagcataagtaatactggtataaacgatgaccccaggtaatgagcataaaaaataaatattggtcggaataataggtgctaatgatagcgatttcaaaataattgtgaaaacaaatacaaaatcagttataataagattgattaatgaatttgttacttttaaaaaaggagttgtttaggatgccaacaaccatgacgactaatattaaaaataatgattttaaagacgtggtgtttaaccgccaatcagtacggcagtttgatccgactgtcaaaattgaccgtgaagaattgcaaacgattattgatgagacaatcagtgcaccatcagcatgcaacttgcaaccctggcactttgtggttgccgatagtgcggacggtaaggcgaaagcaaagtcggttttaatgccgtttaattatccacaaattgattcttgctcagccatgatttttgtcctaggcgatacgcaatcgcatttggtctatcgggacgtgtggaataaagcttgtgaagaaggacgcattaccccggaaaagcgggatcaaatcttcaagacgttcttaccaatgtatgaaaatgcgagtccagaatttctacaagccgatgcgatgattgatagtagtatggccgcaatgcaattactattgattgcccgcgcacatggctatgatgctaatccaattgcgggttatgcggcagataaagtcgcgacgacctttggcttggatgccaagcgctatgtaccagtgatggctatagcacttggcaaggcggctagcgaaccgatcacgacaacgcgttacgctggtacgcaggttaccgaattcatttaattgagctaacctttttaactcgcgaaaatatcgcgagtttttttgtcatcgggcttgttctcgaacgcgtttgagcaggtatactaagggtaagattaataaaataattgacgggagtacattggcatgattaattatttgttttcagatttagatgggacgctattgaattctcaaggaattgtgagtccacaaactgttcaagcagtgcgagaaagtggcttaccaatgacgcttgtatcagctcgcgcacctattgaaatgcgtgatacaattcaggcactagggttaacaggtccccagattggctttaatggtggtttgatttttgaatattgtcagaatcaagttaaggcgttacaagcagccccgttagatcagaaattagcattacaagtgctcgagtttgttaagacggagtcgccgacagttagcctgagctgttacacgcaaacggattgggtgacggaaaaagttgatgctgggactcgtacagaacagcagctgacgggacaaatagtaacaccgattacgagttatacagatcactttcggcaatatcctgcagctatttttaaaattatgattatgaccttagacaaacatgttatggcaacactcgcaatggcccttaaacaattggtcggtagttacgctagtgttaaattatctggacagacgtatttagaagtaactagtgctcaggcacaaaagtctcgtggaattgcatttattaaagaacgatatcatttaacaactaatgagatagctgcctttggtgatggtgaaaacgatttgccaatgctgagggcggttggtttaccaattgtaatgggcaatgctgattcaactattcagcaatatgggcatcgtgtgaccaaacgtaatgatgaagatggcgtggcttacgccttgtcacatttaatcgggaggtaatattgatgacgaacattcatgatattgcccgtttgtctggttattcagtttccaccgtttcgcgcgtactgaatcatcaaaattatgtttctgccaaaactcgtggagatattgaagcggtaatcaacaaattagattatgttccaaacgccgtagctcgtaacctgagtcggggggcaacgttaactattggagttgtgctgccgcatgttgatcatccatactttactcaactgttacatggaattatgcgagctgcttttgctgcgaattatcacattgtattactaccatccaaatgggactcgcaattagagttgaaatacttggaggcactccgtcagcatgcttatgatgcactgatttttacatcccacgggttgccattaaaaaaacttgcagtttatcagcgttacggacgaatcgtattgtgtgaaaatccccatgactattctttaccagctgcctatgcccagcgtacagcgacgtatgttgaggcgtttacgtatttaaaacagcgacatcatcagcgaatcgcgatattaacaagtcgaccgctggaggttagtgccacgacacaggcgatggttggggcctatgaacaagtttatcagcggacattgtcaccgaagttattgtataccggaatcattacggcggaagatggcgagcatgctggaacctattttgcccaacttactgaaccagtgaccgcggtactgactaatggtgatgacattgcagtggggatgcgtcgagcttatttggctgcgcaacggcctgttccacttttgattgggcaggagcatcagttgtctggtgaagtgttgggcattccaaccattgatcatcattttgaagtcgtgggagctcgggcattagaattagcaatcagtgaacatccgcaaagtattgctttgccggccgaactcatcattaataattaattacactaaattgaatagtaataagtccgctctttctgagaactgctggtcagaaagagcggacttttaagttatcgtgcaaatcgtagtcttgataattgaggtaaaagcaatatcgttaatgatagttgcggtgaagtcgcaattggacaggtaaaaaaatgtttatataattagttagcttttgttgcatttatctaactatcgtgctaacataagcatcattcaaatcaaggaggacaaaaattcatgacagttaataatcgtgatttatttagtagttttgggaagttatttcaaaatcgggccttcgtcatggcggttgcccaacaatttcattttggagaccatggttctgagcgtggtcaaatgggaattttacgggtattggcggatgcacccgctggtttaaccaatgctgagattgctgagatcttggatattcgaccaagttcagttagtgccacgttgaatcggttagaagacgggggcttgattgaacgcgaaccaagtgcgcatgacaaacgggtggtgatcgtccggttaagtgaccgtggtcgtgagatggcggaccatcgcgcgcaaggaacgagtgatttagcggatcagttatttggtaatctgacggatgatgagcgcgatcagttacaacatttattagataagttgcgggccaatgcggatgacatcgatattcaagatttaatgcaatttggtcaacaacacggttttggcccacgtcccggttggggtcatgggcatcattggtttaattaaattttagaaacacgaggcataagagcagatggaacgaccacaagcagcatactcgcgtccggcgggtgataaatttgatttaaaacaattcttacagttgattcggcacgctagccctcgttattggcaactctggttgggcttggcattaggcttattggcgactggtgcgcagttgatggtgcccaagtttgcccaaacgttgattaatgggtttagtcacggcgttaatcagaccttactaattggtgtgattggcttattcttgatcagtgcagtcattagcgcgttatcaggttccttattggggatttttggtgaaaatgttgtcgctaatttacgggggactttatggcataaattagtccggctcccggttcgctactttgacaacgttaagacgggtgaaatgacgtcgcggttggtgaatgattcgacgcagatcaaagacttgctcgctaacgcatttccgcaagttgtgacgtcgctgatgcaactagttggggccatcgcaatcatggtcttgatggactggcgaatgaccttgattatggtcttggcgattccagccgttttattagtcatgtttccaatcatgcggcagacgggcaagattggtcatgaacgccaagatgctttagctaattttagcgggacggcagaagaaacgctgagtgagattcgcttagtgaaatcgtccaatgctgaaccagtggaaacaacgactggtgcacatcagattaagacgttgtatcgaattggactacgcgaagccatttatgattccatctcaagtccagtgatgacggcaacgatgatggcgttattcgttggggtactattgtatgcgtctgcgcgggttgccagtggaacgatgacgatggggactttggtctcatttttaatgtatctgttccaaatcattggcccagctgggatgcttggtcagttcttcaccacgttagcaaaggccagtggctcgacggcccggattcgggagttgttgaatgaaccagaagaacaattgacggttggtgttgaacacgcagtcgccaatgagactttggcgatgcaccatgttgactttgcctatgatgatgatcaacaaattttacacgatgtcagttttgaagctaaaccaaatacggtggtggcgtttgcgggaccgtctggtggtggtaagtcgactatctttggccttctggaacgttattatcaaccaaccgctggtgaaattagtattggcgagcaagatgttaatgaactaagtctcaatagttggcggtcacaaatcgggtatgtcagtcaagactcggcaatcatggctggcacgattcgtcaaaacttaacgtacggtgctgatcggttatactccgacaatgagttgtggcacgtcttagaattagcttccgcggctgactttgtacgcgccatggcagatggccttgagacgcaagttggcgaacgtggggttaaagtcagtggtggtcaacggcaacggttagccattgcacgggcttttctacgagaccccaagattctaatgctcgatgaagccactgctagtctggattccgaatcggaggcgatggtacaacaagccctcggcgaattaatgaagggccggacgaccctagtgatcgcccatcggctgagcacaatcgtggatgcggatcagatttacttcattgaagatgggcatgtgagtggttcaggtacgcatcaagagctgatggcgaacgtcccactctatcgggattacgttaaaattcaatttaaagattaactaaaaatagttggttaccgagatattgatgtatagtatccaactgacttgttgatttaatagatatcagatattttgggagatagattagcttaaatgagtgattgagccagttatttcgcgatggctggtatttgaatgaagacgctgaatttggaagcatggaaattatcaaagctcaatctttccaaatgtaggtgttataactaagatagttgctgagttcggattgctgatttgaaaatcatatgcaacaactgaatcatgcaaacacagtttgccaatcaaaagcgcacattaaaaggccaccatttctggtgaccttttaattgtgattcagaaagctagcttttagatatgtaaggcgaaaggtgccatcactggcgacccttcaatttattattatagccaagtcaattttctgtcgttagactgaatagagcatattgatttctagtgaagattataatagtgttgcgcagcaactattatcggttatggccgaaacaaaccatgtatgtcattaatgaaatgctaataatcatgccatccactaaaatagttttaagaagaatctgtttaagccagaaaacgttagctgatgatagtcgaaactctgaatacccacttttattttgctcccaataattcctcgtaagttttgaagtacgactgaaccaccaagtgaatccataagcggcgcaattaattattgtggcctccactggatatccatttgccattatgaaaatttgtcctccagtactgagagccgctatgaagctactaataaaatagccgattaggtacttctttgctgttggattattttttagtggctctaataaatatttttttctggcgttgatacgtgctcggaggttgaagaaactggctcgcatcttaatgcttggcaaacaaagaataactagccctattataaagagatttattaacgctatgaaaatcacagtactaagagtgtttgcaaccgagttagattgcatttgcatcccccttacatggtcttaattataatttttggtactcaaaaccgttattatcaagcaacagccgctaacaaagtgataatgaacatcatcataactgctaaggacgattctgttgaagctggcgtgggtgtgaattgtaaatctggatgcaagttattaatatagtctagagcatttgcgggaatactcaaaatagtctttagattattattataatcagttgcctgagtttgagtaacattaactggtaggggcgctatgaattcatggaagtgaatgtcaagtgtaatttcatattcaatagaatatgttttcccattgctggcagtgtgctcaaacgttgatttaattttcagggtaatcgtcatgagagaagttttaatagatgtattacttgaaatatcaccattttttatgacacccgcaatttcgttcatagcatttgtcatatcagatgaacctaatgcagtttcattctgtgtaagtaactcttggactgcatcactaacagaaaaactggtactaccatcatttaccttatatgtcgctgacacggtaccatcgtcgtcactaatgcttccttctaaatcaacttttaaagaaaaatcagcagcgggtgttgaaattgtgtacgtgtcactaaacgcttcaactgagacggatttcacaaaattaaagtaagtatttgtattgcctagtttctgaataatttcattaattgcgtctaaatcatcgcttccaccaacgctactaccagctgagaagtcatccactgccgtcgagcggctactgttagaagctaccttatcaatgtaaaaatcatcaaaagcaaccccattaaattggtcaaaggcccattcactgggcattggaaacccgagattacccgaaaagccagtagacatatcggatacaaaagctttttcggctaatccatccacaataatcgtattggcgacgtttcttgtggcgtaaataccaacttgaaacccgaaactactgatcccacttgccacgccagtgaagtatggttcgaccgtaccagctatgtcaccatcctgaatatcgacgtccacggcaaagtagataattgtatcatccgggaaacctaattgcatcgctgctaagccagctttacgcccatcactactgcccttagtttgagtgaagtagtcttcatcatcggatgcaccgtcttgataaatagggaaaattttcaaaccagcattagttaatatactgatttcactggtggttaggtttttatcaacctcactgcttccagtaccggctgtcccagttaagtagcgaccgatgtatttgtaaccagcagagctaagtgcggcggcttcactagcatcaatttggtgagatgtctcgcaagcaacagcatcgcggtcagggttaccggcagaggttagaagactcatgaaaacgtccaatcctgctgatgcaccagttgtttctggtagggccatatcgttttcaaaagttgctactgagcttgatacatctaaagaataactgccatcaaaagcccccgtatacgcttgattatttacataaaggccccattgtagtatacgaacaagattattattatcaccagttgaaacagttggagtcagttcttgcgtcattggcccataagttccagaggcagtgtcggtatcaagtccttcttcggcttgtaaagcataaatcaaagcggtgtttgtatcgcgttgataaacgccatcacagggtagaatgccagtataggcgagatagtcatgatttaattgttgttgcatcgtacggatcttttcatagccatccgcaaccagggtgaaggcgctcatattgagtagggcagccatgaactgagaatccagggtaccggatgtatcacttaatccagcgtattccttcatggttgtaactgccgatacagtatcgctagtgaactcgccatcaaaagcggcggaatcaatgcctttacaccagaaaccaccctgtataatatatgcgatattaccagaataaccaggtacaatatcatcagcaatttcatcaaagagctttgcagttgttggcccaaagttatcaactaaatcagtgattcccagttcatactgtaaaccacgagtaagaccgtaaattgtgtcccagccagtaagaccattttctggaacactaccaaatccagcgacgtcaccgtacgtggagtttaaccattgttgagtatctaatactagttgatcagccgtagacacgcctccgtagatttattttgataaagctttattatggactgtttcaccggataaacaagtctagctataaaacatcacctaaatttcttggaatgttcataaattcaaaacgtcatctttggaaatttagtcatgcaatcttctataattggatggaaaaggtgtttttatcaataattcaatgatgcaagatttggaattactgttgcctattcccaaaactatgataattaaatctaatgaccaagaaattaccgcatccgtcacagatttaaataactggctatgcaaggacttggaatggaaaactccaagtgaatttttttcagtaagtgaacccttaaaattggacaatttgtcatagtaaaaaggactgcttaacttgattttaagattcgcttagcttctttattgaatagggttcgaaaatatctagttggtcataacactacaatataatagtgataagttgttatttccatgaaaataatcagaaagtattttaggtttagtttgcggtctggtctgtgattttcaattgttggaacggaactgacatcgacttagaccgttgtttgtagttgatacaactagttaaagggcatgaaagataattgaaaactactgtatttgaagtttgacaaaagaatatacattttgttgattaatcgctatcattgttatgataactagtttaattgataaaggaatgataaaacgatgcagtcattaggagttattgatattggtggaacgaccattaagtttgctgtgtggcaagatcagcaattagttgctaagaccaaagttacgacgcccacaacgctagctgaattttacactttgctaaccacgcaggtcgcgcagatgaaacgcgattatcaaattgctggtgtaggcattagttcgcccggggctgtcaacaaggcaactggaattattgagggtgccagcgcactgccgtatattcataattttcggattcagccggaattacaacgccgttttgaattaccggtcagtatggaaaatgacgccaattgtgcggcgttggctgaattggcggatggggctgggaagcaggttgctagcctgtgcttcttaattgtgggaaccggtgttggtgggtcggtcattgtgaatcatcaaatttggcacggcgcgcacttattcggtggtgagtttggattcacgctcatgaatgaccatcagatcttaagtgagttaggcaccgcggtagctgttgcaaagcggtacaacgcgagccatccagctcaacctgagctagacgggcaagccgtgtttgaactggctgccaagggtgatactgatgctcaagccgaagttcaagttatggttcgggccttagcgcgggccatctacaacttacaatacagctttgacccggaattgatcgtgatgggcggggcggtctcaaataatccgcacctactcccagcaatcaatgctgaaattgaaaaattgcgggcaacggtcaaaattgcttctataaaaccagatgttgtggcttgtcatttcaccgatgaagctaatttacggggagcggtcgttgacttttgtcagacgtatctggacattcaaaaataaaagtctgaaaagtcgatggcaagcaagttattcgcattccaacgcaaacttacttagaatagtcataatgattataaattctaagtaaggaagtatggactgatggtaatgcgtgatctaaaatattggcacgaaagtcgggttaggcgtgctcaatgaccggtgggccgcgttagtactgatcaacctgaaggcggcgccaactgagattatgaatttgcgccagcgagttaggggccttagcacgcttaaactactgaatgttttagctaaattaaccgaattaggattagttgcgactgcagggaactatcaatttcagttgacgactgcgggcattagttttcaaaagcaactgcatcagttggaagtgtggggcgatcaaatgatcgtggccatgcactgaatataataagtattgactgtcgtgactaaaagctggtcgtaatccacaattatgggattatgaccagtttttagtttggtttctagttattatcggccccaagcggacgatcggaaaagagatggtaagctgcggtgtagcggctctgaacgataatgttggcaaccacttcaggtggctccggatgggccttggtcagccagtgctgaataattgccagcacgccactaaagtagattggcatggcgtagtcagccggaatcgactggaaatattgatgatttaagggcgcctgctcagtagtggcgagtaaattatcaatgagaccggcctgaaactgatcaagaaactgtggatcaccatgggggccaagcaaggcctgaaaactagctaattgggtgttgatattcgttgttaattccagataggttggataagcattccgcgggtcaggatgaaccaaggcagcttgaatcccttggttaaggacttgctttgaaacggttgcttgttcgattaaagcatgttcgaaagcgtgaatgaagtcgtaaatatcttgaaagtgactgtaaaaactcccacgactaacgtgggctgctttgacgaccatggtgacagtcaatttaaagatgggtgtcgctgtcagtagtgttgggacagttgcgaacattttctgtacggcaagcggatagttagttgtcatcatgtcacctcctgtaaatggtcaatttgacatcaattgtacatttccaacgcactcgtttggtcttagactatggttattctaaaaaacgaggtgcagctaatgtcaaaaattgattttcatacccactatttaccaacgagttacgttgaggcactaaagcgtcatgttccaggtgatcctgatggctggccgacacctgagtggacaccacagcttacgcttaactttatgcgtgataatgatattagttactcgattttatcgctatcatccccacacgtgaacttcggtgataaggcggaaaccatacgcttagttgaagcggctaacgacgatggtaaaagcttggcccagcaatatccagatcaattaggatacttggcgagtctaccaatcccttatgaactggatgctgtcaaaacggtgcaacaggctttggaccaggatggtgctttaggcgtcacagtgccaaccaactcacgtggactttactttggatcaccagtcttggaacgggtctaccaagaactagatgctcgccaagcgattgtggctttgcatccaaatgaaccagcaatcttgcctaaaaacgttgatattgatttaccagtgccattgttgggattcttcatggataccacgatgacgtttattaatatgttgaaatatcatttctttgaaaaatatcctaatatcaaggtgattataccgcatgctggtgcttttttgggaattgttgatgatcgaatcgcacaatatgctcagaaggtttatcaagtggatgtttatgatgtgatgcaccatgtttattttgacgtagctggagccgtgctaccacggcagttgccaactttaatgagcttggctcagcctgagcacctactttacgggagtgatattccatatacgccgttagatggctcgcggcaattaggtcacgctttaacaacgactgatctattaacaaatgagcagaaacaagcgatcttttacgataacgcccatcgcttactgactgagtaagtgatgttaggataactgttgaatttttggcgtgaccaatattaaaaaccggaacatctgttaattactggtgttccggcttttttacgttattgttagcataattagttgggctaatctgctgtacgggtaatgcaagtaatcagaaccctcgtctaaaaataaagtggctatggtgttgctgttttagccattgtctgaccgactgttgcggtatattcacgttcaccaagactgttgggatgtaaattatctttgacaaaccagttgtcgttgtcttgcgcaacgtatagccaatcaatgagatgcacattgttatattttttagcggccgcggcaatcaattgattgttagggtcttgccaatctttgcctggaacgcgggtgttgacccagtaaatctggtggttgctgccaatctgatcaatgatcccatcgatttcggcggcactcgttggaccgttcgtccccaagttgatcagcacgtttttctgaattgcattatcagcttttaattggctaatgacggctggtgcttccgacacttggcgaccaaccttggcgttaacgttaaaatggtcaaagatttgttttaagtcactcgtggtgcggaccatgattgaatcaccgatccccgtcactttaagtttgcgcaggacgtgaatttcactagtggataattgatatttttcaccaagggcactatccgaaacggcgtgtgtagcgcccttagttttagtattccccgtaatggcgttgccaatactgacaacctgttgcttaatggttggtgttggaatgattaatgtgccaccaatgaagacgacagcaaagattccgaccaaccaataaattaatttttgatgtttcatttggcacctccataccccgctataagattagcttaccaccattacagtgtcaattatgaaatttatcataaggtgcttaaagtggtgtgatggcaggtttgtcagtcggactgtctaagttgaatttgaaaagatcattggaaagtcaactggtgcttgttagactaaggctagtgcttttggaggtggttaaatgcaaaagaaaacggtgggactgttattagccagtgccgggccttttttgtggggaagctcgggaacggtggcacaacatctatttgacaccacaacgatttcgccgttgtggttagtggcggtgcggatgctagtatctggaggtctgttaattttatatggatttagtcgccggttaccggtcatggtcgtgtttcatgactggtgggcaacggtgcgtctgattgtgttcagcctgttcgggatggctggcgttcaattgacttattttatggcaatcagtactggtaatgcggcgatggccgcaattttgcaattcttgtcaccggtgatgattattatctttatcaccgccacgacttggcagcttccagggaaagtggatgtcatttctgtggtctccgcaatcgctgggacggttctaatcgtcacggaggggcacactgactcgctggctttgccagtaattgcaattatctggggattgttggccgcggttggtgcaaccatctacacattaatgccaacaaaattattaaaagtgtatggcgccacacccattgttggttggtcaatgctgattggtggtggcttggtgctagtcggaacaggtgcttggcaccattcgccgcagctaacctgggtggcgtggggacaagtcggcttcgtcgtgatttttggcacgatgctggcctacttgttctttttacagagcttggaatacatcctaccaacgactgctagtgttctgggagctattgaacccctagcagcaaccattttaagcgtcttatttttgcacgttcactttaactgggtcggactgattggggcgataatgattgtcggggtaactattttgcaatttgcagcgacacgcgccaatcagtttgtctctaagtgagcattgattggtatagatggggaccaaacaatatatgaacatattaatcgttttattcacaaattctattgaaaatccatcttgctagcgtatacttttcgatgaaggatattatgttacgagggggatttttttatgaagttaagtaagcggggactattctggctacttgggttggatatactcctctttgggtagacaagcaaataatcaaagcttgcctacctaaggaggagtttttctatgggcagaaaaggttctcgctatacgatta

SEQ ID NO: 10 - DNA, 128157 bp, synthetic construct
  source 1..128157: mol_type = other DNA; note = Lactobacillus plantarum PDG8 - Contig 10
attccgtgtgttaatcgcttaacacaacttaatcatcataacatcttaatcaatatcttgtcaacaactttttttaagaagtaacttgattaatttgtcatagttgccattgcgacaacagagactatcttaccaattactgaagaagttgtcaacaactaatttcaataattatttggtggtgagatgcatctgccgtagcagcaacgtttactaatataccagccagttatgaaactgtcaacaattaatccaatgttttttcacttttatgaaaagaacggcacaaaactgtcgtcaattacacaattactacattatatgtcatcgattaacatcattgtgagatggcactatgttttccaattaaggattccctttagacagcaaaaaagcgcccgtaaaagcacgacgaacgcttatcttaagccagcacatctaattttaaaaattcaaatgacgtttaacgattggtcgaattcccgcaacaattgggaatgccaagataccaccaaccacagcttgaactaaattagtcggtacaccaaccaatccagttcccatcgtatacaacagcgaatctgacaaaaagtatccgaccaccatcaccactaccgcagtaattatcgctgcaatctgtcgaccatgtgatttgctagcaccaagatatcctgctattccgccctctaaaccatgaacgagtagtgagaaaaacatatactgtggataccctagcaataaatctagtaatagtccgctagcaccgccaacaatgaccccaccacgccagccaaaaatcagtgctgcaataaagattcccgcatcacataagttaatataaccgtgtgtcatcgggattgggatatggaaaaagatagaaataacaacattaagtgcgatcaacatccccaggattgcaatcgtccgtgtattaaatttaacccccaccaaaactttcatctcctcaattgattttcatccggcaatgatcacacattattaatgtgacctaagtaaattttacaccagttcttacttgtaataataataaaaagactgggccacaacgggtccagtccacctgctaaattaacttacttaacatgtgccaagaagtaacgtttcttaccacgacgtacaatgacaaatttaccattaaaggctgcggacggatcaatctcggcatcgacatccgtcaccttttcaccattgattcgaatcgcaccgtttttaatatcttcacgtgcttgacgccgagaaggttcgaatttcgtagcatcaaccagccacaagacaatgttttgcttttcagctgagacgtctgctgatggcacacccttgaaaccttgttcaatttcatccgccgttaaactttgaacatcaccagtaaacaacgccttagtaatattttcagcttcaactaccgcctgcttgccatgaacaaattccgtgacttcttcagctaagcgccgttgtgcttcccgtttttcaggtgcagtcttcaccgtttcggccaatcgatcgatttcttcatgacttaagaacgtgaagtacttgagatatttgacgacgtctcgatcatcctggttgatccagaattgatagaattcatacggtgatgtccgttcagggtttaaccatacggccccaccagcagtcttaccaaacttagttccatccgccttcaacaataatggaattgttaatccgtaagccttagcgtcattgccttctaagcggtggatcaaatcggtccccgcggtgatattgccccactgatcagccccaccaatctggagttgcacgtgttcagcacggtacaagtgtaagaagtcaactgattgtaagatttggtatgtgaattcagtgtatgaaatgcccacttccaaccggcttgcaacaacttccttgttcagcatcgtgttcacgctgaacaacttaccataatcgcgtaagaaatctagtaatgaaatttttgataaccaatcgtagttattcacaatcgaaaagttttcgtcatgaccaaacaacttgtacatctgagcacttaagccatcctgattatgcttcacttgatccatggtctgtaacttacgttctgagttcttaccagatggatcaccgatagcacccgtcccaccaccaactacaacgtagggatgatgaccagccaattggaatcgtttgagaatcatgaaaggaatcaaatgcccaatatgcatactatccccggttggatcaatcccacagtatagtgagactgattggttttcggtaagttcctttaacccggcctcatccgtttgttggttaatggcaccacgccattttaaatcatcgataatgttcatgttagtcctcctcgttattgtcgctggacaaaaaaactcgcccctgtcatcaaaacagggacgagttttccgcgttaccacccaagttatcaccaaatgtgatcgctcattgattagtaacggatatcatccggccaatggcagttcacgttatgtaattcatctttgaccacagctcggttcgcaccacccaccgagtcgctagactgttgggtcaacgactactaattaacgatcactactttttaattattacctaacatcataagcactccactgccaaaagtcaatcctattttcggtcaaaacatcgcattaaacccactaatctaaccatagtgtctggcttgtgaatgcggttgacgtcgacacagtgatataaccagactactggcactcatttattgagctcccaggtaaaaacttaatttttagcatccgccgcaattttgataacggtattggcttgctggccttgaaccttagcaacctgtttgccattttgccattgaactgagtttgcctgtccgttttgtggggtatcgtacacggtaacggcaccactcgtgacatttttactcgtcaaatcttgcttttgaatctgattattgacctgattagcaaacttggttggattaccagcaacgtcctgtgtattggcaatcgttgtcactgaccaactacccgtgttccaatgaacatacactttgcccatcgtcccttgaaccgttgccgctgtacctgaattaagtgtcgtacgctgaccctgcgtattcgctaagtaatcgacttggctgctggcatcacttttcgtattgtagttcgtctgttgatacgtcgcagtcgtcgaactagtcccagctttggcgtacttcacccggtagtttcccttggtcccacttgcactgatggccttgactgtttgattggttgccttgacggtcgtaggcgctgccgtctgactaaccaaactaacactgtctgaagccgcgtgtaatacattcgttactgaaggtacggcaacaattccgaccaccaacatcccagttgcagtggcgattcctaattgaattttgcgcttaaagttcatgaaaaatatcctcctaatttctacaacaaatgaccgattttacttaaccataattaccttttctaccatgataatgagaactgagcgacagccatgcaatcagctaagtcctcgcttgtcccgagaagtgttatgtacgggacgtatttgtgttcgttgccaacgtggtgcacgacgaatcgtcgaccctcgccgctgcaccgttactcgtagtgcgcggcggcgggattgcctgtttttcgttactcgctgcctcagtgacggttgacgtcgcgtaagtcgctgccgcgttcgcccttttgaacgagtcaccggttttgttcgaatactcttaccgggccgccgaagtttagttgctttggacgtattcagtttaaactgtgttcctgtacgtcgcgtcgctttaagttttatcactttgggctgagtcgctcggcgtcgaatggcgcgatgctgagttattttgccatgatggctgttaacactgatcgtttgcaatgaccgccgtttgacgcgcgccacggtctgcgaacgcgacttattgcttaccactttctgctgcaccggccgagtcttcacagctggctgaactgctggcctcttaatggcgacaactgcttggcccacccgtccatgctgttgattgtgggccggcatagtcaaatggcgatcgtgcacaactttcagtcttggttgagctttaatcgcaacaccgggtgcgccacgggtcgtccccaaccaccacgaaacgggatgaacactagtaatgacccaactattatcaaccggtgccgctagcccagctaaatgatagcgattggtatactgccataacgccgccgaaatgattggtgggttgggcgttagcgcaccaatccactgggcatcaaaccgttgccgcgcttggttggcatacgtcagtgcgaacgaagcatacgaatagaagatcagttttttgtcagtcaatgcgcgcatttcacgataccaagccgcaactgccgcattagttgatcctgaacgtaccgtattaacttcaaaatccaaagcataaaaacgcgcagctttattggagcgcgcataaaacgcttgggcttcacggcgcgcgctagcggcatccgtaaattgcgaaaaatcatactcaccaaatggaatcccataacgaacatataatgccgtattattcgctgcgtcccggtcaacataatttaaaccatactgacgacgattgatcacaaatagcacttgcgacttcatcgcctgcacctgacttgggctgagctgtccttgccactcggaaatatcgaccaccgcgtgtccctgtgcttgaaccgtaatttgcatgccaagtgtggcgaccaccgccgttccaactaaccaactgagccttttaatccccatcatgcggtccctctccccatactgtgctccgcaattaaaaaaattatcatcataagttgttggtgattcccacaatcaccaacaactaaactgtcaaggacagtttatgacatacccataactttaacattcttatactaccaataataggccatttttaatgggctggggcgtcaattcgatttcaattcagttacagcttgttaacaaagcgtcgcccctttatggttaatattatgaacaactctggaaaggctgatatttgaattacagtttggttacaatcatgatattgttagcagtttctcacccgctttccggtgcccgaactacccataccacgggatattacaaccgtttcattcgaaaataccgccacaaaaaaagcaactaatcctcatcaagattttggctcatcttgaccaagattagttgcttaaactaattggttcacaatagcatgttgttaactaactaatgtggtaacgtcagaacaatggcttgcttgcccatctgattataagcagcctcaaaattcttccagctgactgcctgctgtttttctccgtacggattgttaatataaatcaactttttagtccggttaaagccaacaatgaccacgctgtgcatatcataagtcactttaacggagccctgtggtgtctgccaagtttgcattgtgctgaccggtgcaaacgaagccgtcgtaattgtccaaacgggccgtccttgttctaactgttcaatcacagtatcaaagtttgcccccgttaagtccttcacctgactagtctcagttttcgccaatttatagattggcttatgataggcacctaacccaggatcgttaccagtaatatccccaacaaacccatactctggatttccgtgttcgccgtcactataagtgagtggcacactcgtaatctttgccgctaattcatttttagtgacattgatatgcgcataattcatcaacatcgtcaacgatgtgacttcacaaccattgtataaacgtggtgttgtcatttgattcactagcgggacgtccaacttgacctgattgaccgacttgggcttcgtttgggaactagacttagctgcatccgtttgtttagttgtaaacgatgcatcaatccagtcagaaacttgtgtgcttgtaaatccaatgacccccaaaagcaccatggcaattatgatcagcgtccaggaccggcgccgtttccgtaaatgtcttggcatttgttaccatccgtttctcttttaatttgattgactactttactaacatactatgtagtatcataccatggacgaatcaataatacacctttacaatcttaaaaaaaaggcttgtataatcagccgtaagtcaatgctgacaaggattaaggttagcctggctaatcattaagcaacacactgctttaatcagtttattgatatattagtaaccttattatcaatttgttgaattagccctgaccgttacttagattataattgagattatctggccgaggctggcttttcccaaaatggccttgaatattcgttatttgccgatgaagtcaactttcctaattctgggcaccttcgttattttatgaagcactgagtccttgttttcaaaacagcattaaattggccccggcaaatccgttgcgtccttagattatctgtcatccgtttcaagcctagtggcatccaaagttttaacttctgatcagctttagaaaattttatgttgattaaagcgctttctttattacaatagtagtaaaagcagttaaattttatggttaattgtgaaaggacctgactggcatggctaattctgaagaccaaatggataaacacttacaatccgcaatattcggggcccccgtactacatccggatgaacaacaccgtaaccttggcacgtttcacgaacgaatcgatgtgggcattactttcacccaagcactcatgcgtgactactcaaccgaactaaaaagtgaaatggcggcccatcctgattaccagctactcctacatggcttgctagatgaagacatcctgaatcgctacgttaaactagccaaccagcagcacatcagttttgcgattcgaaatgacctcatgtaccagcacacacctacgagcctcgccatcgccctagtcgccaactgtgccatcacgccaccgacaatcgatatcgatgaacgttttcccgttccgccacttaacacaactaccgattggtcgcacgacgtcctcatcgatcacattcaccgtcatctggaacgcaatcgtcaactcttcagcatcaaacaccacttaatctaaccagtgtcttactttgacatctattgtgcgtgttgacatgaattatggttaaaacaaactgtttaactgcattattttccgtcagccggtgcgcgtcctatgccgacctccggggctgggtgacaattgctggaacgcagccgacgtcgatttgagctaacgcccaacccgcgtcatctcaaatacgagtcttattctaagccggaagcaacccacttccagctaagaataatttggctactgagcattgtcacccagcccctccagtctcaagcctgtgaggggccacgggttgaagccgctcgaatggctgatgaacgaccaccgaacttagcacaatctatcgttggctattttgatactggaacttcaaacaaagtgttaggtgcattagcactttgtcgagagattacatcttactacaccaattcaggattagtgagctatctcaatatcactttcagtctgacagttgattaacaaaattatcgtttatgaaaagcaacgacgaattcatcaaaagcttaggtacatctttgtccgccattcgaacactatcccgactggaaggcatttcggccaatgctcagcggtgaaattccacttagcaagcgtccttggcttggttagtggaagaccagtatttaagacgtggtttgcggcttaaatctgtgtccaccgcgttccagcaattggcagaaatgcctggaagtcggtgtaggacgcgccaactaagcaattttacgcttactcgacttttttccagcgggcctaagctggttgcttttgatttaaaaaacagtccgttttaaccatatttaatgccaatctctcaaatcgatgcattatacacaaagccaccaacttaaaatgatcagctttcactgattgtcctaagttggtggcttttactttatcaatcaaaagacttaattgacttcaccattggcccactagttaaaataatttcatcacgctaattacgattggtggcactagcaaggctggtaataggttcaacgtactgaattgcttgattttcaacatacctaagccggatgctagaatcaagataccaccaacaatggtaatttcattcagtaacgctgcactcaacgcacctttcaaaattaatgctaaaacatacaggctcccctgccaacaaaacaagacgcccgccgcaatcgcgatgccaaatccgaaagtggatgctaatacgatcgacgtgatgccatctaacatgccattcgtaaacaaaaaggtgtaatcatgctttaaggctgcctcaatcggccccaaaatcgataacgatccaatacagtacagtaacaccgcagtcgctaggccttccgctaagttgccacccgccaaacggcccacccagcggtcaaaatgcccttgaatatccaaagcttgaccaattaatccaccaatcgccaagctcacaataaaaagcaccgggtacttactctgcggcatccgttgcacgaccgcattaatgccgatgacacaagccgctagccctaacgcttgtaataatatcgcatggtaagctggcttgattccttttttaaagatactgccgaccaagcaaccagctaaaatcatgctcgtattaaaaatcgctccaatcatatcgccactcctaatcaatagcttaatctctagcgcttatttcaatttaaaataattaattatcatttagtataaagtctaaagttacttgagggtcaagtcttgattggtaattgtatctgcgtcaccgactgtgcaacctgatctgtaatcccataatcaatcagtgctgtctcaatagctgttcccgccacgtgccagccgcgagcacgacaatccgctaacaattgtcgatactgcatcggggcatccaaatgagtgccgtgaaaaatccgctgcgcatagctaccagccgccaagtgttcttgatggggtggcaccgtatcacccggttcaaataataaacaaattcccgcatagcggtcaaaatgtccggcttggatggcttgctggtcgagcatcagcgcaaccttgccgagaaagatttcgttcgtcgcgccggtctgtgcgcgtagcttagcaataacaagttcaatatcatcttgagggcgataaggctgacgtaaagccaccatcgctctttcaggtaacgtcacgcattcagtcacatcaaaattggcactttgggccgttttaatctgggccaagcgtgtattgatccgttgttgtaccgccgttaataattgcaattgcgcctcaacctgctgctgttgggtcgttaacatactcgtcagcttggacagttcacgggccgcaaaaaaatcggcaatcgtagccaatggtaagccgagtgctcgcaaatatttaatggtactcaaccgttcgaactgaggcgtcccataatatcggtagtgactatgcggattgactcgtgccggcgtcaataacccaatctcgtcataatagcgtaaagtcgccactgggatatcaaataactgtgcgagttgcccaatcgaaaaatcagttgtcatccgatcgccatcctcccctataggtcttatcataacttaatcgctgaagtaattgctgtaaccagaataagatatcataaaaaaagttgcatttcagaaattaatttctgaaatacaacttttgggtctatcaatcatcagtgatcatcgccatcgcattattaatgcagaactaactgacagagctgttttcaattatttcgtaattgcgcgcgcatgccccgcccgaatctcagctaaatactgatcacttttggccgtatcaaattcatgttctgacttaccgataattaccgcagctaatgaattgccgaccacgttaaccacggttcgtcccatgtcaactagccggtcgattcccgcaataaaagcgagtccttgtactggcacgccaatcgttgaaatcgtcgccaataagacaacaaacgaagcccccggcacaccagcaatcccctttgacgtaatcataagtacaatcaataaagtgatctgctggctgagtgacaggtgaatcccataagcctgagctaagaaaagcgccgctaacgattgataaattgcggagccatccaagttaaacgtatacccagttgggatcacaaatgagacaattccttcactaacaccgtatttccccatcttatcgataatgcggggcagggctgcttcagaactcgccgttgaaaagccaagcaccatttcatcacgaatgacccgtagtaggtgccaaatatttaaaccgaataacttaccaacaatgcccatcacaaccacaataaagattgccatggtaatataagcaagaataatgaaatagcctaacggggccagcgccttcaagcccatttcagcgaccgtgaccccaattaaggcacagacgccaatcggagccgtgtgcatgacccagttcgtcactttgaacatagcttcggcgacagcgttcataaagtccagaataattttgccttgttcgccaatagccgccgtccctaaaccaaagaaaacggcaaaaaagatgactggaatcatgtcaccagctgacaatgatttaaagacgttagtcgggataatgcccatgaccgtcgaccaaataccattgtgtgagaccgtcttagcggtttgcacatactgactaatattcgacgcatgtagttgatgaatatcgatatagtcaccagggtgaaaaatgttacccattaacaaccctaaggcgatcgcaatcgtcgtcatgatttcgaaatagataatggttttaccaccgatccgacctaactttttgaggtcgcccatattagcaatcccggtaatcagacatgccaccacgattggtaaaacgatcatttgaatcagactgatgaacatcgtcccgatgttttgcatcgcagtaatcgccgttttattgccataaaagacgacccctaatacaattccaagcactagcccaattaagatctgccagcccaagctcaatcggaactggcgataccgcttcatcttcccctgcttttccaagctacttccgccccattctcatttatggatgtttttatgaaatattgcacacaatattaatattttagcacattttcagtcaatatgagaattaaattaaaaaatcaatcattaaaatcaaatggtcccattgtaatagacgttaatctcagttgctttcctcataatcacgtaattgtcgcggtgaatcactatttccgttaccatcagaatccgaacattaaccaaaatagcgacaattaaaactagcttggttagtagttgtaatcattcctaaccaagctagtttttcaagcaacaactttattcaacggctgcggctacaacacctcatcatgtcgtcactcactaaccgatttaaaccgctatttggaacgggtcatccggtcatagacagcggcactaacccaatcagcggtccacatccataaaacatgcccaatggcttctgacacgtgttcggtcattggttgatccttcgcagcgggaacggtccccagtgctggcaagataccatggtgaaaggctgtccagatacctaacccatacaacgcgctgctgccaccttttgcccgggggtgcttgcgagcccataaactataggccacagcaaacgtcgttgagaatccgaaatgcatgacatagctgacacctggtaaatcatgaccagaatatgaatacgttgcatgcgtaacgctggcgggaatcccaatttgttgcaataattgttgtgggggattcgtttgatcccgctgtggcgttcgtggcggtaagatattctcccaccctaacttaactaaaccagaaatcacaccaccagtcacaccagcaataactgcggcccgatgattgaattgcttgttcaccattaataattacctgcctctctattcaataaattaatcataccagccttggtacccatttcgaaataatttagcctggtaattaaataaaaaatttgatttacaaaaatgaacgtgatacgattaccacattgatttatcacttgataaatgaaattaaaagggaggaattgacatgtatttaggcttaaaagaaatggcccacgaaaaactcagatatgggctacttagcggggttttgctactaattgccctcgtcgtctttatgctagcgggccttgctaacgggttatccaatggtaatcgtcaggctgttgaccagtggcatgctcaaacagtttatttgaacgaagatgcgaatcagacactgtcagcatcccaattaaaactagcagaccaagatcgaatcaaaggtcaggacgtcgcacccttagctagtctgtccggtactttacgaactgccagtaatggtcaaaagactaacgctagcgcttttgggaccactcgcgatagttttctgatgccaaaagtcatctcaggacaccgaatcaacggcaagaatcaattattgatttccgcgggattaaaagacaaaggctatcggattggtcagaaagttcgcattgggaccactgatcaaaaggtaacgatcgtcggtactttcaaagctagtacctatagtattgcgccaacggtctacacggacgttgccacgctcaatcgtctcaaaggtaatcccatcaccagtggcgatcaacaaccggtcaacgcctttgtgactaaaaagagtcatttcaagactcaacatcatggcaacatgcaacgtttatcaattgtcacgtttattgaaaaattaccaggatacagcgctgagcagttgacactcaacacgatgatttacttcttgttcgcaattgccctagccgtgattggaattttcatgttcgttctgacccttcaaaaacaagccttgttcggggtcttaaaagtacaaggtattggtaccaaacacatcttggctgccctactcacccaaagtgtcgtcatggcaatcattggtatcggcatcggccttctaattacgttaggcctcgcgcaaatcatgcccgccggattaccattcgccattgactggccacaatttggtatttatagtgtggctctcttgttagctgcagtcgtcggtgccttactctcatggcggactgtcgccaagattgaccccgtcgttgccattggataaggaggatgatatcaatgagtcaaccagttttagccttacaaaatattaataaacaatttggtcacggtcataccgctgttaacgctttgactgatgccaatttcgaagtcagtgctggccaattcgtcgcgattatcggcccctctggctcaggtaaatccacctttttgacgattgctgccggtttacaaacgccaacaagtggtcaagttattctgaacggacaaccactatcgaatcaaacggaaaaacagcgcttagcctaccgtttcaatgaaattggctttatcttgcagagttccaatctgattccattcctgacggttcgtgaacagttcaagctcgtcgataaaatggcccggcgcaaatttgatcaagcaggcaccgatgaattactagcagagttagcccttactgaagttcgggatgcctacccaagtgacctctccggtggtgaacgccaacgtgttgccatcgcccgcgctctttacaatgatccaagcgtcattctcgcagacgaaccgaccgccagcctggacacgccccgctccatcgacgtcgtcaagcgcctcgccaacgaagctcatcagcaccaaaaggccatcgtaatggtgacccatgaccagcggctaattgatgactgtgacgtggtctatcaaattgaagatggtaagatgagtcgccgcgattcgtagcgatattgaccactgcactttaacctcataacaacaaaaatgacctcgcaataatattcctgcgaggtcatttttattgttcatattcacacaacttatcaggtactacaaatcgaaagctagagtttaccaagctcaaagacagcctgcttcggcccgctggaaaaagtgcgagttagcgtaaacatgcttagatttagtcatccgacaccaagtcatccgttcaactaattagcttgcggcaatttatatcgcaatgcgcggtaaacaagtgcgaccacgtacactgtgataaaccgatctaaataatccgttcccacttgtatcaagaagacggccatcgctttgcccataccggtacctaataataattggactagcatgctcgaaccagacgacgtgatgccatgaaataagatgaccgtaatcgccgtggataaaagtgttccgggaagtgaaataacaccagctagccaccaatttgaccgccacgtgcccggcttgattcgccgatatagcagaccagcaactaacccagtcagcagttgaacgggcatgaagaacagcgagtacaggtctgtcgtcgcacccacgataactccggtggcacccccggccaacattccacccagtggtccaaacacagcagcagccaaaacggtaccaattgaatctaaataaatcggtaattttaacatcaaggcaatgttactgccaacaatattcagggcaatgcagagcgccaataacgtaattgcccgcgtttttattctcttcatgcactcaccaattggtgcaagacttgcgttaaatcaggatcagccgcaccgaccacagtcgttaagaacaaccgccaaaaagctacgacgtcaaccttcgtcatgatttgactattgggtgtgttgtgccaaaaatcatgatcatccacgattgactgcccacgcgcgacaccatccgtcacaaccgtcgtgtagctttcaaagccactcagaatcgttgggtcaagcattccggccacggccaacggatcattgatcacacaaccaataacccgttcatattcccaatgaaagtcaaaataaaaggttgtaattttctcaataaacgcccccattgctggattgacgtctttaatatacgttaataaactgggtgtcaacacgatgttacgcgtgacgtctaaaccaaccatctgaatgggaacaggcatcaagtcaaagacgaccttggccgcatccgggtcacaccagaagttgtattcagccactggcgaacaattaccgtgactccgataacttccacccatcagtgtaaattgatcgacttgttcaaataagcgtggatcacgttgcagtaccgttgcaatgttcgtcaacggtcccaacgctaaaatcgaagtatcaggtgcttcaatcagcgtctcttcaataaaaccagcggcatcttgaatcggtcgtaccgccgttaccgctggaatctgactattccctaaaccatcatcgccgtgggtgtcttgcgcactcgtgtaggcgacttctaatgggcgattagcgcccaaatagactggaatatccaatcggtcagccaaatctaaaattttcagtgcattttccgcaccgatatgggttggcacgttcccacaaacaattgtaatcccaatcacattaagtgccggtgatttaagagccaataatagtgctaaactatcatcgatcccgggatcacagtcaataataacgttacgcgtcgcattcattctcttacctccgataactgaagttcttggttttttatcctgggaagtttacgaaccaggccagctcgcctaattaggccaaactgtatgtgatgaaatgctaatccaattatagcggacggtggggcccttgaaaaccaccaatcgttactccgactcacatcttgattgccgcatgctacttctccgacaatgatcaccacgacctgcttaacccgctgtgaatactcatccccattagccccgcaacatcattatttgcagtattcatacgctcccagcgacaccttaagtagtttcccacctcccatttcgaaccaattatttaattatgttactgaacttttaccggagttcagcaagtgaatgaccggaaaacatggtacaatatgactactaaagataaagtaggtgtcgaatcatgcgtaaagttcagttttatggggccatttcaattgacggttgtttagccactaaggataatcggctggactggctgttcaaaacagctggtgccaacgatgcccccaccgaagcatttatgcagcaagttgataccgccatcatgggccgccatacttacgaatacacgatggaacaaaccactgatcaactcattaatccatataatccggcgacccacaatattgtcatgacttcccacccccacaccggtgatgaacgtacccagttcaccaacacccccgtcacgaagatcgtcgaagacttgcgacgtactgctggccaaaacatttggattgttggcggtgctggcgtcttaatgccgctgttagctgcggatttagttgatgagctctacatccagattgcaccagtcattttgggtgacggcattcccttatttaaagcaattgaccagcaacagcgctttgaattagttgacaccaatcgatatggtcagctcgccgaagtccactatcaacgtttaacaactgaataatgtcgtgattaaaaaatcccagcccgtttgcaacacgcaaacaagttgggattttcaattgctttaagcttcacgttggcgtttaaccgcctgacgaagtaatagcggtgcaatcagcgtcgttaaaatgattgctgtgatgactgccgaataacgatcatctgatagtaatttaccttgataacctatctgtgcaatgatcagggccatctccccacgtgacaccatgccggcgccaatctcatagccgcttaaccaattaaaacccgctaaccgtgcgccgaccccggcaccaatgagcttagtggcaattgccgcaacggtaatcacaacgatgaaccaaaaatcgttcaagaaaccattgaatgacatattcagcccaatactaacgaaaaagactgggataaatacagcattaccaatgggttgaatatgctcatcgataacttcatgatagtccgtctgaccaacggcgataccggcaaagaacgcgccaatcacagcacttaaaccgattgcgtccgctaagtatgagagtccaaaacaaatcactagtgacatcagcgtgatggaggttggaaccagtagagcattccccacggccattaaatgtggcaccacccacttgaccacaaagtacagcgccacaaagaacgccaactgaatcgccagcgagagtcccaagttggttgaggcatgactaccgccaccactgacttcactgccaaataagctgatcatcaaactcagaatcaaaacagccaggacgtcatcaacgaccgctgcacctaaaatcgtcgtcccttctttaccatcgagggcgcctaactctttgagaaccgcgactgaaatcgaaaccgatgtggccgcgaaggttacgcccaagaacaaactttcagtggcgttaaggtgaaatagttggctacaccagtcaatcaccgcaacgggtagaatgacccccaggaccgcaactaacaagctaggacgccaatacttcttcagcaatttcaaatcgctctctaaaccggccatgaacattaaaataatcacgccaagctccgcgaagtctttgataaaacttgttgctgagacccaacctaatacggctgggccaagtacaattccacttaacaattgaccaatcaccgcgggtaagcccattcggacactcaggtgccccgcaaccgccgtaacaattaaaatcaacgctaaactaccaacataatccattaaaaacctcctaaaaaagggcaccgcaagctctgactacccaacccaaaagtagtccgaattcttgaagtgtccttcaaccgtaaaatctattgtgcaattagtatagcatatttttacaagtctagccgtgacatctacttatgaaagcggttataataactcatatactgttaactgaaaggtcgcttagtcgtgttgaacattcctgattttcgtcaacgttttggttttttagttttttccattattctgaattctgctgccaacgcgctcaccatcgccaccagcctaggcagtgccgtctggactggctccagcgttaatctagctgactggacccatatttcattaggaaccaccttgttaatgtacggtgtggttgtcacgattctcaaccaacttctgttaggtcactttgatcggcgtcggtttatctccaacttgctctatatcgtgccctttagttacctggtccaatttatcggctacttttgggattggctacagattcccgccctgcccctgttgccacgcttgattctaaacgtgcttggactattaggcgttgcggccgccgtctcgatttaccagcgttgtaatttaattcagcatccgaacgatgatttatcgtacatcttacgctttcggtttttacatggttccgctatcattgcccagtggaccagttatttgccacctctgacgattatcgtcgtttcattcttcgccacaggtcatttgcgtgccattggcttcgggacggcctttgccttaattgctcaaggtgccatcatggggtggtctgatcatcatgtttttccccatctcaaacatcacgtggatattgtccaggcgcatcatccggcctaaatgaatcttgacaaagttcaggccaagcctcaataatgagagtattctaatttattggactgaagtaaatgaatttaacgcaactaactagtcaaatcattttgatgttcattctcatgctcgtcggcctgctcgttaacaagctcggcttcatgcatgcccagacttcaactgatttaaccaacatcctgttatacattgtgtcaccttgcttgattattcaagcctttgaaaagacattttcagccgaccgcttgcaaatgttagcccgggtcattgctggaattgtgatcatttatgtgctcatgatcattgtgacgcaattactattcaaacgcgtctctgaccagaatttgcgtcgcattatgcgttacggtgccgtatattctaatgccggttttatggggattccattaaccagctccctattcggtgcaactggcgtattctatgctgttgcctcgttagcggccttcaatatttttagctggactcacggtatcaccctcttcaccggacaacagggaaatcggcgggataatcttaaacagatcgtctttaatccgaatatcatcgccattgttgttgggctactgatcttcgtaacctcgctgcaactgccaacgattgccaatagcgccattaagtatgtcagttcggtcaacacccccttgtccatgatcgttattgggaacagtttggcagacgttaagcttaaccgtgcgacactcgataaacgtctttggttagtcatcttattgcgaaatttactgtttccatacttggcgattgttgtcctccagctaatgggtatcactggtatcccattattcaccacagtgttaatggctgcttgcccagtcgccggaatcgtcgtcttgttctcgctcaaagtccacggtgatcccgggccagccgttgccctaatgagcatctcaacgattttaagtgtcgttaccattccaatcgtctttgctttggtcaacttgtactaatgtgcctcactgcttttagttaagactaagtaaacgacaactaaaaatgagccatcagaatttttcattctggtggctcatttttaatgactagcatttgagatacgacttaagcttagatccactgcgttttagcaattggcagaaagcgcgctaactttgttttttgctaagtcgtgcgacgtccattggctttaaactggctggtgtcaacctccagcactagcatatctcagccataaattgcactgcaaaacagtggctactttgcaaccactcgtagttgttcaataacctctggacgtggctgagttagtccggccggtgaaaacagctgctcgaccaaatcatcgctaagcaagcgacgtcgatgtaataattcaggaattgcttggttagtggtgagcgcttctttaatcagcgcggtagtcgtctcataaccaaggtatggcgccaaaacagttgccgtaatggccgaatgtgccacttgatctgcacagcgttggcgattgaccgtcaattgccgcacacagtgatcgactaatgtagtcaaagcctgctgtaaatgctgctcactggctatcaatgcccgtaacataatcggctcgaaagcgtttaattccaattggcctgcttccgctgccattgttaccgtcgtgtcatgaccaatcacttcaaacgcaacttggttaacaacctccggaataaccggattgattttacctggcataatagaagaacctgcttgctgtgcgggcaaattcaattcaccaaagccagcttgtgggccgctcgccagcaatcttaagtcattgctaaacttggaaagatcaacggctaacgtcttcatggccgcagagaattccacgaacaaatcacagttttgcgttgcatcgatcaagtctggtgcagctactaaatctaaatcagtattttgatttaatttcactaaaatctgctgttgatacgtgtgagtcgcgttgatgccggtaccgattgcagtcccacccaaatttacgattcggagatgttcgcccgcctgccgtacacgggtcaaatcacgcttgaataattggtaataagcatgaaaggtccgcccgtacgtcgtcggtaccgcatcttcaagctgagttcggccaactttgatggcatcttgataacgctgcgatttaaccagtaacgtttgtaccaaccggctgagtgccgttaatagtcctgggagttgcatgcaaagcgccattttaccggccgttggaaaagtatcattggttgattgtgattgattaacatcatcgttgggatgaacggcaactgccggcatcaatcggtgagccaaattagccaccacttcattgacgttcatgttagccgaggtcccagcacccccctgaatcgctggcacaatgaagttatccgcgtaacgccccagtagtaactgattacatgccgcaataatggcgtgtgccttatcattagacaaagttccggcagccgcattcacactggccgccgctttcttgatttgaacgagactttgcatgatcagtggatgcatcaattccgtcgtaatcggaaaattatgaacggcacgtaacgtatgaattccatacaaagcatcatccggaacagctaacttaccaatacaatcagcttcaattcgcatagcaaaaccctcttatttagatttcatgttacatcttctaacatgaataattagagtttagaccattttctctgaaatacaatccttttaattgatttacgactaatattaagttcaacgccaattatggttaatattcattaagctcatcatcagcatacttcatattaattaactgtcccctactgccagcgcctataccaatcattaagttattacacaaacattaacggcctactcggtataataaacagttcgttcaaagatactcgtcctctggtaatttataagccaagtacaggtaaatccaaaagaagattcccccgccaaagaagaagactaatctgactaaagtcgaagaagtctgaaaacattcagctattcctccacaaacaccaagcaagatgcgatcctttcttgattttcttaatgccacttgaacacctcatttcgttgtacttctcgataaacgttatgttagttaacttaaacgcagatttctgatttaataagttattacacaaacatcaacagcctacttaacaacaggtatcgtgctagtcattttaggattaatcatgattaaaacgtgtcgttttttaagttcaaaaacggccagctaaaaaccgctggaaacaggtgcgagtgggcgtaaacatgcttttcaagttcgtcctacgccgacttccaggcatttctgccaattactggaacgcggtggacacagatttaagccgaagcccacgtcttaaatactggtcttccactaaccaagccaaggacgcttgctaagtggaatttcaccgctgagcattggccgaaacgccttccagtcgggacagtgttcgaatggcggacatgtgcgtacccaacttttggtaaattcgtcattgtttttcataaacaataattttatcaatcaactgtcagggtgaaaatgatattaggatgtctcactattcctcaatcaacatcgtaataattggccgtctcgacaaagtggttaatacaaccctaacgtttcgtttaaagttcccgtatcaaaatagccaacaacagattgtgctaagttaagtggccgttcattagccattcgagcgggttcccgactgtaggggctgggtgacaatgctcagtagccaaattattcttagtcggaagtgattttcttccggcttagaataagactcgtatttgagatgacgcgggttatgcgttagctcaaatcgacgtcggctgcgttccagcaattgtcacccagccccggaggtcggaataggacgcacaccggctgacgaacaacaatctaaacttgacacgttttaatcatgattcatgaccgattaactaatacactgctaatgttgcgcttgtcgtgtcaccacccgtggataatgaacaaagtgggcataaaagccaatcattaacacgacgaccgctaacccgcagacgccgttccaaccagctaaatcccataagacgttgccacaaaatgaacctagggcgccacccatgaagtagccaaacatgaataccgaattgaaacggctactgacatggacatcgatgctttgaatccgtgtctgattcgcgacctgcccgaattgagtacctaaatcaagaatgacgataccaataattaaccccaccaaatgcgtaccactcagccaaaacactacgtaggctaatgttgataacactagacccaagccgataatcgttcggggccgaaaacgatcggctaggcggccgattaaaggggctgctaacacaccggtaacacctagcaacgcaagcagaccagcttcacgacttccccacccgtattgatgctgcaagtaaaagacgagtgttgcccagaaaatattagaaacaccaaacaagacaaatccgttaacagccgacgctcgcaaaaccggatagcgttttactaactgaggtactgtctgaatcatggctttataattcgtggtatgtgtcgtcacgggatcatgcggtaattttcgccacaagacgagccacaatcctgcaatcaagatagcggcaatcagatagaccatctgccaaggcaaatagctcgcaagtaccccactgacagttcgtgacaagagaacccccacgagcaagccactcaggacgttgcccaagacttgaccacgctgattacgaggtgcgagaaagccggcgtacggaataataacttgtggtgccaccgaggttatcccaatcagtaagcttgccaaggcgtacacccaaatattgggagccacgaaggctagtaacgctgaaatgattgcgagtaccagtaagcgcataatcaacattcggcgattcatgatatcacccatgggtacaattaagagcaacccgaaggcatagcctaactgcgtcagcattgccaccgcgccaataacggcgtttgggagattaaattgttgcgcaatgtccgcctcaatcggttgaatataattaatattagccactacaatggctgcggagatcgccattaataggaccgtacttttatttaaagattttgaattcacgttaatttcctttccaattttgagatttaacagcttagtcaaaattagaaagcttgttcaaccctgatgatcaaccagtgttttaactgttgatcaacggggacactaccgcgcacgcctagttaacccactgcttagcagcggccaaatcagtaaccatatgggtcggccgttcagaactagtcggttgtcgctgatcacgattaatccaaatcatcggccactgcatagcactggctggaacaacatcggattcatagccacgtgcaatatgccaatgattatctgccgttaacttaaaacgctcttgaaccgtttcaaagaaagctgacgctggtttgtaagcttgaacgtcttcagccgtaacaaccgctgtgaacgacacctttaaagcagcaatgttggccggcataatatcccaggaagaattcgacataataatcaattgatagcccaattgctgccaggctattaaggtcggtataacatcggcgtatggtaataggtgtcgttgcacttccaagcattcaacgtaatgactttcaaagaagtgtttctgttcaaacaatcgatctaaatgcttaagatcagcccggactaatgttgaataatctagataaggattgacactggcaggatcgtcctcataagtcgcgtaggctttgcgaaccgttagtgggtctaaaccaatcgccaatcctaaattagccacccattgatacagcggctcagtattaattagcgtcccgtaacaatcaaatgttaaatattttttggtcatattttttagcttccttactgaatgtcgatgaattgtgctggctatcattagcacgactcaccacaaattaactaatattatctattttattttaccacgacaccgaacactcagcagaccgccccggtaccaattaataggcctaggacttgcatcgtgatatacttattgattgtgcattattacagaatttataaaagaaaggacggtattatgccaactcaaaattcaacgttgccgcttgatgccaacggccagccctatcaccggacttggcttgtattgactttacttgtcgggacgttcaccaccttcattacccaaacactattaacaacagcttttccaacgttaatggccgattttcatatttcagcaaccgccgttcagtggttgaccactggtttcatgttaatcatgggaattatgattcccgtcagtgcctggttgctgacccgaatcaattccaagtatttgtacttaacagccatgcttatttttggtctgggaactacgctggcgtactttgccgtcaactttcagatgttgctgattgcccgaatgattcaagcaatgggcgtcgggatttccgccccagtgtttcaaacaatcatgtcttcagtttatccacccgaaaaacggggttccgcaatggggacagccggcattgttattggcttagcacccgccatcggaccgacactctctggctggattattgataactattcctggcgggcactcttcttattcatcctgccaatcaatatcctagtcatcatcgtttcattcttcactttgcggaaagtcttaccaacttccaaacaaccaattgattggtggtcagtcttgatctcaacaattggttttggcagtatgttatacggtttttcatccgttggtaatgctggttggggcgacccagtcgttctcacaactttagtcattggtctgattttcattggtctattcgtctggcggcaacttcacatggatcagccattattggaattacgtgtctttaagattccggctttcaccctatccgcaatcctgactgccctcgcttacatggctatgatgggcgtcgaaatgattttgccaatgtatattcaaacggtcctcggtcgttcagcaatggactctggattgattttattacctggcgcaatcatgatggggattatgagccccattactggtcgcatctttgaccatatcggtgcccgcagactagcaatgacggggatgttactcctaacgctaggaactgctttcttcctatcaattagtgccacgaccccaatcttatggatcatcgttgtttacgccattcggatgtttggcctgaccatggttaccatgcccgtcacaacgactgggatcaatgcgttacctttccggttgatttcccatgggaccgccgccaacaacaccctgcgtcaagtcgcagcttcaatggggacggccgttttaatcagtgtctactccagcgtcgctaagtggcaaatgccgggacatcaattactgacacaggcacccttgaaataccgtcaggacggaatcaccgcaaccttaactggttatcacgtggcgttcgttgtctcactcattttttgtgcgattggctttgggattaccttcttcttaaaagccaatcattcaaaaaccattagtcaggaggatgatgccgcatgatcattgtcttactaattctggcaacctttgtctttgctggcacgatgattttttcaccggcaggccgcaaccgtctcattgccattatcattagtggcctcattattgccactagcctcatcaccctcgtcctaaacgacaattaccattggggcatgcacgaggtcacccgcacgcagattcaagacttagccccgctcaaatccaaacaagtagcgttgcgggtccagcaactcggaacagggtctgaacgtgtcatcagttaccgggttgcagccgccactaaagtcagtcacacggtgaccgcaaccaccacaacaactaaactgactagcggttcacccgcgcaggttcaactaaagaccacgacttggcagttcaaaaatcacctgacacacgtgttattcagcctaggaaataccaagacaaaaattgttcaacgacaatatttgtttacaattcctaaaacatggcaagtggtgacagttaaaaattagacgttaataaaactgactaaccatcttggctagtcagttttattttgtttaatcgtcatcacttgtggcgcttcgccagccaatcaaccgctgaaacctgatacacattctcatcatgatcgccatccaataagtgctgaccacctggatgctgaatcaaaaagtcaaagcccgcccgttgcgccaccgcattgcttgcctgattgtccaccgccacacgaatccgcaaacattgccgatgatactgattaaaacccaagtcacaaacgccacggacggctgccgtcatgacgccgcgtccctgaaatggtcgtcccaaccaatagccgatgttggcactgtggtcgttatcatcgaagtggtcacagctaaccatccccgcaacccgttgttcaacgacaatgactaggttgagcgcttgcgaccattgtaactgaagctgtgccgcggttaaaaagcgttgtttatccgccaccgtttgaattttagccacccatagcaaataatactgatactgcgcacgattagctgttaataatgctagtaatgccggcgcatcgctttggggtagtggttctcgcaattcaatcgctggtgtgactcgataagttagcatgaacattcctactctcttagatgaaaaatcgcaatcatgattaattaaatgattaaccctgattgcgatttaagtgtctcaaaattcaattaatgttgtagtaataacgtaattaaaatcaaggcgctgacgacctgaatcgtccccacgcctaagccatacagtgctaagcgcttgccagctttcataaagttaacaagattcaaacgtaacccgatagctgctaacgcaatgatttcaaaccaactactaattgtatgagccgttgcgccaataattgctggtaacgaaatcaagctattcaatgcacataagattaagaacccagccacgtaccatggtaaccaatgaccgttcccattaccactgacgacagcatcctcagccaattcattttcaatcgtgcgttggtgtaaccggccaaaaatcaaaacaacgacgactagcatcataatccgcataattttgaaaatagttgcaaattgaaccgttgtttgattaaccatactagctgcggccaccacctgcccaactgattgtaaagttcccccaatcaacgcccctttaagaatgacactgccaccaaacacggccattcctaagaccggtaacgttaacatcagcactgtccccatcaagttaactaaggtgatgacagtccccttatcatcttcatccgcgtcaataacgggtgcgattgatgcaatcgccgacgacccacacacggcgttaccgccggccatcagcatacgtaccgactggctgaaacccagcttacgccctaaccacaaagccccaacgatcgtaatcgtcatttggcaaagaataaagagcacgccgaacccaccaattttgccgattgtctgtaccgtcatcgtcgcaccgagcaacatcacggaatattccaacagcttactttctgcgaacttagtcccccgaccaagttgcggttgtttcagaaacgtattgccaccaatgattcctaatagaatcgcgatagtagccgcacctaacgctggcacaaattgcgccaatccttgactaataattgcaatgaccagactggtcactaaccccggtaaaatccctttgaccttcattcgctttctcccatctctatctcgatgcttttaagtatacgaaagttatttacatttgagaaataaatcattatgatagttactattaataaaaataatagttaggggtgaacacaatgtttaaacaattggaaacgttctgtgcggtatacgaaactcgcaacttctcccatgccgccgagcaactttttatttcccagccgaccgtctcaacacaaatcaaacaacttgaagccgatttacaaaccacgctcttaacacgtaacgggcgccaagaaatcgttcctactgccagtggtcagctcctctatcaacaggctcaaaagctgttaacaacttgggccgctaccaaaacagcggtgcaatcaccacgccacttagtgaaagttccttgccggattggtgcctcacacacaaccgggcgtctgattctacccactttattagccaatttgagtgccgtcagtgatcgctttgactttcaagtgacgcttgccaattcggccgaaattttgaccgctatgtcccaacacaaactggactttggtttagttgaaaagccactcgttactgaccagctcaatcgcttgccatttggtcacgatgagctcgtccatgcgggcgactttgccagtcccctctggctgctacgtgaacctaattccggtgtgcgtcattataccaacgcctttttaaaagcccgcaacattcagccagcacaagtcatggtcatccacagtaaccaaatcatcgcggacctcctcgctcatggtatcggccaaacaattatttcacgtcacgttttaagcaacgagattcccatcgaacagctaagtgctcattaccaacgccaattctttttactgactaacacgcaaccggcagcggcactgcgccccgtacagactgcaattacccagtacctaacaacgtggtcagattagcgatccccgccgttgttattaggtctttttgacattagcgtttaaaaaatggtctgaccactaaagtcagaccatttttgatattcactgaacaaccggctgccactgttgccaaacttgttcatcactatattgttcactactccgataggcccccttgctaagtcgttgctgacgttgcggactttcaagtgttcgggtcagcgctctgactagttggttgacggcaccatccgtgaccagataaccattcttgccatccttcaaaacatccttagggccatagttaatatcataagcaattgctggcacaccatgactaagggcttcaattaacgataatggctgcgcatcactttcaccagtataaacgtaagcaccggcctgatcataagccattgttaagttcggttgatacccagcaaaagtcacggcggtctctaggtgcaactgggacacttgctgttttagacggtcaagctcaccaccatacccgtaaatcactaaggtcgcatccgtaatcttatggtgcacttggtcaaaagctgtcactagctgatcgacgcgccgttccgcatccaaacggccggtataaataatttcatgcgcatgacgttcactgatcgaaattggtgcgtgttgagcgtgctttttggaaacaatggctgctgaaatcgtcaggattgggacactcggttgaccaccgagccactgcgtcaaatcttgcttctgttgttcggtactcgtaatcacaccgtcccaagcactcagaaactcgtgcaggccataaacatacgcgttattcaaattagaatagacttgatcacgcggatcgactgcatgtggcgtgggtaaccacaaatattttttagccgccgtctgcatgttcaccaccggccactgagcagctaacggccgatccgcaataaagacgttgttttcatcatattgcttgttcagttcatctaagaagaaccggtaccattcttgttcaccattaaagtagtagtcacggccatgataattgataagatggcacaacgaaacataattagtcccattattatcatgcgcataatactgttcggccatccgactaccatctggtcgatagaaaatatccgtgattggttccccggctgacgagaagaattcatcacgggctttaaagccccgttcatcataatcagtacgctgaacaagattattgaagtgatcaaaaatttcaatgaagtacacgtgccccaccgtgctgggaacaaagtggaccttagcaaccagccgatcaccagctcgtacctcactgacattggggtccggcttaatgtcataggcagttggccagttcaaatcagccatcttgatgacccgactggaaaagctggtcgtttcacgaaaaaagtcaaacaagttggccatctgatcatcggcaatattgaagcgccgcatattctgatgtaacaaaccatcgaattgacgcgttactagtttagccggtgcctgatgatctttaaacaactggagccgtttaaattcggcatgttccacaccagaatttaacgccattaaatattggttcacaaaaaaattcatcgctgtgttgccccctcaacttgataaaaatcggctgcggctttcatgagtggttgccactgttgccaaacagccgttgtgctaaagcgttgggcatcttgataagcctgttgactatacatggctaactttttcggctgcgttaacaagtcgatcatcgccgtagccaacgcattttcatcattgaccggcaccaattgaccatcgtgaccgtcccgaataatatcacgtggcccatatttgacatcataggcaatctggggcaccccgtgggcctgaccttcaagcaaggcaagtgcaaaaccttctgcccgcgacgttaacatcgccaactgcgcatcattatagacagctgttaaatcggtcgtataatcattaaacgtaactgccgctttcagtcccagctgttccacaagttgatgcagttgtttgccggtatctccatttgcatagccccagaaatcaagggtcgcattcggcacttgggccaatacctttttgaatgcccggatcacctgatcttgttgcttttcttcggctaaacgcgccacaaaaataatcttgcctgcggtgcgctgatcaaaagatggcttgggcgcattcaaagtcgcgtcatcgacaatcccaactggaatcgtataaacggcgggttgattgccaaagcgggcttgaaagtcagcagtttgttgcttagtcgacgcaataacgccattccatcggtctaggttattgagcgcgtaagcataattaaagttgagactagccgtcttcggatgtgctggatcattaacgtgattactgtgtaagtgcatgactttaaacgctttagttcgcatgtgaagtgcggcgtaagccaactcatacgtccgatcaatgacaaagaccgcatgcggcgtcctccgattaagttcatcgaggaaaaaggttgtcattgccgtttcaccagcaaatgaccagtcttgcccctcataattaatgaatcgataaagtgaattttggacctgattttgtcgatctgccatatgaaatgtctgatagacgacctccccgtccggattaaagacttgttcacttgctacttgtccatcagcggcatagaactgttcaagccctttaaatccccgggtatcgtaccaatcggtcttcactaacttaccattttgatcataatattggacattgttcagttgtttttgagtgttcagaaatgtattgaccttcattaataattggtcattttgataaacttcataatgacgcccaacgggttgcacccgcaagtccggtgctagatgcaggtcttcaatcgtcatcttagtcgttggccgttcactggaatgctgaatgaaatcaaacagattaatttgattttcagccgcaatccccgctgctgtcagtgtctggtgtaacgataatgaaaaaaatcgcgtgaccatcttagcaggaacgtgatgctggttaaaaagtgccagccgtttcatctcagcatgttcaattcccgattttttcgggttaatgctggtattcacaaaataatacattattactcgctcccttacacgacgttctgcttaacggtctcgattataacaaattttactgaattaataagaatatcgctcacagctttaaaccattttttaagttaccttctgaattttaccgcgagtgtgatgataatgtggcgaaaacatgatgaaagtgttaacttgttacaccatgttactttattacaaaattggctcaaaccgtaatctgttatttattgctttgcaatctgcggtcggtatactaatcaccattcaatcgaaataacaacacaacttttataggagtgactgattaacttatgaaaattaaaaatgccctattaacttcattggcagctaccggtctgttagctttaggtactaccgttgctaatgccgataccgttgtcgttaaagctggcgatactgtcagtgaaattgctttaacgcataagacgaccatcaaagcgattcaaaaagccaaccatttaaagaacgttaacttgatctatatcggtgacaaactggaagtcaacggcaaacaccacgcaaccacggttactacccaagtaccaactagtgctgcttcaagtacggctagttcgaccagtactgccagttcaacggccaacagtactagcacccaaagtgccagcagcgcagccgttagcagcagtacaagtacgtcagcagctagcacggctaccagttcgtcaacgacaagtgtcgcctcaagtagtgctgccagctcatcaagcacaagtgctgcttcaagtagcgtgaccagcacgtcaaccgccagcgcggcctcaagtagtgccaccagttcatcaaccagcagtgctgcttcaagcagtgccgccagttcgtcaactagcagtgccacttcaagctctgcaacgagccaagctagcacggcgtcaagttcaaccgctacttccgcatctatgacgaagttgagcaacaccactgcttccagtgccgccagcacaagtacggcagccagcaatagtgctaccacttcaagcagcaccacaacgagcactagcagcagttcatcaacaactagcacatcaagtagtgctgaagctgccgcaaaagcctggattgccaacaaggaatccggtggctcctataccgcatctaacgggaactattatggtaagtatcaactcagcaagtcacttctaaacggtgactactcagcttctaatcaggaaaccgtcgctgacgaatacgtggcttcacgctacggttcatgggtagcggccaaggccttctgggaagccaacggttattactaaacacattcatgcacaactgaacatacaatcagcgcggtcctatatgggggccgcgtttttctgttgccatataggtgcatcggacttgcctgactgcaaactggcaatccccccatgatcggcccttattgcagtccttcatcaaccactatgcaaatggtctgctggtaaagtcgaacacgtgcaagccgcagtcaatttgggagggcttttcaaaagtccaattctaccatgccccccaccgtcaacgtaatcacgttacgcaggtcactacattgacacactcgtcactaagattgcattgcaaattagcggtaatgtaagcgttaatctgttacactatgtcttaatcgggcatgttttattttctaaaaagtccgtcagtaagcaaattgcgcttaacgaaccgcttacatgatggtaaactttaagggaagtctaatctagtttgggagtgaatcaattatatgaaaattaaacacctattattatcctcattagcaacaactggtgccattgcccttggtgcaactgctgctaaggccgatacggtgacggtcaaggctggtgacactgtcagtgaaatcgcagacactcacaaaacaaccgttgccgccgttcaaaagttgaaccatttgaagaacgtcaacttaatctacgtcggggacaaactacaagttaacaaacaccagacagttaaaatgacacgggccaccacctcagtagccacgccaagcacgacgactacaacaactagtgccgccgttcaaaatcctactagcaccgttaccgccacgtcaacggttagtcaaagcacagcgagtcaagccagtgccagctcagttaccagtgcagccagtcaaagcagcacatcagccgttagccagagcagcacgagtcaaaacagcgccagctcagttaccagtgcaacgagccaaagcgcgacgtcggccgttagccaaagcagtactagtcaagctagtgctagttcagtcactagtacgacgagccagagtgcaacgtcggccactagccaaagtagtactagtcaagccagtgctagttcagtcactagtacgacgagccagagtgcaacgtcggccgctagccaaagcagtactagtcaagccagtgctagttcagtaaaaagtgcggctagtcaaagtacaacggtaaccagtcaaagcacgacgaccaccgctagttcagccgcaactagtagtgcaagtactagcagcacaactgccagtcaagctagctcaagcacggccagttcaacaacaagcacgacaaccagctcgactagtacatctgaggctgctgccaaggcctggattgctgctcgcgaatctggtggctcctacaccgtaaccaacggtatttactatggtaaatatcaacttggtcaatccctcttaaatggcgattattctgccgccaaccaagaagcgactgccgacgcatacgtcgctggccgttacggctcatggactgctgctaaagcgttctggcaagcaaacggctggtactaatcagcatctgcaattatcaaattcaagctttatcattgacatcaaagccagcgcggacgactcatcgttcgcactggcttttttcattaagatatagcagtgatgttctgatttaatcaggtcgtcacaccaccaattctgttatactaacgctatcctaattgagacggagggctcacacatgcacttaacattgacccaaacaaccattaaccagcaaacttactggctgggcacaacgcccaccggcttagcctttgtcggccgtgccaacggtccacgcgacgaatggcaagccttcttcaaatccgctaatattcattatgatcaacaagctaatcaacaggcctgtcaagaattacatgattacctaactggtcaacgccagcattttgacatacccctcgaccaaacgacgggcacccctttacaacaccaagtttggcaagctttaacccgtattccatacggtcaaactgcaacttattcacaactcgccacaatgatcaatcaccctaccgcagtccgagctgtcgccagcgccgttggtaaaaatccactccttattgtgatcccctgccatcgtatccgccgcaaagacggtcaacttggcggctatcgtggtggtttgccaatgaaacgcgccctattagctcttgaaaacgcccgcttgcccaaataagcttcatttagaaccaagcgcacgcccttgtcacaccgaatcaactatgtcatcataaaatcaaacaatgattgctaattgtgccaatagttattaggcctaattaggattaaaacgtgccaagttgtgtaagttcaaaagcagccagcttaggcccgctggaaaaagttcgagttaacgtaaaattacttagttggcgcgtcctatgccgacttccaggcatttcggccaattgctggaacgcggtggacacagatttaagccgaagaccacgtcttaaatactggtcttccactaaccaagccaaggacgcttgctaagtggaatttcaccgctgagcattggccgaaacgccttccagtcgggacagtgttcgaatggcggacatgtgcggacccaacttttggtgaattcgtcattgtttttcataaatagtaatttctctcagcaactatcagactgaaaatgatattggaatagctcaacatcttaagccgctgtagtcaaaattgaatgttgcgacaaagtaggttatgcaccctgatgttttatttaaagttcccgtatcaaaatagccaacgacaaatttcaccaagttaagtagccgttcatcagccattcgagcgggttcccgactggaggggctgggtgacaatgctcagtagccaaattattcttagctggaagtgggttgcttccggcttagaataagactcgtatttgagatgacgcgggttgggcgttagctcaaatcgacgtcggctacgttccagcaattgtcacccagccccggaggtcggcatagaacgcacaccggctgacgaataacaatctaaacttggcacgttttgatcctatttcatgactaatcagctcgcacaacacgtaatgactttatttcaagaatttgggggacaaactaatgctatccatcgcacatattcagaagcgtttcgggactgttcaagcattaaatgacgtgtcatttgacgtccatgacggggaaatcatgggattgattggtcaaaatggcgcggggaaatcaaccacgtttcacagcatcttaaattttctatcattcgacggtcaaattacttggaatgggcaaccgttgaccgctgatgactacgatcaaatcggctacttacccgaagaacgtagcctaatgtccaaattaaccatcacacaacaaatcgtgtacttggcccgtttgaaaaatcagccggcacgggtgaccaagggcaaaattgccgcatggatgaagcgctttgcggtcaaggggcagccgaccgataagattgataagttatctaaaggaaaccaacaaaaggtccagctgatttgtactttaattcatgatcccaaactgattatcttggacgaaccattcagtggtttggacccggtcaacgccgacctgctcaagcaagctattttagatgctaagcaacggggcgccgcgattattttttccagtcatgatatgagtaatgtcgaagcgatctgtgactcactcgttatgctacgtaatggtgaagcagtccttaagggtaccgttgaagacgttcgcgcccagtttggccgtacccgtctcttcttgacgactgactggtcacaagcgcaactggccgatctaccaggagtcaccaacgttactcaacaaggtgcccagcgattccgactcgaacttgcagatgcttcagttggcccagcgatttttgatcaagtcactgctggtcattacattgaagagttcagtcagcagccaccaacgctggatgagattttccgaactgaagcgggaggtgttaaccatgaataagacttggattgtgacttttgaaacctacttgcggcagatcaagtcctggagctttttgtcactcgtctttatgcccttcttgttcttcgggttcgtggccgccttttcttattttgctgcacccagcgctagtaagaatgacatcgcggtcgttagcactagcccacaattacgcacaagtttcattaagcagagtcatgtggctaccgctaataaataccaaacactcgccagcgctaaggcggcgacgaagcgcaatgacatcgccggctacctcgttttaacaaccaaaaatcaacagttgcaagcgcagttcactggtcctaatgctgtcagcagcggtgacaaggctaagattcagcagttcttagccactgcccaaagccaacgtaacgtacagcgcgcacaactaagtgccaaacagacccaggcgttggctgtacagccaaaatttactgaacaattacagaagcacgctgcttcagataaaacggctaaaacggtctccttctatattgtcgtcttctttgtctacttgattttgaccacttattcagcaatcacagcacaagagattgccgcagacaaaggcaccaagattatggaagtcatcttctcgagtacgacaccgcggaaatacttcaatggtaaaatttacggtgtcttactagtcattgtgactcagctgctcgtctacttagtgggtggctttgccgtcatgcaattcgttaaacgtagctcactcacaattgatttttggcaacagaataccgatttgatcaatcaagtgattcacaacttggtctcaatcaacttgttgtttgcattactggccgtactactctacaccgtagcgtcggccttctgtggtgctttggtgacccgggtcgcggatgctagcaaggcagcacaaccggtcatctatctgagtatgctagcgtttttcatggccctagcctttcagaacacacccaccaatctcttcgttaagattttctcatatattccgttcttctcatcatacttcatgccattgcgcctcattaacggcatggcaacgatgcccgctgcaatcgtgtcactcctgattctcattgcaacaatcattggaagtatgatctacatcggccgaatctatggtgggctaatgttacaaacggatgaactcggtttctggggcaacttaaagcgtggcttacggttgaagtaagcccactaattgaatattattaatacaatataacaacagcaagcacccggtctagcaacgccattatgcgctagaccgggtgcttgtattttttgaattcacattttcgacttatcggcaactagctcaaacaaccgttaacaacagctaaatcaagttaagcctgcttcgtcggataaatcgtaaattcattaacgttaacatcttctggttggtcaatggcaaagttaaccacgttcgcaacggctgctggactgattcccacttgttgataaaaatcagtcatattctgtttggccgtcttatccgtaatcgtgtgcaataattccgtattgatggccgctggatataagctgaccgttcgaatattggtaccttcttgggcactttccatccgaatgacttccatcaaattacgaaccgcaaacttcgtagcaccgtacacgccggagccagcaaaggacttaatcccagccactgacgatgtcgtaataatctgacccgatttttgagcggtaaagattggcatgaccgctgccaccccgttcaagacgcctttgatgttaatatcaatcatctggtcccattcatccgtgtgcaaggcactgattggcgatgtcggcataatcccagcattattgaaaatcacgtcaaacccaccgaattgcgtttgcgctagcttaaccagtgcttgtacatcggccgacttcgttacatccgtcacctgataggccgcttgtccaccggctgccttgatttcatcaactaaagcggccaggcgttcttcacgccgtgcgcccaatacgactttagcaccattactggctaattgcttagcggtcgtcgccccaattccggacgaggcccccgtaatcacaacgactttgtttttaactgtcatctaactattcctcctattcaccgtaaacttctttaatcagcgccagtgctgaccacgccttaggccaccccgcatagaaagccaagtgggtaacgatttcaacggcttcatcctttgagataccatgatccttgcccatcttaaaatgcgcctttaattgtggaaaatcaccactagtcattaagcatgcaatcgtaatcatgctccgatcatgtaaacttagtgcgctttcgcgtgaccagacttcaccaaataacacatcatcatttaacgcggcaaattgtggtgctaatttgcctaaattgtcgcgtcctgcggtttgtttaactgtcatattagtttcctccttcaataactgctttaacttttataattttgcgtacgcttcatcgtcaactggttcgagccattcgctagttcccttagtaatcgcgatgtgggcaaaccaactatcctttgttgcaccatgccaatgcttcacaccaggatgaattgtgaccacgtcgccgggatgtaataactgggctggcttaccagcctcttgataccaaccttcaccactcgtcaccaataagatttggtatccgttatgatggatatgccaattattccgacagccgggttcaaacgtcacgttggaaacattcacgtcgacctgctcatcaccggctaaggcattcaggtaactttgaccgataaagtattgttggtaggcctcattctttacacctaatccaaataggccgctattattagttgttgtcatattaaaaacactccttaattatttgcttgctaactgattgatgaatacagcttacaacttaaagtacactttaagtcaacaataaagtttaaacttgctaaaataggatttcgtggtattgttattgctaaagttacttcaaataaaagttagaataaggagaattttaaaattggtaaggactactacagaacgttattcaatcggtgacttcgctaaagccgttggtctcagcgcccccacactacgctactacgaaaaagcgggcttgattgaaccacatcgcttagacaatggccggcgctattatgagactgccgatattaactgggtcaaattcttattacatcttaaaggaacgggtatgagtattagcgaattgcagcaatacgttacctggcgcgcagccggcgacgacacgattcccaagcgattagcactgctcaagcacgttaaagaagactttctcgtccagttcaacgaagtccagcatcatctacagattctcaacgacaaaattaattggtatgaagaaaaggaagctggtattacccaggatcacgaagatttttcgagttacttgcaacggtttgggcatcacgaataacctgaataacgcacaaccgtcaccacaatcattattaagttagatacaccgaggttcagtcgccttgctcaaaaaagtaatagtcatttcaagaatcaattcttgaaacgactattactttttttgaaaccttttccagcataatttaattcacgattattaacgtttccgttaagccagcaattccgtaatcattttttgataaatctcgatgaagcgcccatacatatccaaatcaacatattcattaacttggtgcgctgtaatattgccgggtccgaagacgatcacttgcatatcaggactctttacaatataagacgatgcgtccgtcccaccaggagcaccaaagtacgggagccgctgttgtaagacttgttccccaaccttcttcgccaactggaccaactggctatcttccggcgtatgcactgggtagaacgaacttgcgatgtccatcgttagattggcaccatccgcattgcattcagcaatgatggcttccaaatcattaatcaagcggtcattccgtaattctggaatcgtccgaatttttactgacatttcggcactggctgggacggtgttgacctgttcgccaccactaattaacgtcacgacaggtacggttgggcccaatacgggattaacgatagtcttgaaactgtcaaaataggcggtttgtttctgatagtaagtcatcaacatatcgatggcgttttgaccaatcgctggcatcgaactgtgggccgccaccccttgcgctttaatcgtataagtcagtgaacccttatgcgctaattcgatgaagtgttgttcggtcgtcggattcgcatccgccatccgttgcgccgtatcgtcgtcaacacctaacatggcttgaatcgacttggtcagtaaaagctgtttgtccgcaccgcttggttccgcacagatcaacgtttgaatatcatcggcgtaaccgagttccgtcaattgttcagcacctaaatggtcgacttcttctcccacagttgcgagtaaccgcaccgtgccatggagtgggacgtcttgatcgtgcaatgcaatcatcgcgaaaacttcagccattagtccaaccttcatgtccgtcacaccgcgaccatacaaccgattatctttgatagttgctgccaacgggtccgtgtgccatttatctgcatcacccaacgccaccgtatcttcatgaccatccaacgcgacgactggaccgtgaccatcaccaatttcggccaccaagttcacccgcccgggagcgtactcgattgattgtgcttcaataccatgttgctttaaaagtgtgaccaaataatccgccaccaattgctcatggttatttaccgtattcatttttacaatatcgcttaatgcctgtacagcagcttctaactgtgccgtttctgccatgccattcatcccctagtcatccttaattaaactgttccaatcaatttaattataccacttcggctaccgttggccgttgtcagacacgtttaatcgacagatttcagtgcatccagcatattgactcgctttaacttacgatgcatcattcccatgactaataaactaaaggccagggtcaataatgccgcgtaaacgtaactcaacggatgaatcgttggtgaaaacattaacgcgttcgtttcagccgtttgcaagatatatgcgtgcaaccagttgcccaagaaacaaccggcaataatgcctaaaaccgtcaatatcagattttcacggaaaatatacatcgtcacttcaccatcgtaaaagcccaacactttgattgtcgacaattcccggatccgttcagaaacattaatattcgttaagttatagagcactactagcgctagtgcccccgccgagatgacaaagatcaatacgactaagttcatgctatccagcattttaaaattagtggctttctctgtactcatcagtgtcacgttctgaacccccgcctgtttcaatagccgatccgcataagcattttcttgctttttcgttgcctgcttaaaccggacatagttcgtgttatatactggtgcctgcttgaagacacgtcgataataagtcggactcatatagataaagtgattgacgtaattttcagccaccgcactgatgtgaatccgcttggtggtttgcccggccaacttgattgttaaatcatcgcccgcatgaacgccatataacttagctaatttttcatcgatgaccgcaccgcgattaccgatatgaatggcctgatgactttgtcggtgccgtaataccacgaacttgcttagcgattggtggggtgctgggataccgagcgtagccgtctgttctgctaccccggactgtttgaccgtcacctgcttggcctgtaatttcaaactagcctggtaaagttgaccacgactaagtgcttgccgttgttggtccgtttcgttcccactacgcgtcaccactgcatcgtagtgccacaactcgttaaattgcttgacgctaatatcaccaatggaatcctttaagccaaaccccgtaatcatcattgccatgcagcccgcaataccgagcacggtcatcagcaaccgttgcttataccgaaatagattacgaagtgtgattttatgattaaaactcagccgatgccatagccattgccagcgttctaatagcaaagtcttaccggccttaggtgctcgtggctgtaagagttgcgcgggtaaactgtttaaatccacgcggagcacgaccagtgccgtccccaacgtgcacaacaacgcaatggctaaggcgataccaatgtccatccaaatgtattgaacgttgattgcgggcaaattatacatactaccataggcctgcgcgataaaccgcgggaaaaaattgacgccgaacaggacacctagcgcggtcccaatcagcgcggctaaaccaccataaatcataaactcgctaccgaccgcggtattcgtatacccgagggcctttaacgtccccatctgtagccgcaattcttcaaccatccgcgtcatcgtcgttagacaaattaacgcggcaatcgcaataaagaacagcggaaagacagtcgacagtgccacgactcgttgcgtattttcgtgatattctgtgtaacccggattatccgtacggtcagtgtacaaataagtcggcattgtgatggccgcgacctgggactgcgcgcgttttaattggctttgtaacttgactagttgtgccgttcccgctggcacttgactagcaagttgctgggtcgcctgccgcaatggtttcagcttagcctgggcctgggcttgtaatgcctgctgccgcttacgcgcttgtggttttaaccagcgtttgagttgcgcggtgttctcgcgattcaagcgccgatacttcgccgtgtagggggtgacgccccgcaaatttttgaattgcacgtcaatgcgcgttatcacactggacttaatcacctgcggacggacatagaccaagtagtccaaagtccctttaccaatgttggtgacaccacgattcgtattttcaacatacgttggtgaattgacaaaccccacgaccttgaatgttcgccgcgtgaactgtgcattgcgcttagccgtactgctaattcgatacgttgaaccgacttttagcttcggctgcaatcgctgtgcttgcgcgtctaacacgatctcattggcatgccgcggtaaccgtcccttaacgatccgtaaccgattcagtcgttgggttgtcggtaacgccatcacccgcacgacttgactattgttcaactgattaacatcagcgtagcgtgtcgcttggtaagtgagctgtgagcggtgttgattcagtactcgtgtatcggccttagtcagccccattgtcgactggacactattggtcgccagcttttgcttcgcataataatcattagctgcctgtgacatatccggaccggtcgcccgaattcccgtataaaaagcaacccctaagaaaatgatcagtaatattgaagcaaaacgggctttcgacgaccaaatctcacgcataattgttttaaaataagctgctgtcatcgctgcacctaccattcaatctcagccaaaggcgttggatgagcattatgctcaaccgactgcacttgagcatcattgatacgaatgacttggtcacccagctgcgcaatcgcactattatgcgtcacaatgatgaccgttgtctgcgtctgcttagccgcatcttgaatcacctgtaagacttgcttccccgtctgatagtcgagcgcgccagtgggttcatcacagagtaataatttgggattcttcgcaactgcccgcgcaattgcgacccgctgttgttcaccaccggacaactgggctggaaagttatctgcccggtgcgtcagtcctaccaaggccaacgtctcatcaacgtcgcgtgcgtccttggtgatttgcgacgccaactcgacgttttcacgcgccgtcaagttcggaaccaggttgtagaattgaaaaacgaacccgaccgcttgccgacgataggtcgttaattgccgtgagttaaattgcgcaatgtccacaccatccaccagcacacggccgctcgtagggctgtccatgccacctaaaatattgagtaacgtggacttacccgcaccactcggacctaaaatcacaacgaccgcaccctggtcaacttcaaatgaaatatcacgattagcaacggtgacctgctcaccatttttaaactggcgcgttgcctgctgcacttcgatgtatgccataatttagcctcctatatgtaatcggttactattatcataccgtattttcaagattcacggttagcatttaagccaccgcttgcattttgcctcgcattgcccgtacaatgacaacagtcactgacactgataattccagtgttatcacccgttatccgaggaggtccaactatgattgcccaagccattgcgactgttttaatgctaattgtttttatgttcggttttacttactttctgaatagcctatttttcagacgcatcgaaaaacacgaccgtgaacaaactaaaaaacgcgaacatcaagaccaccactcgtcttaatgctcgcatcagtacgtattatgttaaaaataggactgccagttaagatcaagggcagccaacttcggcctgtcggaaaagaggttgtttagcgtaacctggctttgattacacgtctagcaagacttacaggcagttctaccaatggctaaaatatgctcgctgtcgccccacgctactagatcaacgcttcattttcctcattcaacttgtcacagtcaatgatcaattgacaaacttctttgtctggcgtcaacttcatcgaatacttccgcccatattcaatcatcgtgtgatgggcttgatgtaattctgccggtgccaacacactcacgattttttgttcaacttgtaacggcgtcgcggtctgagcgacaaagtgcaagcgtttcgagattgccgagacgtgtgtatcgacagcaaacgtcggttgttcaaaaacgtcactcaataccacgttggcagttttgcggcccgcacctggtaacgccatgatgcctttacgatcggtaggcacgacatcggctaattcttcatggacaatgcgcgccgttttaatgatgttgcgagccttattatgaaataatccgacgctcttgataattgcttccacatccgcaacatcggcagccatcaagtcctttggttctggatacttctcaaacagtaccggcgtcaccttgttaaccgagacgtcggtcgcctgagcgctcagaattactgaaatcaaatactgaaacggcgtccgcgagtccagggaaggtcccactggtccgatgtctgcttccatttggtgaattgcccacacgatctgatcatcttttagcattgcacttaccgcctctttcttatcctgtttctaagttaattttaaggctgagggggtgtaatgtctattattaaaaatatcgcggccttatttctaatccaaactttaatgacatgaacacagtacaattaatttctatcaatcatcatcacgatcagcaaaataggcggcccgttgccgagcccaatattcatggtcagcggtggtgatttctcgtaagacatggcaaggattgccgaccgcaaccacgttatccgggatatcatgagtaaccacggaaccagacccaatcacgacattactcccaatcgtgacacccggattaacgaccacgttgcccccaaaccaaacatcgtgtccaatcgtaattggccaaccatattcgagttgttcagcacgaatggcggcgtcaatggggtgacccgccgtatataagccgacccgcggccccataaagacgttgtccccaatcgtaatccgacccacatcaataaaaatcgcatcgtaattggcgtaaaagtgcttgccaattgtcgtgttgcttccatagtcggtatgaaatggcggttcgatatagcccccgtcaccaattttgttgaacattgccgttaacaatcgttgccgttcttctggttgggcttcggttgtttgattaaattcccgtactaaccgtttggcacgatgattttcacgtcctaattctggatcatcagcaacgtacaactcacccgccagcattcgttctttctgtgttttcatactcccagttcctcccatcaatcgcattttactttcaccagcatagcacgcaattatcaccatgaacacgcattctcgaaagcaaccgcccccattttgagtatcgttgaacttttaagcttttttatactgcgaaaaaatcattatcgtttataatgagaggtatacacacaattaagggagttttaaccattgaaaacatttaaaagcattatgagctgggtggtcccgattgcgattggcttgatcatcgccttactgattcgtcagttctggtttactatggtcaaagtcgatgggacttcgatgcaaccgaatttacaaaataacgaacgcgtcgtagcttttaagactagcaaaatcaaagcaggttctgtcgtcgtcttcaacgcctacggactcgatccgaaccaaaccgacaaaaacgccgtttatgttaagcgggtcattgggatgcctggggatacggtccgctacacaagttccggtaaactttacgtgaacaacaaattagtcaagcaaacctatctcaaaaataagtatcaacagacgactgggtccttcatggctaatagtcacagcaagttcactggttggacactcaatagtttgagccatgatcaaggctgggccaagtccgtgaccaacaatacggtgccgaagggttactactttgtccttggtgatcaccggagcgtttctaacgatggccgttactgggggctcgttcctaagagcaagatgattggggtcgtcaaagcatggccatggcagaaccgcaaacaatatattaataactaccaaccttaagatttgaacaccttatcagcaagtcgttaactgcgacttgcttttttattatacaaatgactcgtttgtatttacattgtcctcatttattgccgatgtaagatcattggcgtcattaggcagaatcggcaacaatacatcaatcattttcaaaactaacaaaaaaaacgaatcaacaaagttatgaacaacttgttgattcgtttttttcgttaaccagacttttatccacagttgataactcaatgtcgttatcaacagtatctgcataagtcttccactcatttgatcagtttcctgaacagattatcagtttcgactacttttggcgctgacgccaatcccggaccccaaaatacccacaaataatcgggcttaaaggaaccaaaatcactgccatcaaaatattcttaaagaagttgataaaaccatccatgaagtcactcttagcctcgacttgtggcgttaatgcggttggaacgggtttgggctttgtccgcttggctgctactgaccatggtcggccagagtcctgaatgatttgctcatcgtctggtcgcgttgacggtgtttccttgggttgtttacgccagacttgaaacacccgcggccaacgatacttcacaattggaaacagcacgagcgcacaaataatactgtaaatgacgaacggattaaattctaacacgatccgattgacttcctgacgggccgtaaaaaacatgataatgaagacggcgattgcaccgtaaaaccaactaattagtaaatgactcgttttccacacgttgtgccacctccccggttgttgacatactcaatcgcaccatacttttacactgcaagccagcttcatagatcgggtctggatagttatccacaaaaaagttgacccacaccgcaatcatctcaaaaccagcgtgttgataaatcgctagttgccgcaacgatgaattaccagtgccaatttgcagttcatcacaggttggcgctgcttggcagaccgcaatcgccgttgctagtagggccttagcaatgccgcgatgttgataggcgggcgccaccgcaatatttttaacttcccacacccctgttttgaacgttgtcaacacgacaacacccaccacttgtccattttgttgataaccataacattggcctgtcgataagtacgctgtgacctgtgcccaagatggatcggctaataacagtaaatcccgtggaatttgagctgccgctaggggttggattttcatgactgccgcctttgatgccgctgatagccgttaccccaacaaacataaggaatgatgaccgcaataattgctaaagcatactcgcgcaccgttaagttcatggcattgaccacgacaaggtacgccaaaaaaaccgtccataaaaccggaacgataccgccgacccaaaagtagcgactagccgtaaacaggtactcttctaagataaagataacaattgcaataacacctaaaatcagtaattgcatggggccacttcctaacttgtgattaacgcagtgcctactgcttgtttaactgttgtagcatatccacaaaacgtccgattgttaagttagccacatcttcatcggaatagaagatgatcatttgggaccgttgttctggggataagttcgcttgggagccaaaataaactaggtaaacgtccgcgctatggtccgtcaaactctgaccataatctgtatctaacgtgaagttgaaatctgcgcccaattgtttttccatggcggccatgaaagcttgcacatccgcagttgcgaccgtctcttggccggccaccgtactcgtaataacattaacttgcattttaaaagctcctcgttaaaatttttaaactcaattttcacagtagcgcacttttgtataaaccgcaagccgctagttgtccacagtggataacttattccgtgaccggtacaatcaacttatccccagtgtaaaccatcgttgtcaccacacttggtgccaatgcctgtctcgttgccgcacgaccagttgcgacgtaatgcatcattcgcaacgttgcgccgtccacaaccaacaagacctgaccatgatcaggcgttgccgtcataacctgttgtagccccttctgatagcgatcccagaactcctggccactttccgccaatccatccgcatcgtgatcgtgcaacaatgtctgtaactcactgggggtctgatccgcagcaaaagcggccacgctctgataacccaacttagtcgcaaaccctgaccaaaccgccgcgcgttcagttccttcaaaaccgccatagaatggcgcacgtaacgcgactaccgttcgtaacttaacgggttgtgctcgtgagtctaagataatgcgcgcagtctgaatcgcccgactcgtatcactagcgaaggcggtatcaaacgttgtcgacgccaactgctgcgcaaccttggccgtcgcctgctcgccagtcgccgtcaacggcgtgccgctccaaccctggaaccggtcaagttgattaaagtacgttgctccagcaacgactaagtgtaaggtgattgatttcatggttaattctccgttagtttttttagattattcaactattttagcataaaaacttggccggacaaacggactctaggacttgtttaatatgaatttgagtagaattgtaatcaagaatgaaacaactatcattttaaaacatatagctggcaaacaaaaaatcaggataagaatcagatgtgcatccttatcccgaccttaattattgtgcggcaacagctcgttcattttggctaaccgagaattagcgaaaatcgccatgctgaatactcatcaagtcaccacacgtcttttgatggtaagcttaacaccatcattgtgtatttctcttcattagtagcgttagatgtataatatcgaacattggtcttaatcaccataattgttatatgccacagtcatcagaaattaaaggtattatggttcgcttaatatattctattcaggaattgtcacaaagcacaggcgtgttgcctttagttgacagtctagccaagccaacaaatactattttcctaatgcgtccgttttactgaccactaatcactagtcgctttagtaggtactggctttctgcgcactaatgacccaatcaccattcttcttctcataaaacatctgcatctgcaaccgccaagtatgcgtacccccaccccaaattcttgcctgaacttggttctgaccaattaaacttgcccggttaccttcaatttgaatagctttgatggtatcttcttttgaagcaaaatattgcatttcttcattttgaatttggtcaatccactctaatttagactgcacataccccgtcatgtgggttaacttcatagttggtgccaaaatttcatttaaccgactgaggtttttctgaaccatagcaatattttcatcacgatacaatttaataattatttctttatccgtcattcttaccacgctttctttatttacatcaagcatgataccaacttttctatgccaaaaccattcagaaatcaagggtcattcataagtaaaaattatgcaaaggtttgtttcaataattcagcaaaagtttcgatataataacctgaattattagcttgccaataagcgtaatagttctgaatcaattttcggtcccctttaaccaaggaaatcattttaacaatatctttatctaattgtgttctcatccgctgattgatgatcaaatacccctgattagacgcgatcaacatttgtgcctcgtcatagcttttagcaatcacaaactcacttttgacacctaaaacattgcgatagtactccttttctgagacttgctgattgccatcaatgatcaaaatacaaggaatatccactaagtcagcaacgtcgattttttgtgcctcaactggcaacgaattgttaacggcaaccataaactcactagcggtcaaaaattcattttgatattcattggataaggcccgccgttgatcagaaaaattcaaatcaatttttcctgtctgtaataattcatagagttcttcgtgcgtgccactactaattttgattttcactttaggaaactcctgagtaaacttcgaaacagtttgtaaaaactcggcagtcccaaaacttcttaaatagccaacccgcaactcgacctcatcattcttttcaattttgatggttttctttataagttggtccacatccaccaaaatatcctgactatgactataaaagtattgacccgcttcagtaacttcaaagctgcgtcctttccgattcaataacttcacaccaagttgactttctagctccttcatttgctgagaaatcgctgactgcgaaatgtggcagtccacggccgcttgagtaaaactatgattattaacgattgcgataaaatactgcatctgttgaaacattaatggcacctcaacctttacaaaattatctttgaatgttcaaatttgtcatattattttaattagtataaccttaatcaacaatttgagaaatgttttgcagcagaacctgaaccgattccctaccatgcttataaacgaaaaaagccactagcaatctagccaatgaccttttgaatattattttgcatttagtccaacactatcatgtgcataataatcattatcgacaatcgcattcttgacaaaatccgcaattgaattgattgagacatcatgcccaccaaatggttcgccttttttcgtgatttcataatcaacaggaccaccagtaaaccagcccggacgaatcagggtgtagttcaaatcagaagcttcaacaacatcggcggcttcccgataagtgcgtagcattggattactacttaaatttccactagcaccaaccgaagcgggaatttcatcataaatacccattgaagtaataaacagcaatcgtgaaaccttattccggtccattgccgcaacaattttttgggcaaagcgacctaaagaaccactcaaggcaacaaaaacaacgtcttgtcctgcaatcgccttgtctaagtcactatctttagtaacatcgccagcgataacactttcacgctcactagtctttaatcgattggcacttctagcaaacaacgttaactgattatcggtttcattcaaaagcgtttgtcgaactacaccgccaatagtccccgttgcaccaataattaaaactttcttcatattttcctcctatttatcactgacaatgaccaatgacttaatcgccgtccgttggtccattgcttcgtacgcagcttgaatatcatctaacataaaccgtttcgtaaagacttggccgggctgaattttccccgtcaaaacagcatctaacaaaacttgcttgtcatccgtcgttacagcagcaatcccaccacgtaagccaatgttcttccaaaaaagattattggtattcatttcagccttttgtgggaccccaacgcgaccaacaaccgcaccaggacggccgactttgactgctgtgtcaacggattgttcagtacctacacattcaagtaccgcgtcagccccagtttcggtcaaagccatcactttggcaactgcttcatcaccacgttcagcgataatgtccgtggcgccaaatgcttttgctaacttttgccgatcttcatggcgactcattgcgatgatccgcttagcgccaagcaattttgcggaaagaaccccgctcaaaccaacggcaccatcacccatcacaacaacggtatcatcctttttgacttctgcgctagttgcggcgtggaaacccgttgccatcacgtcagctaaggctaaaaagttgttcagcatgtcgtcagaataatcttcgggttgcccaggaatcttaactaacgcccagtttgcattggtaaagcgtaagtattcaccttgatagccaccgttaccgccagcttcttggtttaagcaatccccatcaaaaccggctaagcaagcggcacagtgcccacaaccatgggtgaacggcgcaatcacgaaatcgcctgcttgtacatctttaacggctgaaccaacagattcaacaattccaattgcttcatgaccaacggttgaacctgcttggcgttgtgaaatcccgcggaaccaccacaaatccgacccacatacacaggcccggagcacccgaataattgcatcggttggcttttgaatagttggtttgtcgtattctttaacttcgacttttcctggttcaataaaagttgctgctttcataataaactctccttaaaattctatttctggacgccattgttacgaacttctgaaacattaccataccaatattgtgcggtaattccgccatcaaccaagaaatcactccctgtgataaaggcaccacggcgatccattaagagttccgccaaattggcaatttcatcgggtgttcctggacgcttcgtaaccattgactcgaacatctttttgtaacccgcaccacgcggcccgttcaattcgtcaacggctaatggtgtcatgataataccggggctgatcgtgttgatccgtgcactgcgagcttgccacttaaccgattcggcagcgacccgtaaaacattggttcgtttcgcatattgataagccgccaatgaatccttgatcacgtccggttgtaaaattggtaaatccaataattcttcagtcggtgtcatagccaaggcttgattatctgcttgtgataaggcgggtaatcggtgtcctgattgggacgaaatgacgattcccgcactaccgggagccatgacttgaccaaattcttctaacaaaacggcagtcccgtaaaggtccactttgagcacttgctctgggctcgcttgggatggtgaaacgccagccgcgttgaccaatcccataatcttaccaagcgattgtgccttagcaaccactgtcttaatagattcccgtgatgaaagatccgcttggatggtcttaacgttaaatccagcttccgtcaagtgttgtttcatttcaactaattttgcttcattatagtctgccaacaataaatttctaccggcagcaacacgtcgaacaattgcttcaccaattgagccggcaccgaaaagcacaattacttcgttattcatattcattgacctctttacttgttttgattcaccttaacttacaagtcatatcttacaagcaaacgtcttttagaccaatttcaaattcagcccacattgataagttttacttatgaaaagcaatatcaggaaatcggccaccgctagacctggttttctgatattaattgtatctctaattgttttttgtaaaaatcaaatgtaagccgccgtcctctttgtactgtcgccactaacgtgtggtgcaatgactattttttatccgttatacttaacctcctttactctttgttaaaacaatccctcaaaaagagtcgcttcaataaaaaaggattgcccagcgccctactgaacaatcctatttaacatcatcagaatactagtaccatcaaaaaactgatgcgctttaagtaactaacactataattgcctgtcactaaccattttaggagtcagctaactggtcccattcacggtctgcttgggagatactgtcacgaaaacccacccaatcatctggattagcaaaaagttccgaattgattggtgtcataatcagtgccggaccactttgctcaattctataacgtgcccctacttcaaggctcagttcattgggaaaaatgattccctgagcattgccaatcttacgaatactcacttccatctatcagcacacctttccatcacaacttaattttcagttaatcccaacgacatgtcacggtcactttaccacgaagtcatagaagctagcaaacatctgatttgctcaaatgaacactgctttgataacaacggtattcaagacacaaccactattattcatcatcaacaccatcgccggaaaatgatactcaagacacaacaaaaaaagccctccataaccggaaggcctgatcaatcaaaattcatcttatcactaccgaatcaccagtactgaaatcggtgcatgttttgccatatatgcggcttgcgaaccgaagtatttacgaacaccatgcttggcaactgagccaatgactagtaagtcaggcttcaacgctggaatcaccgtcttcacgatggtttcaccagggtcaccttcatcaacgaccgcgttaacatccgtcaccccgaagtcacgggccaacttctgatactgctggacgtgttcttccaaatccttgcgttggccatgaacaaaatctttgctcattgcttcatacacgttcatattatcctgttccaaaattgaaacgatggttaacttagcaccgtcactcttggcccggttaatggcataccgaaacgctaactgcgcgtcatccgaatcatcaacgccgactaagatgtgcttaaattccttaggactcatctctgacatatggctccactccccattctctgataatctgactacacccttattttcatcaatttgagcataattgtcaattatgactgcggtgcattttgtttcaagacacgcgccggattaccgactacaatgacgttatctggaaacgaatgcgttacgacagccccggcacccacaatcacgttattgcccaacgtcactccgggtaagatcacggcactaccaccaatccaaacatcattaccaatcgtaatcggtgcagtccgttccgcttcagtccgccgcacagttggatctaatggatgagcaggcgtgtacaagccaactttaggaccgaatttgcaatcattaccgatcgtaatgagtccttcatcacataacgtgaccccatggttcgcataaaaatgattgccgatacggatgttgacgccataactgaattcaaaggtcggttcaacgaagaaccggtcaccggctgaacgtaggaggcttttcatcttagtattccggtcatcattgtcagcaatctgattatattgcattaacttcgtccgcacgtctcgccgacgttgctgtaggattggtgattctaagtacaattcaccattaatcatttgttgatacgctgggtcattatcgatttccatgtttaacttccttttaagtatgatactttaagcataccacaccattcaaaattgctgtatgatggtttaaataaacctattgaaagtagtggttccatgcaatacgcaatttttgatctcgataataccatccttgactttgaccgcgctgaagcggctaacctcgcagccgtctttcagcatcatggcatcactgatattcgccgtgcagaaagtgagtatcaggcctataacgaaactgtttggcaacaaatcgaacaaggtgccgatcgtgatagcttgttagaccaacgatttcaagtctttctaggcacactgggcatcaccgttgacggtcctgcggttcaacaagaatacgaccaattattagcgcacagttatcaggtaattcccggcgcccacgaacttttgcgcacgctgaccaacgctgggctgaccttactcgtcggcactaacggtatcaaacacacccagctcagtcgcttggcaggtgcccatatgacgccctattttgatcatatcttcatctctgaaagtatcggttatgccaagccgaacccacactttttcagcgctattcatgaccaatacccagacatgaatgccacgaataccgtcatgattggtgatagcctgcgttcagacatcgcgggagcggccaccgcccatttacctagtatctggtacaatccacagcatgtgcataacgacacaacaattgccccaacttacactgtggataactttaagcaactgcaaaaactgttattaacagcttaaacgcaaaaataatcagcaaactctgcgcgcaggcctaacgtatcttaaaaactgaactatttaacatattaggtaacatattaggtattatgcggagtagttgtatcgacggcttttaactcaataatctgcttaccttgatttccaatcaacaaaaagaccatttgacgaatcagcaagaaaagtaattcatataaaacagttgtcgttgcttaattcaagatttggccgtgaaacaatactaatagcagttcatctgggtaatctgtcaaaacgtgccctttcttctcaggtgataagattttcagatttaatcgacttgacgcttgctatcaattaacgtgcgagaagaatagctaaaggaacgggattaaaaatgagttatattcaaatttttatgaaaagaagccgtcgcgccggtaatcaacacttaagctcaaaaaaattacaagcaagggtacttttaatacctgatataatatcagcatccatctaatttttttaaagctcgtcaccgctagcgcctttttatcactgtctaaagtatcactgctttgtgcgccagcaatcaactgctgcatctcctttattggacccaaactatccacaaacgcaattacaaaagaaatgaaaccaacacacttcataatagaagaaaccaaaagcatgtactggtaatcagtatttagcacgagttcactaaagactaagaccggtatcgatgccagtaagaacagttgcattatcaatcgtattttttcccaccttgtcttatttctttttttgagtttaactaggcttaatttcaataagaaattttttttatgctgaatttttttatctataaaatgagttaccaaatagtacaagcaaccataagcgaaaagtatgataacttgtttgaatagcatcgatcgagaaatcagcatgagcagctcattcgaatatgaagacattaatttagaaagtcctttctgaagtcacctaagtatcttagcttagatagcagtatttaataaaaaacgttgtgtctagatttctcattgaaatgaagcacaacgcttttggtattagaaaataaatgattatacgcctgaagaataacactattatgattcatcaggtcagacaagggttattacccatgcacctgctttgacagcggagattaaattcaggcgctgtaagtggaaaacctgcattattccaataaatttcgataatagttgaaagtatcattgcttgatctagtatatagatagctgggaactaagaacacccgtggctaaatataataatatgtattgtgcgtatagtcgaaattcattaacataatctgcaaagcctattgaatgggcacactgcatctcatacgatataaagcaggtaatgttcacacttttatttaaccaaaatagcgtaaagacataagaattttcacgttcctcttattgtgcctatcggatatttccgtagctaagtgggcggagttaattgactagactcgtatcaataccattgtcctcatcaaaccgtataaacaataattaacctcaattaaaaaaagccatgcagccccattcttacagttacgacacagtaagaatcaggcttcatgacccataatacgattcaaatttaaccacgcggcgacgattggcaggaacacctgtcaattgatactcaccgcacggcccaatcaaagtgacactagccacaccttttcttacaaggtcagcactagctattttggttcaaaagtgaacccctttttacaatccactattcttcaatctgaacaaagtgtgtgttacctagtccaccgccaacttgcatgacactgccgccatgccgaagcttgcccaagttaacggggcggaaattcaacggccggacgagcgcagcgaattctttcttagcagcaatgtcatcgcccgcatagaacaagacccgctttccaggcccatcaacgtgcccatccataaactccggtggaatcgtattgaaggctttaatgacccgggcattgttagctgcacgagcaatgacttcacttccagtcaacggggccgtcttaattttcttaaagtcagccgtaaactggttcgtcacgtccaccacgatccgttgcttataatcggcgacctgcgctaatactgccggcgcctgttcaaacggcactgcaagaatgactaacggctgttgtaaggcttcagcaacttctacaaaagccacattggcagcaaactcggcgcgccgtgttgctaaactagccgcaccactgtgccgacttaatttgatttgatgatcaccgcgcgcaaaggtcttggctaatactgtgccgaccgtaccggcaccaataattccaattttcataactatcctccacctcatcttttaataatggtttgaattaaccgacttatctggtccgttatcacggactgtcagcggtcatctagaccaaaccagcttatcttaatgatagcgaaatcattatggaattgcaccccatacgcgtcaactatgcttgaacttgttggtaagccgtaataccagcttttaatcgtgccaatccatccgtcagggtagtcgttggacaagccacattcagtcgcaagaagcggttgccatcaccacggtaaacatctcccgctgataaaaacaacccggttcgttggcgaataaaagcagccaaagccgcactgtcggttgtcacttgacgcacatccaaccataatagataagtcgcttgggcttccaccaacttgacttgcggcaactcagcagtcaagtaagtctgaacttgacgttgattggcagctagtttggttcgcaatgcggctacccagtcatggccttcagtataggccgcaatgctggctggaatcgcaaacgaattgggttcagccaattcatcattgttgatgccccggctcactaatgcgcggacgtgtgcatcgggaataatcaacgttgccgcgtgtaaggctgccacgttgaaagttttgcttggcgagatacagctgatactgttatgtgctactggcgcagtcaatgatgaaaatggggtgtacgtgtgaccgttaagggtcaagtcacaatgaatctcatcggcaacgactagcacatggtatttcaagcacagctcgccaaggcgttgcaacgtcgcacgtgaccagacgatgccgattggattctgcggattgcacaaaatcatcatcgtggtcaacggatcggctagtttcgtcgtcaaatcgtcccaatcaatcgcgtacgacgcgccacgtgccactaagtcactactcaaggtatgccggccattgttttcaattgaatgatagaagatattataaaccggagcctgaactaacacgttatcgccggtcgctgtcattttacgaacaattgatgaaatcgccggaacgacgccggtgcagaacatcaaccactcaatttgcggacggaagttgtgttccgttgcccaccagtctgccacggcttcatagtaagccgtggggacttcttcgtaaccgaagacgccaaactgggcgcgttttatcaacgcttgcttgataactggtgccgtttcaaagtccatgtcagcgacccacatcggcaattcattatccgcgacgtcccacttaacggcattcgtgtgccgccgattaagtacggtctcaaaatcaaacggcatggggcgcacggctttcatggtcaacactaatcagggtctgatgaggatctacttcaggatcatccatgatgatttcaccaatggcttgcgcatgaatccgaccactaagcggatttttaacgctatcaatcgttgaaaccacgtcagcgtcaatgttacgacaatattcaaaagctaagtccgtattgagtaacgtacagttttccaacttaacattatccatgtaacacaggccctgatcgctctcaatcgtacagttgacgaaccgaatattcttcgaattccagcccaggtattcaccaatgatttgtgaatcataaacggtaacattttcacaattccatagcgcatccttggtcatcagcgttgcatgatgaatttcaacgttcttagcaccgtcaaaggcgtaattaccgacgaggttgaagccatcaatgcgaatattctggctattcattccaaaataatcaccagctgcttgaacatcattcaacgtaatatcttggcagttccataacgtttcttccgcatctgaaaagtgaacgtgcgctaacttaacttggctggcccgccgaaatagcttaggtgcctgtagcgtactattcgtaatcgtaatatccttggtgtaccagatgccagagcgagacattgtctcaaacaaaccttgatccacagtcacatgttgactgtaccacaagggatatttccacttaaagattggctgtttcaacgtgacatcgcgactttccttcagtggtgattcaccatcagcaaacgttgtattgtcgatttcaaggtcgtgagctttaaagagtgcccgctcgcccgttaaatactgttgtgtgattgttttcaatttaatctcaataactcctttatactgaaacgtggacctttagtcgcacgataggatcagtgtattacttcaactgcacgttaagtcaactaacttgttcgcttactgtccggaatactgattccaattattagttcgtgaccggttaagtgccatcacgccctccaagtcatggggttggtaaggggtttccaagtactgtatttccgaagcagttaacgccaaccccgctgcctcagccactgcatctaaatgatgcggcttagttgccccaataatcggcgccgttactcgttgttgtagccaggccaaattaatggccgccattgaaacatgatgttggtgggccagttcctcaacgcgatcaataattggttgatccatctcgctggtagcttggtatttggtatcagcaaacgtatcctgttgtcgccgagtagtctgggtgccaaaaggatgtgccaaccggccactagctaatggactatacggcgtcgttgccaaatcgttctcatgagcataactgaacagttcccgttcatcctcgcgatagaccaaattataatgactctggatcgagacaaattgtggataaccataacgaaccgctagcgcattgatctgcgcaatctgccaggaataggcgttagaaatcccaatgtaacgaaccttaccggcctgaacagcttcattaagcccagccatgatttcagccattggtgttaaccagtcccagatatgataaatatataaatcaacatagtctgtctgtaaattctgtagactctggtcgagggaccgcaagacatgttcacgcccactgacatgattttcgatttcttgggttgtccgattcgtaaacttggttgccagtaccaattgatctcgctgaaatttctttagtccttgtcccaagacacgttcactcgcacccgcttgatagaccggcgccgtatcaaaaaagttaatccccagtgatatcgcgcgatcaagtacctggttcgcctgcgtttgaccaaccgcccacgagcgctgattaagcgccgttccagtccccgcaccaaaacccatgcacccaagtgcgatcgacgagacttttaaatcggatgttcctaattgtcgatattgcattgcatcacaactcccttcgttaactcattaccatctttattaaaacgcgatccgttggcagagtaaaatacctagttcaaataatcaattataaccattccgtatagttatccgtcatccagtcgttttaggaattaatgaccgttattagtcaccaatcattattttcaatgtgcctggcgacattcaagcgtggcaccgtactccaggtgttgggccaaaaatgaacagcacgattgcaagcataccaggccacatcctgcagtgagtgtcaccgaccgattttaaggacgaaccactgataaaccggttttgtgggcaccaccacaactcaccgcgaccacctccgccaactcaatttttcaacacaaaaccgaccattctagaagttacaccttttccagaacggtcggtcatgacaactgattgaatcgccgtaagcatcgctaccgacacgacgacaatgtttatttcagttttactttaatttttaactttttaggcgcttgatggcgcgctaagattaattgccagcccactttaaccagcgtactaataacagtcatcacgaccattaacgataattttcgacgcattcggcatcacctcaattaatttaaatcgagcataccacactttaatcgacgtgagcggaattttgcaactgaatcatatcatagtagtaaccatgctgttgcaatagctcatcgttggacccgcgttcaacgatttgcccctgatttaagaccaggatcaaatcagcattttgaatcgtggacaagcggtgggcaatcgcaatcgtcgtgcggttctcctgaatccgatccaaaccagtctgaatcatctcttcggtctcagtatcgacgttcgccgtggcttcgtccaagattaaaatcttagggtcagtcacaatcgtccgcgcaaatgaaatcaattgccgctgtcctgaagaataactggccccgcgctcaatgacgcgtgactgataattctcaggtaaatcgttgatgaagtcatcggcctttacaaaccgtgccgctgcttgaacttgttcatctgaaatctgatcgttaaacattcggatgttggaattaatatcaccataaaacataaacggttcttgcaagaccaaccccatcttctgtcgcaattcctcagccggatactcacgaatgtcgcgatcatcaattaaaacttctcctgactgaaactcataaaaccgcatcaaaacattaatcgtcgacgtttttccactccccgtctgaccaactagtgccaccgtttggcctggttcagccacgaatgaaacgtcttttaagaccggatgctggccgtcataggcaaaggtgacgtgccgaaattcaatcttaccgcgcgtaatcttagccgtaggatcggcgtgttgggccggggcaatcgttggatcatccatgacccgtaaaacccgtgatccggcgacgacgccatcttgaaagtctgacaaattatccatcatcgacgtcatcggattatagaagttattcaggtacgtgatgaacgcataaacgaccccggcagccacataaccattgagtccacgaaccccgaagattcgcagaaccatgaccgtccctaacgcataaaacaagtcgatcagtggacttaataataatgagttcgtccggatcatcgcttggcgggtcttaaaataggcatcattggtatgatcaaattcaccattgatacggtgttcttgtcgaaattgctgaataacactaattccagtaattgcttcactcaacttggtattcaactcactgagccgttcccgcattcgccggtaaacccgtgagctataccgttgataataccaaatcgttacagccaaaaaaggcatgaaaaccaataaccacaaggcaatctgcgcatcggtgagatacatcgcgacaaacgacgaaatcaccgcaaaaaaggcggtaaatagtgtattaaacaacgcccaaaaattggaaaacgacatcgtatcgttagtcaggcgtgacaaaattgagccaccagggacttgatcaaagtagcgcatgcccatccgatgcaacttggcgaacatttgtcgacgaacattttcaagcatatattctgcccccatcgtactactgaagttctgtacgaactgcatcaacgcgcgcacaaccatgccgaagaaatagaggcccgcaaagtaccacatgaccggtaccgtggcgtgtcctgttttgagataatgatcaataaaggtctgtaatacacgcggtagatagatattaaccacactaatcagaccggaaaaaacgatggccgcaataaaaaaccatttgaacggtttcgcatacggcaatagtcgccgaataaccgtgagttgttccttaacaggcatggaacgtgcccataccgattgacgtgctgccattattgcaccgctccttccactttggtctccaattgttggcgcgtaaacatcttctgataccacccgtgttgcgtcattaattgcgcgtgggtccctcgttcaacaacgtgaccggcatccaacacaatgatttcatcagcgttcatcaccgaacttaaccggtgggccgcgataatcgtcgttttgtctgctcgttctgcctttagattagctaaaatttctgcctcagtttcggcatcaaccgcggataacgcatcatctaagatcagcaattcaggattgatgagtaaggcccgcgcaatggctagtcgttggcgttgccctccagatagcgagataccttcctcaccaacttgggtatcgtaaccagcgggcatgctggcaatctgaccactcaaatcactcttggcggcgaccgcttccacaacggcttgactcacagtcggatcggcaaaacgaatattttcgcgaatcgtattcgagaacagaaaactatcttggggcacataaccaagggctggtaagtaactatcaagcgcatactgcttaatatcgtgaccaccataagtaatgtggccctcgtactgatcaaattcacgcaaaatcagtttcataatcgttgatttaccagcaccaacccgtccgacaattccgagcgtctgtcccgccttcaaagtaaagtccacgttactcagactggttcctgcatcgttgggataattgaactgcttgatttgatactgaatatcaccatgcgggcgctgttcaatgccccgtttggcatcaataatggcactttgctgattcaataattccatgacccgatcatacgaggcgtttccccgttccatcgtgttgaataacatcccgaccgcaaacatcggccagaccatcattcccaaataagtgacgaacgagaccaagttaccgattgtgatgacaccgtgggtcacgtacaacccgcccaaaataattgtggcgccgtaagataacgcaataatcatggtaatcgcgggatcaaatagcgagtcgagtacgttgacatgccgattgatcttaatcgtctgatcaatctgttgattaaaatcagcaacatcggccttttcctgacctagcgctttgatcactttgattccactgatactctcctgcgccttattattcagtcgcgaaaaggcggcttgggaggcacgaaacgcgacgtgaatttttttacccaaataccgtgacacgaccgctaataatgggaaaggtaccaccgcaatcagcgtcagtcgccagtcgattagtgtcatcatcgcaatcagcgttgtcccaccagtaataatggaatccgcaaattggagaatgccaccaccagcgacccgttcaaccgccgtgagatcattggtcgcatgagccatcaagtccccggtacggtattgctgataaaacgtcgcatccatcttcataaaatgccaaaagagtcgttcccgcagcgttcgttcaaggccggctgcaccaccccagatggcattccgccataaataacgcgccaggtactgaccaacggcggccacaccaataataactaaatagaccgtcagcgtgtgcgccgtcaagctgtgctgattaatcccatcaacgatgtccccaataatccggggcggcacaatgccgataatggcagtcaaaactagtccaagcacccccgcgaggtacaacttccattcacgccgaaaataccagcctaatttcaaaaatatactcacagcgcacctccaataatttaattaaaatttaattagacaactttttataataccatacctcgcgcaaaccccttaatgataagttccatccctaatgcaaagtgattgcaccagattgaaaataagcttaaactggggacgttagtgggacggtcattacgatcgtccctttcaatcgcaaaaattcagattactgatttttaccaccgactattgggcttggtgagctgtccaaaatacgccaattatttttataaggagtgttgattgtgtcccaaccaagtaccgtcactttaaaaaccaaactggcaatcttatccgttggtttactctcatttgtcgggattctcgtggaaacatcgatgaatgtgacgttccccacgctgattaaaacaatgggggtttcactagataccgtccagtggctgacgaccggttacctattactgacaaccattgtcatgagtaccacggcctatgttctaaagcggtttaaccccaagcccttattcttatttgccgccctcgtgtgtctgcttgggggcattctttgttggttagcgccgaatttctccgtattattaactggccgccttttacaggccgtagccactgggatttcgattccactgatgttccagttgattttcacttacgtccctcgcaatcaactaggaacttataccggtttagctagtgtcatcgtgtctctagccccggctctcggaccaacttatggcgggattttaactagcgtctggtcatggcgggcaattttcgttggtatcgtaccgttattggcattactggcaatcttaggggcgttcaacatttcggggaaggccttaggtgttggcgataaaaaattcgactatctgggcgcaatccttttagccatcaccttcactagtctgttgttcacgtttaacaacgcgggaactcacggctggctgtcgccgaacttcggcctctggtgtctgtggagcatcgtgatgattggtgcaatggtgacgtacgccatcaaggggcgtcgccaactgattgattattcaattctcaaattgccaatcttgcgacttcggctatttaattactttggtttacaattcattaatatcgggttatcgttcgtcctgccacttttcgcccaaaccgtccttggggcttcggccatgacggcggggctcatgatgcttcccggcgcaatcgtcggcgccatcactgggccaatcgccggtcgaatttacgataaacaaggcccaacgaccttattaacatttagtgccatcatggcgagcgccgccttactattattctggctgacaaccgattatttcacagtcatcatcatggctgtcatttacgcgctactacgcgtcggctttaatactggttttgggactgcgatttcggatggtagcacccgcgtccctctgcctcaaaaatccgatcaaaactcgatgttcagtatgatgcaacaatacgccggttcaatcgggaccagtattatgtccgctgtaattgccggctatgaaattcatcattccaccgtaactggaacgattatggggagcaagttggatttcttgctattattcgtgttggcgatcgccattttggttagtgttttgcatgttaaacgacttgaagcagggcaaaactaggattgactggtagcaacgttagtcttgcaagtggattgattgctgcatttttggagattaattctttaatactttgaaactataccaaaaaggcccgggttagcgtacccgagcctttcttgtaccatataaaaaaccatttaccaactaacgcctaacttcactaataccaaccgcacaacattttcgttttggcagttacctttttaacacctgaacaactccgaatgcagcaatcgactattattttctagataggttattctagtcattcagcaaatcgtcaaacttaggcttagccactggcaagacattagcaccgattttaatactttcagataacaaccggaaaaagtcagctgtcataattgtttcatgacaaagtaactagcacaacgcgtattggataaatacataaagctgactgcatagtcggctttataccgttgcgggcaaattattacggttttagtgaacttgcataaaatagtttggaccaggtactggattgtcagcctcaaagtaaagaagaccatggaaggcggcgtggtaaggaccgccacttggagttgctgtaaaatactgtgccacagtgcttagatcaggacgatcagtaatgtaccctgtaaaagcaccctttttttctgaaaagctaacgttcttagcgtttccagttacaccacccatatatctgccatagcgtattcttgaaccagaaaatttatttacttggcaagattgccctttacccaatcgcttgacggctgttggttgtttcgggccccggtcttcgataactggttcttgagatgatgcatcaaatagcggaacctgattgccatctttgtcataaatcacgttttgttcagttgtaacgctttgctctgtaaaagtactcgagttggcatttacaacatggaaaaaaattgacacaatcagccctacagccgataacgatagtgcacgtaacacagttaaactaccccttttcataatacgttccccaatttttaccggtattatactttgtccttatatgatagcataggataatcatatgtcatctattttttcagatatttagctttaaaatattgatgaattttatccatcgacaccatttttatgtatgataaaaggacatattgcgccatgctgcaaccaagctgatcacaaccaattgaaagcatgtgtccaatatgtcccaagataattctactaaattactgatatgattattcaagaacgattacatatcgctcagatcaatatttctagcattggtgaatgaatcaccataacgtcaaagtgtattgaaagtggattgattgctgcatttttggagattaattatttaaatgctttaaatctacatcgaaaaggctcaggttttctttgacctgggcctttttgcgtactctagcgtcagtaaacacactattaagcagattactatctcaatgctttctaaaatagagtttccatattatgatgctataattgaaaactagtgacattacaaaataaataatggaaatacccaaaacattagcacagtattctgtaaaccaatatttgtattgtgtgagaagatcatatccaccatgtaaaacaaaaaaataaataactgatattccaaaaacaatcatgctttgtttgaaacttgatttaaaaacagccatcatatcctactcccatctattgaaaccggtttcgttttgtcttattatacatacgcaattcaaaaatgtacactaccggaataaggaggaagtccaatgaattataccagtcaagctaacattcacaaatttactttgatcattattttattgagcagtatcctaatatctactaccataactttgaaaatttctgccaatacgacgtcatcgtcacaacaagccatagattgtatcgctcaagaattagcagatgtatcaaatatcattcggtatgatccccagactggattagcaacaaacttagatgtgaacgctttagtatcaaaatacggttccaataaccagaaccaattgcagcatatcaacgagataatgaaatatgaatacaagcgaaatttgcaattcaaccaaggcaagctaaatagtattcaaactagaagtttttggtcctgtatgaaaaatcaattattggacatgattggctaccaaactttccaagcattattacgcggaggcattcaaggattaatccaaagaaaggcgtggaaggcagcggctaaattactaatcagataccttggagatagcattggagtcgggtttatcgccgcacaattggcctggtacgcgattagatgtgcctagttattcattagttgcgctcactcgtagaaaaaagtaatgtcttcgaattatggtatcagtaaaattaaaatttaacccttttcgagaaaaaaaccgcgcccccaagacgcggtttttcgtcttggaagcgcgataatatgattaccagtaattacttaccagctttcatctgaatttcagcctcggctggaacttgcatatcgtgttgcttgaggaagaccatggaagcccacagtaatcccagcgacacaatcgtaattcctgctaagacaacgattgatgaccagaaaataccactaccccaaccaccagttaaggcttgccggaacgcttgaatcgagtacgttaatggcaagtatgggtgaataacgttgaagaacttgttggtaatttccatcgggaaggtcccaccagaaccaccaagttgtagcatcaagataaccattgcgacgaaccgtcctgggttatcgaatagcatcgataagaacatgactaggaacattgacgctaaggcaatcatgattgccgtcaagtagtattcaggtacactgattggtttcaaaccagcaactaataacactgtcgcttcgatgaccgccatcgcaagtgctacgggaccaccaacggcaactttactccagaaccattgtgttggcgtgccgtcgtcatccgcaatccgtcgaattggataagcgaagttgaagacgattgccccaacatacaaggccagtgacaagacgtaaggtgctaacgcatgaccatagtttggcacgtgcgtgtagtctttataggacgtcttagttggcgccgccatcattttcgcattcgcgttctttaatggtgtcgcgttaacttgatcagcaccttcttgtaaggaagtcgcgagtgtcttgttaccgttcttgatctgctttgtcccggataggagtttggcagagttgttgtcaagctgggtggccccgtcatttaattgactgacaccactcgttaattgaccggtactaccttgtaaggtttgtaaaccactgtttagttgaccggcaccggtgtcaagttgttggataccacttactaggactggtacttgaccgtttaacgttactaaaccatttgtgaccttacttgaaccggcaaagagttgttgaacaccactagccagaactggcacttgtccattaaggttaattaaaccagttgttaccttgccagagccaacttgcaactgttggacaccactgactaactcagggactttgccattcatagttaccaacccagtcgtaattttgttagaaccaactagtaattgactaactcccccttgtgctgtgttaataccattagtgagggtttgagaaccagtactcaatttatttataccggtaatcattgcgggaacactgccgttgactgtcttcaatccacccgtgaccgtttgggaaccactaaacaactgctcgacacctgaaaccaatgttggaattccaccattcagttgcgcagcaccagtcgccagttgtgtggtaccttggttcagatcatttgaattagcattcaattgctgactaccattactcaattggcctattgcgccagtaatttctggaaccgcgccattaagtgtggtgagtccagtactcaaattattagcacctttattaagcagagctgactgtgaagccaatttacttgtacctgttgataacgactcaatcccactaactaatccagggactttcatatttaattctgtcaatccattgcttaaaccatcagtcccactttgcagcttcttcagcccagtggttaattgttctgagccactggcaagttgactaattcctgaagtcgtggaactaatgtctgaaataatggtattcatcccagcttcaatctttccgtactcggttactaagtcagcattagaattacttgttgccgaggtgttctccgcaactaatgactctacctttgataggctgctctgcaaattttgaacttgttgcgcattagtagtagtcgtcgtgctttgtccaacatcttttagactttccttaattgccgcaacctgggtatcagttaaattctgtgacgactttaaaccatctattttactattgatttgtgacgtaatatcagcttgcgttggcgacttggaagtacttaaagcatccacgttacttgataaggattttaacgcggtatttaaagcatcgttattattactactcttcgtgttagcagcaatttctttttgactagctgccaatgcctgttcaaattgtgccatttctgtcttcaaagtttcgatttttgtcttagtcgctgaatcatttactgcggctgacaattgatccagtccatcagaaattttcgcactatttgtttgtaaatcgctaacaccggcattgactgtttgcgcaccggttgttaaatcgttaacagaactgctcaaattagtagtatttgatttcaataggctggcaccatcattggcggtaccaacacccgctgtataatctgcaactccgctagccaattctgttgagccatcagaaagttgcgaaacactactagacaattttccagtttgaccatctaatttagttaaaccagtcgtcagctgataaacaccatcagtatatgtggcaactccgactttgaccttttgggatccatctgctaactgtcccgttgcattactgattgtcccggttttgtcattcaaattctttagtccagtcgtgaccttgcctgaaccatctgtcaacaaattaacagcaccagctaatgtcccggctttattgcctaatgttaacaatccttcggtaatcgactgcgatccaatctgcattgtcggtaattttgagtcaagttgttgtagaccattagaaacttgagctgagccgtttgtcaattgactgacaccactcaccattgggacgacttttccttgcaacgtagtcagcccagttgtgacttgactggaaccatctttcaactgactgacgccactagccaacgcaccagtcttaccattcaacgttccaagcccactagtaacctgcccggaaccatctgataactgactaacaccactggctaacgccccggtcttactattcaacgtatccagaccggtcttcaacgcactaccaccatcagcaagcttagcaatcccagcaggtaattgctgcactttcgtattcagctcagtcgtcccgttcttcaacgtatgaacacccgtcgtatacgtcgtcaagccatcctgcagttcgacgccaccatctttaagcttggtagccccatcggcggctttttgatagcctttaccggcagtccgaatctgcttgaaaattgctaatgcgtaggccttagtgacttgcgcccgaatactcttattaactcgtgaaacaccagtatcggtaatgactttagcaatataattcaacgattcgttcgtctcataatgcaagttcatctttttcggattggtatccgtcatcgttgtggcattttttgagaaattgctaggaatcgtgacgaccgtgtaatatttccggtctttcaatccctgcttggcttttttagccgacacaaagtgccaatctaaatcgttatttttctttaaattcgtcacgacttgcttaccaactgcaaacttttcgccttgatagttcactgacttatcttcattaacgacagccactggtaagttttgcgtatccccatatggatcccacaccgacttcaagaagaagatgctgtataaaaacgggatcaaaatcatgactgaaactgaaatccatagtattttgctatgacgaattgaccgccattcgtcgcgtatcattttcacaacctgaaaccttccttcaaataattaaactgtgtgttgctcaagtgaaaacaccgtcgcaagcgtcccctgaatcatcgcctgcgtgctggccgcctgaccatcacgatgaccgttattgagccactggacaatacttgtgacgaccccactgactaagtacgccgtcaaatcgggatgctgcgactggcgaatcatcgcaaaaacccgatcatccgctcccgtctcggcgaccgtgacaaaacagtcattgatcacttgttgagaacgggtattgtcaccctcattgttcgtcactaataaatgtcgtaaaacttgcgtgtgcgccccgataaacgtcgacataattgccgaaccaaccgtatcagttcgctcagcagccaatagttcatctaacgtgtgcatcaccatctgcctgagcaaatcaaatttatccgtataataacgataaaaactactgcgatgtataaatgcttgcttacagatctgctcaaccgtaatttgtgagattgaacgttgctccaacaattggtacatcgtccgctgtaaatccagctccgtacgaattgaaattaccatcaccccgtttttaaattcttatattcgaatagaagaatatagttaccataaaaacaccgctgcatccccgtgcaacgattgctggtgttcatgcagtttagtgcaagtacggtttcaattccaagtccgccttaagcgtgtgaatcaaatgctcaacttgcgttagtggcgcgtcaaacgtcacccgataatagttacgggtcccctgatgttcaactgcgacaaagtgtcgttcctttaacgtcttcaattgatgcgaaacggccggttgcgaaatatgcatccgttcagttaattcaccaacagtcatgccctgcgcgtgttgcgaaagttcaatcatgatttgttgacgccgttcatcggctaagacttcaaagatcggaattgtttctcgaaattcttgcagtgcttcttcactactgaccatgcgattagcctcctatattcttatattctaatgttcgaatgtatcaatgataaagctttttgaatccgtttgcaacacctaaatacactttgtcgataaacgcgacaaattattatttttgtcgcatttgacgcaaaaaaagacgcctgaccacgcagtcagacgtctccaagggtaattagtactagcaatcaaaacgattgatagcaacgtccggttgggagccggagccgttgtatggaaaatcataggtgtttgggaaggccccatgatctaagacatcgcgttacttgttaataatgacagaaacatcagcaaattaacggcggttaagtaactcgaataactacagtataatcgctcagtgaaactttgctagtcctactttgaaccttttgtcgtaaaacaggacatttagattaaattgttgtatgaaacaacgacgtttaacagccgaccgtgcccattatgctgaactagatgactgtcttgccgcttaattcaacgccttcttcacatatttgtaaccatacttaaccaactcgcgctcgacttgcttactagtggtcgtcgattgagacgagcgactcgtattctgactactgctgactttatcagccccagcaacctgcatcgtcgaatccgctttcccgcgaccagtagcatagtcgaaactaacgccaggttcaacgttccaaatatagacattgaaattgacactgccatcggttgaaactgcttgcgaccagtaaccacgaggcatcaattcgttgccacggaaaaccgtcgtcacacgataaatgacttttttaccttgttctaacgccgtgcgcacctgatcttcataaatctgcatcgttttttgattcgagtaggccgtctgagttgccaagtttttcgggttatctaagctaccatcttcaccagcgcgatactgcccattagacgtcaagttaaaggataacgtgtaagcaatcaagtgcccgcgattttgcggatagacccgcttaccattaacggtaatcggttgattatgccagccagttgggctccacgtttgcgccgtccgtccttcagaccgtcctaaattggccttactcaaataagccgtgtccgtggttgtccgattcaatgaatctaaattaccgtaatcaatcttagaatttttccactgactcgctgccagcgtactcttaccgctattaactttgatggccgcagcactgcccgattgataagtcatttttgccagttgtttgtaagtttgttgcgtattaccagtcgcactggtcgtttgattacgactggattcagactgctgactagtcgtcgaactcgttgtatccgtaccagacgttaacaagctacaaccacccaacagtaagctcaaactcaagagacccgctatgccaacgcgtcgcattaatttcaccatgattctcttccaccccgtctttttaagtacggttctatcataccgtactttcacaaggggaacaaacgttttcttttaatctttttgtacttgccagtcattccttagaaccccatacttaatcgagttataatactgcccttgccaataacgaacttgtggaatccgggcctcctgctttaatcccacggcttccgctaaccgcatcatccgcgtattccccgaccacgttgtcaatccaatgtgcggcaaagtcgtctcctcttggaataagtgggtcaaccatttagtcaacgcggtgcgcccaatatgctcaccccaatgctcctgatcatagataatgatgcctacctctaaccagcgtttgagggaaccatccacaaagtgccaattaacactgccgacaatcacaccatcccgtgtgatgacccagttacgcggtcgaatcagccaatcacgggggccaataattgtctcaaagtctgtttgagtcggtagttggtcatgaaaatacggtccattccagcgcgtccactccgcatctagatcactaaaacctagttgccatagcgttgttaattctgcgcgctgaagcggtcgaattgtaattgttgccgtcatttgatcacgccctctcaattcataggtctactatatcgaaaacccgccctaacaacaatcacattcgtggacatataaacttacattaaacggcccctttcccagcggaccgaagctggccatccttgactttagatcacttagggacaacaacagcctaaaaaaccaccattctggctgaaagaatggtgatcataagtcttaagcgtgtgttgcaagctgtcgcaacaattttagtatagctgctgaaacgcgtttcaggtcaagcactaagttggcgccaggttgctttggtcagtaagtaccgcatgacgtggatcacttcacctttatcactggtaaacgtgtgcagttctccagccgcttgcatgcccatcttagccatcactcggccagaattagggttggcactcgcatagtgagcctcgatggtctcatagttcagcgtttcaaacccataatgcatcaaacaattgccggcttccgcaacataaccgtgcccccacgcagctgggcttaaagcgtacgtcaattcaccagtcgcaccactaccatgaaactcataaaacccaattagttgatgatcacggcgacgttcaatgccaaaaacagtggtcgtgtctgccaaaaagtgcgtcgtaaacagttgctcgaacgtggccggactctgaacccgtcggtaacgtaaataagcgacaacctgcggatcaaaaatcatgtccgctaacgcatcatgatccgccgctgtcattggtcgtaatatcaaccgttccgtttcaaactgagtcaaattgccatctccaaattattattgattcgttaattataataatctactggcaaatgtaaattatttcgttccactctcaatgatttggcaaagttacctgtgccagcatcgcagttcctaccgcttcaaatcgggggtcagtaatctgattaacgtacgtaaatatcccagtactacattgtaacagtaaccactgtgtcactaatggtggtatttgtaagtctgtcccataaccagcccaaaaagcttgaatcaacgttgaagatcgttgaagatcttcaaaaaagaatttcaaacagtcctcgagggcgtacccgtgacgggatcgttcaaaatcaatcagaacaagctgaccatgatggtagcgaaaattacgagtacccatgtccccatgcagtgtcatgactggttgcggtgctagtgcggttttaatcatcgtccggtggtcgagaaagtatggtaataaggacaccagcgcgtcgtaatggggactagtctttaaccgctcgacccgggcgaccatcccatcgaaatccagaaccggcatcaggtctgcggttgttggaagttgaattgcgtggtgaaacctggagactacctgacccatttggtaaacgagcgctggagtcaaagttgtcggtacaggagttagttgccaatctcgcaacaccaacacccactcgcgacttgctaattgaaaactggctaagacccggtctgtgagttgcgctgtcacttgctgctcagttctaaatttacgttcgcaatccggactgaaaactttaacaaaaactacggtatcatagcggcgactatagccggtatacatctcattaaatgaaacatgcgcaatcggaatcaagtctgcctgtaataaccgtgttaacgttttatgtagcgttctcatttcgtcctcctaaatccaattcccacaaattttaaccacaataaaagggccggtaaccaaccgtccctttctctgatcgacttgcaaaccccaagcttgccattgtgtatgtgcctcgtcatggacccagcccatcccgagaggtataaatgcttgtcaaacgttatgattcagctaattgagctacttatcactatcaataattgcttattaacaatgtcctgacaaagtaaatcgatccggctcccaacctaaatccgctgacaaagcgtatgtattgctccataactctgcctttagtatagcgagccagcattgcgtttagataacacgaagattacaaaaatgttacaactggtctaaaccaactaaaagttagcctagtattgcttaatcgtctctgattacggacacccagtttatctttaacgaacaaagtcgtccactacggccttaacagtcggtctttattgagctaaaagccgttgattgacatgtgcttgaataacttgtcgccgggaaccggtcaagaaataaatcgttatgccaacaaaaataatgacagtagcaccgattgtttgccattcgaacgcattcggcttaaccatcgtctggctacccgatgccatcatgctcaaaatatcaatggcggcatggatcaccatcggtaacaagatactacctgagtacaggtacgtcgaggctaaaaaccagcctagcgtcgctgcaaaaatgatttgctcaaccgtggctgacaagggttggcccgcaaaaacgtttgtaatatgccacattccaaataggccaccgcttagccacactgcccagtcgagctggtgacgccgatgccgaaaagcttgtaataacaaggtcaaaacggcaaaacgatacaaccattcctccgcgattcccggttctaacccactcaaaaacattttccaagtcgctgaccgtagctggaagtcccaatgtgtgaacgtcgtcgcccacgaaccacccgcactaaaagcattccataaactaaaagccgtccccaccacgatcagcccaaccactaaactagtttgagcctgacgattaaaccgccacgatgggcccgttaatccccatccccacagtaagaccccaacagcaatcacaaagcctagggcgcctaaaataccagtatcactgaccatctcgaacactgatggtgcttgcagattcggtaaaatcagaaaagtctgctgcgcactgacgacgccactaaaaatagccgtaattaagaccgcaatccggccaatcacagattcgatcggtttagtgaccaccactaccaccggcacgaatgcgaccattaaataagccatccccacagcaatcagtccctgttcgtctaaccatgacagctgacttaaccaagccacgaggttcgccagtaaaatcggcaagagtgtgaactgcagcactgtttggacgtaataattaacatgtcgcaaacgccaccactgtgcttgatcctcctcggcagctggccaccaagctaacagtccccatatcagcaactgcataccaccaactgggaaaaacacaccaccatcaaacgtaaatagttgaataaaggccgcaccaaataacacgatgagctgccccatgtaccagcgtcgtaataattgttcggtttccggcgtcataaaaaaatcccccaatctgatatgcattaatcataccagattgagggacgctcacacgtgattttgtttagatttctcggattccacgactaactagtaaagatcttgcacccggccctgtgttgcttcatgggccaagtattcatcataagtcgtatcaccacgatcaacaacgcctttcgcactcacttcgacaatgtggtcggcaatcgtttgaataaattcatggtcatgagaagtaaagacgatggcgcctttaaaatcaatcagactatcattcagtgcggtaatggattccaagtccaaatggttggtcggatcatctaataataagacgttagcccgactaagcatcatctttgataacattccccgtactttttcaccaccagatagcacattcactggtcgttcaacatcgctaccagagaacaacattttacccaggaaacctcgcaagaaagtattgtcactttcttctttcgatgcaaactggcgtagccaatcaataattggcaattcactacccgcgtattcttcattaatatctttaggcaaataagtccgcgaagtcgtttgtccccaggtcaccgtgccactatctggttccatcgacccagcaataatttgcatcagcgttgtcgttgccaagtcgttgcggctgatcaacgccgttttttcattaggacggagcgtaaagctaatattatcaagaatcttaacgccttcaatcgacttggaaacgttctcgaccttcacaaggtcattaccgatctcacgatctggcgtgaacttaatgaacggatatttacgtgatgatggtttgatatcatccaacgtaattttttccaattgtttcttccgtgaagtggcttgcttagatttcgaagcattggcactgaatcgcgccacgaattcttgcaactctttaatttggtcagctttcttggcattggcattcgcttgcaatttggccgctaactggctagattccatccaaaaatcataatttccaacaaatagtgtgatcttgccaaagtcgacatcacacatgtgggtacaaacttgatttagaaaatgccggtcatgagaaacgacgatgacagtcttttcgtaaccagccaaaaagtcttccaaccagctaattgattggacgtccaacccgttcgtcggttcatccagtaatagcacgtcggggcttccaaatagcgcttgacctaataagactttcaccttttgcggttcagtcaactcgctcatcttcatgtgttgcatcgattcatcgataccaaggttttgtaacaactgatccgcttccgactccgcgttccagccatccatttcggcaaattcgccttctaattcagcggcccgaatcccatcttcatcgctaaaatcaggcttggcatacagcgcatctttttcaatcatgatttcatacaacttttcgtgaccacgaataacagttgctaacacttcttcatcttcgaaagcaaagtgattttgattcaagctagacatccgctcgttaggccccatcgagaccgtcccagtagtcggttgtaatttaccttccaaaatttttaagaacgtcgacttaccagcaccattggcaccaataacgccgtagcagtttcccggcgtgaatttcaaattgacatcttcataaagcttacgtgttgaaaactgcatactaacattatttacggtgagcattccattacctcttcttttttaaagtgaaattgtccgatagaaaagaggtcggaattaaacaaaccttccagacctctgtgtcgttaattatataatcttaattttagcatgctttcagctcgtttggcaatcaaaaccatacgtgattttctgaaagcatctcattattttcataaacaatctaaattaaccccacccgtaaacaccagttttaaccgtgtctagtgactcaacaaaccggcttgcgcgaccaaagccccgcctgacgatcatcacgcacaccaagtaactcaagttagcaaaatactggtctcacaaagttaactcaaaatatgttgttcaatataatccaatacaccattgtccacattggtacctgtcaccgctgtcgcattggcttggacgttttcaggcgcgttttgcatggcaaccgcatgggtcgcatagtgaaacatctcaagatcattggtgccgtcgccaaagactaacatctcatccggcagaatacccaactgttcaccaagctgtttgagggcgcggcctttgtgcattcccggctgaatcaagtccatactgccctgaccacctgaagcgggtacggcaatgccagcgagcttaggggtaagttcatatactaactggtccgtcattgccgcgggacaaataacgtcgaacttcacaaccggatcagtaactgtggttaaatccgcacatgtctctaattggtaatagtagtcacgcatattagctacaaactgcgggttcgcgtgcgccaacacatggaccgtttgggtgccacacaatgccacttgtaattcaggatacggtgccagggccgccaacacttgctgagtcgcttggggactgaacgtcgcggctttgagtcccgcttctcgttgccacagttccgcgccgttaccaccaatcaaccacatctcagggtaagcactaaaggtcgtggctagttccgccgcttggtgaccactggcaatcacaaactgaataccgcgccgctgtagcgctgcatagtcgttggcaaaccgctcctggtcataatcaccatgatcatttaaaaacgtcccatccatatccgttgctattaatttaatcgtcattactaatcatccatttcatgtaagccttttctaccccttagcctaccgattatgcccgcaaagtacaagtcttttctgatactttgttagaaggcaccaccaccggagccaccgccaaagccaccagaactaccgccggagaagcctcctgaaccacccgacgccgaactagcgcttccagaggcatctaaggcgccactaaaactatcgttgattgcaccggacaaatcgaagtccagcccaccattggcatagaagagtgggtaatacacgagcatccccgtagccaatgcttccgtaccaaaatcaatcgccaattgcttagtcacttgattggttagtccaaaagccgcggcgtatggcaagatttgttcccacaaaatcaaatcaccgacttgggccgtattaaagtgcccaatatccttaagcatgcggcgtagtccattgatctgattacgtaattccaagcctgcgtcagtattgatggcaatccgccgccgttgaattatccagccaatccagaaagccaccgcggccactatcgctggaatcaccatcagggtcacgaccttcggactaactaataacccagcacccgtggcaatcatccccataacactcacgacaactgctgccatcagccattgattacgaagccgataattagtttcgtcttgatagaccgccacgtcttggtctacttcggtctgccagcggctaaaccatttgcccagccgaccagccttatcacgcttcccgtattttttgagatccgttaacatgaactgcccgtcaaccgtgattttatcaaaacagtgagccaaaaatgagttagtcactggtttcaattgcgttaaccgcacatccggttttcggtgacccgcaaccgtttcaatcgttatttcgtgattagctgctgctcgcaaaatttcagccgttaaagcatccgtattcggcgaccgctgtgcccacaatgactcagcaactgctggtgttactggtggcacgtcaaatgaatggttgatgggaatcggttgctgatgtggcttagccggatgacgagccagccaccaaagatagccaatcatgaccaataaccaacctgccaccgcggcaccaaagataacgcgacgcagtaatcgattacgtcgccgtttttcattagcttcctgtgccaacttagcttcttgtttttggaccgtcacttttcgcttggcagtattcgtccgcgtattcgtcgccgtgaccgtagttggaaatagtaggtgactttcaacgaattggttcgcgggattatgtcccaatgtcatcgtcacccggcctgccgcgcgctcaactttcgtctgaccactcaacggtccgtgcgtccaagcttgtagcgcgctcacattcttggcaggtaactgaatcacgattttgacattattcagtggtacatcccagccactaccaatcactttccaattcagttcggccgtgtctgcatagttcgttacgacccctttaagccgataccgatagacaacccgtaacttatcatcttcttgaacttgccggtagagcttgacacgcatccggtcagcattttgggtcaactgatacgtgttgttggcccccatttcacttggcgccgccgtcaccgtggccccaccattcagttgcgtcgtgaccccttccaactgggccccctgaatacctttcaaatcttgaacattaaataccccgtgataatcatcatcaaattgataagtcatcgcttgcgttacattcgcactaccatcacgttgaatagctacattgacttgatattggtcaatatcataatccgcagccgcgcgcattgctaagctaaaccaccaacaaaatcctgccaatagtccgagcacgctcagccaacttaatcgtcgcttcttcgacatctcaccatcgccccctccaataatcgttagccctagtttatcatactcacccagccgtggggcgcgagatactgccaccgctttcttaggcaaagccgtccttttgttgtagcatagaaagtgacacgaaaggggttttagtcatgccacaaaccacgttaccgactcacattcaagtgcgaggcgcacacgtcaataatttaaaaaatatcgatatcgacattccactcaacgaatttgttgcgattactggtcgcagtgggtccggtaagtcatcactcgcaatgggcgtcctgtacgctgagggggcccgccgctacttaaacgccctgtcaacctttacccgccgccgaatcaatcaggtcggcaaagccagtgttgattcagtacaatacttaccatccgcattagcgctacgccaacgcccccaggttcccggcgtccgttcaaccgtcggcaccatgtctgaaagcttaaatatcttaaggctagccttctcacgactcagctcagcagtttgccccaatggtcaccgcatgctaccaacgctcgatgtggctgaaaatgatggttacgtcacctgtccgacttgtggcgccaaattcagagcgcccggcgccgaagatttcgccttcaattcaggtggggcctgtccgacttgcggtggcctaggccaagttcgccaaattgacccggcactcattattgcggatgaaaatcaaactatcgaagaaggggccgttgcttcttggcacctgcctggacgtaactttatgccgatcgttgcacgcgaaattggaattcccatcgatattccgtataaaaaccttagtgaagccgataaaacacgcgtattgcatggtcctaagcaaaccgttgccatcaacattccaagcgctaagggtaaaatctttcacatggacaacgctgtctacgagaacgcctttgccgccgttgaagatagtatggcgacgaccaaaaatgaacgggcaattactcggctgaatcgcttttacaagtttgatacttgtccagattgtcacggatcacgcttcaatcctcagttgtttaactacgaattaaatggtcaaaatattgcgacggttagtgatatgactgtcgacgccttgcatgattttgcgaccacgattgtcccgtggctacctactaagatgcatcatcttggacaatcccttgttgatgaattgctactcagcctgcaacccatggaagaacttggactcgactacctcacactcagtcgtcccggcgcgaccctgtcaactggtgaattacaacgcattcagctcggacgcactttgcgcagcgccacgactggcgtgctatatgtccttgatgaaccttccgttgggcttcatccagctaacgtggcgggcctaatcaaagctttccgtgggctagtcgcccaaggaaactccgtcgtggtggttgaccacgacactagtattatcagtgcagctgatgatgttattgagattggtccgggggctggtaagcacggcggtaccgttgtcggacaaggcactgtcgcagccatcaagcgggacaaaaagtccttaattgcgccatttctcaccggtactgccacgctgcgtgaacgccccgtattaaccgacgatgcactctggaaaaagggggcccttgctattgaggtggctcatcactttaacatccaagacattacggcgcgcattcccaaaaaccgtttcacgaccgtcacgggtatgagcggcgctggtaaaacgactctggtactagatagtttgattccagcactgattgccacagctaaaaagcgaccacttccaacccacgttaaggcctttgacaatggtcacattcggcacgttgttaccgtcgactcagtgcccgttggtaagaatgtacggtcaacggtcgccacttataccaacattctcgaccacctacgccaattattcgccgccaccccagcagcacaagcaaacggttggaccgctagccaattttcatataacgtcgctgcgggtgcttgcccaacttgtggtggtacgggccaaatctccttagatgtgcaatacctgccagacatcaccgaagtctgcccccaatgccacggcaaacgctacaataaacagacgctgaccgtcaaatggcatggctattcgattgcggatattttagatcttgcggttgacgaggccctaccaattttcaaagcgcaatccgccatcgctaatacactccagatcctgcatgatatgggactaggttacttactattaggtgaaagtacgccggcactctcgggtggcgaagctcagcgcctgaagctcacctcccgcattggcaaacgccaaacgggaacgctctttgtcttcgatgagccttcagtcggtttgcacccgctcgacattcagcaactcgtcaaagtctttgaccaactgattcagcaaggggcaaccgtcattgccatcgaacacgatctcgacgtaatcgccaacgctgattacgttatcgatatgggacccgcgggcggtatcaacggtggtaacattgtcgccaccggtaccccattagccgttagtcaaaatccaactagtgtaacagggcaatatttgaagacgcatttggccctattccacgtttaaccaatgaactgctgaccgacctcattcatcacagcagcctgatcgaatatttaatcaaaaagcgtgtccaacgccctagcaagttaactggctgggggttagacacgcttttgttttgccgagatggcgctaatgaagcggacaaaactaacgtccttttccttaatgcaccatttcagttagtaagccgtcccaagatggctttttgagcactgcatttcactaaatcccttcgtaagtcatcacaaagctgatagccacatcctaacgccaaattgaaatatcaataacaaaagattagcaattaatcactgccggtgcgccatcactgcccagatcaacgccagcgcactcataccaatcaccaccgaacacgccgccgtcgcaccaactaagttatataataaaacgatgccgacgctaccaacgggtgccgccaacgtcacaatcgaactgatggtaccaaagaccgtccctgttaagagggggtcaatttgtggcatcatgatggcgaacatcttcgggtccagtttgccactcatgaagcccactgcaaacatgcccccaagaatcaagattagttgtggaacgactagtaaaatcacataggtcagcatcggcgctagaatcgctgccagtaacaattgaaacagcgagagccgatcaaaccaagtatttttagtaatgccacccaatacgcttccggtaacaaagaccacattgaccattaaaattgcgaccgaatagctcacgggcatgcgggatgccaagtcaataaacattaagttcaaaatcgcatcaatactcatcgttgcgacgtttaaaatcatcagaatacccagataactgactgcgcccattctagtcgtcgtcagcatcactcgctgaatcacgggccaggcctcaatatgtcgtggtcgtacagcaactttgggagtcgactgaatcgctgaacgtccggctaacaagcagctagcggccccaataaaagtcatcgcattcactattccagctaacgcataatcatgccactgggcgataatcaagacccctagtgtttgacccagtggctcaacaagtgtacttacgctcgcattaaaccccatcacttgttggcgatcgtcaggcccaatccggtcttgaataacaattgtcaaaatactgccaccatatcgtcctagtagatccgaaataaaattaatcgcaacgaccacgtagaaaacaaccacagtttgctgagtaatcacttgggccaagacgagatataaccccgcttgaacgaccttagtaccaatcagccagttagtttttcggtgcgtctgatcagcgagtcgccccgttaatcccccgaaaacatacggcacaactgtcaccaccgaaacgatggcaacaaaccaatgtggatttggaaaattctttgcgtacgtgagtaaaatgatattgaacaaactcacccccagcgtcgtaaaaaaatttgcactagcaatcgtttggagggtccgattttttaataaagtcagcattaacccatctcccattaagataatggacttagcttactcgtcattaccgtggtacaatcagcaagtaggttgcatatatgccacattaaggagtgctagatgacaaacatcggagaaactattcatcagattcgattaagtaagggcttaactcaacaagaagtgtatagcggtattatctcgcgctcattcgcctcacgctttgagagtggtgccaacgatattggcgccagtaagctctttgcaattctggataacttagcaatttcagccgacgagttacgattcatacaccaaaactaccagccatcagcatatgaccaggccctttggacaattcgtcacgcttatgaaacgctaaattttcccgccctagccacttggattcgcgaacatcgacacagcccccacgcctacgaacaactcatcgccagttatgccagcatcttgatgctatcctatgaccatcgttcagtcggcgtgacaaccacgacccagcccgcttttgatcacctgcgccaagccaagacttggaccctgcaggaactaaaattagtgcccgttctaattccaattattgcatccatcgacggtttggccgcactaacaccactgacaacccgtatggccgccaattgtgccagttatcaaacggcttggggcgatccctttcacgtcagcaacgacttactcgatttttatggatcactatttcaaactaaattgaactttcatgattttcaatccgctcaaaatctgaaaaccaagttcactgccatcgacagtcaccagttaaactgggatgggcggttgagccaacaattctggcttggcatctggaatctctactttggcgactggcaaattggcaaccaattgcttgatgaagtcagcgtcttagaaacacatcatcacccccggattgataatacgttatttgcaattcgtaatattcgcactaagcaagcccagacttatcgccaatcgcatcagtctcacaagcatctttgacaccgaaagcctgttctagcctggcaataaattatgccagactggaacagactttttcttaatcacacatactgattaactgacccaaggcttgctgatagctatgcctttcagattgttataattagcgcgtattgtgttggcttgtcatttattttgtattacagcggaatacggaaatgaatttataactcatgatggtttgaggttgagcaacgtaaaaagaacttctccaaattagaagaagttctttttacatgatattaaacaaaccctggcttaaaccgacttggtctggttcaaatgcggtagagccaagaaaatcactaatccaacaacaaataaaatacttaaagaagcagcaccaatcgttgacttccccgtcatttgggtcacgattccaactaggacggggcccatcacggctgagaacttaccgagaatattgtaaaagccgaaaaactcactcccactagtcttaggaatcaaacgaccgaagtacgaacgactgagcgcttgaatcccaccctgactggttccaactagtatggctaaaatccaaaaatccgtcgtactattcaaccgcaacgcgtacaagcagatacctaaataaataataatgccaagcaagatgcccgtccgggtcgacattttattcgctaaccacccgtaaagcagtgaaaacggaaacgcgactagctgaacaaccagcaagacaatcatcaacgtggtcgtcgtaattcccatatccatcccaatcgaagttgccattgtaaagatcgtgtcgactccatcaatgtagaagaagtacgccaccaagaaccacgccgcagcgcgataattccggatgtgtttcaaagtcgaccatacccgttggaaacttgaacgcaccggatgcgcactgggtgctaacgcgtacttttggtgaacgtttttcaacaaaggaatgtaaaagataatccaccacgcagcggctaagacaaaactccaccgcgcgaccccatagcttgataattgaccaaaaccactggttaattgtaagaccaagaataagataaacgccaagacaccaccgagatagccaaacccataaccatatgacgataatcgatccatctgatcgtttggcgccacgtcagtcagaaaactgtcataaaacagattaccaccggaataaccgataattgataaaatataaatacctaatagccacttccaggcactagtcggggcaacactcagccctagcgtcatcaccattccaagtatcgaaaagatgttgagcattcgtttcttggcatggggatagtctgctagtgcacctaggacgggcgccaaaatcgaaactagtaaggtcccaatactattggcataaccccagtaagccgttgcattagccggtgtcacaccgctactttgggcaactgccttaaagtaaacgggtagcaccgccgttgtgacaataatgccatagcccgagttggcccaatcgtaaaagatccaaccccactgctgtttattaaatttcattaagttacttcgcgggaacctctgatcgcaatcggaggcggaacgagcactaaccacaatattagtggtgctgatgtccgcccgcttttcctctctctctcttttttgtctagtctttaaaaacaccatcgaggcaatgtcccggcatggggccatcgaaattcaatccgagtaaccgcgcaaatgtcggcgcttcatcgactaagttagccgtttcaatcgtcccaccagctttaactgctggtccattgaataacagggtcgtttgatagtcaggcttagtcgggtcatatccatgaaccccgtggtaacggtctggttgtccgagtgtcgctggatggacgggttcaaccacagttggtcgtcgactttcatcagtaaaataatagccttcctgggcttcaaccatcaatgcacaagcggggtcggcaccacgacgtgcagctgcctccccagtaatgatggtctcaacaccttccacctgactaaccagggccttcaattcatctaactggtcaaattccggtcgcgtataaatgtacgttgagccgtccgccgtcttcgccatcacggaccagtcatcttcaaacgtctgatcttgacgtgcggtcaaccagccctgctgagcgaataacgtatttaaatgaatcatgtgatccacattgatttgatagtgatcacctaaaataacaaagttggtatccgcaaacgtgcccgcagctttagtcgcgtcaatcaactggcccacgtgccggtctagccggtgtaaagctgccatggcctcactggatcgcacaccatagcgatggcgcatactatccatgtcgactaagtgaatcatcgttaggttcggcttcttattcgttaacgtatcgactgcacaagccgtgatgaattcatctagttggggctgcttaatcccattacgaagatgcccatacttatgattcatcgcgagtaagaagagcggtgaactcgccttcaacgagacgagaacttggttcgtccaaatgcggttaggaaagatctcggcaaggttatatgtaatcttgctgccagccgtcactggccataaaaaagccgccgttgttagcttcttttgccgtgccaaatcatatagtgttggtacttgaacgtccttttgataccaataccaatctggtgaacggcgtgtcggttgtaacttagtattattaacgattccatgcacgctgggatactgtcccgtaataatcgtggtatgtgacggatatgtcagtgttggataaatgcctgtcaccgacttgacccaagtaccaccggtcatcaatccactcagaacgggtaattctgcttgatgttcgcgtaaatcacgaaatcctaacgcatctaaggaaataatgaccaagtgttgatttgttgccatctcaatcgctccttcttacttaataagcttattcgtattattataccgcagaaaattaattggtgtcaggatcgttgacaaaaaacgggcgatcagtgaagcacgactgatcgcccagatttattttcaataattaccagctaacaatccctgttcttgtaaccaccgcaatgctaattgtggccatattgcagcctggtcattcaaatacttgtccttgccaggtttttgcgtcacatgattggctaacgctaacccatgaatcccactaccaaataaatgatacgcagttgcgacctgatgttgtagcatggcctgcacatattttaacgaattgattggcgggaccaactcatccgtcgccgtttgccagacaaaagcgggtttactagctggtgtgaccaggcgctgggctgcccacaaccgggcatccgtggtaatctgattacgcgccgccgaagtcgtgggaaaccccgctgtcaaatcaatgactggatagcctaaaataatggcagcatgctggccttgataatgatccaaatgataccgtgtgcgcaattctggttgggtcgcaacaccattataagtcgcaaccacgtggccgccagccgaaaacccagcaagaataatccgctgacaatcaacatggtgcgcggacgcctgggtcgtaatccaatcaattgttgcacctaattgctgcaacgcccaaggatagacggactgatctcccacaattaattggtaattcaagaccaccgtatgcattccggcggccatcatccgggttgcaattggcgcttcttcccgcccagaatgataagtaaaaccacctcccgggcagataatcatgattggataatcaacagctgtttcaaaatcactaatttggtctaaccaatacgccgtgatctgaaatgggtgtgccgcagtatttaatgtgcgctgttcaacttgcatatgttccccctcctactcccgtattaccgaattgatttcgctttcattatagtaggtcacatgattgcttgtcaatttttattcgaataaatatcgatatttattcgcttgtttactcgctaatgactattatttgctataattaaattaattatatgatgagcgggggtattaaaatggggaaacaaacattcagcgacatctatcacgttttaaaggaccgcattctcacgggacactacagcgttaagatgcgattacccattgaagacgaattaattacagaatttgatagcagtcgctatgctgttcgtaaggcaatcgcacaactagccaaagacggcctagtttacagcgttaaggggcgcggggtggtcttattggagcacacgccacaaacccagcaattcaatctggctttaaataatctcaacggtctgcagagcctcaacgcggagcgccacctcgattatcagaccgaggtcgtggcctttcagcaacgaatcgttgaccagccgcttagcacacataccgcttttgaagtgggtattccagtgtatgctattcaacgggttcggatcgtagacggtattcgggcagtgctggacattaactattttaacgcccagcgcactcccactctgactaagaccattgcccaacactcaatttatcaacacttcaaaaaaaatggtctgaaaattgctgtcgttaaaagaatgctacgagtcgaatccgccaacgaactcgacaaagctcagctagcgctcggtgataataattgcgtcggtaatatgattagcatcgcatttaacgatgaaggacgccaggttgaatacactgaatcccactttattccgaacgaatttaacttcaatgaattaattcgtaattaaaccttaccaacattacttagctgaatggtcatccggaccatccagctttttattatggttacttactttagaccaattcagtcggtcaattaaatttatctgtgaataggtttcaacataaattaaaaatatattcgaataaaagttgactaatgtgctgaattatttataataaatatcataaatgctaatgggggttagcatttataccacgtttcactagtggcgcatttggggtcaagagattaggtcggtcatggagtagagagaattgagcgtcactagaccaatttggtttagtgacttttttatgcaaaaaaactgttgattcgcaagattaaacttgccgaatcaacagttgcttcaaaatacaattttaagcttaatactgacgcttccgccggctaaccgctgcagcacctaatactaatgtacttgctaatgcgattcccgctaaactaatcatctgacttggcgcttcatcagtctgtggtaatgcttgccccttagccactgccaacgcgctagccaccttagttcgtagagcttgtaattgcgctactaacgccgtattatgatgcgctttagcttgtgcgattgcccggtcaatcaagttgatcagtgtttcctcatccttaatctgatcgccaaccactgcttctttttgaacttcctcaaacgccgtttccaattcagtcgcagtttcgtccgtgacccagtcagctgtaatttcattgtcgacttcttcttcgatttggtcgacaacttcgtctggcgtcacaccagcttcgatttcatcctcaatatcgtcttcaaattcttcttctgcgtcttcagcttcttcttcgtcctcaatctcgtcaaagtcaggcatttcaacatcgatgcttggatgaactggtttgtcgtactcttcttcttcttcgccattatctggcatttcgatatcaatacttggatgtaccggtttgtcgtattctggttcttcttcttcgccatcgtctggcatctcgatatcgatacttggatgtaccggtttgtcgtattctggttcttccccctcgccgtcatctggcatttcaatgtcgatacttggatgtaccggtttgtcgtattctggctcttcgccctcgccaccatctggtaattcggcatcaatacttggatgtaccggtttctcatagtccggaactggttctggatcattttcattatcaacattatcctgtaaatcccaacgatgggtctccgccttcacgttgactttattagcaatgatgttgccatcaatattttgatttgcatcaatttccgccgctggggctaaaatactgccttgaaatggccggtcgacactaatgacaccagttgctaacttgtcactcgcggttgaatcatagaagttccaaagcaaatggttatcaccaaagtcttcagtttctttattattccgctccgtaccgtcatcataaatgattttgatctgcgagttaacttgatagttggtcgcacctgccgtatcaacattaataatgaccgtattaccatccgcatctgccgatagtcccttgattgtcagcggcgtactcgtgtttaaaacatccgctgacagattgatcacaatgtgtccatccgcatcaggttgcatatccgtcacatcgatgacccgctgattcatatcttcaaaactgtcactcgtataggtggcgttcgcggacgcttcgctaagactagcgctcaatttttccaacttagcaaactctttgtcaaaatcaatatagacgttaccatctttgtcttgataaacttcagaggcaagtaaatggtcgatatagaccccgttgaccatcggccgattaggattcgaaacatcaatctcaatattttcgccaaagataactttattgctccgcgtctcaccagccgaaacaaacgaactcccagcaatattactgatattttgaatatacgaaatatctttatctaataattcttcaataatgttcgtaccaaagttaacgttgcccactaagttttgcaccgcaacgttcccattcgtatgggcatgtagttccgcttcccgtgcaaaaatatggaattgggacgaaaccccgagcatgttatgtagatccggataatcgtccgtcacattaccaccatcggcaacggcatcgtttgcatgggtcacagcttgactaagcgccaccgcgacggtctggggcgttgcagttgtcgtcgactggtctttagttgtcgtcgtttgctgggctacactatcactagtcgtcgtaccggcaatcttagcactagcatcggtagttttagcagccgttgccgcggtatcattgctggtagctgagtcagtagtcgcacctttattagaactggttgttgtccgcgcagccgttgcagtggcagaatcagttgtggtcgacgtctcttttgtcgactctgaaccggttgtcgcattcgtctcttttgccgtctttgaaccagctgtcgtatctgaaccagtttcagtattggcactagttgtctcatccaaattggtggtagcgtttgtatcagtatccgttgccgccttagttccagccactgtgccagcagcagtctttgaattcgaaccatcggtatctaaaaccggctgattttggttagtcacatccgcttcagttgtggccgcagtcttcaaagtttgtgtcttagccgtgactgatttggttgtgcttgaactggttgatgccgtatcagtccccgttgcagtcgttccatcatcagcccgagccaccagcgttgttgtgcccatcgtcaagataacggcacatgcaaacgcccagcgacggccaattttgtacattttaaaattcgtccgttttcgctccatcatttacccacctaaaatatagtttattaactttcctttaattcaattctattttcacgctttttcatacaacattcaactctttatataatttattttgtattgttatataaacagtggatgactgtcaatagacgtgccagcaaccattacaggtcttaactaatcataagttagtatttttgttatctattcgtttacttggaatatcgattatcatcacgcacttattttacacaatgtctcaaacccacaaacagccgcctaaaattggtcaatacttgcctcgcagtacgaaaaattttggtgtgaaagctcgtttaagcaatcacaacagccgcctatccacacaaaaaaagactggtcacaatcaaccagtcttcaataatttaattagtcacgtattgaccaacgacggtcagtcccgttaacactttacgtccatgtggtgatttggtgtcgatgactgcagttaattcttgccccgcaagattaccatgatgcttaccgccagcccatgctgcaacccccgttacatcataaacgacaccatcaaccgccacgtatgcgggttgaccatcctgaccattatattttgctaattcagtttgattaaatgtcgctgaattcatgccgaatcactccttcacaatttaccgtcatgataaactggactgccaagtaaaagcaagtgatccgttcttaaaccaaataattgacctatcttgaacataacacgacatcaaacgatcgccgaagtagttatacccccacaaccatctcggtaataccggcctaacctttgaccgacgaaacttaattaactaggtaaccatacttacgttagcacccaattaatcgtacccgtgatagcagttgtgcttataagtctgccaaaacttaatcgctgaccaattactgctacccacaactacttaatcttaataccttataacatcagcgacgccgtacctcctagtacggcgaccttgtgaaccagtactgttcatgcgtccagcactgcccctaactgcgttattaaaacgcacacctcagccactactgcccattcaatgggctgcgtcgaagcgtgacgtctagacacaccccgtatctaggacgtcgattgcttattgtcaaacaattaattaccttggggtggcccgatcgttgcgacccgatgattaccagccatactggtcgtaatacctgagataacagttcccatcggatcgacttgattacttgctgccagcaaccgttctcgaacacgaacaaccgcatgtctaatcgtcaataccaccgtcgttttaactggttggagccgttgtgtcagtagtgaaatcacttcaaccaacatctgcccagcaaccacccagtcacccggtttaacgttgaacttaaatgtaggcgattccaaagcactggttaattgaccaatccgtagccagcccaccagaccgttggccgctcgaaagccaattaaccgttgattggctgccacggctgtgataaccccagcaaagggcgcaacaatttgatccgttgccggtataatttgctgcttaaatcctagtaacccatataagtgaaccgtatttgcaagggtcgtcacattgatcacttggcgtttaaccggcgcaactacgggaattaatgagctaatgaccactggcacacttctcacttccttactttataaattggcaaccattcgtatttaaataaccttaacaaacgtaacgtaaaaaacttgttttctttaatatgtaagtcaattagtttaagtcattgactgttatctttacaacataaaccataccataattaaactagaatgccagcataattaacggtttcgattaaggtttacatctgttagcgttaattcgtaaactcaattaacgaacgatgctactaaatagctgaaattggccaccataaccccaatgtcgcactcaatcaatcttgtagatttgacatcatgtttccccaatacgtcaatcaggcaatgacggttaggcctacaatttcagtcagaccgattgcgagcaaaaaagagcttccggcttttattccgggagctcaacaagtcaacgttatttatttttaatctcagccactattcaaccgtaacacgcatccgcccgtgccgctttgaaaaatagaggttctgatcaacacggttgtacaaatcaatcggactaccatcggcttgatgcagtgtcgagacaccaaccgaaatcgacacattgatttcctcgtcttcatacttaacaacgagatgattgactgcttcaaagacctgacggacaatcacttttgtactagccagatcataaccgggaaacaggacattgaattcttcaccaccggtgcgatacagcttgaccttctcgtcattggcggccaagaccgtcgtgaccgtggcggcaacttcttgcaaaacgcggtcccctgcaaggttgaccgtacgtgtcattaacgtgcttaaagtgatcaatatcgaacatcatcatcgataagttgagattgttcttggcactatcatcgaataaatatttgatatgttccgtgtaagcggcaaagttctcagtctcagtcaaagcgtcgtgactcgcaaactgggccaaccgtaatttaatctcactatcttgggtcagcatattaacgtaggcgtacaataatcctgcaaaaatcattaagtagccatattcttgtaaagtattgtcccaatccagcgaatatttaagcttgatcaggccccacaagattccgccgtaaaaagcgaccgcgccatagtaatatagccaaggataccgatgcttaggtacccacagccgtagataattcatgctccagaaaaatagcacgaacacgacggcgtaactccacgattcccagtaaaaaatcgactggtcgaaaaccatgtacactatgaccacaggtaacaatgaataatacggcattcgaatattcaaaaaaaacgagcagaacacgacggcaatcaagtgaaagttaacaaactcccaactatctgctttaccgacgaccgacagttgcatgacaaacacaaagaccaacatgtaaatcacaccgtgccaagcattgacggtatcatcgtcaatgttaatgtgacgggcatgaaaccacgtcgtaatccaattaaagaggacccagtaaagtgttagaacacctaatataaagaaaatactcgttacgaacggcgaaattcgccaattagaccatgtcatcgtaaggatcctttctcagcatccgccgttgaccaattgccgaccatcatcgactaaccgcggtttcccataatagtaaccctggtgccattcaataccttgttgttcggccatcttttgatcaccctggtcttcgacaccttccagaataaattccagatggtaagactgagcaatatcacgccaaaatgctaattcatgaggaatgcgctccgcttgcccactcatccgtaagttttgcatcgcaaacttgatttgatcaacaaacggtagtgcgtggcgaatattctcaaacgtgctcgagcccgtccccacgtcatcaatgcttaatttaatatcatgttggtggaaaaagagactatatttttgaatctcgtttaatgaaggacattctgtcaactcaatcgtcagcgcggccggattcaaccttttttttaggtaaatgatcgtccctaacatcaggtcgtcctcagcttgttgccggtttgaattaagggctaacacctgattagtcgctttcgtctgcaattgactagcaagttgttctaataattcagcttgtttatctaatgataattcagtgaacgacttcggaacggcccagtgaccattcatctctttacgtaacagtaattcataaccaaaaacagctcgatggctgtgatcaacttggggttgaacaaaaaaacgatacattcatgaagcctcgcttttaatgatttctttatgtcaatataaattgacaactcctgtaaagtataaccgcttttaactaaaatatcgagacatagttacagactttaattaaaaaaattattaagggttatatgtaaccgttatattgaccgtaacaaaaaagaacgtcgtgacgacctcgtcataacgctctttttaccagtcttaatttcacttaaccaacttatcccagatgacgactttaccagctgttagcgacttaggaacgtcgataatacgttgattggaactcccccgaaattgtagcgagagatccatcttatcttgtaaaaagcgcccatctaccaagatatcaattaatgatagcatcttcagtttatcctcagagtcttgttgcaattcttcccaagtataacctgaccacgaccaaatatccttcgtgtttccaaattcggagcgaatgcgttcacaaatccgaatgccgacttgagtatttagaaacggttcaccacctagcaacgtcaacccttgcacataatcttgcccaaggtcttcaataatctgatcttccaattcttgtgaatacggttgtccataatgaaaattttgtgccgccacattataacagcctggacagtggaatgggcagccgctcaagtacaagctacagcggaccccttccccatcaacaaagttaaatgccttataatcagcaacatattgttcacttaagtcctctgccagccattctttgggcatcggattgtttggtcctttcgtagcgcgcggcattcttaatcatctccggagacatatttttagcacgggacgcgatttcaacgtggcgaccatgtaccattggtcgttgttgtgggttacctagatacccacacgtccgcttaacaacatcacagtatttagggtcgtgattgccacattctggacagacgaacccacgggcagtggccttgaactcacccttaaacccacacttaaaacactggtcgatcgacgtattcgttcccaaatagccgacatgatcataggcccagtcccagacggcctccaaggctttaggattctgagtcaaattaggatattcacaataatgaataaagccgcctgacgcatattgtggaaaacgttcctccaaagttaatttatcgaagggcgtcgggtgcttacggacatcataatgaaaactattcgtgtaatattccttatccgtaatatctgcgatccggccaaacttcgcaatatcgtcacgacagaacgtatccgtcaacgattcagccggcgttgaatacagactataatgatagccactttcagccgcccactgcgcacacttatcccgtaacgctttcaccacggtctccgcaaaagctaacgcgtgctcgtcttgttcccagttcggaccaaagaaggtcgtgcagacttcataaattccaatgtatcccagtgaaatagtcgcccgctgatttttgaagagctcatcgacattaccacctgctggtagccgcttaccaaacgccccatacatgtataagagtggtgcattttccggcttagcttccttcgttcgttcgatacggtacgcgagtgcttcatgacaagtcgccatccgttcctcgaagatttcccagaacaactgttggtccccatgtgcggctaacgcgattcgtggcaggttgactgtcaccacgcccaaattcatccggcccgagtttacctcgacaccattttcatcacgccaaccttgtaagaaggaccggcaccccatcggcgtcttaaaactccccgttaattccttgatcttgtcatacattaaaaggtcgggatacatccgcttggttgaacactcaatcgcgagcattttaatatcataattgggatcattcggacttaaatttaacccccgcttcatcgtgaagatcaatttaggaaaaatcgcagttcggtgctccttaccgagtcccttgattcgaatctggagaatcgccttttgaatttctcgttcaatccaactagttcctagaccaaaattgaccgtggtaaacggcgtctggccctgtgacgaatataacgtattgatttcatactcaagggcttgcatcgcgtcatagatatctttttcagttttggctttcgcataagcttcccgctgatcggcagggacccactttttcgcatcagtcatatgtttttgatagttgattgccgcatagggagccaataattggtcgacccggttagcggaacagccaccatactgtaatgaagccacgttggcaatgatctgcgccatttgcgctgtggccgtttgaatcgaccggggtgaggcaacttcggcgttcccaatcttatacccatttttgaacatgccgtcaaaatcaatcaagcaacagttcgtttcaggcgtgactggtgaataatcgagatcatgccaatggatatcgccacgcagatgcgccttagccacgacatctggtagcatcttcaagcccatggcgcgacttgcagcaccggcttctaagtcgcgttgcgtgttaaaaatcgtactatccttatttgcattttcatgcacaacgctggcatcgcgctcaaacaacttttcaatccgtccttgaacattagttgctgccgcaaaccgctgctgttcagcttcaaagtaatcctgatatgccttagctgccgcggtcaggccttgcgcattcaaaatctgcatcatggtactacgtagctcccgagtatcaatgttgtcagcatcttgatactgggcaacaagggcctgcttgacgacccgtacctcgtcatcagtcgctaacaaccgtcgtaagacaaagtcaattttatacggatgaaatttcgtttgtgcgccaccccgctttgtgacggtcagtggccgtaattggtctaatatatcgttagttgtcgttgttagcatcttaattccccacttttcaaagtcattgatcgaatacaattgatagtgcgttctgtttgaatcaatactatatatagtagctcatttccattaacttgcccattgccaaaattaactgtcaccttcagttgtgtacaccaaatcgctttaatcgtccggttagtgcgtctttggaatatttaaaaaatattttttatactgttttttatctaatatcagaatatttaatcaatctcgttaactaccgaaccaaccttgatacggcttgctttcaatatttttcacacgccataaaccgaattttaattcgttaaaaattaagctgaacacaaccaagttgttgtaaactgattaacttatgactattttgtttaactcatgcggcggattcgctataatgaatttaagtcctcattgagggatgtggacattggaggagagaataattatgcaaaaaagcaggggaataatcgttggcttgttgttgacagggctactgacaggatgccattctgccactgacacacaaacgcccaccgttcaaccagcaacatcaaaagtcagcgccgttcgctcagtcacgactcgggatttcttaggtcgctgggtcagcgctagaccagcaatgagtctgtacctcagtaccaatcatcaagttgcttggttccgacgcggacatacgcccattcgtagtcgcgcaacgttaacgttaagtgatacacgtgccacgttcacaatcgatcacaatgttgcaaaactgaccctcaacgacgctaatcaaatgaccatgaattatcaagggactaatatcgcactgattaaagatccaaattggcagcctgaacacaaccaggttcccaccacaactaatgacgccttaaaggcgggcaccttaacgccaacatttaaattgtcgtactaattgaaggccacaccacatttgcacgttgacttgtgtgagtgtggtgtgttttttagggcctgacaactagcgaacggcttgcttctgtcaaccgtgctctctataattaattaatatgactaatcaatggaggaacatcaaatgattcgaccaattgtgcatgatcccgccgcgcttagtgtccctgctgacttagcaacccctgcagacactcaagtcttgactgatttactggataccctcgccgcacacaccgataattgcgttggaatggccgcgaatatgattggggtcaacaaacaaattattgtcgtgcaactcggtccctttgcaattgcaatgatcaattcgaagataattgatcatcacggcacttacgagactaaggaaggctgcctgtccttacctggtgaacgtccgactagccgctatcaccaaatcacggtgaaatataaagatcaacactttaaaccgcaacaacaacgattcaacgacttcacagcacaaattattcaacacgaattagatcactgtgcagggaaactgatttaattgtgcctacttctaactgagcgggaataaatgttcagtttgctgaactcgttgatatttatgaaagataggactggttttatgacaactttagcttataatggcgagacagcaattcctgcactcgctcagcagcgtcgacaccaagctcatcacgcgctcggtaccgacattgatttgaccctttttggtagtgatagtgaccagtacctacaagttgcttgcgatcttatcgaccaatatgaagaccgcttgactgtcaaccggactgtttctgaggtcatggcaatcaaccaggcggcgggccaacatcccgttcaagtgagcgccgccacctatacactcgttcggcaagctgtcgaactcagtcgacaacattttggtttcaatgcgttgattggtccgctcgtgaaactctggcacattggttttactaacgcgcacgtccctgaacagtctgcaattaacgaacgattggccttgatcgaccccgaagccgtcatttgtaatgacgctgatttcagtgtgcttctcaaggtcacgggaatggagctggatctaggcgcaattgccaagggctacattgccgaccgcattcaagattactgggaagcatttggacagcgggccggaatgatcaacctaggtggtaatctgttaatggtggggacgtccccacttcatccggatgggcaatggcgcgttggtatccaagatcccaccactgaccgcggtaacgcgattgccagcgttacgattggcccctgctcggccgtgaccagcggtatttacgagcggcacctcgaatttaacggccagtcctaccaccacatcttagattcgcaaacgggttatccccgacaaaacgaccttgaaagtgtcaccgttttctcgaaagcttccattgatggtgaaatcgaaacgacgcggctcttctttgcgggccaaccgattcccgattgggcaactcagcgactcgatatttacggcgccatttttgtgactaaacaacgtgagcttcaaatcgttggcttatcacctgaacaagttaccttactcgatgaccggtttacaataatttagaccacaaaataagctaggtcctccaagaaattaacttcttgaaggacctagcttattttatggtccacttacaggctagcatttaatttgcagttgactttagatgcggtacgttcgacattaaaaccattttaatcaagcacagctaaatggcaaaaatatagccgttttagttaaaataacgcgacctaatccgctggtagcttagcctctaagcgatcaataatcgcacggacatcatccgttgtcttcgtctgcattaattcattgcgcaattcggccgcatgacgcataccgcgaacataaatcttaaagaagcgttgaagcggtgcgaaatgcccttgtagacctaagccaataaattgatcatacagatctacttgataccgtaacaattctagcatgtcacgcgttgaatgaggctggggaatcggttcaaaagcgtatgggttctgaaaaataccgcggccaatcatgataccatcgactcctggatgggctttggcaagcttcagaccagcctgataatccaggatatccccgttaatttgtaatagcgtcgctggtgccaaagtatcacgcatttgaactaaattatcaattaactcataatgcgctggtaccttgctcatctccatcttcgtgcgcacgtgaaccgttaacacgggaacctgctgttgcaacaaaaatggaatccaagtctcgtactcatgcacatcgtcaaagcccaaccgcgtcttaacactaacgggaagctctgcttgacgtgcgccctcaatcacttctttggcacgatcaaaatgtcggattaaatcactaccactatgatttttaatgaccgccatatctgggcagcccatattaagatcaatggcttgataaccttgattcttcacttcatgggccgctttcgtaaagtcctcaccactattgccccaaagttgaacgattggtcggggcgactcggcctcatcaacatatagtcgtccccgcgttgtaaacttagccttcgggtgagtaatgcttaacgcattcgtaaattcagtataaaagacatcgggggccgcagcgcgcatcacgacccggcgaaaaacggagccggtcacggcttccatcggtgctaaactaaaaaacggtcgctgggcggcctgagctttggccgcgatccgttgccaatatggcgactgcgtcatagttattcattcccttctagataataatcacttatccataatagcggtgttccacgttgaagcgcaagtattttggcggccgcactaacataattcgccaatcacaagccaaaataaaagtccggcgttaaccggactcgcaataatagctaagttgataagtttaattgtcgctttaacgaattaaaaccagtgcccacagcaatagtccaataacgagtaccaagtttaacaattccatccgcaaatcagcgaacttcagtgagctgaatgagataccggcagttgtatccatatatcggaagaaaatcccacttaaaactaaaccaactaacaatacaaatagaaccatcattcccgtcatcatcacaaactcaactccttatttagtaaaattcttgggctctttgaaaccatgtttatagtagtccagcagctactttcaagcaagtatttccggccgaaaaactggcgttcttagcatattattattaactaaacgataccaatcattcccagcaaaaaagttctttcaggaacaactaaaactccgaaagaacttttttaaatcgccattaattccgccgtcaacttagtcgctcagactaaagtaaccgattgaactagtcttgcacttcgaaataatcattgagaaatcgaattgtgcccacacacttgttaattaatcagttgttttatggcgccgttgttgcttgctaaaaccaaataagctagttgcggccaataatacgaagcccaatacggtcaaaactcgattggtttgttcaccagtctgtggtaacgtggccgttttagttgcggtcgttggcaccgtctgctgagtcactggcttagccattgccggactcgtcgtcgtccgcaataccgttgtggcttgtcgtggctgcgtcgtaacaacccgctgcgctgttgggacggaagctgaacttgactgattaagagtgggcttggccggggtcgcttgtggtgccgccgactgattagtgctggttgacgtgccagttgaatgactaacgactggtcgttcgcccacaggtttttcagtcattggcttttcggccgctgctgttaaggttgccaaggtccgggcgcgcacggtcgttaatccagcttgagcttgggacaattcccgctgtgcagtaacgacctgatcttgagtacccgcaacgcgctgcaacttagctgtcaccgctgctttcgcctgattaactgctgcttggggctgaacaatatcataatctctttgtgccatttggaagtcgcggctcgtgccactgacttcaattttggcgttggctaattcttcttcggccatcatcacgtgctcattagtcttatcaaggttagcttgtgccgctgttaacgtctcttgcaccgttttcagctttgcctgagtagtttgtaacgtgactttgttggccgcactgttatccttatcgaagttgctctgggctacttgaacagcagcttgtgacttagtcactgccgcttgcgccgtcgttaccgcagtttggcttgtctttttagttgccaattgttcatcaagtgctttcgttgccttgacgtgccggtcagtggctgcttgcttaagtacgcccatatgcgtctgaatcttttgattcttggctaacgttttgttggcagcgtctaacgtggtttgcgccgcttgcagatcactcatagccgttttgactgccgtagtagccatggttaatgcttgcaccgcttgcgttacctggtagtgggccgccttaacagctgggttattttcgacctgacttgctaaactgaccgtgccattcatccttactgcctgaccggttcgagtgttagattcggctgcatgtaccgtcattttctgggccatgatgccccctgttaacatggtgattcccatcactatcttaagcgcttttgacatactaaactaatccccttttaaaaagtattgcccagccatgaccagcatgatgatcaatatgaaactgctggaactatttcattttgccggattcaatttcaaaagcaaggaaagctagtgattcagcgtatttgtaatcaccaaccactcaacaactttcatccacatcaccaaaataattatatctagatgtcattactgcctccctcaacacgagtccccatccacaattaaacggtaacgaataatcatcaccgctaacaaatgttaacccgcaccatgattttattagtgacccattctcaataaaaaaaataactaatatttcgattaccatagcggcctcacaatattgatactaatttataccgttacttaattaggcgggcctcgccatcggtgttagaatagaatttaacctaaagaaaagtgtgactgctatgaccattaatgacctccaagcattcgtgatggtgtacgatttacgccacatttctaacgctgccgtagaactccacttatcacaatcggaattgtccaaacgaatgcgagcccttgagaacgaactgaacattaaactactagatacacacaacaagcgccgtctacaaatcacgccagctggtgaaacgttctatcatcatgcgcataaaatgattacagactatgagaccatgatgcacgatttggcaccgaatcggccaacgacatttgccaagctcatcattggcgccattccaatctcaggtcaatataacattgccaaaaagatcgccacttttgatactcagcatcctgatactgaaatcaaaatcatcgaggatgagggcgaccaaatcgtcaaacggttactgagtggtgagctgcaagcggccatcattcgcgatactcagacgacccaattgcaacccaccgaatttcaaaaacaaccactactcgctgacgaactcaaaattattttaccgcgtgatcaccccctagctgcccagccagtcattcggattcaagacttagcgcggcagaaaattgcaacgttaccaccgggctccggtgtttacgaaccgatcatcgcactctttgctcagcaaggcatgacgccccaattcttctttgaaagtacgcatattgaaacgctcctgggcattctcaatcaaaataacgtgactttcttatttaaacaatcggtacttccgttcatgactgaacacgtggtcatgcgctcactcgccatcccgttcatcagtcaactgaactttgtatatccccagcgaacggggaaccagttactcaccgacttaattgactacttgacggtgactgcccaggaaaatcaacaagtttaaaaaataccctttccatccgaccaaccggccgtttgaaaagggtattttttaaacttatccgcttatgccaacccaacgaggtggaaccagaacatctcaactaacgcaacgacaaagacaaccgccgtcagtgggattcctaaccgcatcacgtctttttgtgtgtaacccccaccagtatcggggtcgcttccaactaagacagcgaggttgtggaacggtaaaatataatgcaagtttgtcaccgagaagactagtaacgatacggccaagggtgaaattcccatatgagccgtggccgctacgaaggccggaatcgtaatccccatcaccgcaatgacagaacccatgaacatatggataatcatggcaaaaacagtaatcacaatcgctaataaataaatattagttggcaagttgcttggaatcaaggtcttcgcaatccaattattcatgccagtcacaccaccgacattcccgattgcgattgccgaagtcaagaacacgagcacgttcacgggaacaccttcccatgatttggccgtcaagatcccgccaactaccgggagactcatcatcagcgcaacgatcaacgtcaaccaaccaacgtccaaaccggtgatcccactcgttaaccagagtgcaatcgcaatgatcagccaaataattgttcgaacttccttccccgtcataccacccaactgggcttgttgttgctttaacgcttccacatcgatgtggacttcctgactaggcttgaagaggaataagaacagaaacatggttaagatggccgcaatgatcatgggcacgcccatgtagataaagtaagagacaaagttgacgctttgaccagaggcctgtactgccaacggatttagtgacgtgtcaccagtataaaagaccccggatagtggacaggacgcagcaaagacagcgaggcctagcttagccaaatcgcgtttgggcatcttcgccgtttccgcgaccaccgtaatgacggacataatcatgaacgcccgaggccatggatggggaatcaggagtgcgaggataaaggttagggcaaaaatcgaaatcacaatccctttccaactccgcacaaacttgataatgaatgcgtacgcgatgcgttgacccaaaccagattcattaaccgctcccgcaatcaagtacgccccaattacgagccacataattgaaccagtccacgccgaagagaagacctgtgacggtgtcgccacgttcataataatgagcaacattaagtaaatcccaccaacgaacgcgggttgcgcgatttgggtggcccaccagacgaccgtcatcaaactaagtgccaagtccatctgccccttagctgacaagccggcaatcggtaagaagtaaataatggcaaatacggcgattccactgaaaaagccaatcgttttcttgttcacgagctacatgctcccttcaattttgacagcaaaaagccccccgaccagcacacttccgttggtctggcggctctttgtaagattaaattttggttcaatgcgataaaaatacgctcatcaagtgcaatggatgacgttacttcaaatacttctcccagtcagccactttcatgaattgggcccgttcaaattggtccttcatatcgaatggtacggtgccatcaatcactagtttagaactcatcccacggaaacgaatcgactttggatcatattgtgggcgttccgatgggtccaacggatgattccgcatgcctgataagaccatcaagtcctgatcggcttggaaacgggtattcatcgtccaaatcacatcattcatatcaaaaatatcaacatcttcatcaaccaggataacagtcttcaattccttaaaggctgagaacgcaagcaaggcagcttgccgttgaattccttcatccgcttcattatccttgtgaatctgcatgatggtcatcaacttaccaccaccagccggcggattataaacattcgtcactttaccaggaatggcacggttaaccaattgtaagatactagcttcagttggaattcccgccatgctgacatgttcttcggatggtccaatcacgctttgcatgatggcattcttccgatgagtcaccgccgtcaccttaatcacttgtaaagctgggttggcgtcaccatcataacccgggaattcaggcatcgccttgcccgtatgcgtattgatatcttcctgaatacgttcgttaggcataatgtacccctcaagcgtatattcagaacgcgcaatcgccttttcatcgacggtcaccccgtcaactaattgaacagcttggttccgaatcgcaccagcaacacctaattcgttataaccgaatggcgtggtcggtggttcgaaagttgcaccaatcgtaatggctggatccaaaccaatattaattgtaattggcattggcttgttagctttctcatactcttccgcaaacgcaccaatgtgccgaccgccaggcatgatataaatccctaacttatccttatcttcaaggaccattcggtgaatcgtcacatcactcttagacttgtccatgcttgagccaaacaccacaccgaccgtaatatatggtccagcatcttggggcgtattcgttggtgctgccactaacttacgaatatcaaagccttcatccgtcgctttataaacgacatcgtgagctggcgcatccgcttcagcaaccgtttccggcgccactggattagagactgcttcgttcaagtattgtcctaacgtctgataatcgtgatggaacatcttaccaacgcgccggcgactcgccatcaatccagtcaagacccgcgtatcaggaaaccccttaacgttgttaaacatcattgctggaccctcttgcgttggccgttgaacggtcccaccagcaccgatataccgataaacaccagaaagttccgcatttggatcaacttcgacgtcagtttcatgatagttctttggatcatccttgatctcatcaagcacgcgacgcaaatcccatggttgttctgccatttcattcatctcccttaaagtttacaagaccatcatacggccactcgtaagcgggttcaattcggattgcgcagatatgttattcgtgaatggaataatacaactaaacgcattaggtcgatgattgttatgtattaattatgattgaaacgtgctgatttccaaagtcaaaagcagccagcttaggcccgctggaaaaagttcgagttagcgtaaaattgcttagttggcgcgtcttacgccgacttccaggcatttctgccaattgctggaacgcggtggacacagatttaagccgcaacccacgtcttaaatactggtcttccacgctttaatgccatattggtgaaacgtgctcgggtcagactgagacttccggttagctacgctatgacgtcaagcggaaattcaccgcttaacgccctagctaggctaatcctcagtctcaccccgtctgaacctcacactcttggcagtgctgagcattggccgaaatgccttccagtcgggacagtgttcgaatggcggacatgtgcgtacccaacttttggtgaattcgtcattgtttttcataaacaataactttgtcaatcaactgtcagggtgaaaatgatattgagatagctcactaatcctgaattggtgtagtgagatttaagctcttgacagagggcttaatacacctaacgctttgtttaatcaaaatagccaacgacaaattgtaccgagttcggtggtcgttcattagccattcgagcgacttcccgaccggaggggctgggtggacaatgctcagtagccaaattattcttagtcggaagtggggtacttccggcttagaataagactcgtatttgagatgacgcgggttgggcgttagctcaaatcgacgtcggctacgttccagcaattgtcacccagccccggaggtcggaataggacgcgcaccggctgacgaataacaatctaaacttggcacgtttcaatcataattcatgactaacgaaccggcacagcatttagccgagtcgtatttttaatgcgtgacatgtcgtttattgtgcaaactggggcattactaaataaatacgccgtgtaaatattgataaacagtttaatcatgtttatactttaaaatatgttaataatttttagactttcttaagctattaacgatgattagtcatcaatagccttattcatcgattagcacttattattcatattcaagtgacacgtcttattcagaattttaactcgattgatagtagcggctatttactgtgaagactccaataaatagtcttttattgtcgactaatcaatctatttttggaggagcatcggggaatgtataaacagcaccaattttttaaagccgctgacgatcgtcgcggccaagcatcgttttgtcctaattgtgggcaagcagtggccgcaacggatgaattttgtcctaactgcggttttaagttgcacgcaaccactgatcagccatcgccatcagtaaacaccgcgcagtcaacagcaagttcgacgcgcaaggttcgacaacaagcccaacgccatatgccaacttggggttggggtctaattgccgttatcgttgtcattctgattggtggctatctgtatggacagaattattatcagccgctcaatcagctcgaccgtgacttaaccgcactcaagactggaagaggtttagcgaagcaagtaactagcactgacccatcactcaagattacaaatgatagcgtcaagccgatggtcacttactttaaaaacaatcgaaaatcattagcatcactggctagttcgcttaaaagtcgttctgcgactaatgattacggtattcagttcgttaaaaccggtaaagcctggttgtttttcgataagtatcaactacaagtcacttccgtttatgccacactggcgacgaaccaccgtaacgttgcactcagcgttaatggtaagcacgtcgcaacatctaataaagcaacttacgagcataaaatcgggccgtatgttcctggttcatacaccttgactgccaagggaacggttagcggccatcagattaccaatgagggcacctattacctccgggcaaacggccaaacttacgacttagatttacgtacaatttccttcaccgttaatggtacaccgaataccaccgtttatatcaatggcgaaaatgaaggaacgattaacagcagtggcacactggcgctgaatgatattccctggtctaatcgcatgatgttgactggtaaatacaaagccggttcacaaacattgaccgccaaacaaactaacgttagtgacgctgagggtcaagacgtggacctcaaatttgccggtgtgatgagtaaagatactgcctcggactacctgaacggtatcttcaccgctgtcagcagttatacgtccaccggtgacctatcggatgcttcggattacgatgaccgcactttggacgactacttcgtcaacggtaccgataacacggactacaaagaactggtccaaatggcgaagggctactacgacaatgatgacgtcctcgatgtcacctatgagccgactgtcttatcaacggttccagcagctaaacaacaaagtcagatcacttatgacgtcaaatatgactttaccaactctgaagatgaacgcattcaggtctttcgttacaccgcgacggtcgagaaaaccggggggcactacaagattgttaaaatcacaccggcccaaaaaattcggtcgtacactaaatccgatgattctgataattaatgaaggagaatttaacttatgaaaaaatgtcccaactgcggcactgagattgctgccaatgcaaagttctgtacccactgtggttacgatctaaccaaagcgacaccggcctcggcaacggccaacgccacttcagccacagctacccaaacaacgactgcaacgacgcaagcagctgtccataccagcacagcttcagccaatcaacaacaatcggccagcgctgaaaaacaaacagcatcacgttcagcagctgctgatacgacacgaacggctactaaccaacaagtccaacagctgcaatcatctgctaagaattattttagttggctcttggctagctggaaaaatcctagctgtgaagtccgaactgaaagttattttagttacatttcctttgtcattgaagcactatttatgacgttggccgctgtaaccattagcaataagtttctgaccactgccaatgacagtcaaagctatttccacattagtaaattagctttttccaccgacttaaagattttcttatgtctcctaatcggcatgtgcttctacctggctgtcggctatgtcacttgcttacttggcagtcgtgggaccaaagtcggctttacgacctatatgaaacgcttcggtcagttaaccaattacgcgattattgtgaacctattattatggtttgcttcgtccctagttaacttcagtgttgataacttctttaccattgcggctagcttcagatggtcgattatcctgttgagtgttagtgtccttgtctggcaattaggtttgatcttcgtcattaacaagtcggtgacccaaccattaattagccgcgtctacctagaccttattgcggttctagtcgttagcctgctgttctactttatggataaaattattctgcaggatttacagactgcacttctcagtcacgcaactgactttgccaatcaaattggtaacttgttcggtagtcaatactagttgttcgaaggtatcacaaataaagcctcgtaaattaacgcttatgataatgcgttaatttacgaggctttttatattcattagattgagcaaattaatttgtaaccgataacagggtgctactcgaatagtgtccgcttgagctgacggctaacaccgtaacccaccagaataatcgttattaaccatccggccgtcactagtgctttcccgattgcgatgattcggcgcatcgtcccacctccaaaatgagtcgctggttcagccattacgcactcaaccgatgactgaccgatagtaactcactaaccaataagttttcagttggcgtcaagcgcaactgtttagtaaaaatattataagtcacgtcattcgttaaccgcttaattagcgcatgatcaagctggggcgcctgtttcaattgttggtgtgccttcaatagtgctgcccgaatttcttgattcgccgcagttggtgctaattcttgatataaatcttgaatgattccctgtacttcacttttcacgttgcacaccttactttcagaaaactaactactcttagtataggcgtcttccggtaaaagattaaggttattttcattgaacattaaactaatttgtcagcaccgcctttaaactcaccaacgttaactaacctaacattatattaactggcgtaagtcatcatttaaacgcggccagtgctaattggatcgcggtagcgcgcacatcgccgctaaagcgatggtcaccgtcctgaacccaatgcaactgactgtgctgatagacctcatgatacttttcagaagcctgtggcgagaccaccgtgtcggccgtaccgtgaatcaatgtcaccgaaccggaatactgctgagctacctcataaatcggcaactgttgcgcggtccgcaaataaaagccaccaactttaaggccatcacgaatattcaaataggccggaatatgttgtggatcataggtcgcaccttgcagaacaccttgttgcgcatcggactttaacgttgcggccggcgccatcaagatcagtttgtcgaccacgtctggataatatcctgctaacatgctggctaccaccccgccttgcgaatgccctgccaagacaatgtggtcataatgtaaggtcaacgcttcatctaaaactgctttagcgtccgcaatctcattaatcactgtcatatcttgaaaccgaccttcactacggccatgaccattgaagtcaaaacgcagaactgccaagccgtgagcaactaatgcctgcgccaattgcggcacaaattgggtcgtatcatatcccatatcggccgtaaacccatgcattaagatgactagcgttgagctcggtgccgccggagtctccaaccttgcctgtaacgccaacccatcccgtttaatcttaaattccatcgatgtcatctcacttattcattattcacacctttaatatagtggatttacgtcccatttcatagtcctgagcactcaccctatcctgaacaaacagctaacactatacaaaaaacctgtttccatggccttcacatcagtcatagaaacaggctcttaatatcggctggacatcaaacgatttccaactgtagctgctgcgattcgacccactttgccgcaactagaatgcggtacagcacgattgaaataactgctggcatcagcaccccagtcaagagatagaccataaaactgttaaagttcgtcgatgctaacgaaatcggtgcaattaacgaattcaatcctaagccggccagcttgtaactggttgaaaaatgaaaggcaatcgtcgctagcggggcggcaataaccgcagcaaccattggtggaatcgctaaccgtggattcaccagcaagtttggaaattggactttaggcgtgataatcccctgcgcgatattggcccccaagttgttttggcgaaaagacataatcgtaaagcccacgaactgggcggttgttccaattaaggccgcgcccgatgagacgggatctaacatgaccgccaccgccaatgcggccgaagacgcaggtgtcattaaaaataacgcccaggcaagtgaaacggccatcgaaccgatcaatgggttgaccttcatcgaagtcgcgatgaacttgctcagccagaccaatgcgggcgtcgttacggctgctaacccgagaccaaccaccgcaccgacaaaagtggccgctaacgggaccaacatcatatcaagcggcgtcttaccagttaaataattaccgatcagaaccgcgactaacccagccgcaacggccgaaatcggttgaccggtggtaaagatcgagctctgagctgcttgggccaacgtatgccccgtcgctgtgacgccgttagttgcggactgcgagaaaaagacggcgttcgccccgatcgtcgacgaaatcatggcgctaaacgtaactaacgtgttgctgttgagcatcgtggcaatcgcgactccaaatgccggtcccaataacacttgcgcaatcgcaccgacttggtataatgccgcccagtgaacaaaattcgcgagtgactgcaataacaatccaatccctaaacaaactaaaatagcattagaaacacctgccgaaactttataaacgtaatccatggtactcatcttatgtgtcgcggtagccgcggtcgtagttgcttccatatgtaggcctccatttaaattaataagaatatgattagacaaaaatgagaatagctacatttaaccacgtgttttgaaaattgtcaacgtattttcatcacattatcgttgccaactaaacgaaaagaccagccaggcacgatgccctcgctggtcgctttcactcatcgtattcaaatcattggcacaagccatcaatccaggaaaataaatcgcctaaatcatagtcaccactgtggggaatatcccacggtagcgcaaaatcaatgccataaccatgattttctaacattattgctagaataatcgggattgcaaaactcgtatctcggtcggccgcaccgtggcgaatccgccagtgcttagcaacttgtgacgaagttgtcgttaagtaactgagcggattaatcgcctgaatcagctcagcgtccgctagttgtgcagtcaccgtacttcgcgtctgtgccaaggccgtaaagtgcttggctttcgccgttgcatcgccaaacaaattattctctggactcgtcaaatctaattggtcaaacgccgggacggctttcatgcgagttaacgacttcaaataagctgataaatccaagtccgtcacctgatttccagtaacgacaaagcctgcgtacttatgaatatccgtcccttgatcgaatgccgtctgagcagatgatatcaataattggcgaacaacatcacgaaatgaacccattcccgcctcattaagcgtcaagtgcgtcccgtcactggccgtgagtttcaactggttcaagtaagtactgaactgggcttttaacgccaacgaaagggcctgttcttcaactgtgagctgaccactaaccggttcaaattttggtcgcccattcttggtcgtccccgcaacaggctgataacggtgccagtcattaataccattaaactgccactcgtaggccatgtctgcgtgttccagattatgaatcgggcagtaagctgacaccgcaaagatatcgtcagtcgccggtgctgccccgagcgcagttaaggctggttcaaaataagccgaattgccactcgcacccgctaaagccgaagtggcacccccagcactcgttccattcatgatgatccggttcgcgtcacctggcagccggccctgattatacttaacgtaacggattgccgccttcatatctacgataaaagccggcgcttgcccgacccgttgcccagacttatcaaccgtcgtacgaccgcgaattccagcggccaccacaacgtaaccgcgtttaagtgcctgttgaatcgtccctgcattcgtcggccaagtgacacgttgcggatcatccgccggtcctggcaaataaccgccgaccgtattcggcatcagaattggcgccgttgcccgctgataaccattgactgaactgccatgcaagtatgcggctggtacaaagacgtttaggacctgaatcgctgcgactggatgctgaacgtactgaatattacgggcagcataatattgaatagcctgcccggcaacttggacctgttccggcaccagccagtcagcatcaaaaatcaatcggttactcatcttgtgacctccatttctatctattcgttactttacccccattatccagttaaaatcaaatcgaattgcgcaaccagttatgccaattgcgactaataacgattaacgtagtcagcagccgcttgtgaacccgtcataaactaatgttgccgtgcgttaaccagtgagcccttctaacgaccatggtcgccattgctaactaatctaactatttcaagttagctattaaatgaccgctaactaaaaacggctttctgaattaacagaaggccgttttaaaaaataacattatatgtgcatcattttagggctatcagttagccttaaaaccaatgacggataagtgcaccgccacctagcgttaatacacctaacaaaatgccgactgaacgaagcgcttgactgtccatcttagcttcgttagtttgtggcaatttagcaacttggttaggcgttgatggggtcaacgcgtcactttcagataccgttgtcttagcactagactttttagtatccgctgctggcgtttgatcagcaccatcttggcccgtcgttgtgttagcgggcgtactcgtaaagacactcgaagttgaatctttcaatggttttgacgaattagtactgttggaagtcgtactcccatcgtagttactatcgaacccaccatcaacatcgatggtcccagtatcttcatcgatatctggataaaccgccgtattatcttcaggatcttcaatgtcaccagtctgatggccattgtctggttccgtagtcgtattgtcagaactctcagaactagtatttacatcactcgagctttcagaaccggagtggtcataactagagtccacagcgcttgaactttccgaactagagtggtcggaactggagtccacaacgctcgaactttccgaactagaatggtcggaactggagtccacagcgcttgaactttctgagctagaatggtcggaactggagtccacagcgcttgaactttcagaactagaatcgtcggaactggagtccacagcgctcgaactttccgaactagaatggtcggaactggagtccacagcgcttgaactttcagaactagaatcgtcggaactggagtccacagcgcttgaactttcagaattagaatcgtcggaactggaatcgacgtcactcgaattatttgagctagagctgttcgaactcgagctggaacttaagtcgccagtaccgctcccaccgttaacgactttttcgtagaccttaccgttagcttcttcgctgttcttgccaccggacgtgccgccgccccattccattacagctttatttttaaaatgataattttgatcaattaattctgtatccgtaattttagtatagtaatcgatgacaactaggttgctgactgtatcgttgaatttcaagtcaaaaccattatcgctgtagttaacttgataagcatcgtcactaagcttatcacgccgcttgtaagtgttggcactcgaccattcaccattgtagacttcaatacctttgatcatttgctgatgatcaccaatggtatcggcaatcgataagttttttatggtaatttcacgccgatcaacaagtaaggtccacttaatcgtgccattttctttatcaatggtgccttttttagacatattagcttcattagcaaccatattgatcactgatgtatcttgaccgtcttgggtatcaaacacaacgtcttgttcccctaagtcatcataacggtacttcattcccaggttaacatcaatctttacattagttttaccttcaatcgccgaattcatggtcagtacgacctgaccatccccgccgacgacacccgtaccagtcacagcatcagtcacatcaaaagtagccccaacggtccgtggttccaaattagctggcatatcaatagtgactgtgtccccagctttgaaagccgtatccccaaaactcatttgatactgaatttgaatggtatcagcgtgcttaaaatcaggaccattgatgaccgatgcggcagttgtgtaatccttcgcatgataattagttgcggcttgggcccctagtggctgactaaatagtagtaaaattgcaaaacttactaacgggactgctccgagtcaagtagacagttcaaataattaaaatagctatgcagtttttagaatggcatgattccgaaattctttcggggtcatgccatt

SEQ ID NO: 11 - DNA, 115239 bp, synthetic construct
  source 1..115239: mol_type = other DNA; note = Lactobacillus plantarum PDG8 - Contig 11
aggatacacctgttcccatgtcgaacacagaagttaagcttcttagcgccgagagtagttgggggatcgctccctgcgagggtaggacgttgccatgcaacctaaggaatcgttaattcgattcctttttttgttgccaaaaattagcctactgggcgaactaagactaaattttgaaattcaaacggcgggtcggattattaggaatcccggtactcatcagcgcatttggaattcaacccatactattaatcaccggcacgatctacttattggttgcaatcacactcattgtactgaataagtttccgttgagttgaatcgttagcgattgcgctcaatgctcatatttggggtagctggcagtgatgggggagttgtcaaaacgagagacagtagcactcggattttgagagtcaggcgtaaatggcgtacgtttggttggttagaaaaatcgaatgctagttatcaatcgataaggtgattcagctcagtctaaggtactaggtattggtttacgaacttggccattactaaccgcaaatactggctgctgggcctaatgtcatttaatttggacagtatccgtcataaccatgtaaaaatcatgtaaattcgggagcaataattgttattctagcagttacgtgctatgttattatcatattttatgaagtggagtgatagttatggctcagatttctgtgggggatcgggttaaatgtcaaaagaacggcaataccgattatgatttttatgctaaagttgaaaaaatttacgagaactccgccttcgtcacaattactcattatgatttgcgggatgatattaatgtggcagaacttcaatatcgggcagtgatcgccttaaagaagatgaaacccgctaaaccgactgctggtgaagcgaagcagctacaggcagttagtgcggccatgttagctgaataaattaagaatatcgatgcaacatgtaggtaatgggttgttcaagaatttgattcttgaacaacccatttttagtttggctgcaaagcttttcggtgtgatggagtgccctggttgggactgattttatgatgattagaggccaactgacttaatgaatctgtccgttagagctttaacagattggatatttaacaatcattcacgcgggtgttgttacaagctaattgtgcacgtctctttattcggtgtagcaaacttttttgttgccaatctgacttttagcctgtacatcattggtttcaatggtacaatggatattagtagttgataactgttctaaagtaaggaggagttttgaatgcagacagctaatcaaaatgtaacgttgacggggcgtcgacgcttctggttcatttttacgctgttgcttgggacttggaccatgtcgatcagtcagtcttccttgtcgacggtctacccaacatttatgcgcgactttggcatctcggcctcaaccgtgcaatggttaacgaccggctttatgttgacaatggtcgtcatgatgccaatcagtccgtggttgttgaataacattgggtttaagaaattattcttagccgttttggtgcttttcgatattggttcaatcattatttatttcgcacccagttttggtgtgatgatggtcggtcgcctaattaaagcggcggcagttggcgtgctgtttccctcgtatcaatccattttactgacgattacgcccgaggaaaaacggggcagtacgatgggtgtcgccgggttggtcatgggatcagcattagcatctggcccgattatttccggtgtggttttgaagtttaccgattggcacggattgtttgccgtcttcatcacggtggcaactttgttgatcctaattagtttcacaacgatcaaggacgtgatggtcaataagccttcaaagctggatttgctctcaatcgtgacgttactgggctttgctgggattttatacgtcgtgaatgagattggtaaacccaatgtgaactggacgttcggttggctgttattagcggtttcagtactagcggtggcttactttacttatcgccaatttcacttggagacgccgttattggaactacgggtcttaaaaacatttaattatgacttagccattttcctaacagcaatctcgtacgtggcgctgattgtcgtaacaatcatcttcccactctattaccagggtgtcttgaaggtgtcgccattcgtttcaggcatgtcactggtgcctggtgcggtgcttctaagtattttgaacccgcttactgggaaactagcagagaagattggatacaaacaaatcatgttacttggtatgagtatgatcgttgttggttggctgatcttagcactgatcaattcagagttgaacctgctcaccatgattttgctggctgccttaattgaaggcgggaatgcctttgtcatgatgcccgccgtcacattgggggctaattcattacccgatgaactgatttcacacggtaccgctgtgattacgacggttcgtcaaattctcggttcagctggtgtggccgtggcgaccttggtcttatccaacgtgacgcttgctcagaaacaagcgggagcctcaacgttgcgtgcgaacttgcaagggtaccatacggtcttctggatgatgctcggcattgaattggttggcctcgtgcttgcgttacttttgcgtgatgggcgcaagcagtcgcattaataatcacggtgactgactaccaggcgagaatgactgaagttaagtgggatatgctttgaacgccactaattagacattagtgcctgcacaatcggtcggttagtcgtaattaggccaaaagggccgccattcttgtaatcaagaatggcggcccttttttcgtagtgcgactgtgatcgtactgaatcacaggacttggcccaactaaccggggcgcttctacttggctgttgctttttgaatctttgccaattgacgatattgactgagcatccagctttgatacgtctgattggccggtaacgtttcggtgaccttcagtactggcacatcgtatttcctggcgagtttgaccatgttcgtgaccaagttactatcggtctgagtgttttcaacgaaaaaggcaatccggtggtgcttgatgtcttgttgcatttgctggatatccttaggtgatgggtcggaaccctcttcaattgcatgtgcgaaatgcgtattgctgattcggtagccgattgccttcaatgagtagtcaaagaccggctcactgacagcgacacgctgattatttgcatgctgtttcaattgtttgatcatagtggttatagtcttagcgttggtctgatacttttgggcctgctgttcaaaataatgcttgtgctgcggctgaattttgctgagttctgttgcgattttagttgccaatttgggcatcgttgtgggatcgtaccagacgtgttcgttggccccgtcagttttatgagccacgtcggttcccactgtgattacccgggcgcccttggctttgttgacagtaagcttttccatccagtcatcgtagccgaggccgttgtaaatgattaattgggcgctactagcctgcttagccgtgttgacggtcggctcgtagtcgtgggggtcaacgctcggtcgatcaataatcgaggtcacttgaccatactttcctgccaccgccttagccgtttgaccataaaagtcgagactagccatgatattaattttgtcgttagtcgttttactgggggtgctcgaactttgacagcctgctaataggccgctgagtcccagtattattgccaaataaagccatatccgtcggttgaccatgtattgtaaccccattctctttaaatcgtaaccattactgttaactttaccgaaagaaacggtcgtcgtcaagtctttaagataaggtttagactaggtgaaaacactgcactgactgacgaaagctggtaaaataggcgtacctgaaaagcggaaggcggggcacgcagatgatatttacgattgtgattttaattttactagcaagcgcaatttttcgcgggtttcaccgcggatttgtgattgaaatgttgcatctgattgggacggtcgtcgtcctattgtttgcacgactactctatcagccgttagggacaatgattagtaatctattgacgaatttacatttaattgaagcttcagtggcggcaacgttgatcattaacctggtcgctttcttcgtgttaatttcgttagggtggtccgtgattcggttgttaggccgtgtttcacgtagcattacgtggctaccagttattaagcaagtgaacagtgttgcgggtggaatcgtgtcatttgtcgtgatgtatctggttatttttgtcgcgttgtcgttggcgaacatcgtcaatacgagctttattcagacgcaaatgacgcagtcaccgctcgccacctatattgtgaagcagacacctggtctaactagccattacctcagtaatttgattaattttaatgatgggacgaatacggattcctagagttcatggtgggggtacgactgctttaaactaagacaaaggcgttactggttttttgaccagcaacgtcttttttgatgaaccggtttgttagcaacgcacttttttcggttcccgaacgattgctagtttttatggggttatttggctgattactatcatattgagcgtccttcatgctatgattataagtaaaaatgagcaagaaagaggctgggatacttatgggcatgattcgaattaataatttacgctttcacacgtttaacggggtacttccagaagaacggcgtaatggtcaacaactagggctagatattgccattaaatatcctatcgaaaccaaggttcaacacgatgacgttcacgagaccatcaattacgcggcggtccgtaacgtggtcgatgaatttgtaacgacccattcatacaagttgattgaatcgctagctaaccacttattgcagacgttattgacaagttttcccgcggcggatgcaatcaatattaaaattcgtaaatatagcgtaccaatgcctggaatctttgatgatgtggaaattgaggtggaggggacgccgaatggcaagtagggaagaacgggtttatttgagtgttggttccaatattcatccgcgcgtccaaaatattcagcaagcccttagccgattacgagccgtcaatggggtaaacgtgattgacgaatctcattggtatgagactcaaccgtggggaaagcgtgatcaggccaatttttacaatgtttcggtatccttaacgactaatttgacaccagaagaactattggatgaattacatacaattgagcaggcgggccaccgccaacgcttggttcactggggaccacgtacgattgatttggatattattttttggggcgaccggcaaatcaacacagcgacgctgacgattccgcatgcgcaggcagctaagcgcaactttgtgctactgccaactgctgaaatcgccaaaactgatgtgttagttggaccacaagtggcccaattgattgcggctaatcaggatcagagttggattaaaaaagtaagaaatgtgagtgagttagatgattgatgagaagaaccaagcaaagattgagcatgcagtacgagaaattttaagtgcagttggtgaagatcctgaccgaccgggattagtagaaacaccagcacgggttgcacgaatgtatgcggaagttttcgctactaagaccgccgcaccatttgataattataaactgttcaaggttgagcatccgactgaaatggtattacttaaggatattccattctattcgatgtgtgagcatcaccttttgccattttttggcacggctcaagttgcttatgtgccgcagcatgaacaagtgattggcttgagtaagattcctcgcttgattgactattgcagtcaacagccgaacgttcaggagcgcttgacagtttccattgcaacagaattacaacgaattcttgacccggctgggatcgcggtctcaatcacggcgcggcacatgtgcatggagatgcggggtgttagcaaaccgggtgtgcatacggaaagtagctattacagtggtcaattcaagacggatttagacttgaaaagagaattcttacagcgaatcgcaaagtaggtgattgagtggatacagggacgattgaacaacattatcaggacttattagcccaactaaatcaagccatgttagccaataatcatcagcgtgttccgttattacggcgaatcatggcacatcttggccaccctgaccattattaccatgtgatccatatcgctgggactaatggcaaaggctctacgggagctatgttagccagtatcctgcgggcgcaagggtatcaagttggccgcttcagcagccccgcgattaatgatgcgcgtgaacaactgcaatgcaatgggacgtggatcagtccagcggaatttatcgatacgtatcgtgagattctaccggttctgcaaaatatgggactgacagctagcgatgtctccatctttgaatggttctttctcattagtgtcgtttggtttcggaatcaaaacgtgcaatgggcggtcattgaagccggtttgggcggcttgtatgatgcgactaacgccttagccagtccccaactcacggtatttactaagattgccctcgatcataccgccattcttgggcccacgattaccgcgattgcgcaaaataagtcaaaaatcatcaagccccatacaacagcagtgacattggctgaccaacacccagaagccctggctgttttgcagaccgaagcgctcaatcaaggtgttcggctagtgaccgctaagcacgcgcaactgacggtgactgggcaaacactcacgcaaaccgtcgttgatgcgcacagtcagctttttgattggacgcaattaacggtcggactgagtggcacctatcagctacaaaatctgcggttggttttaactgtggttgcagtactacaacagcaacaagttaacttgacgaacagtgcggttcgccgaggcttgcaacaagtttccttgccaggccggttgaccgtgttacaggagcaacctgtcattattgccgatggggcgcataatccggatggcatggcagcactagtggcaagtgtgaagcaattactcgctggtcgtaaattgatttggatcgtcggggtcttacaagataaggcctaccctaaaatgctggctgaactattaccggtagctgacgtcctgattacgaatacgcccgcaaatccagaacgagcgttatccgcgactaagctggccgacacggcgaccgcattattaacgcccacctttatgaccacggctgcgatgcaacgacagccagacttattgactgcaacgacgatcacggatgcgttaacgcaagctcagcagcaagcaaccagtaatagtgcgattattgtaacggggtcattttatgtcattcgtgagctccaacaggctggttggctggggttaagccaatgaggacttggttgatcgcatccaacaacgctggtaaaagtcgcgacttgatcgcgtgtttggcttattatggcttgacttctcgtcagtacttgacagtggcgccgcggctcgaatttcccgtggaaacggcgacgagctatgtcgataacgcggttgctaaagctcgttttggggcgcaacagctaggggttccggttatcgcagatgatagtggcttagagatttccgcgttaccaaacttgttaggtgtgaccacggcgcgcgacttaggggttgcagtcagcggctttgatcgcaatcaggaaattttaacggccctacgcgatattcctgacaacgagcggcaagcggtgatgcgtgctacgttagcggctgcctggccagatgggcggaccttggccgtacaagcttcgatcaccggctacattgcgtcctatcaatttggacgctattctgggggatttgaccgaattttctggctaccgcgctatggtcgaactttggccgaattaccagcaacgtggcgcatcccgctgacacaccggggacgggccgccttaaaattgatcacaaaactttaaaaattggaaggatcggtggagtagatgttagtacaagatatcaccagttcattagcacaagcaacggattttgcgagtcaggcgttgaatgcccaagttcaacgacaacaacaattagttttgcgttttagtgattataatcgggaacagcagctccgattaacccaactatgtcagcaattagatggggtcgtgctggcgagtcctgaacagttgaccgtcttgttgaaccagacagctggtcgccagttaacccaccaatggtcgcgagtctttacggatcaagcaacgactcaaattcaattgacccaaattatgaaacaatatgatgttttttggcaagcgggtgagcaccggtttaatctcaccaagaagccgatgatttatggcatcatgaatattacgccggattcctttttcgacggtggccagtacaagactaaagatgacgtactgaatcacgtggatgccatgttacaagcaggagctgacgtaatcgaagttaatggtcaaacgacacggccgggcttcacggaagtcacgccgcaagttgaattggaccggacgttgccgtacattcgcgccatcaaggctcgtttcccggaagcagtcttagcggtcgatacttataagtatgatgtcatgcaagccgtcctggaagaaggtgtcagcattattaacgatgtgaacgcctttacggacgaccctcgcaagctcaaattgatggctgacagtcgcgtcggcttactgactatgcacagtagtcgtgaccaagaatataccgatctgacgagcagtatgcgtggtttctttgaacaaaatctggcagcattgacgagtcatggcatcgatattgaacgaattgctctagatcaggggatcggctattcacaagtcgcacatggggaacaggattacgtgatgatgcgtaacattgatgaatttaattatttgcgacgcccaatgatggtggccatttcacggaaaggttacttaggtctattgcttggcctgaagaaggaagaccggctaccaatgacgttggtcactgaagcagcgatgatgcttaagggtggccggatcatccgggtccacgatgttgctgaaaccaagcaattgattacgctgttaggtcgaattgagaatggctattggttatcgaataatgattagtccggatgattttgacgatattacagcgaatggggttaaggactacgatgcttatttcggtactcccacgtacgatgatcacgttttatttgaattgttagtggttggaatcttacaagtgggtttaggctggcgggtcgcggctagtcagttaccagtattgcggcaacatatggcggggctgcgggtagacgccgtagccgccctggacgaaccggattttgaacggctgatgttgactcccaaagtgatgcacaatggtcgtaagttacgtgcaatcattcaagatgcgcgtgctattcaacaattacaggccgagtatggtagctttagcaactacctgtgggcgtttgtcgatgcgacaccaatcattatgccggcgcccgatgatgaattaccgacgcgctcacccctgggcgcccgcgttgcgaaggatttacaccgacatggtttgaccttcgttggaccagtcgtcactcacatgtttttgctggcggcgggattgattaaattgaattaggtagaattaggctggcggatgctggccttttttatttgcttatgcctgcgtatttttgtgagtatcaatgtgtgaatgtaagcaaggtgggggctttaatccggagtggttatgggaagtgtgattattagttccatcgcaatatgaagcgcaagttcacaatgagggtaagcggcaaaaacatatttgaatggtcggtgatgctggcgtgtagaaccagtctaaccgttttctaggtaatagtgaagttagcaaaaacacgtcgcaagagcaagttgtaatggtcttatgacgtgttttagaatgagttgattttgtatccctctgacacgactagcggttagcggtcgtcgtcgtgtctggcaacagccacatcgttaccaagccaatcagccaggccactaagaagaacgccatggcagctggtaattgatagccaagcaaccattggcataacaagataagcgtgataatgataccgataacgcgattgatgatgctcatgtaagtgcctcctaggtggttagctaagaatgaagtgaaccagattatctgaattaataaatattacttaaattatataatgaatgacgttatgtgtgctgcaatgtgcgttaatgtcttaatttaacgtacgaacgtcgaaaaatgctgaatatttgaaaaaacgataccgctgaggttgcggtatcgttgaacctgtgactggtaattagcagtgtattgtgactgactcagatactggttagtgataactacttctagtaccataacgtttcagtaaacggtatagcgtttggtgcatagattttgaatgaataagcgttatccacaaaaatcatgctcactgcatcagactgatggttatactgtgctaaatgcccagcatgagcgggttaattgcatgtctggaaaatacagactagtttttttacttaagaaggttgtatttatctgataagacacctattataaattgcaaatataagtaagacatttaggagtgattggttatgattaatcttgttttctacaaatactacagattctgggctgcaatcgttttactattgctaagcgctaacgtttatccagcaattgttaacggtaatgtcttaggtcgcgaattttggcgaaatggcacaaatctgattaatcttgtttttgtaattgttgctattggctttttaattcaagtgttgttttttaagaaaggtgagccgcgtgcgaatgaacgtgcattttgatcaggtcatggtaaaaaagcatgatttttaatcgcgttatggcaaccaaagtatgagggagtagtcgaaagtctgatatgaaattctctgaaaaactaaaagtgtgtaggaagcacgcacaattgacacaatcgcaagtggccgaacaattacatgtatcgcgcaaaacaatctcaggctgggaaaatgaccacagttttcccgatgttggcagtttagttcaattgagtgatatttatgacgttcggctagacgatttaatgcgggatgatcacttactggcttattataaggaagcagaacgacttcatcagaagagccgaaaatgggtggtcgtctcgtatcgatgcaatttcttgttactggtacttggctacattgactatttgcggccgtttggaatacgaacgtttttggtaccgtttttagtactggtgaacgccatggtattattgtcgtatttttcagattggcagcggttcaagtcaggtaaattgcgtatcggtatcgtcatcacggtgtttattgcatttattgctgagattctgatcaatacaatagtaccgagttatctgaacgagttagcacatgccgttgatgatggccccgctgcgataattggtgaagtggccggtcgcttgctggtcacatcaatactgatattaagtttggtattagctatctttttgaagccaaaacaacgagaacggtcgtagtttaccgagctagtcaatattgatgagtttggaagtgagccgtggcgtctcaaactaacgaaaatgtgtaagacaaaaaacgaccgcatgcttaatagcatgcggtcgtttaaggcggaagagatagtttatacagaaacagattcgatttggatgctgtgtatcataacttaactcacgatgaactaaatcgaactatccgttgtttcataatccaccttgccaagttcaatctgaatcgtgatatgagttagtggaaactgggcgcttaggtccttgttcagttgttccaaaaaggcattattgtcagctaatgttgaacgacagagatggacggtcatggctgtttcagtagtactcatgccccaaatgtgtaaatcgtgaatctggttgacggtgggctggctggttaaataatcagcgattgcttggcggtcaacattgttcggtacagcttctagtgaataattcatcgcatctcgtaagagtccccaagtaccaatcaaaatcacgacggcaattagcagggaaacaacggggtctagccagaaccagccagtcttcaagatgatgaagccagcaatgaccacgccgatggagacgccggcgtcggcggccatgtggagaaaagcgcccttaatattgagatcgtgcttttggcccttcataaagagtaatgcggtaaagccattaatgacgaccccaacagcagcaacgataatgacatcccattcggcgacgggacccggattactaaggcgctggatggcctcgactgaaatggccccgatagcgactagtaaaaagacggcgttgaagagggcggccaagattgatgagcttttgtacccatatgtgtacttatcgttggcgcttttttgtccaagccagattgccagccaggagatcagtaagcccaggacgtcgctgagattgtgtcctgcatcggcaactagggccagtgagccgctcgcaaaaccgtagccagcttccaagacaatgaaggcagtatttagggcgaccccaatcttgaaggcgctggtctgttgttgtatttgatggctgtgtgccatatgaatcacctacttcttagttgaatttatccttgttatggctataatttaaatatgaacgaacaaacatatgaatgactgttcatgtgtattgtaacacgcttacatgacaatctcaattagaaattggagtttatgatggaaaatgaaatggaccatgaaatgatcgtcaaacggttggctgaactgatgccgccgactgatgagttgagtcggatcaccgcaatctttaaggcacttggtgatccgacgcgtgcccggattatctacgctttggccgtatctaagctgagtgtgggtgaattggcgacgggattagccctgacacagtcgaatgtgtctcatcagttaacggtcctcaaacaattaaaattagttgtgggaacacgcaatggacgtaacgtgcactaccagctggccgataaacatatcattagtatttttcagcaagtcgcagctcacgctgaagaagccgataattaggttgaataggtgttaccactgatcagttatgatgagtggtaagcgctgtgggttcgtagtgggcactggtatagatatccatggcctagaagaccgcatgatgaccttgaatataagattgtgcttagcatgacaccgcgaaatggttaatttcgcagtgtcattttttgaactagttatgtttttgttaattacctagttttataaactagatgtattgatatttacactatgtgatggtatgctggtgtcaacaataaatatgaggtgattaacatggcacagtcggcgcgacagtatcaaataacaaatgaagtcctcaactcagtgactcatgggattgggattattttaagtatcgttgcatttgtttttttgatgctcaaggcatatgcggatggtcagcccctcgaatgggcggcgtttattatatatggttgttcgttgtttgtactatatacgtgttcgacgttatttcacggattatactttacgcgcgcccgcgaagtttttcgtatcttcgatcacagtggcgtgtacgtgctgattgctgggacatacacgccgtacagtctactggcgattaagggttggttgggctggacgatcttattaacgatttggattttagcgattgctgggattacggttaatgctgtttggcctggacgtttgaaaaaggtcgaaacggtcatttatgtgttgatggggtggatgtgcctcgccggtggtcggcagttatgggaccatttaggtgtcactggcttctggttattagttgccgggggcgttgcgtttaccttaggtgcattactatatagtttcccacggattaaatatttacacgttatttggcacctattcgtgatggtgggaaccacgttgatgtttttctcaatttatttctatatttaaggatgactgtggggaccagctgctgagctggtcctttttttttagatgcgggagatttgagtcgcggatgacgtcttaaatgctgattattgacattttattgcgaaaagtttttcaactggacggtattcgaatcgtaaccattgcgtacgctcgttaagctgaatgagttatcgccactcagctaacaataattttgaaattaaatggctagatcgctgtagcatagtctagaatacgatttatttttgtcatcaaactgtaatcagccaggcgtatcttttgattgcctttttaaataaacttccgtagaatagtaggacaacgaaatttttagtgaggtgattaagatggcatacgggttattatttggtggcattttcatggaagttttagggagctttttcttaaagcgcgcaaacggttttcggaacttaataccaacgataatggtgttggttggatattttagttcgttagtccttgtaacgcttgcaatgcaacgcctgccgttaggggtgacgtatgccatgtgggctggactgggcacgtttgcaaccgttattttagcggtcgtcgtttaccgtgaacggctcagtctctcacgtctgagtggcttaattgcaatcgtagtcggggcgattttactgaacatttaaatcaagggggaatgatgatgcgtgcatggattcaattagttattgcgattggcgttgaaattgcggggaccagcttgttgaagttatcggctggatttaagtaccccttggttggaattgtgggcatgttactatacggcctagcgatttttagtttctcacgggcattgagcaaaatcccactgagtgttggttatgcaatctgggccggagtcggcacagctgcgaccggcctgattggaatttgggcgtttggcgaaatcttgacgggattgaaaacgttgggattcatggcgattattacgggtgtgattctattgaacatgcctgctaaggcgactaaaccggctactgcgacgccgcgcttggcacggtggcggacccggtttaaccggtaactaaaaagatcgagaatctggctgattttttaagcgattacgcttgaaatgcgccggttgattctcgatcttttttagttgttgtaattaggcttctggccagatttccttagccgtaccaatgactaacgacaacttggcccactgttgagcctcagttaactggttaccttcttcagttgaagcaaagccacattgggtcgatagtgctagattacgcaatggcaccttagtggtcgcagcttgaactcgttctttgatcacagtggttttttccaattctggaaacttagaggtaaccagacctaatacgatgcgtttgtggtcatcatggttccaaatctggtctaacgcttcgaagccacccgcccgttcgttatcatattccaagaacagcccatcatagttaagctggccaaggtagggtgcaaccacgtcgtaactgcccgagaagaggtacgtggatttaaagttaccccggcagatgtgggtcgtgacggtcaagtcgctcggtaggtcagctaatgctgcgttaatcactttaacggcatcggtcgcccacttagtgtaggccgcgtggtcagcttcgggatcattgagtttgctaattaagaaagcccacgtcgtatcgtctaactgaatatagcgacacccaaggtcataaaaatgttgaatggtatcgtgataagcttgagcgagatcatttaaataggcatcccagctgtcatagaatttggtccaattgtcactccgattatcgcggaataacatagttggtgatggaatcgtttgtttagcgagtacgccagcgggaacgattgattgtaagtattcaaaggcagcaaagaacggatggtcgggattatacgcgactttgccaataagttcagcgttatccgttcgagtatggtcccccttgaacttatagctttgatggtagtcgtacttgccaacaccagttaagccccaaaggaaatctaagtgccaccagctgcgtgaaaattcgccatcggtcacggctttgagcccgagtttaacttgttcagcgaccactcgtttgatttcagtgtgttggatttcaagttcttgatcacgcgtaatggtaccggcggctaattgttcatgggcctttttcaaactagcggggcgcagtaggctgccgacgacgtcaaaacggaatggggcggttaaagttgtagttgtcattaaatatcaaactccttaaattttattgggaacgaaaaaacgtcgtcctgaataatattaatcattattcaggacgacgttgggccgtggtaccacctgagttctaggctagtgaactagtctactcgatacagctgccaaatgattggcaattgctaacgcgggtaacggttgttaaaccggctttagttaatgctggttgctttgttgctcaccagacactcaccaaaacgaactagggagaagaccatcttcattggttgtgccggtaccgtttcaccaacccgatactcgctgaacagcgacaccaattactcatcttttaatcgttctttaattattgacacctatcatactggtaattattttaaatgtcaaatttaatttaaggccggaatcggtgggcgggattaatccatagtcatgctataatgcaagtaacatgcgattgggggcaaattatggatagaatcattcggttttttaagcgggatgacgttgacttgtacttaacgttggcgttattaatcatcattatttatttaatgcgcgggtttgcgacagttgttctattaacgacgatttttgcgtatttgggcattaagcttagtcggtggttaaacctccgaacgcacttaccttattggattgccgtcattgtggtctacgtcggcgtgattgcgttgtttatcggtgcgctatcgtacgcggcgcctaccctggtcgatcagttgaaggtcattccagatatgctggctaaagcaatcaccaatcacccggtattgaataagaatattgataaatgggtcaaccaagccattcatagtagtgaattgattcaaaacgggaaggcgttactcgtcaccggtattaaaggactgagtgaggttgggactggttttacgcacgtcttaatggcaatctttttgagttttatctttgcagtttcgcggggacgaatgatggtctttggccgccagttcttgcagtcgaagtttaaaaagttcttcacgaacgtttactatttaacgcataaattcgttatgattctggggcggattattgaaacgcaactggtgatttgtacgatcaatacgattttgatgacgattgggttcatgattattgggatgccaagtatcatggtgttgtcgatcattgtctttatcttaggcttagtgccggtggctggcgtgttgatttcaatgattccgctaaccttactggggtttgcgtcgggtggcttgattcgagttgtctggatcatcgtgttggttattttgattcacgccttcgagtcttatttccttcatccacggctaatggcggatcggactgatttaccagtctttgtcacttttattacgttgattattatggaaagtctattaggggcctggggcttgatcattgggattccaattgtttcattcttcctagacattttgggtgtgcagaattctgagccgcgacgcgtgacgtctcaaatagcgaaacgtgaaccttagtgtgattgtaactgtactttaccggtagcagactttgtatggggtcgggtgatttatatgaacagtagcttgtgactgcgcgtaaaggttatcaaagataattgtaagctggtatcttcgaagtggattactttcgaaggtgccagctttaattaattactgcttaaagatgctgatagtgacaattacaagtcagactgttagtgttaagctatcagcgttctaggtggtataaggttgacttatttcgactaagtgttagagtgagcggttggaatctgtttaggagggggcgattacgattaatcaatcaaataatcaacatcccgtgttagatggctggcaagaaattgaagctgaccaaattaagcgaatgcaaggtgcgttgtggcatttgttgggcaatgcgatagcatatttaagtctatttgtaatcgaactagtgcttgcaacgattggtcattcgcaatctttgcacgcggatgcgtttaataattttgcgggtattgtttcatcggggttgttatcgcttggtatctggggtggcattcataatcatcaatcacatcaaagtaaagtgaccgctttggacggctgggaggccgaacgtcgcaatcgattgatgcgatttcgtttacaagacttattcacgttaatgagtggggtcattatgttagttatggcggtacaagttattgtgagtggtgttagtaatttgtttaaatcacacacctttcaagcagtgagcggtgtaactgtttggggagctgcaatcgcgagcatcgttatgttagtcgtctggtactttaatcgtcgcggtgggcaacaattagataattcgacgctattggctgcggcaaaggatagtcttagtgatgcgttaacgagcattggcactttaatctcattaagtggggtcttactattcaaatttgcttggttagatagtgttgcgagtatcgtgattggattctttatttttgccgctgggttacaaatttttcgggacagtgggttgcagctaattaattacagtgatccacaagttgaaaaaaattatattaatacgattcaacaaattgatggtgtgaatcaggtcaatgcaattgatgtccagtattctgggagcttagtggccttgtcgctggttatagcagtgtcaccacgaatgacagtggcagccagctttcagctcagtgaaagaatcgagcaagtgatgcgaaatcagtatggcattattgacactaaggtaatgtttatgccgcaaacataagtgtgttgactgatagattttaataataaaagactagtttcaaggttgaattccttgaaactagtcttttatttatggttggcgcgaattccgttgcggcgtgcgggcatggtggaccgtcaaattcgttagtgtggcgtctgttgctggtttcgtgaacaaaggaatcgtctcttccaagacatcgctaaacgctaagccgtaccagatagcaggagatggggtgatgttttgtagtagaacgcgaccaccaattagtagtcgatcgaactggcccatagttgggttgctagcaaggtccatgatctgctgattctgaacgacaaatttaaaatcgccaacttgacgaggttgtgtgattccgtaacgggaatattggggatcgatgctgtgatctgcaattaagttcgtgacaatttggcgcaaatataaattaatgtgctgtgatttacggaaacctaagttgagttgaacttccacgatatttcgagtgcctagcatgtcaatgctgtaactacaatcataaggtcggttggtttcattaatggtaataaaccagtaaaccttagcgcgtttaggccgcttatctaaaatcgagtacagaattgaccgtttaacccggtgttgatggtcgaccttagccaagtagactaagttcgttgcaaatactggcaaatgatcatcgtggcttagctggatcagttgattacgataatctagcagactaatctgttcatttgcctggttgtaacgcaaacgccggcgattaccaaagaaccaaacgaccataatcaagaaaatgacgagggtcagccccaaggtcaaatagccaccgtgaataaacttggtcagactagccgttagaaagacggtctccagtgcgccaaagccgaataataaagctagcgccagcgcccggtggcccttcatgtgaatccactggctaagcaggatggtcgtcatcaacattgttaaggtgatggctaaaccatacgccgcttccatgtgagctgaagtttgaaatagccaaacgattcctaaggtgaccagacataacagccagttgatcgcaccaatataaatctggctccgaacgttactggggtgcttgataatcatacgtggtaagaactttaaaccgaatgcttcgtcaactaaggtataagagcccgtgatcaaggcctgtgacgcaatgatggctgcggccgtggctaagataatcattgcaatttgaccgcccgcaggaaccatggcatagaagggattgacattggtggcattgcgccatgccgcatcctgataatgggttaacatccacgcgccctgaccaagataattgagaatcaaagtcgtgtatacgaacggccaagtggcgtcgatgttggctttaccaacgtgacccatatcagaatacagcgcttcagccccggtcgttgcaaggaagacactaccaagaatgaaaattcccattttattagccggattgaataagacttgtacggcgtaaacgggtgagaaagctttgagaatgacgggtgcctgactgatgttgatcagaccgaagatgccgatgacggtgaaccagagcaacatcatgggaccgaatgaccggccaacgacggcagtaccaaacccttgaatcataaagagaaccagtaaaataaccgtaacggttagaggcacgagccacgggtactgggaaaaagcccccagtttgggtaatccctttaagccttcaactgctgatgtgactgtcacagcaggtgttagggtgccatctgctaacaaagcggcgccaccaatcaacgcgacgaaaattaaccatttggcccggtgacgaaccagcgcatacagggcgaaaatgccaccttcatgatgattatcagcgcgtaaagcaatcaggacgtactttaccgttgtaatgagcatcaacgtccaaaagattaatgaaacactgccgataacataatcaggtgttgcattcttaagttgccccgcgtcattgatcagggcgttcataacgtatagcggtgacgttccgatgtccccgtacacgacgccctaatgtgattaacatgccaatcaatgaacgttcctgaatccgttgcttacgcatgaattattgacccccacttcaattagaactgtgactcatactatactagcttttttcaaaaggggttaaccagacaaactaaaaatttgctcatgttaacaagtttcaacttacgtttcgttaggtgaactttacttcaagttgagtacaataagtaatccggttgttcgtatttagaggataaaaaatgggccgtttcattccagttgataacgctgaaatgaagcgacccattagttttgaatttattagtctagtcaattatttctcatcagtggctgtattcgtcttcaactgggagtgtttaacggaatagccaaagtaaacgaccataccgatggctaaccataccacgaagcgaatccaagtgacaggcttcaggttgattagtaggaagacacaacagatgattgacatgattggtacaaacgggacccatggcgttttgaagggacgccgaagatctggttgtgttttacgtaaccgtaagatggagaaggaaactagggtaaaggcagtcaaagtaccgatattcaccagttcagctaagtcagctaatggaataaagccacccatgattgcggcaatcgacccaaacaagacggttgatttaagtggtgcaccggtcttggcgctaatatcgctaaagacatgggggagtaatccatcccgcgacatggagaaggaaatccgagtttgaccgtagagacagactaacattacagtggtcataccaagaatcgcgccaaggtcaatgattccggccatccaattttgaccggagtaaataagaacggccgagatcggatgatcaatgtacttggcaaacgtttcaaatgggaccacgccagtcatgatggctgatacagccacgtagagaatggtacagataccaagagacagtaacatggaacgtgggagtgttttggatggttccaatgtttcttcaacgctggatgaaatggcgtcaaaaccgatgaaggcgaagaaaacgctagaggctgcgccgaagacccctttgaagccaaatggtaataacggactccagtttgccggtttgatgaagcgcaccgcggtaaagatgaataaaaaaacaacggctaatttaatcactaccatgacgttattgacgcgtttagtttctttgaccccgagagacaataaagtggtaatcaggataataatggtgaaggccggcagattaaaatagctggtcacaccagggacggaacctgcagctgccgacaaagcagcgggcagtttgaggccgaagcccgccaagaatgattgaaagtagcctgaccagcccgctgaaacggttgagacagcgaaaaggtattctaacatcaagtcccagccgataatgaatgcaacaatttcgccgagggttgtgtaggcataggtgtacgctgacccactttcaggcaccatcgcagcgaattcagcgtagcagagtgaagcaaacaggcaagcaattgcagctaagacgaatgagatcattaggccgggaccagccgtcaaggcccccgtaccagttaaaacgaaaatcccggtcccgatgatggccccaattcccagcatcgttaggtcaaatgttttaagttcctttttgagcggactgtgataagtggctaacatggcattgatatcttttttgcggagtaaccgcgtgtgtgataaatccataatcatcgccccatttcgatgtgatagctttagtttaatcggttttgacaaagttacgatggtcaatctgaccaaaataaatattctgatgggctatagtgactaaaagccaaataattggacgcaatcgcgcgacatcctgcgacttcttgctgattgtctgactaatcgtgattaattagctatggtattcaacgcctattaatagggtgatatagcgaacatggcggggattgtttttctgaaggttaacttaccttgtgattgcgattgtgagtggggattattgaaggaccttaggaaatatggttttggctcactaaatcgccacttgattgatgcaacctgaagaactggagagagtgagcggcttattggaacccttttttattgatatcgattatatgaataaaatgggattatgattatccttaaagtattttgatgaatcaaattggataattaattttcttgcaggtaaaacggcctacgggaaactgatgtgattcgtctcgaccttccaatatcaacatttattgaccacatttgcataaattttattattccaaatacaaacttgattgcaattctaaaattaacaaatacgaatgatattcattagttggtgacaatgggtttggcgtttgctatattcaaaaggagaacgcaaatcaaggcctgaccaatattaaaggccacttgaaattagtggactactgggtctgctgattgttgctggtatcgaagctagtgattgcaatgactggcagatcttgaatcaaaaaaggggatagcaagctgattggtttggtgttggtaataaaagtattgatactagtacgtctgcattcataatgtataaagcattgccagactatttccagataataaagttgggaggcattagtcatgtcgtcatttcttaaagcaaagaccgttacacattacgtgctttttgcaattatccttattagtagcttctgtttatacgggtacgttaaaaatcgtattgagttaaatcaagcgaggactgtactaacaacaatgttaaaaagcagtccttatgacgtgcgtgtctcgagaaacacaataatcaaggaagaatccggcccttttagcggcattatttggtatgaatacacatttgcaaccagccaaacattagcggaaagtaagaaatacaaaaagtttttgcatcagtcatcaaaaaatatgaccctgaaaaattgccccatcgtctatcgcgtaatcgttagaccgccgactaaaaaaataaagcattggacgggtgaaatctatctcgataccaatcaaaaactcagcgcaacgggacgttcgaattacgtccaagctttaagcgacaagtctttgtgtgaactaacgatttcataaaaagccattaaccaggtggttccaatgatttagtttactatcggcctacattgaaaaatggggtaggtaatgcgttaactcaatcaggccatacaacagatgttcagaaggggtggtcgaatcgagttgtgttgattgtctaatcaacgcaacttttttatttgaggatttaacttggtcaaaaatatttgttatgagtttctccggtggtagcagaggtatactgcaatgattgaataaaccgatccgtaagataatgacccacaaaaaaacagctgggagacttcaccagctgcttcaaagatttgatttattaacgatgtcgtcgatagtaacggtagacgaccgctaataaaataataattagtaaaataccaacggccgctcgcggacccgcaatgtgttcggttaagtgaaacatgcgaatggggccgaggccgtgaattccaagcattgcaagcattgaacgcgccctccttaagcataattattagctatttaatgattaaatgcaaaaattatattcgcaaaagattattatctcactactatctgcggtaaaataaaaccatcattaataaattaggtgggtgcctccattgcaatatattcagccaattttctatacaattatcgttttaaacgcggccgcggcgttcgttaccgtgttccgggatcgtaatcgggacatcgcggccacttgggcttggctactcgtgttgatttggttgccgattattgggtttatcgcgtacgcctttgtcggtcgtaagttaccaaaaaaccggttattccggttacgtaaagagacgcaaattagactcgaacagatgattcagcggcaacgtgaagccctgggaacggaattgatgcccgcagatgcggtcactagctcggttcgtgggatggtcagtttattcttgaattccgatggcgcgttactaagccgtaaaaaccgggtcaagatttatacggatggacatgagaagttccatgcgatgttccaagatattgaagcagctaagaatcatattcatattgaatattacacattttataatgaccagattggaaatgaattattacaccttttagagcggaaagcagcccaaggcgtcgacgttcgtgtcttgtatgatccgtgggggtcgatgggcacgttccgcagcttctttaagcatttagaagaacttggtgggcatgcccgaccgttcttgggtgctcattcagcgattttggacttccgtctcaacttccgtgatcaccgtaagatcgtggtaacggatggccgggtcggctacgtcggtggttttaacgttggtgaccagtaccttggtcgtagtaagaagtttggttactggcgtgatacccatttgcggatcgtcggttcaggagtttttgaattgcaggaacgtttcattcgtgattggaacgccaccgatgcggaacatcgaatcgtgccagacgttaatatgttcccagtcattcgcgttaaagggaatacttcattacagatcgtctccagtggtccggacagtgatgcacaacagattaaattgggttatattaaaatgattatgacagctcaacaccgtttatggattcagtcgccatacctaattccggacgattccgtattagatgcgattaaaatcgctgcgatgtcaggggttgacgtccgcattatggtgccggacaaacctgatcatgcctttgtttaccgggcaacccagtactatgcccgggaactggcagatgctggtgttaaaatttattattataataatggctttattcatgctaagaccattgtcattgacggtcaggtggcgtcagtgggctcagctaatatggacttccggagctttaagctcaactttgaagtgaatgcctttttatacgatgctgatttagcacaagagttggaacggattttcttagaagatcaaaaaatcagtagtctgattaccgttcaagattttaagaatcagtcattctggttgaagttcaagcagacgttctcacggcttttatcaccaattttataatcaaacaaatgaacgggcgttgctaaaaagctgattttaaagagtcaaccactctttaaaatcagctttttagtgtgcttaatcgtccaagtacaattggcgcagattatttatatctgcgacggatagaccaagcacttctcgtaaataaccaataccattgccgtagaggtcgtcgaaaacccgaaagaccatcttcatattgtcggcttcaacagccatggcaacgttgaattggctagctaggtcaccagcattggccttggtaatgatcgtagcggtatccatactgtctgcggccatgaagacggcgttagtgagcaggtagtcctgcataatcgtttcacgagggacgtctagggccgtcataatgagcgcacccgcgacccccgttcggtctttaccagcagcacagtgaaagagtaccgattggtcgggctggtcgttggtgaggagggtcgcaaataaattttgccagactttcacggcatgactatccgtaaccatttgcgcatatgtttgtgcgttgaaggaatcatcgacgaccattcgcttgatgagccgttttaaacggcgatcaaagcgacgattgtcagtgaacggatagacagacgtattaatatacttagtattcttgggataacggtctggagacatctcagcttcattggcttggcgcagatcgatatcataacggagtccgtagttatccaagtaggtgagatcgcggttagtgagtagtgacatgccaccgcaacgcagcagtttttgccacttgattgtctgaccagcggtgttctcataaccccccagttctcggaagttgatgccgtgttctagtcgtaagacccgattgtgttccatagtctgattacctcgattagtgatttagctttattataaccgctttcattgctggtgtcaggtgtgattaacaagcagtcgttaaagtcacagccgccattttttaagtaggtacgttggtttggaaacttcacaacagaatcattgtcaaagtgaccggccgtcacgacgaaactttagtgtggtgggatttataagacgcttgatgaggttttaacatgaaaataatgagaaaacatcttgaaatcaaagctctaaccgcttatgattgcggcacgtatttttatttagtatcaactaacgactatacaaaaggtggggacacaatgggagcaaaaaaaggctggttggcagcaaccttctttgctggaacactattactagcggggtgtgggagctccaaggcaagtaatcagaagcaggttaagactgaccatttcaactacgtgtatgtgcaggatcctgataatttcgattacaccgtttcggcaaagcagaataataccgacgtggtatctaactttgaagacgggttgcttgaacggaatccgtatggacaattaactggcgacttagctaaatcgtggtcggttagtaaagatggcaagacgtacacctatcacttacgttcgggggtaaaatgggtcgatagtgaaggcaatacgcatggcaccgttaaggcccaagactttgtgaccggactaaaacatgcggttgcggcaaagtcggagcaattatacgtcgttcaaaatagcattaaagggctcaatgcttatgcgacgggtaagactaaggacttctcaaccgtgggtgttaaagcactcaatgcgacgaccgtgcagtatcggttgaataagcctgagacgtattggaattccaagctaacgtacggcgtgatgtatccaattaacgcgcagttcttaaagcaaaagggggctgattttggtaaggtgactgcggatggcatcctgtacaacgggccatacgtgcttgccaactttacctcgaagtccgtcttaaagtataaagctaatcccgggtattgggataagtcgcacgtttatttaaaggcggttacgcttacttttgatgatggcagtaatccagatggcctttataaatcgtttgagaagggcaattacacctatgctcgggtttatccgggctcagctggatataagacggttttaaagcagaacaagaataatgttctgtggaccagtcaagattcgtcagtctataactttacttttaacttgaatcgccagtcttacaacgataccgccaagaagactgatcaacaaaaggcggatacgcgtaaggcaattttgaaccagaatttccggttggccgttcaatttgcatttaataaagccgattacaacgcgcaggttaacgggaagattggcgctaataaagggttgcgtaatgaattaaccccaccatcatttgtttcgattggtggtaaggattatggcacgcaacttcaggaagacatgcagaatactggcttcagtgatattaagttggcagatggtcaggatggaacttatcaaccgacgaaagctaaacagtatttcgtcaaagcaaaggctgaattgaaagatcaaggggttagtggcccgatccatctcgatttgccagtagatgaaaaatcatcattactcctgaatcaagctaagtcgtttaaaaagtcagtagaatccacgctgggtaaacaaaacgtcatcattgatttacaactgttgagcgatgataagtataatgccgcgactttcaacgcaacgacgggtaaaactagtgattttgatattagtaatggatctggttggacgccagactatgacgatccgtcgacttacctcgaaatctataacccggtttctggggcgaacttgcacaccctaggattagatccaaccgcaacagccggtggatcggcttccaatgcggccgcaatcaaagcagttgattttgatcaatacagtaagttattggccaaagctgaagccattaatactgataccgctgctcgctataaggcgttcgctaaagctgaagcttggttgttgaatagtgggatcgtgattccaactaattcgggtggcgctggggcgattgtcagccgaatcgagccgctcagtggtccgtatgcaccatcagggcttggtgctggtcgctataagtttttgaaagttcgggaaaatgctgtcacgacgtctgaagccaagaaggcgcgggcggaatggctcgcaaagcggaaacaaattgcggaagatatgccgacaaattaggtcggcccttgcgtgaaggaaaagagggctagcaagactagcctttttctgtatctgttgttactaatgtgtcgagttatgaaggaagtggtgggtcgtgaagaaatacttgttttaccgggtgttgcgatcattgctgagcatcttcttggtcacaacgctcacttatatcatcatttattcgttagttccgcggcgtgatatttttaaatccgatccaatgatcagtaagctgagtactagtcctgatcagttggtcgattacgagaataccgcctatggcaagatgaattatatcgactatctggatactaagtcactcctagcgcaagcgtcaaatcgggggcaaacggtgacggctgcgcacactgcggtcaatattaaccggttgcggcagtgggcaacgcggtatcactatgcgcttcatcgctatccgcaaagtgggaattattatgcgacccgtgagttacccttgtggcaacggttggtgaagttctattcgggactaatccaggtcgatacgccatgggccattcacgatccggctaatcctaagttaccacggtatttaaaaatcagccacgatccgattgtcggctggagcttgattgggtctggcacgcgctacaagtatcaattatatgtcaattcgatgtttccatacctacatgaaaacatcgtccatttgaacttagggatttcctatccaacctatgctggcacacgggtcactgaggtgattggtagtcatcagggggaggcggtgacgcaccagtatacgtttgcaaatggtcaaaaaatgttgagcactgatgatgtctatacgcgtcagtaccagccgactagtcggcaagatgcaactgcccgagcgcaatacggtgacaattacactgcggtggtccaagagaatcatgatccgtcgatgattggaacttcctttaaagctggacttggtgcactgatcattgcctatgtgattgcgattccaatggcaattttgatggcccgttataagggtaagtggttcgacaaactcggtacggggattgtgaccgccctaattgcggttccgagcttagcctttatttatgcgttccggtacttcggcagtgccgtctttaacttgccagatacctttccaatgagtggtgcgagcgtactggcatcgtgggtgtcaccgactttgatcctggggttgctatcggtttcaggcttagtcatttggtttcgccgttacatggttgaccaacagtcaacagactacgttaagtttgccaaggtcaaagggttgactgataacgagatttatcggaaacacatcttcaagaatgcttcattaccgatcgtacaaggattgccagggtcaattatcggtttgattggcggtgcgacaatgactgaaacgatttttgcaatgcctggcatgggtaagatgttgccggatgcgattttaacacataacaacccgattgtgattgggctagtctttatctttacgacgattgcggtcttttcaatcttgctgggcgatatcttgatgacgattgtagatccacgaattaaattgacagcaacgggagatgattaggatggtaataggtcgagataaaccgcaacctgaaaaagtcgaccagaatcaagttagtaacgcggattttgaatttgtgacgttgaatgatcaggccaccgaaaagatcgaaacgccgcgatattcttactggcgctccgttgcgaaagtcttttttgccaataaactgacgattgcgatgttcgtactgatgttgataattttattattggcgttcatccagcccttgttcagtggctatagtctgatgaacgttagtaacatcaatgattttggcgcacgctataattggccgagctggcactactggttcggaacggatgctgatgggaagtctttatttgatgcagtctgggcgggagcccgcacatcgatttcgattggcgtgattgcgtcgttgattacgacggtgattggcgttgctatgggagccttttggggcaactccaagaagttagaccgggtgatgctggagatttataacgtcttgtccaatgtgcctaatttactgattattattgttttatcgtatacgtttggcaacggattttggaatctgatttttgcgatgacagtgacgacttggcttgatacggcgtatttcattagggtgaaagtcatccttcgacgcgatcgtgagtataatatcgcctcaaagacactggggacgccgatgggacggttgatcattcgtaatgttttgccgtatctgacgtcagtgattgtgacccaattgtcccaactattaccttcgttcatttcatttgaagtctttctgtcatttttaggagtgggactgagtgccaacgtaccgtcactcgggcggctaatcgcccaatattcaccagatatgaccagctacccgtacttgttctggttaccggtaaccgtactggcgctgattaccgtgtcgttgtacattgttgggcaaaatttggcggatgcatctgacccgcggacacatcgttagccatgtggtgataagtcaagaaagtaggaggatggtgtgatgaaaagaccagttgtattagctgttgatgatctttcggtgggctttcaagttcgcgggcagcaattaaaagcgattcgccatgtttccatggcattatatgatcaggaaatcctcgcattggttggtgaatcagggtctggtaaatccgtgttaacgaagacctttacgggaatgttggaagataatgggcacatcaccggtgggcgtattcagtacggtgatacctgtttgagtgacttgaagacggatcgagagtggaatcagattcgcggaaaagggattacgaccatttttcaagatccgatgacctcactggatcctatcaaaacaattggttcccaaattgcggaagtgattatcaaacatcaaaagaagtcggctgcggaagctaaagcgcaggcaatcgagttaatgacccgggcgggaattcccgatgctgcagaacggtataacgaatatccatttgagtactctggtggaatgcggcaacgaatcgttattgcggtcgctttagcctgccacccgcaaatcctgatttgtgacgaaccgacgactgcgctagacgtaacgattcaagctcagattttggatttgatcaaacaattacaatgtgaataccatttttcaatcatttttatcacgcatgacctcggtgtcgtagctgcaattgctgatcgtatcgcggtaatgtatgccggccaaatcgtagagctgggaacctgtgatgagattttttatgacccgcggcatccctacacttggagcttgttatcggcgttaccgcaactggcgaccgctgattccggcttgtattcgattcccgggacgcccccgtcactatttcacgatatcaaaggggaggcctttgcgccgcgcaatcggtatgcgttagcggctgactttaagcaggaaccacccaaattcagggtgagcccgacccattgggcgaagacttggttacttgatccccgggcacctaaagttgagaaaccggccctgattcagaatctacacgcgcgcctagttgccttgaccaagtcagaaatgcaaattggtcagatacggggagggacgacccatgactaatgaaagaacgccactcttagccgccaagcatctggagattgcctttggccaaggaaagcgggaattcgtggcggtcaaggacgctaattttgacatttatcggggggagaccttggcactggtcggtgaatcaggatcaggaaaaacgacgattggccgcgcaattctaggtgttattccgactaagaaagggacaattgcgttccatgaacaactcattaatcagcacttagcaatcgatgcgcaacgggaagtgatgcgcaagattcaaatgatctttcaagacccagccgcgtcactcaatgaacgggcgacgattgaatatattatttcggaagggttgctgaattttcacctctttcattctgaacaggattgccgtgatcaagttgagcagatgattaaagcggtggggttgctaccagaacatctttatcggtacccccatgaattctctggtggtcaacggcaacgaattgggattgctcgcgcccttattatgcggcccgagttagtcgtggccgacgaaccgatctcagcgctggatgtctcgattcgagcacagattctgaatctgctccggcagtttcaacaggagagccaattatcatacttgttcattgcccatgatttatccgtcgtacgctttattgcagaccgtgtggccgtcattcacaacggccgtgttctggaacttgcaccgaccgcggagttgtttacccatccactacatctgtatacgcaatcgttattagccgccattccaatacctgatccacagttggcacggcaaaagcaactcgtgacttatcacgagtcagttcacgattatacgactgatccagctcaattcgttgaactagttccgggacattttatctatgccaatcaatcggagctggtcacctaccgtcaacaactgtctatgacgtaaggccgaagctggtcacaggtacttcgaactaaaatctagcaagtgaacgtaaaagaaggacacaaaccagtttggcttgtgtccttctttaattagtccccgttgtaaatcgaatttttaactaccacatagtcgcacttagtaatggcctttaaatcccggccaccggcatatgagatggatgattgtaagtcttcttgcatctcgtttaaggtgtcgactaagcggccccggtaaggaaccagcatttgtttaccctcaacgtttttatgttcgcctttttgagtttcactggcggaaccgtagtattgcttataagtcttaccatcgatttttaaaatgttgccgggtgattcttggtgtccggccaacattgagccaatcatgaccatcgtagcgccgaaccgaatcgacttggcgatgtcaccattggtccggacaccaccgtctgcgatgattggtttgcgagcggccttggcacaccaccggacagcagctaattgccagccgccagtaccaaagcccgttttgactttagtaatgcaggccttacccgggccaacgccaaccttagttgcatcggcaccagcattttcaaggtcgcgaacggcggctggtgtggccacatttccggcaattacaaaactatccggaaggacgtctttgatgtgtttgatcattgcaatgacactgtcagcatgaccatgtgcgatatcaatcgtgatatattctggcacgatttgattagcagccaggtcgtcgataaagtcatactcgctggacttaacaccgaccgaaatagatgcgtacagttgcgcggcatgcatcgtttcaataaaagcacggcgggtctcgggggcgaagcgatgcataatgtagaagtagtcgttagtggcgagccacttggcaatctcgtcgttgatgacggttgccatattggcaggcaccactggaatcttaaaacgacggccacccaattctacggtcgtatcggcttccgaacgactattaatgacacacttgttcggaattagttgaatatcttcgtaatcaaaaatctccatgcccatgatgcaaaactcctttaagttaattcacggtgtcgcgttcaattagccccaaatgttgtgatcgataacgttagtttgttcgcgatcgggaccaacagagaaggtggcaattttaacgccgacgagttcttctaatttacgcaagtagttctgtgcattagttggcagttcctcaaaggttttaacgccagtaatgtcttcgtcccagccaggaacttcttcatagataggtttgcaagcttctaattccttcagactagcagggtagtgatagatggtttcgccgtttaagtcgtaagcggtacataccttgatggtctttaagcccgtcaagacgtctaagcagtttaaactaagatgagtaaacccagaaactcgtttagcatgccgtaatacaacgctatcgaaccaaccaatccgccgaggacgtttagtaacggtcccatattcatgggccgtttcacgaatgaaatcaccgacttcgtcaaagagttcagttgggaatgggccgtcaccgacgcgggaagtgtaggcttttaagaccccaacacagttatcgatcttagatgggccaacaccgctcccaatagtaacaccaccggcaactgggttagatgaagtaacgtaagggtaagtcccttgatcaatatccagcatgactccctgagcaccttcaaataggacgcgttgaccgttatctaacgcatcattaatgacaacggaagtatcggtgacgaatggtttcaaagtttgaccataagcgtaatagtcatcaaaaatatcttcaaatttcagtggttctaagtcataaagcttggtaataatttggttcttttcagctaagttgcgcttgagtaacgccgcaaaggtgtccttatcaagcaggtcggctacgcgaatcccaattcgttcagccttatccatgtaggctgggccgattcccttattagtcgtcccaatcttgccaccggctttagctttttcttgagcgccatctaatgtgatgtggtaaggcaagatgacgtgtgcacggttagagattctaaggttgtcaggattaacgcccttgtcccgcaagtattgtaattcttcaactaatgacttgggatttaagaccacgccgttcccaatgacagctaacttatcatggaagaaaatccctgatggaatcagccgtaatttgaaagtttgcccattaaatacgatggtgtggccggcgttatcgccgccttggtaacgtgataccacatctgcttcctgactcaaaaagtccgtgatctttcctttaccttcatcgccccactggctacctactactacgactgatgccatattcttccacctcattaaatagtttaattatgaataattaatcctaaagagtagttaaacgttcaccactccaacaggaaagagtatagcaactttaacgtcaaaacgcaacccaaaaaccgaatgttcttgttttgagcacaaataatcgttcataattaaggcgaattagttcgaaaacaagtccttaatatggaaacgaagtgaaaaataacagtattttttcattgttcgtctctattaattactcgaggggtatgctataataatgttcgtgttttgttagtgaatacctaaaaagaaatgaggattagcaatgattgatcgttatacgcgtcccgcgatgggcaaagtatggtcgttagaaaatcagtaccaagcatggttggaggtagagattgctgccgacgaggcctgggctgaattagggaagattccagcaagtgatgttgctaaaattcgagagaatgccaagtttgatgttgaccggatcgcggagattgaagccgtaacgcatcatgatgtggttgcttttacgcgcgatgtttccgagtcgttgggtgcagaacgtaagtgggttcactatgggctgaccagtactgacgttgtcgacacggcgcaaggttaccggttgaagcaggctaacgcgattattcgccaagacttacaagatttacgggcgacactagcacaacaagcgaaaaaatataaatatacggttgaaatggggcggacacacggcgtccacgctgaaccaaccacgtttggattgaagattgcccggtggtattctgaaattaatcgggatatcgagcgttttgaacacgcggccgcgggcgttgaagcgggtaaaatcagtggagccgttgggacttttgcgaacattccaccatttgttgaagaatttgtctgcaaacaacttggattgcgcgcacaagaaatttcgacgcaagttttaccacgggacttacatgccgaatacattgctagtttggccttgattgcaacaagcgttgaagtgtttgcaaccgaaattcgtggtttgcaaaaatctgaaactcatgaagttgaagaattctttaataaaggtcagaaaggctcatcagcaatgccccacaagcgtaatcccatcggttctgagaacgtgacggggttggcacgggttattcgcggccacatgatgaccgcctatgaagatgtgccgttgtggcatgaacgggatatttcccactcttctgcggagcggatcatcttaccagataccacgattttagtggattatatcttaactcgaatcaataagattattaagacgctgacggtgttcccagaacggatgaagcaaaacatggatgcgacttacgggttgatctacagtcaacgtgtcttgctcaagttgattgatacggggatgtctcgtgaaagtgcttatgacctcgttcaaccactgacggctaagtcatgggatgaacagttacaattcaagccacttattgaaggtaacgccgagattcgtgaacatttggaccaggctgcgattgatgatgcgtttgactatcattaccatcttcgccacgttgatgatattttcaaacgattgggattagacgattaatttaaaaacgatgaagccccagcgatgagtaatcgctggggcttttattatgattaaaacgtgctaaaaagatgggctgtttattcgtcagccgatgcgcgtcctatttcgacctccggggctggggacgattaatggctatttttgagcttgataatggcacggtttaatcatgcttcatactaaacgataactagcgcaatgcgtgtaagtaccttgatttcagttcaagggaccaaatgttaggtgcgtcgcaatcagaccatacccaagtgccatatgacgctgttctttgcgcgtgaggcgctgtaattgggtgtgaacgtattggtagaggtcacgatgctggcgtggtagagtcgttgggaccatatagttacgataataggcttgatatagctggatggttacttgctgtggcgaaacgttgttattcaggtcgattgcagctgccagtagcgcttggcggtaggaatcggatggttgattggtaatcggctgattataagcagcatctactaaggtaaataatttttgagcatccacatccattgttaggaccaacctttcaatcgttgagataggcgcaattatagcatggtcagtatgcttgatgtgcaggcccgagttggtttctaaagtaatggaacgaacataaccagagccgccaatgagtgggggtcattggcggctctggttattaataagggattaatcaagcggcggtcgcagcagtgttttctgttttaagcccggtgccaagctgcgtagccgatggttgggaaaataccaatcaaacggtcgatttgttcgcggtctaattgatattcgatagctggtagtagtgcgttgacggcatcttcagcttgatcactgatttcagtcacgccaacgagatggccgtcttggtcatggacctgtttactagcggcaatcggttccttggagacttgataataccagtaatctgctaaatcgttatcactaacggttaagccggccttttcagcagccggtattttcatgccggcttgcgcaattcgtggtgaagtaaagacgaccgatggaattaccggatagtcaatgggagcactggtttgaccagagaacaaacgcatcaagtatttggactcaaagtaggctgcaggtgtgacctttggcaagtcattggcaaggacatcaccggctgcatagatgttaggaacgttggtttgcaagtggtcgttgacataaatgccgtggcggtcatatttgacgccaatccggtctaagcctaagccatctaagtttggaattcgaccagtcgcatctaggatccagtcggtcgttaattgctggtggtcgccataactaacttggaactggtcatcctgtttggtaaatgcttgcacgttggcatttttgatgaaggttaccccacgttcagttaagtcgtcaaccacttgtgcaacgaatggttggtaaaaatcacggagggcctggtcgccatgtaacatgactgtcacttgggcaccggccgcgttagcgatggtggcaaattccataccaatatagcctgcgccaatgatgacgatactttgtggtaaccgtttaaggttcataaaatcactactatcgtgggcgagcttggtccccggaatatctaaacgatggggctttaaaccagtcgcaataacgattttttcagcggtaatggtttgctgatcatcaacgacaacggtgtgagcgtccttgaacgtggcatgaccatgaatgatcgttgcgccaccatcttccaaacgagctgtcaggcctgctggtaagggatcaataatctcttgtttatgggccacgttggccgtccaattaatggttggtgcactgctcaaaatatcattgaggcgtgctgcttcccgcgttaatttgacaggttcatcaagagtgattttggcgttacaaccacgattagggcaggtgcccccaatcagaccactctcaatcacaccgacgcgaacaccagtcttggcgagtggtgcggcgccatcaaacgtggcgtgacccgcaccaatgtataacacatcgtaatcgtatttgtttgtcatgatttatcagcctccattaaaattttggtaacttaagcttaacgagttttaagaaacctgacaactgatatgaattgctcgcgcccgctgtaatgattatactgaaagtaattatgtcaatagggagacgttaatatgcacgctttgatcgcaattgattcatttaaaaattccatcacgagcattcaggccaaccgaatagtggctaaacgattttcggctcacggaatcaccgctactcaagttgcgattgccgatggtggtgaaggaacggtggcggcgtggctggctaaccatgctggtggacaagctattacggcatcaacggtggatctggcgcaacggccagtgactgcaacgtatggctactttgccactgaaaaaatggcagtgattgaggttgcggctgcatccggaatccagtttgtcacgacgaccttgacgccgttagcaacgaatacctatgggaccgggctactgattaaagatgcgattgagcgtggcgcccggcagattattctgggcttaggcggtagcggaacggtcgacggtggtgccggaatcctacgtgcgctcggttatcgtttttgggctgccgatggtcaagagttagccatgactggcgctgatttaagtcgggtcactaagattgacgatcgacatgtgttgccacaattagctgaagtctcgttcattagtgcagcggatgtgacgaatccgctaacgggaccgaacggcgcagctaagatttttggcccacaaaaaggattaccggttgctcaaattcaggttcacgatgccgctttagctcactatatgacggtcgcagctggtgcggtgagtgcccacgaaggcgatggggctgccggtggtattgggtttgcattacgttactttttacacgcccgcgttcgctctggttttcaattgttagctgaaatgagcaatcttaaaacgaaagtggcccaagcggatctagttatctctggtgaaggccaagtcgacgatcagagttttatgggcaaggtaccaattcagctcagtcagttagcccaagcggccggcaagccttgctatttattagttggtcggcaaaaaggtgcaaatgaaacatttgccaaacagggggtcacggctgttttaccgattgtcgatcaagtcatgaccttagatcaagccatggcgcagggaccagccaatctggaacggatggcggaccgcttagcccgaatcattagccagtcataaaacaacttaagcggtcaaaaaaaccgtatgtgcagtgaatagcgcatacggtttttcgactgaattttatttatcaggaacatagtgattcaaaaaggctgtaacatgtcgttgatactcggcaggatcgatccaaaaactctcggcgtgagtggcgttgggaacctgccacatctgcttggggcccttagcggcctgataattttctttgagcatccaacttgggacgtagacatccttgtcaccgtgaataaagaagatcggtagatggttatgtttgagctgttcgacagaactgacgtcgcttaaataatagcccatacggtggcggttaataaaactaacgatgggcacaaacggatactttggtaagtgaaactgtcgctttaataagtaagcgagttcttcctcgatactcgaataaccacaatcggcaatgatggccttaacttgtgatggaaggtcttcgccgctcatcatttcaacggtcgcaccacccatgctgacaccaaaaaggatgatatccgtgtgacgaccattgatacggacgactttatcgatccagcctaaatagtcgcggcgatcctgccacccaaagctaatgtacttgccggcactttgcccatggccgcgatcgtcgggcaagaggacgttgtagcccatttgatggaacatataagcgtaatttgccatcgtttcaccatcacctttgtagccatgggaaacaataacggttcggttgctggttgttttagcaggaacgtactgtgcgacaaggtgattggcctcgtcattagcgttcagttgccactgttgaacgggctgtcggtgtagccaatcgacataagcgtagtaggcatcggcgtatttttgtttatctgccgaagtttcgggcacgtaatcaacacgcttgaaagcaaaatcgtagagcttctcactcgcgaatagggcggccgaaaaaattgccacaggagcactaattccggctacggcgcgtgtttttttcattaaatatcactcctctaatctctcaataatatgatacgtcgattagaagtgagatgtaactatattattctagtaatataaaaggccatcgcggcgggcgatgacctataaattgcattggtcgctaggtggcatccccagcgagcctgtttttcattaactttggaggagtaaatgaaaaaggttcaagtggctgaaggagatgtccagtcactatatgtttagtatagtagtttgattgttaaaaggtaactaaatcgcttacttgactggtgaaaaaactaaaaattatttgtgggtggtcaatattccggtatggacagatttcgtcgtgccaagtatgataccgattcaagtggcattaagcctccttaagggctagttcatgcattttggcgctaacttgattaaggacctgtgttttacgttcagctgtcaaaaagacgcgctgacttaaaattgggtagtgttgttcacgtgcgattagcaataattcacgataaagcaaagtggcggctaatagcgatggccgggcgacgggatcaatttgtggcatcatggttaatgcagcctcgtacttgttcatggcaatctgtgcttcatgttcccaaagccgaataaaattggcagatgggatggggccatgcaagtcagttggattgagctgatagtgtgccaatagttttgatggcaggtagattcggccacgttggtagtcttcaccaacatctcttaaaatattggtgagttgcatggcgatgcctaattctacggctggtttgacaagtgattgcgggttagttgctagcattggcaaaatcatcagaccaaccgatccggcgacgtaatagcaatagtcttcaagtgcttgctgagtttgaggttgtttaaaagtcgcgtcttgttcttgaccagtgagcatatcgaaaaagacgtcaagattcatatcataagtctcaaaaacgacggccagtgcgcgccacattgggtggtctgggacatgaccattggcaaaggtggtcaatgattggcgcaatgccattagaccatcaatatcatggtcaacatcaacgaggtcgtcggctgttcgacaaaaagcataaacggcgtaaatactccaagcgcgttctagtggtaattgcgagaaggcggtgtagaatgcgctagaagaccttttagtaattgtttgacagtatgtaaagtcagtgcgatgttgttcgaatttaggcattagtttggtcatctttaatcaactcctcaacggctaatttagcactttgcataacaatgggaacaccggccccagggtgggtgctactaccacaaaaataaagatggtcggcatagtcgaacttgttatggggacgataataattactttgttttaacgtcggtcgtaagccgaaagtggctccgttataggcgccaaactgttctttgaagtcaaccggtgtaaactgcttttcgacaacgatatgctgttcaatatcgctgaaggtagccgtttgtcttagtttgttaatgattagttgacgatagttcttcagtgttgttggtgaccagtcattaaactttgagagctcaggaactggtactaaaacatagagtgcctcactgttttcgggagctaaacttggatccatctttgatggaacatagacataatacgagggatcttctggtaacttgccgttgtcaaatagatcggcgacgtttttgctgaaatcttgtgcaaagtggatcgtgtgtaatgcttcggttgggtattttttgtctagtcctaaatacaagacgagacatgagcatgaataatccattttggcaattttttgatctgtgtactgaccacgatcttgctcatttggaatcagtgttgtcatggcggttggaaaatcagcattacataggacatagtcactgtggatcggatgattattgacacgaatgccaacagcaactttatctttgatgataatttcttgaactggtgtggcaagctttaacgtaccaccttgttctttgaataacttaacgagactattgacaactgtgtacataccaccctttaaaaaatagaccccatagaagagctcaatcattggaataatgttgtatagcgacgggccctggtagggagaaatcccaatatacagtgtctgaaaggctaatgaattacgtagattctcattcttgataaattttgcaatgtttttgtaggcattgttaaaggtgcgtagctgtagtcctgcatacagagcgggtaggttataaaagtcacgccagttacggaatgatcgttctaaaaaattaggcttcgcgatggtataccggtgataaatatccgctaaaaaatttaacataccattgacgtcatcaggcgcaatgcggttaatctcggcaattaatgttgggagatcgcgtgacaaatctagactagattgatcaccaaagacaaggtgcatcaaaggttgaacttcttcgaatggtaaatagttgtgcggatcgaccccgcaaaagcgaaagacttcttcgtagatgtctttcatcatgacgatcgtcggccccacgtcaaatgtaaatccttggctaacaatctggttcattttgccacccggttgcgcgttttgctcataaatcgtaacattataacctaatttttgaagccgtactgcagcggttaagccaccaataccagcgccaataatcgatacttgcttcatcagtaaatctcccccttaacagatgaataactaaaaagcatggttaatcattagttatattttggtttaataatgtaaaaagtacaacaaatatgattactatgacgtattaaagtagtcggtaggtgcgaatagagcggacgagaaaacaaaaaaaccaccgtatcggggaatacggtggaaaaaggagtagggtaaacatgtgacggggaatcacatgttactatgaatttcattactttggaggagtaaatgaaaaattttaggttgtgttatagctgattgagttaacctcaattgctatgatgtaatcataccgaggttgtgtgaagaatttgtgactgaacatggcgaatgtcatgaaaaaaagggaaaggctttattaagaagtgtgaagaatcatcaacgttcttacggaatgccttggcgaggtgcgatgatcgactgtttggggccaaagaaaatagtcacttcaaaagttgtcctttgaagtgactattttgattcgcaatcaatgctagtaataacaagtttgcggcgacgctaagttgatagtgaccaagcagattttggtgactggctgtgggcactgccatttggcgcgattagttatcgtcacgattaccaccgaatagaataattagtcgtagtaattgtaagaatgttgacagggctgcagcaacataggttaaagccgccgcgacaagcactttacgcaccatgggaacttcgtcgcgagtcaaaacttgcccatcagataaaatctggagggcgcgtcttgaggcgttgaattcaactggaagcgtgacaagttggaacaataacgccagtgagaagagtaaaatcccaatgtgaatcagtgtttggttgtaactcaataaaacgccgataatgattagtggtaatgataagcttgaaccgatgttcgtgatgggcacgagggcggtccgcaagcgcattggccaatagttaacgtgatcttgaactgcgtgtccgcattcgtgggccgcaactccgatggcggccacagaggttgaatctgctgtggcttctgataggctgagaatcttagtttgaccgttgtaattgtcggtcagatccccgcttatcttttggacaccaacatcattgataccagattggcttaaaataaagcgagctgcatcggtgccggttgtgccagattgactacgataggcatcataatgccggaatgtccgattaacgtaacccgatgcggccattgagataatcagtccaatgatgactaataggtaagtcggatcaaaaaacgaatagaacaaggtcgacccctcctaagtggtttaatgttaatccgattctatcagatttagcgtgacattcctactgaagaaagccattggaaagtgtctttactatcgagaaacgacgtcagattatataattagcccagttaatcgtaattggcaaagagcgaaggagttttctgatggaaaagacgtatcgaaccaaaacgtatggggaaatgccgttaaagttagatactgggaaaggctggatttttcctaaaggtgttgaagtgaaggcgcatgttgatttagaaacgggacaggtcagtttttttattgcaccagaagatctcgataagatgaaataagtactaggaccacgatacgcggtaaggttgagaagtttgtttctcgccttggcgcgttttttatggtggaaattggattggcaatgattatggttaatacggtgttcacgcgtgagccacaactgcttgaaggcaataaaaaacctccgtatcggggaaatacggaggaaaagggaagtaaatcggtaaaatgtaattaagtacacacacatcattacttggggaagtaatcattaaagttagggggtcgttaaggattgggatttccttaatgactataaacatagtatagcggcgacgcgtgaagaaagtgtgacgcgaaaagtttaaaagcatgattttcagacgaaaaagttaggtcatggaacgaaaaaatatgacgatttttacaaagtttataacgaaatgatgaccgtcataaatcaatatgagtggctaaatgctggtgtgacgcagtttttattggtcctagactctgaggtgctataatgaagcacaaattaatcgaaaggtgttttccaaatatgacaattaaaatcgtcaccgattcgtcggtccaattaacgacggccgagattgcacagtataatattaaagtggttccgttactcgtggggttcggtggcgacttgattgcagatacggcagttagtaccgcggaatttgaccaacagatggcagtcagcccagtcttgccaacgactagccagccgccaattggtgatttcgtcagttgctacgatgaattgacagcggatggtagccaagtattatcactacatttgacggagacattgagtgggacggtcaatgctgctcgccaagctgccaaacttgctagtggcgatgtgacagttattgatacccaggcggctgaccgtgggatggcctttcaagtgcttacagcagcacggatggctcacgccggtgcggatatggccacaattttggcgaagataaccgtcattcggcagcatactaagacctacttgttcgtggatacgctcgacaatttggtcaaaggtgggcgcgtccctaagttggctggcatggtcacgaatttgattaaattaaaatttgtctttgaattagaagccggaaaattaaaactttatacgcggggtcgcgggaaaaaggcgctaatcaaagcgcaggaacaaattctagaccaattagcggatgcgactcgagtcgaagcggctggaatttcttacgtcggcgaaccgagcgttgcggaagcgccagaaaagcttctccaacaagttgttccacaggtaacaccactggttgcgcgcactagtccaattattgcgacgcacaccggtgttggcgcttacgcgttgatgttttatacagttgattaaatttgacgaactaacctactattaaaaattactttgatgtgttataattaattaatgataaatgagaaccgtgttggtgcactgttctgagcctaaccaccatttaatgatgactagacccggatggggcaccttttttgtcactcttttcactaaaagaaagtaggaacttatgtgagctatcttctcaataatccgtttttcgggatcggactgtcgatcttggtgtatgggattggcgagtatttatatcacaaaacaaatcgctttgtgttattccaaccgttattttttggaatgctgctcgggattggtttattggtattgattgcgtcgattctaaaggcacccgtgcaaaaagtttatgaagcgtaccaggttggtggcgactggttattctggtttgtggcgcccgccaccgtctcgtttgcggtgccactatataagcgtaatgatatctttaagaaacattgggatgtcattgtgattgcgttagcgattgggttagggctgtcattatttggtatctatgggatttcacggttgctcggtctgacggatgcagcgttaggtgccatgttagtacaagcagcaacgacagcaattgctttaccggtggctgagtcggtgggtggcgatcaagccattgcggcgttcgcagtcattctgaattcagttttgatttacgcgttaggcgaccattttattcgctggttcaaattgcacaagaatccgctcggtgccgggttaggattcggaattgccggtaatgcggttggtgccactaaagcgattgaagtgagcgaggctgcgggcgcaactggtgcaatcgcctttgtgattgccggtattcttgttaattttatggttccagggtttgcgcagttgattggtttaggttagatggtccgggagggattcgatgaaaaaaggcgcgtttattacacaaattgtgatttatggtttgattttattagctagtagtttaatcgctaatttagtcaataagatttggcccgcattcccaatgccgacaccgttgattgggatgattctactatacttgctgttaacgtttaaagtggtcaaacttgagcaggtggcgggtgttagcaactttttcgtccaatttatcagcttgattttcattccatcagggatcgcgttagtaactaagttagacgtgttaaaggcagaaggcgttcagattgtgatcgtcattattgtttcgacactaatgttgttgctttttacagcgggaatcgcgtgggttttaattcaagtcaaggaatggctcattgctcgtcgaacgaacagcaatgttgagttggaagaagattaaatcttggtggcacataatttactcgtgagtagattgggtaccagttggatctaatcgaaacaggcagttgttgaaccgcttgttttggctattacaagataatagcaggccgttgtggggattgcatacccatgacggcttttttagacggcaataaaaaagccaccacatcagcggatgtagtggtcaaggagtaggaaacatcaaagtgggggctttgatgaaccccattcatcagacttgggggagtctatgaatgaaagtgattattagctgcattatggcagcaacgcactaataatcgaaaaaactaaagaatattaaggattgacagtcagttggtcactttctatcaatctgcgactattataattgcaaaagttattggctgcaactaattgagctgattaattagtttaaagtaacgcggggctggaaatcagccgcaaataagcccatgtgatagaggtcgattcgttgcccatcacgcttgatagcacgcttattggtgccctcaaattcaaaaccactattctggtaaacagcgatagcggcggggtttgttgcgatgacgtccaaacagactttgtaaagattcaattcgttaaaagcgtagttcaaaatcaagctgagtgtctcggtaccataaccatggccgcgttcgtcgggatcaccgattgcgatggctaattgggcaacctggttatgccattcgatattgaatagggtgacaaagcctaataagtggtcgtcttctaaactatgaacgtgaaagtagtattcggtattccgatcaaggttacggtaagttcgttcgagttcttcaccggtcagtggtcgggcggcagccgtatccattttacgaacaaaatcggcgtcagtgtaccagtcactgatctcatcaaaatcttctggctggggaacagcaagggccacatggggcccgacaaacatatttttcaaaataatccctcactcgtatgatgttattaaagcttatcttcatggtggcggcaaaaggtgggcttgtcaaccaaaaattatgagattacgcgtcagactagctagctcagtatgaaacacgggtggcatgtgccaagtgctgaggtcaagaacaactagctctgggggacggcgaaataagatgcggatatactgaagacttacagtaaagccgttgggcacgtgctgccgataatgtggtttcagtataatgagggcaatacgggtgatggctgaactattggtgaaaggtgttgctgtgggggcacttttcaatggtgcgtaaagagaggttagcacaaactttacagttactttatatgaagattggtaaaactttacgttagctcgctatattagagataaccatctggtgattaaagtatgagagggaggatcgaattgcgtcctttacaagttattcagatttctgatctacatttaaccccccgcggccaagtaccggcacatggtcagcagtacgatccctggggcaagcttgccaatattattgatgatattcggcgattaccaaccatgccagatttgattgtttttaccggggacttgattcatgacggtagcgctgacgattatcagcggctgcacgcaatcatccatacgatggaagctgaatttgattgtcatgttcgagttatccttggaaaccatgatcggcgagcggcgttttacgaagggtatttgccggctgacccgggaccatactacgcgagtcgcatgcggattggcaacaacgacttttattttttggattcaaaggttagcggttatgaggcaggctggttggcaccacaacagctacaatggttgggaaaacatctacgacaggcaccgacaaagcgggcttttctatttttgcatcaccccctagatgggccgacgatgacaaatatgcactatgcgattttacaaaatacgccggcgctgttatcggtgcttcggggacataatttaggcggcgtattctctggtcacgttcactttgtttcaagttatttgattggagataatattctgaatgtggtggccggttctgcggcctatgcgatcgattgccatgatccacatcatcattatgttcatgagggcagtagttaccaaatcattacaatcgatcgaggacaggtcggtgtgacaacgcgccagttactgcatgggaaagcggttattgatgaattgacgatcccagacactaagtttgtcgggcgagccccacaagggtatgaataaagatagcgctttcttaattaacaaggtataatgttggtaataattaagggaggcgtcaatatgggactatttcgtcatcacaatcaaatgccaccacggatcaaacgtaaattaaagcaacggttgttacccgttgccgccatggagattaccgcaaccacaattgtggttgcggatgtcttgacggcgaagtcatttcgccgaggacatcgacttggctggttgttattagcctttgtacaaccatttggaccgtggctctattttgcgtttggacaggaacgttagggtaattagtaaattaaagtggggttaagttcgggtgaaagctcggacttttttacgttgatgggcgttttttgaacgtttatgaatgtttttttgaatgcaatcataagcgtgtataataaaagtgtatataaagatacctataatttgaaattattatggtaatccgaatcatatagagggggactttattaatgcagcgagaatcagaattacgacaacaagctcaagaggctattaagggactaatcgtccggttaagtgggtggtctgatcagtcgggggacttattggatattattgatgtattaatgcaggtcgataaaaaaattactacgactaagaacccagaagccttagtcaatcgcctagtaaactatattcgtagtgtagccattaagggacggttacactttccagatgaagaagaaaagctaatgatcgacttaggaataatcgggcaaaaggccggattgaacggggcctatatggctgatttctctgacaagtcacagttctatggcatgctggaagaagtcccacaacattaataccggccagggggttgagggctaccggtcgtgtaattgctgattggtgttccgaaagcgtcctccgattgtgatgctgattaaagcgtaagtaagaccagcttatcgtataaattaaaaggaacacctcaggctgtgatagtccacttaaggttgacagggactaatacaggaaaactgaaagtgttccttttgttttaggataaccagcgcgctaaatagccggttgccattgaactggttctattcactgtgcgtcaatttcaatcgctttaaatcagctgttttagttacattgagtagtttctggcagtctgggcataatccatagacttccatattgtgacccgtaaccaagtacccagagagttccgccgccttggcttcgacactgcggaggtcgggttcgaaaacgtcagtaattttaccacaattctcacaaacgacgtgataatgtggtcgaccgaaaaagtcatagtgggtgccagcatcgccattttgtaattcaattacgattcctaagtcgacaaaaagttttaacgtattgtaaaccgttgccaagctcaggttaggtaattgagttgctaattcctgatagatggtttcgacggatggatgattatggtgagtaatcaaataattaagaatgatttgccgttgcggcgttacacggattttatggtcctttaattgctgcaaggcttgggtcaacatatcttctgccacgacgcggttcctccttttatcatattcacccttattaaaccacactttttagaaggattccaatttagaaacattactagataaaacttttgacaaaattaattaacgaaatagctgaaaaggctttactggggctgaagacgtgagtaaactaacgataattaagtgcgtgttgatgggggtggcaaaatgacacaattaattgtaccagcattaccggttgagcgggtccaatacgaacgcgcatatgtacttggccttgaagcaatgatgaaagttatccggcaacttacgactacggaaaaaggacgacaggtacccactaatcagttcccagtatttgcggcgagctatgatgttccccaagcgttggcccaagttgcagtcctaaaagccgctactactcggttgaaggttcgaccgattcagttgaccgtgacccggcagtacgtgacgttacgattccaattacaagcagccgctggacaaccagtctgggtgccgtccgccggggcactatggcgcctatatgatggctttttaagtaatttagtggggatccctttccagcacctagcaaatattcagattggcttacagcgcgttactggaccgctgacagtgactacgccgatacgccctagttttcaaaattatgatgttcgactgaccccaagtgggcaaactggttgcctagtgaaagttcacaaagcaccagcaatattggcacgacgggcaccgatataccagttaagtcattactcggaaacgattcggccggatgactagtcgtcattagctggatgattctaaataatccataatcacactgatagccagattaacagcggccacaaaaaatcccaagctcatttagcttgggattttttgtggccggtatttaaggcctatcaattgacttaattatgcttggtggcgcaacgtcacattatcagttgtggctacttgagcatctgcttgtgcccacactagcagttgagcttgaatgttttccaggattttcatggataactggtagtcacgttcggacccggtgctattgaagctcaatgtacaggttccggcaaacgtgctggcggcaatttccataacgggtgagcactggaaggcacccgagaagacgcaattgacaaccgtcaagtcatgaaatttaagccgttcctggtcgacgacaccaaagttggtataccggagcgcaggctgtggtaaccagcgtttggtcattttacgcatgaccgtaattggcattgtatggttcattttctgtaaattgctaagtcgataaaggaaggcgacccgcgtacgctcgaccgttaacaagtcgtggacttgattgacgagctcactaaaaggtgcatcaatatctaccttgattgtcagaaaaacattgacggttaaattagcgatttgggtgacgttcgcatcttcagtcgtgaagcggcgcaggtcgattgggcacggcaatgtcacggttgtatgaccagttaaaacttggagtgctttagcgtatgccgccaaaatggcctcgctaataccgacgtcttgggccttagccactcgtcggacgcgcatgaattgcgtgctactgagcattacgtgaccaccgtgccgcaagttaattcccggataatggggtagtttaaccataccggtaacaatgggtgcatgaccgtgtggccgtgcaaattgacgttgcaacttagtgataactgggcgtagtcgccgttcattatgcaaattcgtgagatcggcataattgtaggcttgtgcgagcaggtacagatattctttaaacccacgattgtccgttagtaggtggctcataaaggtttgtaagacatcgtagtcaccgtgatgaatgacaaataaccgtagttgcggactattcgtaaaatcaaaatcagtgttttcaggactatacgggctttgaacttcctgaataacttggttgactggttgatcagtaacaacgaaacgattacggtcagcttgataatgaccgaaaatctcgggtacgatttgtgcggaagcgagcacggcagcctttaagcgttccacgtcgatctgactggaaaaaacgattcgcgaacgcattaatggcgcggcacctgtagtatgtagcatattcaaaaagtcaagtgcttcaccacgataatacacgattaaccccccaatcaatttctctaatcaatagtatagcagactctattcatcacactaacaatggacgtttggttttgaaaaaagttaagaaacatttgtgaaagtttattaatcctgtgatggcgatacagcactgcctcgattattatgtctggtagttatttctatgagcaagaaataatctggcctgctaatgaatgcctcacctcgtttaaaattagacttaagataatggcagttacgcggatggggactggaattgctaaactgactgaatattcagcagttaagattaaaattttgatgaaagcagctgattttttgtaaccggttccgactatttaccaaaaaaggggtatactaaaagtaattacaacttaaaggagtttttcacacgatgaagattatcgcactcgtcggtagcattcgacgttcctcatataatcgtaagttagcaacgtttgttcagaaacggtatgccgatcaactggatgtcacgattcctaacttgggcgcgttgcctttttatgatcaggatatcgagctagaagcccccgcagaggtgcaagcctttaagcagacggtcatggacgcggatggcgtcatttttgtgacaccggaatatatccaggtgtcttggaaaatgcgattgattggctatcgcgtgttgaacgaccgttaattgggaaaccagctatgattttaggggccacaatgggacccttagggacagtgcgagcgcagagtcatttacggcaagttttagattcacccggagttgggatgcagattctgcctggaaatgaattcttgttgagcgcggtgcaggacaagatgaatgccgatggggaccttacggacaataaggtcgttgagtggttagaccattgtgtggctgactaccttaagtttgctcaccagttagccgcaaacgactaattcggataaaataattgataaggggaagtttcagatgaacaaagaacgtaagttgatttatgttattttgaatgacgaagatgtggaatatgatcttgaagaattaccagatcaatatgtggtctatattcgccaacaagccggggattcacgcgacttgtcgttagttaatactgagattcagaacctgtttaaggatgccgaattggactttgaagaaaagatcaagcctgaaaatcggaaggctgacattgtgctagctgttaagcgcagtacggtggcagatgactaataaacaagcgtaaacaatagttgtagcggattgatgttttgccgttacgactatttttttgtaagatcaaattattggtctcaacattaaccaattcatgtgaggagggctaacaatgaccattgagacactgtatcagcagatgttagctgccatggggccccggcactggctccaagccggaataccacctgccgagacgccttgggagattctctggggcggtattctcgttcagaataccaactggcgcaacgtggattacgcactggctaatttaaaagcagccactgactttgagcctcggcggttactagcattgactgatactgaactgacgactttagtcaaacccgcgggcttctatacgcgcaaagttccaactttaaaagctttagcagcgtggtgtggacagtatgattttgacttgaccgtgatgcgagccttgccagcagaacaattgcggcgtgaactaatcgctctgcgcggtattggcgatgaaacggctgactactttagcatgtacgtttttcatcagccaacgatcattattgacacgtatttgcggcgcctattcggctggcttaaccaaccgttaccgagcaactacttaaaggcccaacaactgattatgcaggcgtggcattatgatttaacgacggcttgggagtggcacgcactgattgttgatttcggtaaacaggtcaaaacgacggctgatttcgaacggtcctttcttgcaacgcaacgattaacacttgcttcacaaagtttggcaaactaattaaataagttcctaaattcaagtgaaccgccttattttaatcgggttttattgaccgacttaataggggcggctattattatgtttataaaagaaagcgcttttatggttaaggacgttacttgattagttaggagggcctgacagttggtcactggatggattggcaattattagtgattttataacaaccagtgtccgaaattagtttgttaacaacgcgattattgattagtcaaagggggagaatcgctatgaagcaagtgcatttattaacgccggttgcaggacagttagtgccactcgaatcggttcacgatccggtgttttcacaagggatgatggggcaaggattcggtattgaaccgacagatggccaggtcgttgcaccaatcagtggtaaagtaacgatggttgcagcgagtctgcacgcgattggctttacggggaacaatggtctggaagtgttggttcatcttggtatcgatacggtcgaactagcagatcggccaccgtttaaagttaacgtgcaagttggtgatacggtcgaggccggcgaaaaagtggccatgatggatttagcggcgattactagtgcgaacaaggataccacggtaatcatggccgtaacgaatacggcggatatggttaccaaactaacgcccgaactgggtgaagtccgtgccggggtcgtcggtgctgttgttgaattgaaagaacacgttgccgaagcaccggtggttaagggtaagggcggcaagtacgatgaattggcgactcaaatcattgctcaagttggtggaccggtaaatgtgaaaagcgtgattcactgcattacccgggttcgattttacttaaaggacgaagggcaggccaatgacgaggcaatccgaaacctaaagggcgttatcgatgttgcaaaggcaggtggtcagtaccaggtggtgattgggccaacggtgaccgacgtgtatgatgcaatcgtgggtcaactaggcgcaggctttggggatgctgacgcttcggctgttgcgatggagaaggaagcgaaccggttagcgtggcagaaaatgacgccgtggcagaaggtcaaacacggttttagcagcttgattggtgttattacggggtccatgattccagtgattgggttgttggcagcttctgggatcttaaaggggattttgtcgttactaaagaacttcaacctcgtctctgcgacaacgccgacctacgtgattattaatgcgatgggtgattccgtcttctacttcttaccgatatttgttggtttcaccgcagccaagaagttaggggctgatccggttatcatgggaattattggtggggtcttaacatacccagcaattgttagtatggcaacaaccggaaaggttacgggtcacttattgggaatggcaatcaatgcgaacttctttggcattccggttcacgttgcctcctatacctactcgattttcccgatgattgcgggggcgtggttagcaagtaagttggaaccatggctcaagcgggtcatcccgacagtcttacggatgatcttcgtaccgttgtttgaagttgtgattatttctggagccatcattatcatcctcgggccaatcattacagctttgtctggcgcattggccgcaggaattgtggcgatttacaaactcagtccagccatctctggcttaattatcggtggcttctaccaagtgctcgttatcttcgggttacactgggcgattattccaattgttgtcaacgatattacgacaactggacacagttacttgaatgccattgtttccgcaacgatggttgcccaaggtggtgcggtcttagcaattgcgctgaagtctaagtttgctaatattaaagaactcgcttggccagcaacaatctcagccttctgtggggtcactgaacctgcaatgtacgggatcaatctgaaatacggccgggcattcattaccgcaagtatcggtggtgctgtcggcggtttcttgaccggactgtttaacgttaacatgtggggcttcgccggatcattgatcggtgtgacctccttcatcaatcctaaggggcttgattttagtttctacggtttcttgattgcctctgctatcgacttgattgtcgcctttacgttaacgtggatgtttggcttttccgataatgatgtcaaaaacgttaagaaggcgcctgaaaagaagcaccttggtcaacaggttgcaaattagggcttaactatttttagaaaagcatttcttagggctgctcttgtaatgagggtagccctttctgtgtatttaattttaacgatgtagcgacgaaatgtttccgaattaatggcggcaatgggtgacgttaatatcataagcggccgctttatttgacaaatatatcgatatttagttaaatgtaactaataaagttacatgaaagggcgagttaaattgaaatatgcgattacaggtgccactggtcatttaggacaacagattgttgccgcgatgagaccgttagtcgccaccactgaattatatttaggggtccatacactcagtaaggcccaggtataccaacaacaaggtttgcatgttgcggctattgattaccagcagccagagcagttacgcgcatttttccaagacagtgatgtcctgatctatattcctagtaaaagtcatgatagttattcgcgggtccaagaatttgagaacgtcttagcagcagtccaacaggcgaatgtgcatcatttcctagtcatgggtttcattgccgatcaggtgaataatccatttgcattatcagcattttatggttacgtgccccggcgattagctggaagtgatattaactatacgattgtccggaatgcgctttacgcggatccgttagtgccatatttgccagaattaattgaacggcacaacgtcgtttatccaatggctgatcaggctctcagcttcatcagtcaggcagatagtgcggccgcttttgctaaagtcgccacaacgcctgatttattacaacgtggtcgaatctatacgttaacacagtcccgagcttacacgatgccggaactcgctactgtgcttagtcaggtgagcgggcaaccaatcgggtatcgaccagtgtccttgcaagccttcagcgatatgtacaatcagaatggtgaggggccaatgttggcctcgatgtatgccggtggcgcccgcggactattagccacagtaagtgatgattatcagctgattatggatcgtcccgcccagtcattgctggattacttacaaacaaattatcagaaaagttaattaatcacggaaaattccaagcgagttaatggtcgcgacgaaattccatgctataatttatatcaatagcaactttggaaaggagtcgccagtatgactaacgggacgcgtgcagatttacgtgagctttttcataaaggacaattaactattggcattagtgaactaagcagaatgactggtgtctcgccacgacaactacggtattggcaaaaaaaggggtacattattcctaagaacgaggatgagccgggccaggctcgcgtgtatacaatgaaaatggttatcaaggcagccgcgatgagtaatttattgcagactggttataccttgaaggcggcggccgctcaggtggatgagcggatgcgaccagcccaaacaatctatcatctgcttgccgatcgttaccaaggatatgaagtggcggataatggtcagatccttgtcgacttgggaccatttgatcctcagcctgaccaggaactatttgtcaaactcgtgggggataaagttaagtttgaattgaaggataattcgagaccagatagttaggcaccatttgataatgagagttaatactagactgttctgaggaatattgtaattggatagtcttagcagcgtgatttcaggataatgaaatcacgctgcttttttatgattgatatcaatagttaattaattcagtaaatgatttgtcttcctgtaagataacgcgcaaaatcggggtaatattagtcacaataggattcgagattaaacttctaaagcaatcttcaagtatatggccgacagcacaaagaataataacttatgaaaggtacactagctacaagtgtacttttatgagcttaaataatgtatacggttacattatcatatgaattgtaaaagttagggagtgataaatttggcgccgaatagttcaccagcaactcttacacgaatgattattgagttgatattgtcaaaaaggatagttcactatcaagatattatggagtatacgggcacatctcgtaagacgattgctaagtatctgaatgaggtggaaaaggtagtcaaccaacaaggtgtacaccttgttaggaaaagaggacagggtattcgttttagtggtaatacgaagggactgttggctgagtttccgatactgaaggataatagccaaagtgagcaagaacgcagaattagcattatgacattcttgacacagcaatctaaaccagtgttattagatgatattgctgaccacttctttattagtcgtagtacgttggaacgtgatttaaatgttttaaaaatggattatgggttgaagctgacggccactacagaaggcgttaaattcaacagttcggagagtgatgttcgtcgagtgattggtcagctattacagtcatattggggacaagagattaagcaaaatcaacagactggcaaaatgacacgcacatttaaagtgccacagtccctgaaacgatatgtcaataaacaaaccttaaatcagatgcaaaaagtcctgaataaatttgtgaagattttaaaagttgatgtaaatgaatatcaatatgagtctttactgatccatacaactattgcgattcagcgaattaagaatggcgagtttattactcaaacgacgacacagaattttgacactatggcaatatctccgagtaccaacaaattagttaaaatgcttatcgtggccttcaagtgtgaaattcccgatgaagaagttgcttatttaaatatgcatgtcgcggccattgaggatgggtacattgatctggatagaagtggcttagttgaacgaacgatagtcgactggctacgtagcgtgctaacggattatgataatcaattattacgtaatctaacgctacacttacgtccggcgctggttcgcattaaaaatggcattagtattacgaatccgtattgtaatcaagttaaaacgtattttcccgtcgcttttgatcaagcactagcattagcgatggcgattgaaaagcaataccatttacagctaactgaggatgaaattgcatacttagcactgcactttgaatcgttcattgagcgccgaaaggtcttaaaaccagatgttgagcttgcaattgtatgcagcactggttatggtacggcggagttactaaagcaacgtgtcatggacaaactaccggatgttcagattgttggcactttgtctgtgaatgagttgatgacttcaacagtgactgcagacattattatttcgactatcccgttaaagatgagcggtacgagggttattcaagtcagtccgtttttgaatgaccaagaactcaacttattggaaaagttaagtcaagatattcgtcaagaaaagtatacgcggaacgcatttgttaaattattaagtccaaacggtattatcacaaattcaaaggcaactgaaaaaaagatggcgattattcaactaactgatcggctagaaaagtatgggtatgttgataatcaaatgcaaaattcagcgttagcacgtgaacaagttgcatccaccattatcgataaatttgcaattccccatggtgatatcgaccatgttttgcaaccaacgattggaatcatgacgtcgaaaaagggaattaaatgggatcacgaaaatgtccatgttgtatttttcgtagccctgaatcgcacggttgaaacacaaatggatgatatttacagttatttctataatttgattcaagatgggcagcgaatgacggccttaataaaggctcaaaatgctcaagaaattattgatacattagcacagcagtgaaggggaaatgcaaatatgacagaaatttttaaacagaagtatatttttttaaaagaacattttagaacacgtgaggatgtttttagctttattgcacataaagcaattgaacttggctttgcagataacgaagatgcagttttgaaagcgctgtatcaacgagaaaaagaagcttcaacaggaatgcaggacggtatagcgattcctcatgcaatctcagaatatctgcggcaacctgctgtactattcattcgctctacaacaagcattcaagattggccgacatttgatgaccaaccagttaatcaggtaattgctatgctagttccaaaaaatagtgagcaggcacacttacagattctagctaactttgcgagtgcattagtggatgaccgtgagcgtcaagcattacttgaaagtcaaacagttcaggatgtttacactgtattaaccaatagttcggaaaaaattttataaaaagaggatgactgatatggattttgttgcaattacatcatgcccagcagggttagcacatacaccaatggcggcgaaagcgctagaaaaagcagcgcaggaactaggtttacaagctaaagtagaacaacagggtgcaatgggacttaaaaatgaaattacagttgaagaggcgaaaagcgcaaagtttttattgattggttcggatcaaaaaattgaaaagatggatcgatttgaagggattccagcagttcgagttgatattaatatgtgtattaaaaagccgaaagctgttattgataaggtcagcaaagcggttgctgctcgtgttaaataaaatgaacttaatgaagaatggaggagtgagttatgaagaaaatattggctgagtggaagggctacttaatgtctggtatttcatatatgttaccggttgttattggcgggtccctcgtagttgcagttcctaagttgataggtctatgttttggaattacaagttttgatgcgtataaaactggtttttggttttatatgggacaaattgaagccgttggttggattggtgttggcttagttaatttagttttggccggttacattgcatatgctattggcgataagccagctttagccgccgggttcattgggggctcattagcatctagttctaatatgggatttttaggagccttggttgctgggtttgcagctggttatactgcacgttggtgtcacaataagttacatgttggtgaaaagttcgaatctattatgccattagttgttgtaccgctgctatctacaatggttgtggcaatattgatgggagtcattttgaagcaaccgctgacttggattaatgtatcacttgttgcctggattaaacaaatgagtacaagcggtgtaagtgctattaccttagcagttatcatgggcgctatgattggttctgacttaggcggtcctgttaataaggctgcatggatggcaggaaacgttttattagctgaaaagatttacacccctgcaatgatcgttaatgtggctattgctggtattcccttaggatatgcatttgcgacgactttctttaagcatcgtttttctgatgaattacttgatgctggacgaagcgactggttcatgggatttattggaataacagaaggtgctattccgtttacattagttaacccgttgaaattaattccaattaatatgattgctggtgctgctggttcggcgactacgattttacttggggctcaggctaagattcctcctgttggtggggtttatggatttgtcaccattacgaatggttgggcctatttaatcggtctaattgtttgcgctgcgattatcggtgtactggcaccattggctgtggactttaaccaaacacagagcgaagaacaagtcactgatgataatgaggacgacattaacattaattttgaagcttagattgactaaaacgagccgcataatggttaaagagccgtagtgcggcttttgttacctaaaataacagggagcgatacatttatgacaaaagcacattttgtaaatcatactcattgggatcgagaatggtattttacaactgaggacgcacaggtgctaagtgatcagctgttctcaaatgttttgaaggagttagaaacgcatcctgaagctaattttactttagacggacagacatcaatactagatgagtatgttgaaatgcatcccgaagatgttatccggataaagaaattaattaaccgtaatcaattatttgttggaccatggtatacacagactgatgcgatgatacctgatgcagaatcaattattcgtaacttagttattggcatcaacgataccaaacaaaagtatgggcaaccaatgatgattggctatttgccagatacttttggatttaattcgcaattgccaatgctcttaaatcaagttggcattaatgactttattttttggcggggcactaattttaagcgacaaatggactctgtttattttaaatggcacagtctaggtcatagtcaagtctatgctgctaattttccgttaggttactatactggtcaaatcgcattggattcgaagaaaaacttacaagagttcgttgcaaaccgtctagatccaggaattgattttgaaagtcaacagggtcaaaataattcggtcctagtgccttcgggaatcgatcaaatgaatattattcataacgtatctgagactattagtaagataaataaatatagtcataatcagattgtgatcagcaattatccgaagtttatgcgaacattacgacaacgcaacgatttaccggattatcaaggcgagttgcggtatccaacttatgctagagttcatcggacaattggttcagtacgttcgcgcattaaacggcagaatttcaaactcgaacagcaaatattacgacgtgttgagccactgatggtcatcgccaaaagatgtggtatcgatgtgtctaagggtcttattttgaaactttggaaaaagttgctagaatgtcaaccgcatgacagtttgggtggcagtgtttctgataatgttgctattgatattgaccatcgattcaaacaaggttttgaaattgcagacggtatcgaaaactatatcaagaaaagaatcgcacaacggttgaaactggatgccaatcaggtgctagtattcaatactgatccacgcccattcaatggatataagaaaatccgtttcttaacatcatcgaaaaacattatgtttgatgaaaaatatcaagcaactattttaagtgcaaattatgtggctaagcgagaaaatatcatgcaacaaacggctaaaggctttgaatttaaagacgagcctggttactatgaattacaagtacaagttgcagtccagtttgatgggttgggctaccaagtaattgactttaaggatggtgcagaagctttgccagaattacagtctgagcaacaaacggctatccaaaatgaaagttggaaagtgaattatgtcgatggcaactttcaggcaactactaatgggaaaacttacaaaaacatcattagtattgtagattcgggtaatgatggtgatacgtacgattattcaccgcttcgaggcgacaaagaggttgacttgcctttagccggcgttgtagccatttatgttggagctggaaggcaagaactgcgattaagcggcaagtggcagttaccagaaggcttggctgacaggattagtcacgaaccaaagctgcacgatgtcgcatttgaattaacgttgactttaactgatggtgacaatgtattggcaggtcgtttaactgtcgataatcaggttctagatcatcgattacggttaaaaattaatacagcaattgaaagtgacactgcagttgcgcaagttcaaggcggctttcaaagaacacgtaatttaccaattgcggaaaattgggaagaagaatttgttgaaaaaccggttaacctttataactttgataaaattgtcgggatgcaaggggctagcgatggcctgtatttaattgctaaaggaatgaaggaatacgagttaggaaagaaagcattttatgtcacattaatggcaaccactggtcaacttggtaagcctaatttactgtggcgaccaggtcgtgcttcaggcgatacaactagtattggacatcagatgacaccaacgccgttggccgaagaattaggagcaaatacatttgagtttgggttagtttccacgtctcaattgaatgaaaataaattggcaataattgctgaaaagtggttagcacccgatgttagttatcaattacaaaaattgaatttatttgtaaatcgattagacaataaaatttgggatgttgaatttgatgattcattaccaactatctcagagtgcgagtcatttttgaaactcgatccacatgtcacaattagcgcgttgtatccggcctatactgtgccaaatagttttgttatccgtttggcaaatgaatctggtgtggctgctgatttgacccccttgttaaaacaacatttcattcaggtaaatgctctggaagaggctcaaccatgttcggaacaattagtgattcagccttatgatatggttaccttgctcatacacaatcagggggcatagctcatgcgtttgggaagtattgaagctggagggactaagttcattttagcaattactgatgagcactaccgtatcttgaagcgacaacgagtagcgaccacaaagccaaatgaaacgctggcagcctgtgtttcattttttaagaaaaatccagtcgatgcgttgggaatcgggagtttcggcccagccgatattaaggtggattcaccgacatatggtcagattttaaatacaccaaaagctggttggtctcatacggatgttgtacagatgttgagggcagctttgaaaattccaattacttttacaacggacgtaaatgcttcggcttatggtgaatatatgattggacaaggacaagcagtgcgttcactagtatactttactattgggacaggcattggtggcggtgttatccaagataatcatttcataggtggtatgtctcatcttgaaatgggacatacaatggtcatacctatgtcaggcgataacttcaagggtgtctgtccatatcatcaaaatcggtgctttgaaggcatggcttcaggacccgcaattgaggctcgaactggcaaaccgggggaacaattgaagcgaaccaatgaagtatttaagttgatcagttattatattgcacagctggtctttgatgcatatcttaatttcatgcctgaaagaattgttattggtggctcagtagtaagcgaaactgaacttccagtgattagaagagacgttgagcagcttaataacaattatgttgaattaccgaacttagatcatttgattgttttaacgggaattgctaataatggttctgcaacgattggtaatgtcgccctggccaaaaatttgatattttaggtaaaaagagtcgataacaagtaacgttatcggttcttttactttactatgaatgaaaaatggtctggaatacttatttatgacttgattcatgctacagtagaatctataaggatacataatataagtctacgcttagcatagccatgattaacttaacggaggaaaatcaatgatcaaattaatcgtaagtgatatcgacggtaccctagtcgacagtcaaggacagttattaccggctacaattacgggagttcaagcagcggttgcacggggggcacaaatggtgttggcctcagcacgttcgcctaaggggatgtttggaattgcacaacaactaggaattaattcgaccatgattgcctataatggcgcgctaacggctacgaccgatgtgaatgatcgactaactgtttttgaagagcaagccgttgaccctaaactagcacaagctgtgcaaacggtagtagctcatgattggccagctgcctcaattagtatttattcgaataataactggttggtggctactaatggcccgtgggaacagcaggaagcgacgggaattggttatgcaccccatgtcacggatttgggcacatggttgcaacggatgccgacgccagtgcataaaatgatgatcatggccgatccagatattattcaggcgattgaacaacgattaagccgtgatgaatttagcggcttagcagtttatcgttcgaaagaaacttatttagaaatcgttgcggcaggcgtaactaaagcagccgcattaatgaaattattacaggatgatcaagttacccctgctgaaacgattgcgtttggcgataactttaatgatgttgcgatgctccagacagcggggattggtgttgcgatggctaatgcgccacaacccgttaaagaggcagcgaacatagtaacaactgataataatcataatggtattcagctaaccttagctcagtattttgctgatgttacgcgctaattaaaaggccatttacgaatcattaaaaaataggaagcccaacgccatgttcgttgaacttcctattttcgtattgtagaagatatttaagagaaacttacagctagctcgttattagcgcgctaagatttctttaatagctacactggcttccaatggttgacgtcccaagacatgagctaagtcggctgacttttcagccagcgcaccatcattgattggggattggaatgaggcaaacaaagcagcggtatcatgatttagaccagtcgtttcaaggaattgcacgtacgcatcctgactgacttgggtaatcttaacttggttgccagttgcttcttggagtgcttgaccgagtgcggcataagtgaggggtgtcccagcaaattcgtacacttcttgaggggcatctgccatcaaaacggttgctgccgcttcggcatattcacgttccaaggcccagccagctgtattattagcccagtacaaggtttcttggttatgggcaccactttgtaagaagcccatttcgttttctaaataccagttgttacgaagaaaactgtgcgcaatatcagtcgcttttatggcattttcggtggcccgatgatcattggctaaggcgctgactgctgcctgtgcgttgggaaaactagtgtaggcgacaaatttaacatgagcggcgttaagggcagtcacgacgtttttatgagcggtggcccggtcaacgggaccaccaggttgtgatgaaacgaagagcacgcgttcaacgttctcgaaggctttcgtcattgagtcgacatcatcgtaattcccggtacgaattggattatcaggaaacagctgagcagctttgtcctgattacgagcaattactaaaacattttctgcaccaactttagcattcagcgtactaacggcgctttgaccaaatttaccagtagcggcagtgatggcgtatttcataattaaaacatcctttcaaattgctgtagcaataaaaattacagtgattagcttatcacatgtaacttcaaagtcaacaagtttgcttccaataaccgaaaagacaattttcgtatgctgacatttaatgaatggctaagaaaaataaaaacgagtattagtgcgaatttctgtgactaatgaagtttcaccgctattgatttatgtccgaaaaaataggattagacaacttggtgttatctaatcctaatttataaaagtcagcgataaatggtggcgtttacttattattcaacgacgtcaaaattcgctgtggtgcctgtccgttgaagtcattggtttgtagccgttcaaaaacgtctttcataatgtgcattaattgttgatcggacaaaccttgggcagataatgtattgagcatgacttgcagcaagtcgattggtaggaccggtcgctgttcaggatgcgcactgaagaattcctgaacggcttggtcgtgtaagcgccagtaaactgggttttggacatcatcaaaaatcgtttttagttgctctagggccggtgatagcggaatgtttttggcaataatcgtcgttagcatcccatcacgagccgggatacgaacatccgccacgtaatcttttaatagtaagaaatgagtcttgaatggtggccgtaacgtaaaggtcatcgttaatgcaatttgactatcagtagctgccatgatgattccccctcatatgattggcagtgagtggcaaattaatgacgcttcgtgaagcggacgacggcttcgcaacgagctgtttgtgggaacatgtcgatcgattgaatatagtcgacttgatatccgcgggtaagtgcttgtaaatcctgagcaagcgtcgatgggttacatgaaatgtagacgagtttttccggtgcgctttgtaagatggcatcaattaagacgttatctaaaccagtacggggtggatcaacgaccattgcatcaggcgcaaaaccgctcgctaaccattgcggtaacaagacttccgcctcaccaacttcgtaatgagcattagtgatttgattgcgttgggcgttggcattggcatctgcaacggctgccggaatggtatccattccccgaacttccttagccacgtcggctagtgataaaccaatcgttccgacgcccgaataagcgtcgaccagcgtctcattaggcgctaagttcaaagcttcgcgtgctaagcgatagagtttcttggtttgctgcgggttcaattggaagaaggcccgagcagataaatcgaagactaggccgtctagctcctccgtaatagttggtttgccggccagtaatgttgtttggtcaccccagatcaatgaagttttaccagcattgatattttgcatgaccgacacgaccattggcagtttttcagcgattttcatcaataattgatgctttttcggtaacttgggtgtatttgtgatgaagaccagctgaatttcaccagtggcggccgcttcacgcacaacgattgtcttgacgatgccagaattatgttcttcatcgtaaatcggtacttggagttcctccagccaagccacgacttgacgcatgactgtcattgtcgccggcatttgcaccgaacaggtcggtaagtcgactaggtcatgactattttctttatataagccagcagcgacgtgcccatcaattaaacgaacttgaaattgggctttgttgcggtattcataaggattagtcatcccaatggtgggccgaacatcatagtgtcgataaccagctgggcggtatttttcgagtgcttgacgaattaaatcttgcttaaaggctaattgggccgggtagtcgaggtgttctaattcaaaaccaccgacttcgcccgcataggcatcgcggggatcgacccggtcaggactaggcttgcgaatactacgaatcttagcttctaggtaacgtgggtgcacggcggttacttcagcaacaacgacttcttcaggaagggcgcccttgacgaaggtgatgacgtgtttgtaatagccaataccttcaccgttaatgcctaaacgccgaatggtcagtggaaaacgctggccgatgttaacggtcgcttgcactttttcatccggctgttgtcggcgccgatcattgtgcgatcgggattggtgcgaataatgattagattgtggcataagtttgattttgacctcgtttttctgtgaactgtgttaacctccattatagcatgtggaaagacacaggataactgaggaggattgtttgaaagtcgcctaacagtcaggttataatgattctaaattagtaatcgggggtgggcatatgaattcattgattagtttagaaaaagttaattatcaaatcgctgatcaacatattttacatgatgttgattggcagatttcagctggggctcatattacattgacgggaccatccggtggtgggaaaagcacgttattacggatcattgcggccatgatttctaaaacaagtgggaccttgatttttgatgggcagccgattgaaagctatgacccaatcatgtatcggcggcaagtctcatattgtttccaacagccgacgctatttggtgagacggtggcagataacttagctttcccgtaccaaattcgtaagcaagtcatggatacgcaacgagtggtaacggcgttaaataatgttgggctgtccgaacgaaccctgcatcagccgattaccgagctttccggtggtgaacggcagcgggtcgcgctgattcgcaacatcttattcttaccaaaagtgttgttattagatgaggtgacagctggtttggatgaaaataataagcaaatcgtgcacgcctggttacgacagttaaatgagcaggatcacgtgacaacgatcatgattactcatgacgcgacagagattgctgcggcagatcaattagcgaaagtggttgctggcagattggaggtacatgcatgaatttagcagttaataatacgtcgctatttttggcggcaatgttagtgctcgtcgcgttaggaattagtttgtggcagaaacttggcttggataaggacatcgtcattggtgtcgtgcgggctgttgtacaactatttatcgtgggttacttgctaaagtatattttccgagtcaacaatttgtggctaacgttggcgatgatgggcttcattatcttcaatgcggcttggaatgcgaaaaaacgggggccggggattgaccatgcattagccatttcgttattagccatttttgttagtacgggggtaacactcggcgtcctcgtgctatctggtgcgattaagtttgtgccatcgcaaatgattcccatttctggtatgattgcgtcgaattcaatggtcgcaattgggctggcttatcgcagcctcaatagtcagtttcatgaccagcggcaaggtgtgcttgaacggttggcgttaggggctggtctactcgacgcttcgattgccatcgtgcgtgaggcgattcgtacggggatgtcaccaaccattgattcggcaaagactgtgggtctagtcagtctgccagggatgatgtccggtttgatctttgcaggggtcgatccagtacgggccattaagtatcaaattatggtcacgttcatgctcttatcagcgactagtttggggtcaatcattgcgtgctatttagcttaccgtaatttctataatgaacaaaaacagttgaagtaatgactcctgattgcagtcccgcggggagtcctttatgatggaagctgaaataaaacttaatgcgggggtattgatgtgaatgacgcagcggtttgggttccagttccagcaatgttttactggggctggttagtaccactcatatttggaaccatttttggttggcgttatcatcgcgataaggttcgcctaggtaacggtatttggttttcgctatttttctattcgtttttaaccatgctggcgattacaattttaggtagcaatatccactggttgatcattatcagtgggacgttgtttgtgttgctgatcctgttgattgggctgatttttaccttacaagccttcttgctcttatggaatgcgtggatcatgtggcgtcatgagagtcatacgttggcgaatatgctgaccttgtacttgggactggccattctgattttgccatttttaggcaatctgttgagtagtcatgtgccgcagcccgtgagttattttttgacggtatttccgaatctggtcattttttaccttggtttttggttttataactatctgacgatgctgacgatttatcaattcaattggccccgtctgcgacaagattatattattgtgcttggggctggcttgttagatggagaccgtgtctcgccattgctagggcaacgaatcatgcgtggactgcgcttttatcagaagcaacaacgcaagacgcatcatcgggccgtgatgattttctcaggtggtcagggtggtgatgaaacggttccggaaggccaagccatgctggaatacgccattgcgcatggccttcctgcaacggatggctgggcggagacgcaatcgaagacgaccttgcaaaatatgcagtttagtaagcaattgattgcacagggccctgttaaaaatccacgcacgatttttgttacaaataattaccatacctttagagccgggatgtttgccaagcaagcaggtctaaaagcggatggtattggtgcgcggacggcgcgattcttcttaccggatgcgatcattcgtgagtatattgcgatatttgtccgaaataaatggtggcacgcggtggcgatgcttggtatcttgattgtgtcgctattattgacgtggtttgatgtctatcaagcatcgttatagcgattactaaggctgaatcagtaattaaaatattccaagtcaggtgcacactggcttggaatatttttttggctggaatgttaaaaatgaagttatcgaaatggcaggatacttccatttttttactggtggactaaatgttttaagggcaaacgtttttagtgaattcattttgaaaaaccaatttgtcttgacaattacttgaaaggtcgttatattaattatggaaacgattccaaatagggggtgagcttaaatgacaacgattagtgaaatagcagctgaggctggtgtaggtgttgggactgtttcacggtatttaaaccatcggcctagtgtttcagttgctaagaagaagcaaattcaggcagcgattgaaaaactggattacaccccgaatgccattgcgagtcagctacgcgcgcagagcactaatacgattggtgtactggtatcaagaatctctaaccccttctttgcacagttatttgatgcattggaacgggagttaaacggatacgggtttcaagtgatggtaatgcagactcatgatgatgcgttggcagaacaacactttctggataaactcaagcagcaacaagtggatggcgtcattctggcatccattgaaaatcaacaactagtggcacaattgtcggcgacatatgctaatcagatggtgctgttgaatgaagaagctactgatattggtattccaatgatcagtttaaatcattatcaggcaactaaagatgctttggcatacttatatcatcaaggtcatcggcgaattgcctatgccacgggtggtgattttcccagtacgcatcatggacgttcgcggacgcaagcctatttagatttttgtgaagagcagcagttagttgtaaacaatagctgggttttcgcacaacaacatacgattgcggatggacaagcgttggggaagcaattagcgtccttaaaccctattgatcgcccgacagcggtgtttacaaattctgatgaggtggccgttggggtaattgatgagttacagcaacaacattttcgcgtgccagatgatatggccgtgataggatatgacgatcaaccatttgcggcggtggcccaagttccattaacaacggttcgacaaccggtcgcggcaatggctcaattggcggtcgatcagctattacatcacttgggccggttacaacgacctgagttaacgattgatctaagcttagacttaatcaaaagaaaaagtgcttaagcctttttcttttgattaaagtggaatcgattccaaatataggagtagtaattatgcaaaaaaattggtggcaaaaagaagttttttatcaaatttatccggcatcatttaaagatgctaataacgatggcattggggatttgcgtggaatcatccaaatgttaccccggttgaaacagctgggaattacgactatctggttatctccaatatatcaatcacccatggttgataacggttacgatatttctgactaccaagctattgattctcggtttggaacgatggctgattttgatgagttgatggaagtaactaaacgattaggattaaaagtcattttagatttggttatcaatcatacctctgatcagcacgtgtggttccaatctgcaattaaatcgccgacgagtccgtatcgtgatttttatattattcggcgtggggcacacggcaatccgcctaataattggcgatcaaactttggtaaaggctcgtcatggacgttattgccaggaagtcaggatgagtattatcaccatgtcttttctaaacaacaaccggacctaaattgggaaaatccggctctaaggaaacgaatctatcaaatgattaattggtggttggcaaaaggggttgcgggttttcggatcgatgcaataacattcataaaaaaagatcaagattttgccagcattagtcctgatggtgttgatgggttaggtaaagtcaaacgtaaagctgaaaatcgacctggtattgaaaagttcttagctgaattgaacacggctacttttaaaccagctaacgcggtgacggttggagaggcttcgggggttagttatgaccaacttggacaatttattggtaaaaaaggttacttctcgatgatttttgactttcattacgcagatattgatattgcatccggatcagagtggtatcgacgagttaagtggacaccgacggacttacggcgcgcaatttttaaaagccaactggcgattcaaaatgtcggctggggagctaacttttttgaaaatcacgatcagccgcggagtattgataaatatattcagacaccagcttatcggaatgaaattggtgccaaagcactagccttactttattttaacttgcgcggttgtccatttatttatcaaggacaagagctgggggtgacaaatgcacggcgtgactcaatcaccatgtttaacgacttgagcagtcacgataattatgatcgtgctattgaagagggatattcagcaagcgaggcacttgcctttgtaaatgctcgttcccgggataatgcgcgattaccatatccatgggatgattccgtcaatcaaggctttaatcagggtgccaagccatggattacaccaaaacagtcacatgatagggtaaactggcaaagcgaacaattagattcaaattcagtttggcatttttatcagtcattgattaagttacggcaaatatcaaatttaaatcaggatttaatagtcggtgattttaggccaattacttgtgattgtgaccaagtgattgcttatcaacgtggtcgaagggtacaggtgtatgttaacttaagcgcaaaacggttattactaacgttacctaatggccgacctcgattaaataattacgcacattatcgactcaatacgttggaaccatatcaagccattctttttgaggtgaattcaaatgagtaaaaactatcaggtacttgcgaaaaaaattattgatattgttggtgttgacaatgttgaatcggttactcattgtcagacacggttgcggtttgttgttaaagatcctaagcagattgataaagcagcgcttgaagacttagatgaggttaagggagtctttttcggttcaggacagtatcaggtcattattggcactggtgttgttaacgatgtgtatgacgcgattgaaaagttacatttagttaatgcaatttatagtcaggaaacgacgactacgccgactcctgataatcagaagtcaccattgcaacgattcatggcaatgctttcgggaatctttattccaattattccggtgattgcagctactggacttttcttgggattacaaagtgctttgactaacaatcaggttttacagttgtttggaacttcatctgccgcgattccggcaagtcttaatacagtaatttcagttttaacggggactgttttttcatttctgccagctttaattgtttggtccacatttcgctattttaaaggtacaccaattgtcggtattgtgattggactaatgctcgtttccccttcactgcctaacgcgtattcagttgcgggtggtacagcgaaagcgattatgctttttgacaagattccagttatcggtagtcaaggatccgtattaacagcgttagttgctggttttcttggaagtaaactggagcattactttcataaacacgtccctaacgttctcgaccaaattttaacgccctttttaacgatgttagttacttttggtattatgattttaggggttggcccggttgtacactggattgaaaatgtgatgattagtggtgttgaagggttgattaacttaccatttggaattggtggttttttgattggagccgcttatccgttaatggtgctagttggtattcatcagatgatgattgccatcgaaacgtcactattagcagctaccaagctcaatccgttaattactttagaagccatgtatggctttgctaatctgggggtagctttggcgatgattttacgagcaaagtcacaaaaggctaaggctaattttattggcgcattttcctcgcaactatttggtgtttcagaaccaaccttgttcggggtcttgattcgctataatttcaagccgttggttgtaaccgttttaaccagtgggataggtgctggcgtactgagtgttatgagtgtggcagcaaattcatatggtctagccgttgttccctcttatctgatgtatatttacaatgctcgtgatttgctgatttatacggtcgtctcgttattgacggtagcagtggcttttattgccactaatatgtttgcgattcctaaggacatattaaaatctgatcaagtacaaccaaagattgtagatgatacgatattttcaccagtttctggtaaaagtattgccttgagtacggttaacgatccggtctttgcatctaagatgatgggggacggcattgcaattaagccacaggaacaggggccggtaaaagtctgtgcgccacaaagtggtcagatgagtgttgtagccgatacaggacatgcctatgggttaacaaccaataatggagttgagttgttgattcacatcggtattgatacggtgtcattaaaagggcaaggctttaaagttatcgttaaaccggggcaaactgttcaaaagggtgatctcttaggtgagtttgactcaacggtgttaaaagctgctaacttagatgacacggtcatggtgattgtgacaaatagtaaaaattatcaacggatagaatcagaacctaatcagtctattcagtcgggagcagcactgctggcgattcaagggcgtccggaaatgacgactgcaacagcatcctaaacgtaagtacgataaaaccgcgatttgccatgagcaagtcgcggttttattttgaaaatttgagtaagtgcagtactagcatggactagctagcactaaccgtaatatcaccattgctggtcgtcagtcggtattgtacggctgccgattggttgacctggtaatcaccgccatcggactggagatgattgaaaatatgcaagtccccatcgctagtgctagctttaacaccggttgtccgtggcgcggttattcgaatatcaccgtcactggctgtagcggataaactttcagtgatgcgattattattgagcataatatcaccttcgctacttgttagcttaagggctttgaactgattattggttagatggatgtcgctatcagcggttataatttttgaagcagtcttggtaaaatgactgtcggtgatgctgatatctggatcgctattgatttgtagactaggcgccgagacacgagttaaccgtaaattatcgccggtcaacgtcagcgactgattgactttgacatccgttaaattaatatcgctatccgtactaagacttttcaattggtcgacggtgacgttttgcaacgaaacgttaccactttgactagctttggcggttatttgatgaatagtagttcctttaggcaccgtaattattgtcgtgtcagcaaattgtccgacgttatcgaacatgaagcccacggttttggcgttgtgtgtcgttgaagtaacagtgacgtgaccattgttggtcgtaacagttggtaaggcgcgcgtggcggtaaccgtgatattagcagctgtgccttgcttaatagtaatattgttggccgttgcaatcgtgacatcttttagctgactgacgtgatagcgccgcgtcttatgatgaacgatatggaagccttgatcccaataaacgctttgaataccgttattggcgattccaaacatggtcaaaatcagtccaatgactaataaaataatgccaactctaattgtccttcgcatggtggtgacctcctcgttccgcccgatttttcttaacaaatcggtggtataggttttgtacgattttggcaattccttgcagaataacgctaataagccagataaatagtggtaaaactaatagctcggcaccaataatagcaagaccgctacctaggtagaatagtgcgacccatagcgactggccgaagataccgatgccggctgttagcatggcaaatgcgaggatggtcacgccaattaagatggcacccgctgcaatcacgaatgcaaagacggtaacggccaaggcaaagaagaccgctaaaatagctattaatgcgggaattgtgatcggtgttgataataaagcaagcacaattagccaaatcgtgcgtacggttgcttgagatttttgccgtttagaagtattggcattgagattttcgttaaaacgaatcgaataatcggctaacactttccgagccaattgtttaggcgttcccagttcggcaacgcagtcatcataattggcgattgccgcgtctagtaagtattcgcgataaaattcaacgacctcgtcgcgttcatcatcggtaagttgaacgagtaacgcgttaaatttggataagtagtcgttcatggttcatcctccccctgaagtaagtggttaatggccaaataataggtttgccactcttgttgaatcgcactcaattgtgtcaggccggcgctcgtaatctgataatagcgtcggttgcggccttgataggcctgatcgtaagtcttgacccagtcatttttcttgagtcgtcgaagcactgggtagagcgtcgattcggacaccgagatggcggcttgcaagcgctgcgttagcgcgtaaccatagtaatcttggcctttaaggcaggctaaaacgcacccgtccaataactcggaactaatttgaatggccattgctattcctcctgctatattatacgtcgtatagtattgctcaatgagtagtatacagtgaagtgaaactaactgtcaaacttaaatattaaaataatgataaaaggtaaactacctttagccactagtaaacgcaaaacgtgcttgctaacggtgactgaaataggcccgtactaaagcttaaaatcatgatgctcagcgaataccagctgtccggtacgcaagggtgatactatactgatctgataaggcctagaaaaatgactgatttcgatatataatcattatattgaaatattaatacagttaattgtcatggctgagttaattattatcgataatattatgacggagggcaattatggaaacggacatgaagaattgtgtggtttgtggtgaacgaattccccaaagtgcccagtattgtgaaaaatgcggcagtggacaaccgacagttgctgaggataagcgtaaagacgcggaaacgacgactttaaagcagccgcatcatcaaaaaaagagcttacggacgtggtggttttggttgccaccagttatctgtgcgctagtcattgtctttgagattggatttaatttgtatcaggctcgggaagctaatacgcttgcagccaatattcaatcagaaatcagaacgaataaagctgaatatggcaaggttaaagtgagttggaatggtggtgccatgcgtgtgcgaatatcaaagcaagcgccagttattgaaagtgtcgatcaaggcaagaccgcttcgtggcagtcactagccaagacactgcaaagccgctctgaaaaaatcgcgaagaatcacaatcaaaaatattcacatattgaggttttgtcgcctaagaacaccaaatatatgtggttggaagtcaatcatggcaagatgaaattcaatattgcaaatcagttgaattagctgaccgggttcacgacataagcaatggtgtaaatggtcccggatggtttttagcaacacaatgagtgataaaagatggtcgctgaaagacgccgacacacacaaaaagcccggttttccgggctttttgtgactatcaactggacgctatcaaatagattgcgatggctattggtttgtgacgttaccaccaaagtatttattagacagtttctttaaggtgccatcttgacggagttcttgaatcgctttagacagttgtttttggagtgaggcgtgctttttagtgacaattgcgccaatcttttgtgttttgatttctgaaccaccactaatgaatttcaagctggcctttggattctgcttgaggtaagcatagaatgcttcccgtgagttgattgttccggcgacgcgaccttggtttacgaggtcgatcgattgttgaaagccatcggtcggtgtgacggtcgcacctaaacgtttagcatcggtcgcgttattactagtcgttgtttgggcaactttcttgcctttgatatccgtgatcttgttaattgaggaccccttcttgaccgctaattcggatttagagtagatataaggcgtagagaagaggtatttttgtttacgttgcgcagtttcagcgatatcgttgatgaccacgtcgtatttgtcgacatccaggccagcaatcaaggagtcgaatttcgttgggacgaactttgccttgagaccgagcttcttagcgacggctttaccaaggtcgacttcaaaaccagtcaacttaccgtctttgcgatagctataaggctggaaggtgccttctagcccgatcgtcaacgtgccgcttttttgcaatttgagctgactactcgtgctagaagtgctgcttttagatgagctagaattaccgcatgccgtcaaggtgactgttagtgcgagtcctaaaattgttaaacttactgccttgagccattttttcatatcgattacccccgtagagctatatttttttgacaaaaaaagtcgtcctttatcgaaaaaggacgactgctgatcgtggtaccaccttagtttccaagcgcgtgcacaacgcttggctcaatgagctaattcactcagtacactaacgggtacgacgcgttactggcttgctaatgctcaccaataccatttagagaccatcttcgtatcactgtccgaccgttttacaccaaccaacggctcgctttgcgtggcaatcacactactcatctcatcacaatgtttagatattgaggctagtctacaagattaaataacaattgtcaaatcgaaatcacattttatattaatctaaatgccatttgttgtgaatgcgccagatcgatggttgacgtgagacgctagggggtgctaaaaaacgtgcatctgactgggattttccagttagatgcacgttaactcaaatgaacgctattggtttgctttgtctgaaatcgtggtgaacgtcatcgcggctaagaagtcggcaattcgttgcgttggctgcttaaagaattcagcgggtgtcccgtcgaacagaattttgccatcttcaacaaataggatcttatccgcaactgcgcgggcaaattccatgttgtgagtgacgataatcatggagtcttcttcctgagcgagggctagtagaacgcggagcacaccagcttcgagttcggggtctagcgcactagttggctcatctaacaagatgaattcgggatccatcgctaacgagcgcgcaatcgcgacccgttgttgttgcccaccggataattgttcggggtaggcgtcggccttatcttgcaagccgacccgggccaacaattctagcgcggactttttagccgtcgcggaatccttttttaagacttgcacggggccttccatgacatttttaacaacgctgagatggggaaacagattataaccttgaaagaccatcccagttttgcgtcgaatattgagaattgttttattagtcaacggcttagtaaagtcgatagtttcgtcattgaagtggtataaaccttgttcgggccgttcaagcaaatttagtgaccgcagtaaggttgatttaccagaacccgaggggccaacgatgacggtcgtctggtgttctttaaattcagtattgatatcggttaacgcctggtgatcgccaaacgtcttatttaagtgttctaatttgatcattcgacaacctcctaattaagtggccgtaagtaacgtgacgtccgcttttccaagtagccttgtagccagctgagaatcgtacatagaattgcgtatagggcagcaaccagggagtacatcacaagtggttgataattttgagcagcaatttgttggctgacttcgaacatttcaataatcgtgattgaagcggccaaggaggtgtccttgactaagctaataaaactattggatagtggcggtagtgagactcgcgcagcttgcggcaaaataattcgtttgagtacttgtgacttggtcatgccaatcgagtaggccgcttcccactgaccttgaggaatggagagaatggctgctcgaatcgtttccgcacagtaagccccggtgttcagtgaaaaagtggcaatcccagcagtccaggggtcgagctggaccccatttggaaagagccctttgattttaaggtagggaagcccgaaatagacgataaagagttgtactagcagtggggtactccgaaagagccagacgtagaagttagcgatggcttttagaattaaaaaccaaccacgacgagtcgaaatcttgacgagggccgtgaaaatcgcaagtatcaaaccgagaataaacgaaataatggcaatcggaatggtatattttaaacccgctgcagcaatttgcggcgttgatgtgacaatgatgtgccagattgaatccatagggagcctcctgtaacaaattagaatttggtgctatgtatcccgccataatagcgggcaatggtacgttacttatcagtaacgttaccaccaaaatacttattggacaatttctttaacgtgccgtccttacgtaattcttggattgctttcgagatttgtttttgcatcttagggtgttgcttagtgacgatggccccgattttctgtgaggcaatgtgatcgccggaatcaatcagcttaatgttagccttcggattctgcttgaagtaagcatagaaggattcacgagaattaatagtcccagcgacgcggccttgtgagacgaggtcgatcgactgttggaaactatcggttggggtgatggttgcacctaaacgtttagcatccgttgcgttattgctagtcgttgtttcggcaactttcttacccttaatatcggtaatcttactaatcgatgagttcttcttgacggctaattgtgatttagaataaatgtaaggggtcgagaagagatacttcttctttcgggccgccgtttcggacatgttattcatgacaacgtcgaatttgtttgtgtctaaaccagctactaacgaatcgaacttcgttggtacaaatttagcttttagtcccatcttcttggcaacggctttcccgaggtcaacttcgaaaccagttaatttaccgtctttacggtagctatatggttgaaaagtgccttctaagccaatcgtcaacgtccccgatttttgcaatccgaggtcgttagactttgaactgctgctagtgttactaccacaggcggtcaatgtaactgctaaacctaacccaagcactgcaacgcttaattttttaacccatgacttcatgattcacactcctagaaatttttcacaacactcctagtttatccgaaaatgaagctgttaacaaaaaataagcattgagtgtcgcaaacggaccaatgcttattttataatcggctagtatagcgttagtgtagcgaatcagagaaggactgtcaaacccttttttatcagtaaaagcgacgcaagcgcgggtgctcaaactgatacagtataaatggtcgtaaagcgtacggcttatttgatgtggatcctgatataaaaagtgctaatattcaggatcacgaccactcattacagctgacagatgtaatcaaaaaatgcgactaatcgcaattattacggttagtcgcatgatgagtgggtcaagttagaattggggtgcgaacgatgctgctggaacaattactggtgccggttgtaagatgtggccaaggcgtttaattcccagcgtaatcgtttcgacgtcgagactggtgaaattcaatcggaacccgtttttaaccttgcgacttgcgaattggcaagcggatggcacataggcaacgtgtgcttgcggtaaaacaacgtcattgagcaaggttttagcatcaattccttctggcaaggttacccagatgaagaagcccccattaggacgggtgtagtggacattttgcgggaagtattgatcgagtgcggctaacatcgcgtcacgtttaatccggtatgaagtactaatagttgcaacgtgatcgtcgatgtcgtgttgatctaggtagctgttgatagcagccagtgttacatttggcgattgaacatcgattgcggatttcagtccgaccaattcgtgcatgattgcgtcgtcagcaacaatccagcctgttcgcaaggccggggaaagaatctttgagaaacttgagataaagatgacgcggccttcagtatcgtagtgtttgatagccggaatattttgaccactataacggaggtcccggtacgggctgtcttccaaaataatgacgtcgtactgattggcaagggcaacgagtgcttgacgacgtttggcactcatcgtcgtacccgttggattgtggaagtcaggaatcgtgtaaatcaatttgatctcaggatgagctttcaaggttttacgaagttgacgaatattcatcccattatcatcaactggaatttcgtagtaagtcggttcgtaagtgtcgaaggcggctaaagcccccatgtaagtcgggccttcgacgaccatggcatctccatggttcaacatgagcttcgccacgaggtcgatggcttgctgaccaccttgggtcatcatgacattgtcggcactaacttgaacgtcagcatgagtcgccattcgatctgcaattttttggcgtaatgccggcaacccttgagttgatgagtattggaaaatgccttgaccatcgtgttcaatagcatcacgataggcttgctttaagtcgttgtcagggaataagtgctgatctggaaaaccaccagcgaaggaaatgttttccgggtttgcactattcttgaagacctcatctaggtcggaagtgtcattgtttaacacgcgatttgcaaataattttttcataataattttcccccactcagttttttgtacttaaactgttttctttgattatcaatatgataaaataaagcttgtaattagtaaaactcaactttttcaataataagtgaaataaattcacctaagagaggtaaatcattatggcaaacttcgcatatgaagtcttttcaacggtcgttgcccaacatacattctatcaagcggccgctacgcttaacgttacgccaagtgcggtcagtcattcgatcaatcagttggaaaaagaactgggttttccgctattcatccgtaaccgttcaggcgttgaacttactagtgatgggcggcaggttttaccctatgttcaagagattctgaatacggaaagtaacttgcgacaagttgccgataatattcaaggattgcactctggatcggtacggatcggcggtttcagtagtgtctgtatcaactggttaccccgaattattcgcgaatttaatcataaatatcctgatattaagatttcagtcatgcaaggtaactttaatgaaataaccaactgggccaagatcggtactatcgatattgggtttacgtcgatgccagtcaatgagaacttattagtgcattcactgatcaatgatccaatctattgtgtgacgcccgctgattttatcccagaaaatggtgaattcatcacgactgatgacgttgcggataagaactttattctacaacaaagcgattatgaccgggacaccaagctggcactggaccactaccacgttactaataactttttacgattctcgattgatgatcaatctattatttcaatggtagaatccggtttaggcatgggcattttgcctcagctagcactacggaagctaactggagatgttaacacgttttcctttgccgaaccttataatcgtgagattgccttagttgccaacaaaacccaggcagccgctccttcaacggctatcatgattcgtgctattaaacagtttttgaccaaggagtatccggatcagatgttatggcagtagcaaagttaggcagagcgttggcgtagccagcacagacttcagtggcattgagcatgtttcgggaagccactcgaaaggtagatgaacgaccgcctaactggtgcaattagtcgttaaattattatttactactaagaactttgaacaaatgttaatgggacatcaactgttttgaatacctcagtataaagatcatggaacagtcgtaattctattatcagactgacagttatatggcaaagtcgctgtcgctaaaatagccacggccaattcatcagaaacggaatacgcacatgtccgccattcgaacgctatcccgactggaaggcgttgtaggacgcgctcaaccaggcagggttggcactaacttaaacttttttcagcggacttaagctggctgcttttaacgttaaaggcttactacgaccagatcgcacaattaaagctaaaaatagccgcttttccagtagaccaagttggttgtcaggaaaggtggctattaatcttttagatatgttttagataagcactctgagcaaaaatgatggctaggtcgattggacgggtgaaatcagtttataaacgtttgaatcgtattaccgatttgatggttgttgagtaagccggattgggtgcgccatgagcgcaacactttttgttgatagacctttaccactggcttgaagatagattgaccagtcagggcactttgcagtggtaggggttggtcagctttgatggcttttccagcgacaatcaatacctgcatcttggaatcaatggtatggcggtgtgcaatcaatttagctagtgtggccgtttgcgacttggcggcaaccggcgtcgtttggcgacgattgttactttggcggctggtaccgttaaatggggtggccatcagtacaaggtgttgtggtgataagcttgttgttgtgtgttcgacatagttagtggcagtaagaccgccacgaccgtaactgacaaggttaaaccggcgaaatttaaactgctggcgggcgacggttaggagttgctttaataaatgcgtttgtcggtttgaatcaaggttcttgggcagttgcacttgtatgtaggggcggttgtcactgttgagcaattgtcctttaaatgtcacggtccccgtcgctgtaattttggcggtgaccagtgtctgagtggcactactgttctgaatatgggcagttaattgctgaatctgattgtgagttaagtggtcatctagtaagagcaccattggaatacgttcagtagaagtcactgttatggtggtgaccggttttgacttgtggacttgttgttgccaaagcatggtaccaccgatcattgctagcagaactactagccaggtagcgcctgtcaatacttgttttgtcgttgctttcatatttcccgttactccatatctccaaataaactgcacttttaatgtaagccactcacagtcaacttgcaactgtttatacacacttttagatagcaaaagtcccgaccaagtaaatttggtcgggactccttaaaggtatcagtcatgtgctccgaatagggcagagactgatgctttaagattacatatggtactcaaaaagcatcaccccctttcattaattgtccgtagtttagtcccatttaatggtcaggtcaactaattagttcgcaaacggactaaacgcggtataatagaattccttggcaggggcactccgcggttgcgggggacttaacgactgaattttcagttgtcatcaagtcagttcatcattggtttattattcaaaatgggagctgatagaaaaagttcgattcaatgacgaatcgaacttttttgatcagaaagcatgaattacgtgtaaattttgatacgagaaaatagactggagttcttactggtttgattgattatgcaaccaagcgtgtgattgccaaaggatactaaccagtagaagcaaaaggccaattaacgaaattatagcgcccaatcgtaatccgggtgtatgatattgtaatttgactttatgctgaccagcgggaatttttgcaccaacgaaacctgtattaacaacttgagtcttagttggtttgtcatcaactgttaagtgccaaccagttgaatatggaatcgaggtagttaatacgctggcagtttgtgcttgagtgcgacccgtaatggtgttgttagttaccttttgttgtttaaggccgtgcttttgaatggccttgatttgacgctggtagcgccccttaaatccaactgccattaattttacatgatggatttttagttcaggcacttgactaaaacgaacggtcacgattcttcgtaaatgacttgaatagcctaaatttaaaataacacgttttcgaatcgaataattcgaaagattagttggtgattgttgtgaaaagttgttacttcgataagcggttgatgcggataaatagtaaccgctgagttgccaatcagtatgaagtgcctggcgaaactgttgaatcttagctaatgttgtattggggcgattagcaaatacggcattagccgcattattttgcaaaaattgattcaacgtaggtttgaccattgtcataccgctaacctctaaatataactctttattttgccacttttcaggatgatcaagaattaaatcataggtcaattgatgtccctgacaatcactaactaattgatgtagaccatcttggttagtggtttgattgtcattaacaatttttttattagtagtgactaatttctggcttagtcggcttgaagagttgactggcctgtcggtaatattcctaactttaacggtataggggacagtggtggctattttttgaggttgcacttgtttaacaccagttattggcttatcagtaatcggcgcttgtatcattgcttgctctttatcaacagcatttaatcgttgatatttggctgcgctaatctgagcgttttgcgtggatactaatggtaaaaagttgtcattaacaaaaacgatagttccggttttgttagataatccaccggccactggttgatctttaaatatacgcacgtgcccatcgttgttttttaaagcatgatagcctacgggaatatttttagggtcataacggtctgctagttcaaatatataacggacccccagaaggttgcgtgttgttgtccgaccatcagctgtgcttagtggtgaattaggatcggcctcttgattgccaattgactgtgaaaattggctaatacttctattctgtactgagaaataggatgcaatatcatgggtgccgagcaacattgagatgtttttctttccagaagcagctcctctagcatagaatccaggggttaatgtagttcgatagaaattatcattacgcggtaaagctttttgagcaccatccaaatatttattaatccaactcgtggcacttccacgatatagttgttgtggattggcaactccggaactggtcatagttgcaccaaagccagtattaattagattaagacatagcagagtgaaacagccaattatcagtgttaagcggcttaaatgcatcgcacttgacccgataaaccaggtgattaagacgaatagtaatatatatgatattaggtcgcgcgcactaacgttaaaagtaaaaccatttacgacccaaataattataattaagccaacactggcgcctagaaatagtcggtaatcccaactatcaagttttttccagtcatcgatgagtcgcattgtaagaacgctgaacagcaaagtgcttaataatagccaacgattggagggcgaagatagaacgttgaatgtggctgcaacagctggaagtaataggcctactaataaaataatgagtagactatttaagtcccatcgttgtttaaaatgacgtaacgaatgtaaaatagctaaccaagttaggctactgatacctaaaatgacccaaaacggcatcccatcactatttaaaaccaaattgggtagcgcaatataataacttaatgggtagagcgataatccgttggcaaattggccacctgtacgtgtcgagtgcaacatggcgaggacggtcggaataactaacactgctgcacacgctacaccgactaaaacagcgcttaataagtggtaaatcaattgccaaaatcgtgcatacgtttttgtttgacgatattgttgccaataacgccagattgtgtaaataacgctcccgagtgctaatacgtaagcaaagtaaacgttactggcaaccgtgattgcaattactattgccaggggccaccatgattttcctctgaatactcgctcaattccccaacataataatgggaaaaagatgaggggtaataagaagaagggatgatgcatgccgatgtgaagtgcaaaagcagtgaaggtatatgttaaagaaccaattaaaagacttaagcggctaaagtgccatatcctagcaaatgttaaaaaagctaggcccgtagcatataagcgaatcaaaatcagaaactgatatgcaaattcaattttagtagttggaaatagagcgactaagtagttgaatggatcgccgacaacgtaatacgcaaaagtcgtcatttgatcggctcctaggccaagattccaggaccatccaaataatgattgtgtgccaattcccttaagcattttttggaatgctgttagtattggcaaatgctgtgaaatcccatctactgtccaaatcaaagaccgtccgtccagaaatagtggactataaatgatgcaagttaaaataataaaggctactgtataagtaatccaaactggtactttccccaaatgacgcatgaaattctcctttgtatattggcataaagttttaaaaagattaactaaaaataattgaatgcaaccaacatagagatatagtcaatctcaatgattcccgggttgtaacaacaaaagtctattatctgccaagtaactggtgatttttaactgttatttaatgatttgaggtatttattaactgataatgatttattaaattggcccttgattgatacaatgactttgaattacgggtacttgcggtgagaaatataggtaaattgaatcatgatactttaattttacagattataatgtgtgggttttattattgctattagtttgtaacttaacgacttagagaatactcagataaattactaagttaataaattaattctagtcacaataagttaacggttaatcaagatgggcctaaattttcgatctctgattagcagaattactaaaatttagaatgaaattgggcagacataactaaaattctcacggttaccagcactatttggacggggcctttcaataaattggtacggcctaattaagaacttaagcttttctttaaaaagtgctaccgcaagtgcgtattaaatggtaaattaatagaagtagttttgtcatatttcttacattcatagggaagagggattattcacatggtctttaacttggtagttaatattattgggattgtggtttttattgccattgcctacttattctccaagcaaaagcacgccattaactggcgttcagttggtgtcatgttagtactagaagtcttattggcatggttcttaacgggttcacaagtcggtgtcgacgcggttaaagcagcggcagatggcttcacttggctcgtcaatgtatcatacgatgggatcgcctttgcgttagctagttgggttaacgttaagtcgatggacttcgtcactagttcattattaccaatcttgttgattgtgccattattcgatattttgacctatattggcgtattaccatggattatcaaatgggttggccggggcttagcttacattactggtcaaccaaagttcgaatcattcttcgttgttgaaatgatgttcttgggcaacacggaagctcttgctgtttcgcagttacaattgaagcagatgaaggcacaacgaaacttgacgattgcgatgatgtcaatgagttgtgtgacggcatcgatcttaggggcttacattaagatgatgcctggtcaattcattttgacggcggtgccaatgaacgtcttaaacgctgcgattattgctgcaatcttgaatccggtagaagttaagccggaagaagataccattgcgaaaatctcaggtagtgcggctgttgaagaaactactgccaccactgaaacgagcggttctgaagaattagctaatgaacaagttaaggaagctaaaccagctcgcgaaccattcttctctttcttgggtgattcaatcttaggcgctggtcgcttgattttgattattgctgctaacgttattgctttcgtagcgttagccaaattaattgataagttgttaggtttaatcaatagcaatttatcacttgaaaacatctttggggttgtcatgttcccatttgcatggttacttggttttaacccaagtgatgctttccaaatggcttcatatatgggaacgaaattagtgactaacgaattcgttgtcatgggtgaagtttccagcaaagttaacgattttgcaccgcatttccgggcagtcttaacggtcttcttaacgtccttcgcgaacttctcaacgattgggatgattattggagctttcaagggaatcgttgatcgtgaaaagaacgatttgatttcacggaatgttggttacatgctattatctgggatcctggtctccttactatcagccggtgtcgttgggttgttcgtttggtagtcggtgatataatttaatcttgaattaaacgtaagagtgtcagctattcggctggcctcttttttattaatgaatcatcgggtcatacttttatccggtgtcgtttttaacggtgagatgttcaaggcagttcatgaatttgactagaaaaattgcaaactagaatagctgtcaatgatggctgtaaaagcagacttttcaagggttattgcgattttaacagcggggctgtgcattgattttaagtgttatttacgttaaagttatgaggtgacgtgaaacattgagttgtttcacaaaaagaggacgaatgtgacccctttaaggagagctattactaatgaatccagaagaatttaaacaagcgttagcccaacacgagattgcgctgacggcaaaacaattggcacaatttgcgctgtattttcaactattggtcacgactaataagcagttcaacctgaccacgatcacagcggaaccagaagtttatcttaaacatttttacgattcactcacgccagcattctacgttcctgcgctgcgtgatcaaccgctcacgatttgtgatgttggcgctggagccggtttcccgtcgattccgctcaaaattgcgttcccacagttacaagtgacgatcgttgattcattgaataagcgaatcaattttttaaatgatctagtccaacaattaggcttaacgggtgtgaaaacgttccatgatcgcgctgaaacgtttgctggcaagaagtctgctcaccgggaaagctacgatatcgtgacggctcgggcagtagcgcgcctatcagtattgagcgaactctgcctaccactcgttaaaattggcggccagatgattgcattgaaagcagccaatgcccgtactgaaacggctgaagggacatacgccgttcaacaattagggggccaaattgttcaggacgaggcctttagtttgcccgtgactgctgatccgcgccatatcattgttattgataagaagaagccgtcaccgaagcggtatccacgcaagccggggacaccggcgaaacagccgttaacggcaccaatgtaaggtgggaggtaatttcaatggcattttcattatttggttctaatcgtgataaacataaaaccgaggcggccacgacccccacggagcaacaaattgtccgtattccggtcactgccattatccccaaccggtttcaaccccggcaagtcttcgatgaaactggtattgctgaattggctgctacgattgcggatcacggcttgttgcagccaattgtcttgcgggaatacgaaccgcagaaatacgaaattatcgctggtgagcggcggttccgcgccatttcttcacttcattgggcagatgtgccggccatcattcaaaagatggatgatggtgaaaccgcgtcaatggcgctgatcgagaatttacagcgacaagatttaacggccattgaagaggctcgggcctaccaagaactgatggaactcaaccaattaacgcaatcggcgctagcgaaagaattgggcaaaagtcagtcgttagttgcgaataagttgagattgttgaagttagcacagccggttcaaacggcgttgttgcagcgacaaatcagcgaacggcacggccgcgcactactcaacttggctgtggagcaacaggctgcggttttgaaacgggtgcttgatgatcaattgacggtcaaagaaacagaacagctagtggcgaagacccaaacgccgccgaagcccaaacgcaaacgtgcacgggggttgaccggcgatacgcgaattgctgtgaatacgatcaaaaaatcaattaagatggtaactgatgccggcttacccgtgaagacccatgaagaggatacggatgacgggtatcggattacgattgaaattccaaaaaatcaaccaaggggtgatcaataattatgggaaccgtaattgcactcgctaaccaaaaaggtggcgttggcaagacaaccacgagtattaatctcggggctagtctggtcgaattaggccaaaaagttttattaattgacacggatgcgcaagggaatgcgaccagtggtttaggtgttcaaaagtcgaccatcgaacgtgaaatctatgacgttttaatcaatgacgttcccattaaagaaaccattatcccaacgagtcataagggtttagatatcgttccggctacaattcagctttctggggcagaaatcgaactgacaccgatgatggcacgtgagacccgcttacgtgatgccatcgatgacgtgaaggatgattatgattatattttgatcgattgtccaccgtcgttaggcttgctgaccattaatgcgtttacggcttgtgattcgattttgattccggttcaaagcgagtactatgctttggaagggctgagtcagttattgaatacgatcaagctcgtacaaaaacattttaataaacagttgcgaattgaaggcgtgctattgactatgtacgatgcccgtaccaatctcggagcccaggtcaacgaagaagttcggaaatactttaaggacgccgtctataagacgattattccccgcaatgtgcggttatctgaagcacctagccacggcctatcgattgtcgattatgatgcccgttcgaaaggtgcgcaagtctacttagctctagcaaaggaagtgttggccgctcatggcaagtaaagataaagataataaggcgctgggacgcggtattggagccctgtttgccgatgttaacgaaccagctagtgaagaagccgtggttgatctagatcttaaggatattcatgccaatccgtaccaaccccggcgaacttttgatcagacggcacttaaggagctcgccagctcgattgaaaagtccggcgttttccagccaatcattgtacgacaaccggatgccaagctgaataaatatgaaatcattgctggtgaacggcgttttcgggcgtcgaagctcgctcatcaaacgactattccagccattgtccgtgatgttaccgaagaacaaatgatggaagtagcggtgcttgaaaatctacaacgggaagatttaactccgcttgaagaagctgcggcctacgattcgttgatgaagaagctgaagttgacgcaggcggaagtctcaaagcgcctaggcaagagtcggccatatattgctaattatttgcggttattgggcttgccagatggggtcaaacagtatatccaaaagggccaactgtccatgggccaagctcgaacgcttttgtctttgaagaataaaaccaagttagcgccattagcgaagcgcgtcgtgaaggataacatgacggtccgtcagttggaacaaatcgtggcgcgttataacggcgagtccaaggagccggccaaaaaagttgcacccaagaagtcaccgtacatccgtgcgagtgaagaacaattacaagagaagtttgggacggccgtttcgattcaaactaaggcgaacaaagctgatcaagggaaaattgaaattccgtacttgtcaaatgaagatttgacacggattttagaaattctcagtattgatttaaattaattaatttataaaggggcgttgcgcatgtatgatttaggtgatattgtcgagatgaaaaaggcgcatccgtgtggtgtcaatcgctgggaaattacccggatgggcgctgacattaagattaaatgtacgggatgtggtcacgtggtcatgatgccgcgtcgtgagttcaataaaaaactcaaaaaggtattagaaagcaaagccgatcaagcttaattattaaaaaaggaagagtgaataaccgatatggcacttacagcaggtatcgttgggttaccaaacgttggtaaatccacattgtttaacgcaattacgaaggcgggcgccgaaatggccaactatccatttgcgacgattgaccccaacgttgggatggttgaagttcccgacaaacgactagaccgaattcaagaaatcatccccgcaaagaaggtcgttcccacgacttttgaatttacggatatcgccgggatcgtcaagggtgctagtaagggtgaaggacttgggaacaagttccttgaaaacatccgccaagttgacgcaattgtgcacgtggtccgggcctttgatgatgacaatatcacccatgtgacgggtaaagtcgatccgcaagatgatattgaaacaattaatctagaattgagtttagcggacttagaagctgttgataagcgtttggctaaagtgcaacgggctgctaaggggagcgataaagaagctaaggctgagctcgctgttttgcaaaagatcaaacctgccttggaagccggcaaacccgtgcgttcactagaattcaacgaagatgaccaacaaatcgtcaagggcttattcttattaacgtctaagccagtgctgtatgtagccaatattgccgaagatgacatggccgatccagaaaactctaagtatttccaagtggttgcggactatgctaagcaagaaggagcccaagccattggtgttgctgctgaaactgaagaagaaattgccgaactagatgatgacgacaaggccgactttttagcagctgaaggcgttgaagagcctggcttgaataagctgattcgggcttcttacaagctattaggactggaaaccttcttcacggctggtggtaaggaaacccgggcttggacgtttaaacgcggtactaaggcccctcaagcagcgggaattattcactctgattttgaacgtggatttattcgggctgaagtgatgtcttacgatgctttggatgaagccggttcagaagcaaaggtcaaggaaaatggtaagctgcgtttggaaggtaaggactatgtcatgcaagatggcgacatcgtcgaattccgcttcaacgtttaagctgaaaggagcaattgtatagtgagtgagagcgaaacttcaaagacacctaggaacgccgcggccggggccaagcaggctcaagccgcagaacggccagttcacgaagcgactgagttgacgaagcgcaatgctgaatatatgcgtcagatgcgcaagtcacttgatgccacagcgttgagtggtgagaaaaagacggcagttctgaatgaaatgacgtctacattgttagcggaacaaggtcggggaaccacggctcgtcaattatacgggaccgttcaagaacggaccgaagagattgtgaatccaaaaaagacaccggtagaacgtcaaaaggcgaactattgggtcacggcgctggataatggcttgatgctattcatgattttctgcttaatgtacgggatcatgggcttcatcggcacgaacgctactaagaattcagctggtgccaacgggatcaccgctattctgattacgtccgccattggtggtttgggcgttgctaagttattcgaatacttaatgcctgctaaagatggcaagaaagtttcgttatggaagaaaatcgcgtggtcagtactggctatcatcgtttggatgttagtctttacaaccatgtcaatgattcaaggaccattgaacccggtcttaccaggaatcgcgtacttgatcattgccgtcgtcgtcttcttcgcccggatgtggttgaagcggcgctttaatattacgacgagcatgttttaggctcggactgaaagacaagctgatggcgtgcattggcttgtctttttgtcgattgcaagtggtcattgcttgttattcacctagttagcttttaaactggtgatacggatgtaatgactgaatgaaagttgtgtgtgaagtacgctcggcccaacctggaacattcggttgggcgttacaggcttaaaataagaactttctgaaaatctgcgcaaccccttgcatttatcgcgatgttttgttacctttacagataaaaataaaaacataaggagctaacgttcaatgtctaattgggatacaaagtttggaaaaaagggttatacgttcgatgatgtactattaattccggccgaaagtcatgttttaccgaatgaagtcaatttaggtgttaaacttgccgataatttacagctgaatattccaattattagtgcgggaatggatactgtttcagaatccgcaatgggaatcgcgatggccaaccaaggtggcttagctgttatccataagaacttaagcattgaagcgcaggctgaagaagttaagaagatcaaagcggtcgttaaggatgatgatcacccacacgctgccgttgatgccaacaatcacttgttggccgttgcggctgttggggtcactagtgatacctttgaccgggctgaagccctatttgccgctggtgcggacgccatcgttattgatacggctcatggtcattccgctggtgtgcttcggaagatcaaggaaattcgggcccacttccctaagcagacattgattgctggtaacgttgcgacggcagaaggcacgcgtgctttatttgaagctggtgttgatgttgttaaagtggggattggccctggttcaatctgtacgacccggattgtcgctggtgtcggggtgccacaattaacagcggtttatgattctgccagcgttgctcgcgaatacggcaaagctatcattgctgatggtgggatcaagtattccggtgatatcgttaaggccctcgctgctggtggcaacgccgtgatgcttgggagtatgttagccggaacagccgaagcaccgggtgaggttgtctttgacgatggccgtcaatacaagttctatcggggcatgggttccgttggggcgatgtcacaagctcatggttcgtctgaccggtacttccaaggcggcgtgaacgaagcgaacaagttagttccagaaggtgttgaaggacgtgtgccattcaaaggcagcgttgatgatattatcttccaaatgttaggtggtttacgttctggcatgggctacgttggcgctaaagacattgatgccttgatcgaaaacgcccagtttgttgaaatctctggcgctgggctccgcgaatcacatccacatgaaattcaaattacaaagaatgcaccgaactattcagtcaacggttaaaatgacgatatcgtatgagtcagtctgattggtttagttgaataagcatcaagtaagcgtagaacatcaactttgttctacgtttttttgtctggtgagtaccagcggaagatataggcagatgtaacgttcgtgtagattgaccgtagtgtttctttcttgttgggacgttgatactagctctgtacacgattgtgttacttattaagttcattagatttttaatgatatcgtggcattagtgatgcaaagaaaggggctaatataaatgaagtatcggttaataggggtaggtgcgagtctagtcgtcgcagtcatgttaacagggtgtcaagcgaaggctacgacattggtcaagtcagatgctggccaggtcacacaagcggaagtatttaaacaaattgaaaaccaagcgacgacgcaacaggctgttcaagaattgactctaaacaaagtccttaatcaacgatatcatgtttcacaagctgaagtaactgctaaattaaaagcattcaaacggcaggcgggcgcaaattatcacatgattttagaacgtaatcatgtcactgaaccgcgtttaaaatcgcaaatcaaagcgaatttattgatggagaaagccgttagtgctaagtatccagtgactaaagcgcaactaaaaaaagcccgagcagcttatatgccaatgacaacggttcaacacattgcgacggccaatgagaagcaagcgcaaaaaattattgctgaactgaatgcgggtgctagctttgattcgcaagtgcgaaaatatcagaataatcgacaagcgcacacaactgctggaaaattagcgcagtttgacagttataatcaaactctagcaccagcaattgtacaggccacagctaaactacgagtgggacactatgtcacgaaaccggtcaaaacagttatggcaactgccgacacgaaagacaaaccaacttatgaaattatcaacgttgtcagtcgtcgatctaagactgcggctgtaactgatgatagcggtaagcagattgatgtgacaaattatttgcgtgaaaaaatccagcaacagcggatgatggacaagcagacgcaagttgcgacgattcggtcagttttcaaagcggcccacgttaaggtagttgatgcccatttcgcaccagcgtttaatgattatttaaccacccaaaatagctaacaatagaatcatcagcaatgatgtgatgattatgaacgcgtctcttaacctgtcatgggttaaaaggcgcgttttcgttaggtactgatgattaattgcgctatgatggacttattaaaacgtattgtaccagtttagtgaggtgccaaattcaacatattaagtaggtgagtagatgcaacggtttcagtcacgccatttattccagttacgagaaattggcttgggcttaacctgtatcggtggctttattgacgcatacacattcatccaacggggtggtgtcttagcagctggtcaaacgggtaatttgatttttctcagtgttgatgtggcacagtggaatttaccgggtgtgttgactaaattagcaacagtcctcttttttacactaggtgtgattgtcgtgggtatactgaaacaatggttgggcgcgcggtcacactactggcgcttgcccgttttggtggcagagctggttgtttgtttaatggtcggcatgctaccagcgactgttagtaatgcgatggtggtcccaccactcgcattcgtgatggcgatgcagacgacagccttcagcgcaatcgccggccacggctataataacgtgttctctaccggtaatctcaagaaggcaacgatcgtgctgacgaattattggttgacaggcgtgcgcatggagcttgacactggtttagtgtattgggaattagtgttgagctttgctacgggcgcgattgtttcggcgatattgcagcggtggtggacattacggacgatatgggttgcggcgggattattgatcttagtaggtggatactatacctggttattagttcaccgtacggcaaatgacgcggaatagttgcgttttctctaaaatcaatcgttaactgccaagcccggacgcttttttggtaaaataaaaacagaattatttaaggagaaaaataagatgaaaattttagtagtcgatgacgacaaagaaattgcacaactattagaaatttatattaaaaacgaaggctatgaaccaattagcgcctataatggccgtgaagctttgactaaattaaatacgaatcctgatattgcgttaatgattttggatatcatgatgcctgaaatggatgggattgaggtcatcaaagaagtacggaaagattcccaacttccaatcctagtcttgtcggccaagactggcgatatggacaagattcagggcttgattacgggagctgacgattacgtcaccaagccattcaatccgcttgaaattatggcacgggtcaagtcactattacgacgttctgaaaataacgtgacgactaccgagcctgatattttggacattggaccgttaacgatcaataaagattcgcacgaagttaaaacgttgacgggtaaggatattcaattaaccgcgttagaatttggtattttgtatttgctcgcaagtcatcctaaccgagtcttttcagctgatgatatttttgaacgtgtttggcagcaagaaagtattgtctcagctaagaccgtgatggtgcacgtgagtcatttgcgggataagatcgaagaagccacggatggagaaaaagtcattcagaccgtttggggcgttggctataagatcgaatcgcgttaagagtgagggttagcttttgaaattaacgggacgcgaaaaaagtgaattattttttgaaggggtagtgacggtgattttgctactccttttaaacttgtcgatcgtagtactgatcaacagtacgattgcgcataatccggggttacagagcggtattttccaaattaaacgatcgattaccattggtcccaataactaccagctatggagttatgaaaacatctttattggactgatgctgattgcggacggtttcgtattatattggcgattaattcgacgatacaaacagatgcagttacgacatattattagtgagttgcattatattgcggccggccactttgaccatcggattgactttaatctgactggtgatacacaacgagtcgttgaaagtgttaatgccttagtagactcggcaatccactcgatggacgaggaacgggaaattgagcggtctaaggatgcgttaattacgaatgtcagtcatgatattcgaacgccgttgacgtcaattatcggctatttaggcttaattgagaacaaacagtaccaatcagaagaggatttaattaaatatgcgcatattgcctatttgaaggcaacacaaatgaagtcactggttgaagatctgtttgaatatacgaaatcacggcagacagagacaccgttggccattaatcggttaaacttgacggccatgttagaacagttagcggcaagctttgagctggaagcgaacaagaagcatctgaagattgaagtagaaagtggcacgcagcctatttacattgaagccgatgctgaaaagctggggcgggtcttcagcaatttgatcactaatgcgtttaaatatggaactggtgctaaaaacgtagtattacaagctgaacaacgtggtgaagaagtcgtgattcacgtcacgaatgatggtcagcgtattccagctgagtcgttgggacgcttatttgaacggttttatcgggttgaagaatcgcgttctaaggcgaccgggggttctggactgggcttagcgattgcccaaagtatcgtggatcaccacggtggctatatttatgcgcaaagtgatgatgagcagacaagctttgttattcatttgccagttaaacatgaccacccattaacaaaaaaacaatcggatatgataaattaacttgtttccacagacataattatttaaactaaaactagcattagcaattaagaaagggataattgagaaatgagatttgcgggaaagttaaagaaagttatgattgccctcgttgcggcagtcacgtttagtacagctggtttaggcattgcgggggctgacctccaggcccaagcagccagtacaccatcgatctctgcgaaagccgccattgcggttgacgcgtcgaccggtcagatcctgtatgataagaacagtagtaagccaatggcgatcgcatcaatgacgaagatgttaagtacatatttagtgcttaaggcgatccatgaaggtaagttgtcttggaatcaaaaaatcagtgttagcaaggcagtcgctaagatgagccaaaacacggaatatgcgaacgtaccgttattatcaacgaagacgtattcagtgcggcaattatataacgcgactgaaatctattccgctaacgccgctatcacagccttgggtgacgcggtagccgggacgccccataagtttgttagcttgatgcggaagacggctaaagcatgggggatcacggacgctaccattattaatgccagtggattaaccaataaagaggttggcagcacaattgggtacagtaccgttgccgccagtgctgaaaacgaaatgtcagcacaagatgttgctaccgttgcgcaaaagctattatcagattacccagaagttttaaagacttctagtattgcccatgcttggtttgaaaagggtactagttcagcaaccaagatggataaccgaaactacatgctcaaaggattagttaaacattactccgcacttcctgtggatggtttgaagactgggacttccactaaggctgggaatgccttcactgggaccgttaagtttagcaatggtaaccggatcattacggtcgtcatgcatgccggtgccgctaacgatagtgggacggaacgtttcactcaaacggctgaaatcatgtcatatgtttaccacaactacacgactacgacgattaacaagaatggcaagatcaatggtgtgaaagccgttgatgtccaagatgggaagtccttaacgtcgcaactcgtttcaaatagtggtgcaaccaagatttacttgccaaccgggacggatgctagtgccgttactggtaaggttagcttgaagaagtcggcgacaaccgatggtaaattacaagcacccgttaagaatggcaagactgtcggtactgttaacttgaacctaagcaagaaagctatcaaggtagttgacggaacgactagtaagaatatgaccatcaatgtaacgcctaagaagtccatcgacaaagcaaatatctttgtacggatgtggcgcggggttaagagctggttcaactaaattatagcagttagtgtattggattctgtgggtgcattagcttagtaaacgctacgagatatttcttaaaagatatattcctctttgagtaggcaagctagtaattgagacttgcctgctcaaggaggatttttttgttggcaatagtgattcatgacaggcaactaatgaccagggctgtgccactgatttagctaattaaaaataattagcatccagagtaatttcaaaaaggcactgtcaaggatgaccaagttgaacggctgcggatgttatgataaaagagtactaatagtcttcatttggcgatgctaaaaaagcaacgtttaaatcgggataattatgaggtgctttgttaaaaattatttcctaaattaagctgtgtgcctatcttagccactacttcgactattcgctacaagcgttccagtttgagtgttctttctttttttgctaatatttgaatgctagctttgcggataaattgcggttccatttatgtagaatttgttagcatgatccacgattaactgtataatgaagactgataacagtagttaaaccgaatggagtgaaagtcacctatgagcgtatcattacgaactgcaaccatgtcagatttacccattattgtagatatttacaatcaaacgattcccagtcatcaagtgacggctgatcttaaaccagttacggttgagcaacgtcgaaattggtttttgagtcatacccctgaacactatccgctgtgggttgttttaaaggacgactcagtagtcggttgggttagtctgtcaccattttatggacgggcagcgtatgcaaagacgactgaaatttcagtttatttggatcgcagtgttcaaggacagggaatcggtagccaggttttgacattagttcctaaacaattacctgtgttgggattaacaacgattatcgcttatattttttcaagtaatattccaagcattaagctgttcaaaaagtttgggtacgaacagtgggggtttctgccagaagtcgctgaattaggtggccgaccgaatgacttagtgattctgggacaacatttcaagtaaaaaatggcattgataccgcttacatacgcttaaaaacttaacaaggtgtaggattgcaataaaaaacatgttaaaattaagtccgagtgtctaagtaatttgacactcgctattgttgctagaattctttactggtatggtactggaggcattcttggtgaaaaagaacgagccaaattggttagtggtattacgaacagtaatgccgcttgggcttagctatattcccatcgggttagcttgtggggttttattgcatgcggccgggttcaaccatctactgacagcgttaatttcggtaatggtcttttccggtggtgcccaatttttaattgcatcgatgttgacgattaatgcaccgatgacaaccattattttgatgatgtttttcttggagttacggtacgccttattaggttccagcttatcgcgctatctgaaggggcaatcattaccgttcattttaacgtttgcgttttcgatgaatgatgaaaattacgcggtcaactatttaaagtttgcgacggacaagcattggaagccatcgcaggccttaatggtcgaacactattcgttattattttggacggtaagtaatattatcggtagtttgattggcagtgcattgacgattaatctccaagtggtggattttgcgctgacggcactattcatttatatggcaattatgcaagctaagagccgcttgattatcttagtggcagttttgtctggcgttctaacgataggttttctggtcttaatgaagagtacgctgggcctagtggtgtcaacattactcgcgtcgttgaccggttactttattgaacgttacttgttggcacataagccagaaagtcatttactctataaggttcacgatcctactggccaaacagccatggaagaatctgacaagtagggcacagaggggtttttcttatgcaatcagtcagctcaatgagtagtatggaccatttttggttggtcattttttgtgcgtgtgtggctttcataccacgctttttcccgctactgttctttacgaagcggaagatcccagaatggtttaatgaatggatgcggttcgtacccgtctcactattcacggcgttagttgttaaaagtgtctttatcgatagtaagtacgcagtgatcacttctggcaatctggggatgattatttctgctattctcgttggatttgtggcttatcgcacgcgttcaatgactttatcagtggtgattggtctagtctcagtgatgatttttgtgttactaattcatatttagattttgttggaactgggtgacccggttcttttttattatgatgaaaagaggatacgttgatggtatggttattggttttcttacccggattattggctggtctggtccaagggttaacgggctttggtgcggccatcgtcatgatgatctttttaccacagttgtttccgattgctcaaagtgcggccgtggcgggcgttattatggcagccagtgtcataacattagtttggcgttatcatcagcatatccactttcgtcagattattgtgccgtttatcgtttatgccagtgtggcggcctattcggtacatcttggtcaagttttagatgtgcaattattacgacggttattaggtgcgctgttagtttcgttagccgggtactttagtctgagcaaacgtgcggcaaatcagacttatccgtggtggttagccggtctcttcatgattatttcggggttcttcaatgggttattcggtattggcggcccgctgatggccctttattttctatcacttgccgatacgactgcggattacttgggaaatttgcagactttctttttgatcgatgtggtctatatttcgacagtccgcgtactgaacggtattctgacgccagtcttgctcccccatattatgattggtatggtaggtgcggtcattgggacggcgctggcggcacgaattctgccgcggctacccatgacgacagtccggcatttgatctacttgttcattggacttagtggcgggtattatttgattgcgccagtttagaacgaggtatttatcaccttcactacgagttgattttagtggtcaggcgcaatgcgtttggccttttttgatgggtaagaaacgttgaattgttaacaaaaaatttcgaagagtagcgctatcaccttgatgacctatccttggttagaagcgagtcaacttaaatgtataaaatgagcattactaatttaataatcaaggatttgttggctacagttgtgacagtggttatctgttttgggaacagacgtggatgcgtaagatagtgccattgagcgtacctgactgtagcttcttaatcggccttgcgcacggttctaaagttgaacaaccgggattgaaatatttattgttgaagattttttattttaacgatgcttaattacaggtgctacatagctgaaaaaagcattggcttattggtttccttttagtatagttttattctaagaactgctaaattggggagacatatgaatagctacagacgaattcaagttattacagggatttacttgctgatatacattgcggcactttacttttcgacgggggttcaggttggatttaagctggatagtaatcagctcactgggtatgtgagttgtgggctgttgctggccgtaattatggggtcagagtttggcaaacgattaaggataaaaaagctattttccattttgatactagttagttgtttgattattctagggataactagattcaatgttgtgagttttaacgaggccttctggtactttatcttatttgttcgatacatcccgttcattgtattgattgaaaccatcatttttatctttgacctagattgagcaaaccaggccctaatgagttgaatgctcattagggcctggtcttttattattctaaaacctggttatgccgaacttttagctggcgtgagtctgacataggacattagtgaggatgatggcaactacgctaatcttcgtcggtaatcgtgcctagaccgtattgataaagtagttcatcagtacgattaagatcaaagcgctgactaagtgcgaagatgaccagagcatcccattcatccttcgcataaaggacggcgtaaccagttcgcttgagcatcgtgttaagctcggtcagggtcagttgaaaaccgaatccgagggcgatgatgcgagcccggttaggtcggcgcttgccatcgaagtactggtaaccgatcgagggcgttagattagcgcgccgaatgacttggcttttagtgacgtgtttgatttgaataagctcggcgaggtattccgccggattggtacgaataaaactattggccatatttgtcataaattggtcggcctcacttgcatgtttgatttcgttaaatagttccttagttgcgcgttctaccacggttagtgcccccctaatactccttcttaattagtattagtgtaccagaaactactgtaatttaaaggtcaaatgccgatcactgaagtagctgggattgtagatgagttcaacggacccatctgctttggcttgaccagtcatggtaccactgacagagccaccagcggtcaggtcaccactatctaattggttattttcatcaatgttgatctcatctaggctagtttggttaccggcggccttgattttaaagtcaaacgggttatagctgactttatctctaccgctatttttcaatgttacggtgaccgtataatattgattgccagttttaggctgaacatcattgagcgtcgttgcggttttaacattattaaccgttacttgcacgtgatcgatggtggctgtctgcccgactttataaatcgtatttgccggggtttccttagcggtggacttgctagcgctggtctttttggtcgtcgctgcttgtgagtttttaccgtcttgtggagaattgacgaggctgatgacaaagaagatgccaaggagaatcaggacccacgcccaccatttttgataccaagctttcgttttttgcatgagcttacctactttcttagtgctaagccgcccgcaataacaatgagcagaccgcttagaacgtgtttagaatcttttcaagagtattcgcaggaaggctaagctaatcatcatcttactggtgttcagctttcgctcacaattgcgccagaggcg

SEQ ID NO: 12 - DNA, 110338 bp, synthetic construct
  source 1..110338: mol_type = other DNA; note = Lactobacillus plantarum PDG8 - contig 12
ttaagctatatatttcgacggcggatatttcttccgttaaagtcaagcaagccattagattcaaagtcacgcggaacgtaccgaagccaattattttggacggtgtggtcacaaagattggggtctcaccagtcgaggagagtaaagcgactttttatgaagtgacagcggccgttccgattacagccgatcaggcacagttactgcgctacgggatgattgggcaaacggcgattattacgggcaaggtgacttggtttgattattataaagataaggtgctggataataattgatggtggtccatcagtactaactgactaaatatcactgtggtaaagtaaagttatctagaagcacatatatcatacgaaagaggtaagtaatggcacactcaaataaacaattcatcattaacctagtcattgccagtctaatcagcttagcattggtgagctttagtatggcaccggcgtatcttttcctaattaagaataattggttcatgatcacgattggttttgtaatctatgccttggaagcttgggggctatattggctttattggcatacagcacgagttaggcattaccaagtcgcgacgttgaagtcccgggtgaacattgcacaattaggaactgtgattattgcgatgctgacaatggtcgtgctcattattgttgatcttaaattgagcgcgatgctaaatattcccgagaccagcaattccaggtcgttggcatggatgctcggtgaagcaccgcttcccatgattgtttcggtcgtgatattttcccccatctgtgaggaattgatttttcgcggtatctttttcagctacgcgttaacgaatcagtataatcaccgtaattatcagatgatcgcggttgttattaatagcttaatatttgcaagtgtccatgttgatgcaaattgggagccgtggatttattatacgttaatggggggcatcttggggacaacttatttgttggctaagcgcgatattagaatgaatattctggtgcacatggggactaatttggcagttttcgcgttggcggctatgagttaatgttgtggataaaaaattaaaacataagaattggtttatccacaggggataacttgggaggcttggtatggttgctcgattgatcagggtatttggttatgtgttagcgggtttagggctatttatattcattcaattaccggtgttagcggatggctattggaattggtggggtgaacgcccgcaacaaatcaacgtcggttatcattggggagcattagtcgttttaaccgttggtgttgcggtcgtactagtacgttgctatcaccattattttgagatgccagtcctgttagggtatttttcttggtcaatgatggggctgactgctttagtggcagtggtggtcgtggtgattcaaatggggataagtggtctgctagtcagtccaaccgaaacacaaaatgatgaaatcatggcactgatccacagtccattggggttattaacattagtgtgcacaaacatcgttagccccgtactcgaagaattacttttccgtggaattgttcaaaatacgctgcgacgatacttgccagtattgggcgcgattatgctgacaaacgcagtattcgcactcggccatggttatcagttagccagtacggtgggcatcttcattacaggatgcggtttttcatggttagtactcaaaacaaaacaactgagtaccgcaatgggatgtcatatactggtgaactggctggtcacacttattaacatgatgtggggataagtttcagttagtgatatccggtcaaaccgcaagttgtggattagttaccattggggataattatcaggaaatggatgtgaaggagcatggtacatcaaaacgtcaaatttattggtagattactacttgccagtttattggcagcaatcgtgatggggcttagtacggcgcccatcgatattttaacactcaagtataactggataacggtggcgatcttcttggtcgtctacctgtttgcaatttatttattctatcgaatttatctggaatcagttactaataatcattttaagattacgaaaatagttgctaagccgagcgcgcgtcaattagtgattacggtactggcaatggtggtcatgctgattttggcagcggtgcaagttaaatttgttagtgatgctgtctatccaatcgcggagaatgttgctgacttgcaaacattgtctcagcgctcaccgatattgatggcgttggccctgggtgtttttgcaccgatttgcgaggaattaattattcgcggcaatttcttcagttatgcgctggcggaacgttttgatcagccacgctaccaactagttaccgttattgttaacggcgtgttgtttggtctactgcgtggcggttttagttgggtgcagttgtcatactatacggttatgggtctcgtactcgcggcaacctacatattatctggccgggatattcgagttaacagtgtcgtgcacgtcacagctaatctgggcctcatgctaatggcatgaggccagatggacttggcaagtaacttgagtgggttgatttaaaagcccgttagtgaacattctagttacggttgtttggatggagtggatgaaatgttacagaagaatttacggtttattggtaatttactaattgtgagtgtgttgagtgtcattattgtcaatatcagttccttacccgtgtatatttatttgattacggccaattggtttacactgttagttagcttcagtttatatgccgtgattatcgttttcttgtacaacatctataagacgaccgcggaattacggcaatttgattttcgaccgtggcgaacgcggctaaataaacgggccttgctattcatgatgatcggcgcagtcattatcgtggcgcttgcttttggctatgctaagctgacggcggtatggcacatcactgaatcgggtaatgaacgttcattggatttactgttgcggaaaaatccggtagcgatgacactcgatgccgtcatttttggaccaatcgctgaggagctgagtttcaggggctttttctttagttacgtcttgtcagaccaatatcttgaccgggagtaccaagcagctaccattgttatcaatgggcttcttttcggttatctgcatagcggaaatagcttggtgccattagcatattacacgctgttcggcatggtgctggggaccatctacctattatctaagcatgatattcgtgtgaatagcgtgacacatatgttagcaaatctggggatactctggttggttcctagctaaaataggggtcgtactagtcgggtactcagatgaattggatatttgggtgtggtcagctaataataggagcaagagtcggatggattgagatatacacgtgatacgggtataatcgattaagaattttgcagataaggaaactcacaaggtttaccaacaaaaattctctaaacaattgccaccaaccattcagcgattagcattgcgaaaattactaatgattgatcatgcggaaacaattaatgatttgagcctaccgcctgccaatcacttggaaaaattaagtcatgatcgccaagggcaatatagcatcaggattaataatcagtatcggatatgttttgcaattcgaaatggtaatgagtttagttttatgatgttgaaatagtcgattatcatcatggttaggagaccaaaaaatgaatgaaatcccaacacctaaaattagtgaaattcttgaagaagagtttatggctcccttgcatatctctgcatattttttggctcaacagattggggtacccacgtcacggattcaagacttactacatgatcgtcgacaggtgacggttgatacatcgctgcggctaggacgattctttggagtgtcggatcgttatttcttggaacttcaaaatgatattgaaattcgtaatttgaaacagatacatggtgctgaatatgcacagataaaaaagtatcaagtcagttaaataaggacgtagaccgtagttgcttggtagcgtactacggtttttgcaaatataacctaaactgataagcagcagatcttaaattttaaggttatcaacaggtggataaagcagtggcgtttgtattatccacctgttgataatcattgagttggctaattgcactttcactactgggttaactggtcgtgagaaaaatggtcaagcattagtttcgtgataacgaaaaacgactggaagtagctagcgtaataccgctgggctacttccagtcgtttttttattacagttatactcgtacctgatgttcaatcgtaaataatgtcgggtccaattgggtaattagtggggagacatcaccgatgctgagcaatgtcaagtggtgcatcgctcgtgacgcaatcgtgtataagatgccaactgaatccgcatcgggataattggtagcggagacatcgtatgcgaccaccgcgtcaaattctaacccctttgcaaggtagattggcataacaatcacgccttgtggcatggtacggtcgctatcggccatcaacgttgttactgtatagcgcttcaggtattggtagacctgcttgctttctgctaaatctttagttagtacggcaacggtgttagttgccttgagctgatgttcaacttcgctacgcagactgctgagagcggcgtcttcgccatagcgaatcatgaccttaggtaaatcgcctttacgtgtgaacgcttgaatctggtcgccgtcgggtaatagcgctttagcaaagttcgtaatctgttcggtcgaacggtagctcttattcaacgtaatcaagttcgcccgtcggacattgaaagcatccttgaggcgttccagtaattgctgtggtaactcaatccccttgaataatgcttgttcactgtcacctaacagtgtgaacttagctagtgggaacgcgtgcttgatatataacagttgtgctagcgaatagtcttgcatctcatcgacaaagatatattgcatccgccggttctgaccactgccagttaggacatcgcgtaataacaatagtggcgcgcagtcaaccagagcaatccgatggtactcaacggcggcctggtaagcggcaattcgttgttgccattggtcaggcgtcacggtggtgggccgatcaacttgcgctaagaaatcgttatattgttcataggtgtctaagaagtaaccattatagatcgcatcgtagacttgccgcagtcgtttggtcacgatttgcttaccaatatagaagacttcatcgtcgagtgattgaaaatcaccgcggcgcttggaacctaataagtcgtggtaagcttcgtcgctcaattggtcaatgatatcattgacccagtcagcttgggcttcatcgtcaatgcgatgctttaagcgtttaattaaagtgttcttgattgctaggaaacggtcagctggttgcatcgctgctggtaaggccgtcgcaatctttgtaatgacctctttagcgaagaagatttcgccattaaagacgatgttggtgaagcgtaattggtcggctggtagctgatggcaatattgatcgacttggcgcataaagtcggcgctttcttgaaaatcgcgaattgccggtgtcagttgttcacgctggcggtcactttcgtagcgctcaaagaggctttcaacggttaggccttgaaaacgtgcactgagaaattcggcaagcgtgacttgacgcatattgcgctcccctaaactaggtaagacttcggagatgtagtgactgaataagcggttgggcgagaataataccatttggtccgcttctagggaagcccgtgagtggtagagcagaaaagcgatccgttgtaaaatggcggacgtctttccagagccggcaaccccttggacaactagtaagtcactagtggtgtcacgaataatatcgttctgttctttttgaatggttgctacaatattttgcatgtaggcatcattttgttctccaaggacggcctgcaagatttcgtcaccgaccgtttcattcgtgtcgaacatattcttgatctgaccatgattaatctggaattggcgtttcttgatcagctcggtcgtctgctgcccggccggtgtttggtactggacctgacccagagtaccattgtagtagactgaggaaatcggggcgcgccagtcgtaaactaagaaattctgttcagcgtcgacaaatgaggcggtgccaatgtataaacgttcggcttcctcgtcgggactatcttgaatatcaatgcgcccaaaatagggtgagttactgagatctttcaagacaccgacttgccgtttcaagatggcttcggattccacggcgcgttcaaccatttgcttttgttgttgcagttccgcgttcgtttcaatccggtcatcgacttcaaacgtgttgacggaattattatcaccatagtttttctgaatgacatcggtttcgtgatgagcctttgccagcaagtcgtcggtctgttgtgcccgttctttaacttgctcgatgactcgatcaacccgttgttgttcgcgttgttgctcttgatctgatgttgccacgtagagggcctcccgtctgataatcgtctaaatcgcttgaacaattttaggcgggtttagggatgatgtcaatcaaagcgcctgcaaattcactgatttatcagtaattgttgtgaaatgtgattatgagtggcactaaggcgtgctagccaacggtgggcaagttcggcagccttacgatggcaaggctgaaacttgcaacctatgactatttattctaatatgattttaatcattctaataaagtgggtggaacgaatgcgtgtcgcactagcacaacttaatattcagtttggaaatccggatgccaactacgagcagattgaagtggccattcaacgggcagctgagcaaactgtcgacgtgatcgtcttaccggagatgtggaataccggttatgcgttaactcgcctgaatgtcttggcggatgatgatgggcagcgaacgttacaattactcagcaagttagctcggcagtttcgcgtcaacattgtcggtggctcagtcgcggtcgctcgcgatgggcattactataatgagatgttagtcgtcgatcgtcagggacagttactgagtcgttacgataaagtccaccggtttgggttaatggcggaagaccgttatattaccgctggtgagaccgagaacgtttttgaactcgacggaactgttgcgatgggggcgatttgttatgacattcgtttcccagaatggcttcgtaaacaagcagcccgtggcccccaagtgatttttgtcagtgctgagtggccgacagtgcggcagatgcaatggcggctattactgcaagcacgtgcgattgaaaatcaagcattcgtggttgcggttaaccgcgttggcagtgatcctgataatcaatttggtggtcagtcactagttattgacccgctcggccaaattgtggctatcggtggtgcccatgcccagttgattacggccgagcttgatttaacacaagttgaccaggttcgtggtcagattccagtgtttgaagaccggcgcccggaattatactgaagcgtaaattggggactggggctgggagcacttaactgaattttaatggtgttgaaggaacgcccgcttgaatttcgatgggcttaaacgtcgaaatgacggtcggtatgatgaaatggtagcggctagttaacgcgaatgatgcccagaatttattttgacacggtcaggtataaccagtacactagaactaattaatcgttgaagaaaagaacagtaaggcgtccaataacagagacctagcacgtgctgaaagctggggcggactaatgaattggctttttggagattcggtgaacaccggggacccacccttatcggtcaatgagtggcagagacaagctttctgcaatttaggtggtaccacggtgatgcgtcctaattaactagtattagttgatcaggcgcttttttagtgccaatagaaaggatgagtacaatgacaaaaaaagtgattttaacgggtgatcgccccactggtaagctgcatatcgggcactatgtcggttcattacgtaaccgggtcgcattacaagattctggggactatgattcatacattatgattgcggataaccaggcgttgacggataatgcgcatgatcccgaaaagattcgtaaaagtttattacaagttgcgatggactacttggcagtgggaatcgatccccaaaagtcaacgatcttagtccagtctcaaattccagcattaactgacatgatgaatcaatacttgaacttagtgacggtagcgcgcttgaatcgtaacccaaccgtgaagacggaaatcaagcaaaaagcttttggtgaaagtgttcctgccggtttctttgtttatccagtcagtcaggccgctgatattacggctttcaaggcgacgaccgttcccgttggtgacgatcaagaaccaatgctcgaacagacccgtgaaatcgtacggagcttcaataagacttaccaaactgatacgttggtcgaacctgaaggctacttcccaccaaagggcttgggccgaatccctggacttgacggcaatgccaaaatgagtaaatcactaggaaatgcaatttacctttctgacgatgctgatactttgaagaagaaagtcatgtccatgtataccgatcctgatcatattcatatggaagatccgggtaaggtcgaaggtaacgtggtcttcacgtatcttgatatttttgatgaagacaaggccaaggtcgcagacttgaaggccgcctaccaacatggtggcttgggtgacgttaagattaaacgctacttgatggacgtgttggacggtgtattgcggccaatccgcgaacggcgtgcaatttacgaagctgatccagctcaagtcttacaaattttgaaggatggtacagcgaaagcgaacgtggtcgctgaccaaacgtggcgtgaaatgcaagacgccattggaattaattattttaaataaattatggtagaaaatagtgcaactgaccgtcggatgtgtgaagacggtgagttgcacttttttgtagacccttaatatatggggctttccggtaaattaataacgatggcccaacgcatcacggttgcgaattaaaaagaaaaggcagactaaattgaaaattaggctgatttcgtttgctttcttacatgaatgattgtaaaaaagtgcttgttaaaataagtttttggcaagaaaaggggtggtaaggaattcgaaagcgcttgctgtggctgcctttagtcataatataaattcattggtataaaattacgaaaaataaagcgttttcatgtattctgtgataatataatttgtgggcacaagttttacaagcacctactaatttatcgaaaggaggtttagtcatgtatcaggcaattgcgcaggcaatcattaaatcgataatggcggatgaatatccgactaagttaccaaccgaaaaagtgttaatggcgcagtacaacgccagtcgcaatacgattcgtaaagcgattgatgtggtcttccggcatgggttgttacgtcgcgtgcaggggagcggcaattttattatcaaacaaccgcagaacacgaagaaagtgctcaacttatcgattggatttgaccagtccgccatggttgagggtggaccattagtatcaaaagttgtcacgtttgataaagtgacagcggatgaaactttagcacaacaggggaacattgcgcttggtgacgaggtttatcgggtggtgcgattacgttatttgaatgacatcttgtatgacctggaagagtcttattttccgcgaacggtcgtcccgttcttatcgagtgagagcgtgcagcattcaatcttcgccttcttgcgagaggcatatggtattacggggagcaccacggaaaactacgtccatcaagtgcgggtggacgcgcaacgggcggagttgatcggttgcccagatggtgacaaaacgttgtgcttggaagcaatcaattacttggctaatgggacggtctttaacttctccaggacgttcttcgtctatccagatttggaactctattaccataccgaaaatattgatttacaaaactagtacgggggtgacgcaacagttgtgttgggtcactaactagcgaaaacctacattaggagtgaggggtatattatgaattcatttatcgaatggcttaacaaacacttagtgccagttgcggccaagattggtgcagttcggtggttgatcgcattacgtgacgcgtttatagcaattatgccggcaatgatggccgggtcgatcgccacggttctgaacgctttagttcgagatattccaacgaagttcggttggatgggcattgttaattcgatgcagtggttgattggaattaatgcgatggtttggacggggacgttagccatcttaggtctgattttctcatttacatttgggtatcaattggcaatccagtacaaagttgaaccagttactggtgggatcgtgacacttggaactttcatcatgagtttgccacaaaactttaccggcacgttgacgagtacgttgagcaagggcgctactaagattttgacggactctggcatggcggttgctggcaaaaaagtgacggcttggggttacttcaacttcaacacgtactttggttcgtatggtttctttacggtcatgattttaggggccattgcaagtgccgtttacattgctttgatgaagaaacacattacaatcaagatgccagattctgtgccaccggcagttgcaaacgccttcactggggttatcccagccgccgctgcattttatgtcgttgggattattaactggatcttcagtaaattcaacaccacggtgattgaatggatcgcgaagattattcaagaaccactattgaatatgagtcaagggtacggcgccgtcctcttaatgacgctgttagttcaagttttctggttcttcgggattcatggttccaatgtcctggcaccaatcttggacggaatctggttgacggctcagcttgctaatgttaacgcttaccaagctggcgaagccttgccatacgtttggacgcggaactgttttgacttgtatgcatggattggtggggccggctcgaccttactattattagtagcgattttagtgtttagtaaacgagacgaccaacgttcagtggctaagttggcgattggccccggattctttaatattaacgaacccgtgatgttcgggatgccaattgtacttgacccaatctactttattccgttcgttttagcaccagttgtgactgtttcgatcgcctacgctgctttatcagctgggtgggtcgcaccgattacgaacaatatcgtttggtcaatgccaccgattatgaacgccttagttgccacaatggactggcggtcagtggtcttacaattatttaatgccgccgttgcctttgcgatttacgtgccattcgttaaggctgccaacaagattaaaccagcagcgattggagaatagattgtcatgaaaagcttaaagcagtgtttactcatcgggatgaaccttggattattagccgttatcttaagtcccctggccggaacgaccggtcaatgggtgacgctcggattaggtttagcggtcagcgcagcacttttcgtcgtttatcggcgagtgggtcagatagaaaggagccaccagaatgcagattaaattaactttgaacgcccctgtggattatttataccaacagttgatcgattccgcgcgggctgatattcagcagcaaacgggtcggccggcgccacggcggagcttacaaggctatgagtatgccaaacagtggtccaacggtctgaccggtaatttgaagattacccacgcgcaacccggtgttcgatatgcgtatgaattagaaacgccccacgatcattacggcgtcgattatcaattcgtaccggacactgatggtcaccaaactgtcttagaatatgccgaaacctttttaggcaaggataagaagacgaatgccaataataagcttggcgtgctattcctaggatggttccgtaaacgccgctttaagaagatgatgaatcagatggctgctagttataatcaataagtaagttgctgaactgaaaaaaaggatttcgttatttcgaaatccttttttgtgtccaggcaagatatggaagctaatcagttgcaacgagcgtaacttcgtgtatactcaagatacacgggagggatgcgtaatgaaagcacgggtggttggtaattcaacgacattgacaattcctaaaaagttcaatgttgcgaatggcacagagtttgaagcagagcagctagatgatggttcgattttattcaaattgaaacatcgcaatccgttcgagggtgattggtttaatgaccaactagagcagtctgacataaccctggacatggaggacgtcgatagtgaatgggactaatcagtatattccacgtaagggtgacatcgttttaatcaattttaatccgagtgctgggcgcgaaatccaaaagtatcgcccagcattagttgttagtaatcaaaagtatgcgcgattaacaaagctagcgctagtttgtcccattacccatactgccaataaccggatgacggctttggggttgttgatcaaaatcaaaacaccgaaagtcgacggctatatcaatccactccaatttcacacgtttgattacgtccgtcgggatatgcgtcaggttggcgctgtcgataagcaaatattagatcagacactacaagttattaacgatgttgttaatgctaatgaagtatagcatgttgcttaaaatagcgcttagtcacagtgttcaccaatagtgtgactaggcgtgatgttcgcgacgccaaccaatcgtggcaaagttcgcgtttatcggttggttaagcgatgcttgggagcggacgaacggccagcaaacgtcattcctgcaaagcaggcatatcaatgctaaaattaaaagcattcaatccaaaagttaaactagtgataagggagtatgagaacgtgacagcaacaccattctggtcgcaaattgcggcccaagccaaggcagacgggcgaccattttttacgatggccccgatggaagccgttagtaatactgtttttcggcaagtcattagccatgccgctgctccagatacgttttttagtgaattcgtctatgctaagagtattacgaacccgaatacgaagtttccggtgcatggtcggttgtacgtggcggcagctgagtcgcaaaaaccggtcgttcaactgtggggtaacgaagcggctgactttgcttcggctacagctgaacttcgtgaccggggctttgaagcagttgatatcaatatgggctgcccggatgggacggtcatcaaaaatcatggtggcagcgatttgattcgcaatccgcagtgggctgaagacgtgattgcggctgcaaagacgtcgggactggccgttagtgcgaagacgcgcttaggttacagtaaagttgctgaatatcatgactggattgcaacgttgttatcgcaacatgtggcagtcttgaccgttcacttgcggaccaaacaggaaatgagtaaggtacccgcacactttgaagttatcgatgacttgattaaaatgcgtgatgcgatcgccccggaaacgttactccagattaatggtgacgtggctgattatcaggccggggtggcgttagccaaagcacatcctggattagatggtatcatgattggtcggggagtgttcgcgaatccgtttgcatttgagtcccatccccaatcgcatgatttgcatgaactattaggtttactgaacatgcagctcgacttgttcgatgactttgctacccgttatgacgtgccacgttttccgtccttaaaacggttctttaaaatctatgcgcgcccagaactaggcgccactgacctgcgtaacacgatgatggatgccaagtcaacggatgatgtacgcaaaattttagcggcttatcaagccaaaatgcaggtgaccaatcacagttagtgtcagcagcagacaggttgattaaggcagtaatacgttaataaacttcaatcttattatatagaaacatctcgatatcggcagtgagtgctaatgttgggatgtttttgtatctaaaggggtatgacaattgtattcaaatcattggaggactgattgttcgcctgtcgccaagctaatctggatgcttgtaacatcatttacaatgattgtaacgttgtcatcttatcaagaaaaccatgttacaagcattcgttactgccaactagctagtctaatgaacccaaaatgaacggccctagtcaaaacattagcgtcgttcattttgggctttttgatattttttggtgtgcaatccggccctagaagtcacagtgttacatcataaatgttagaataaacctaactaatattttataaacgaaaagtgagcgtggtgttatgagaaacttagcgattgtggatttagggtccaattcggcgcggatggcggtcagtcggttgcacgctaacggcactgctcaagaaatcaagcgtgttaaggaagatacgcgtttgtcggaaggaatgggaacggcacacgtactccagcccgccgcaattgagcgaacaatcaaggcgttactcaattttcgccgactttatgaaaaaatgcccaatacggatgttattggcatcaccacagctgcagttcggatggcacaaaatcaggctgaatttctcaatcaagtcaagcaagaagtggggctcgatttacgggtcttatctggtgacgatgaggcctattacgattatcttggggttgccaattcattggtcatccatgattgcctaatcttagacacgggtggcgcaagttgtgaactgatcttggtcaaaaatggccgcaaacagcaactgatcagcattccatttggcgcggtgacattatcggaacaattcggtctcgacgacttagtgccgtctgcgagtctatttcgggcgcagatgttcctacgtaaccgactggcagatatttggtggttatcagaagcagtgcacttcccaatcattctattgggtggtgccaaccgaaccttagcccgcattaatcggcgccggcaacaaaagttaaaagttgaagatattcacgggtatcgtctgaagacagagacggtgttccacacgtttttggacttactgtcacggtcgaaaaaaggtcgccaggaaatttcaggaatggaatatgatcgtgcggacattattgttggtggaatgttaccgctagtgacgttattacagatgttggatagtgatcgggtgatcttttctgaaagtggtgttcgtgagggaattatttcagaacacctcaattcaataggtcggttcggtagatgagtcgaatggagagaataggaatgagaatatgacagctgattttcggcacttttatcaaaaaaattgggcggaacgtactgccatcgtagcgcaacaggcccatttaacgccagctgaacaggcgttatttaaacaatattatttaccacaacatcatgaaattattgagaattatttgacggattacccattaccgatggggttggctgtcaacttagtcgtcgatggcgtggatcacattgttccaatggttactgaggaaccttctgttattgcggcagcaagtaatggcgctaaaattgtcaagcgtgcagggggcttcacgaccgtccttaatcaacgtgaaatgattggtcaaatcgttctggagcagttgtctgatccggctgcaaccgctgccgtgattgaagcccacgctgcagcattattaaaagtagctgatgcggcccatcccagtttaaaaaaacgaggtggtggcgctcggcgcctacgtacgcgtgttctcggacaaggctatttatcaattgacctattcgttgatgtgcaggctgctatgggggccaatatgctcaatagtatgttggaagccgtggcaaagtccatcggtgtgatgacgaagcaggacgctttaatgagtattctatcgaattatgcaacggcgagcttagtcaaggccatttgtgacattccggtcggattattacaggctgggcggtatgccggcaaactagttgcccagaagattgcgtcggccagcacggtcgctcagcttgatccgtaccgggccacgactcataataaaggtatcatgaacggtattgatgctgtcgctattgctagtggcaacgactggcgcgctttggagagtggggcacacgcctatgctgttaaggacggtcaatatcgtggcatgagtacctggaccagtgatggtcggatgctgcacggtgaactggaattgccactaccggttggcattgtgggcggttcaatcaaaattaacgagttagcccagttgaatcaacgaatattaggtattcaaacagcgggtgatttggaaagaattatggttgccatcgggttagcccaaaatctagccgctttacgcgccttggtcacgactggtatccagcagggccatatgcacctacagttgaaatcgctcgcgatggcagcgggagcgactcctgaggaactccccgttatcttacaacgacttgaattagcatctcaacaagacctcgcaaccacgcaacaactcattgcggaattgcggcaaacaaaggaagagactgatgactgaaattaaattgaaccaaactgttacagatttattaagtaccgccaattcgttatatccgggcaatattagtgttcgttttggtgacacaaaagcgggttacgtccgccatgatcaagcacaacaagtgttagatgatggtgacctgaccgttcgggttagcgatattacggctcctaattacacagcgtcacatgaattattacatctattattgttattacaaggctttccacagattacctttaatttaaccacgcgtgatcaacaactggacgaacaattgatggcaatcgctatggaactttatgacatggtgagccacgtcttggtcgtacgcaaacaacgtgaacataacttaatcgatgagcaaattgaaacgctatacatgcaaggtgtggcggccacaatcgaaccggaacctgcgggcaaggcggatgcgatgatgacgttacggttattaacattgactgacctactcgttttctttaatggtgaattaccagctgatgatttgcaaaaggtgacaacggcctatccacaagcttggccggctgcacagaagctatacgccgtaatcagtcagaagccagttgacaccccgtttgcgatgcggcgtgccgtagtaaagctgtttaaggcttttgatgatcagatgacggcttggcatttaccagtcctacacggaacggaatttgtgaccgttcagagtgtgctcagtgaacggcaagagcggctggaagtccggcagttatttgacgtttaccattcagatctattagataaaaataaacatacccgagcgtacattgggttatataagagtgaccgtcagaatgcgtttgtcctaccagcaccggcgcaaaagaagagcgatgcctttttcaaagaggtgtacgataagacggtcaaagaattattccaagaaatgaatctaccctatacgttacggtaagctaagcagggagatgtcagaatgagtgacattacagcagcacaaacaactttacaacaagctcagcatatcgtttttatgacgggggccggcgtttcgacgccctcgggaattcctgattaccggtctaaaaatggactgtataccgaacaccataacgcggagtattatttaagccacgcgtttttggcggagcatccgctggaattttatcaatatttacaatcaaatttatattatccagacgcccaaccgaatgtgattcatcaaaagatggcggcactgactcagcaagggcgggccagtgtgattacacaaaatattgataatttatatggggtggctaaaacggctcagctcgttgaatttcacggtaatctctatcaggtctactgcaccaagtgtggtcagcatgtcgattggcatgagtatttgaagtctccttaccatcagacagaccatggctacttacggcctaacgtggtgttgtacgacgaggggattgcgagtgccaatatcgaacgggcagttcaatatttacagcaggctgacctagtcgttatttgtgggacctcgtttcgggtgtacccgttcgccggcctaattgactatcgtaatccgaaggctcaagtgcttgcaatcaatgcggaaccgctccagttgccatttgcatttacgatggtgcaacaagatgcggtcgacttcttcgagggggtgcaggtctgatgataacaattggcttaacaacttggacggaacaccctagtttactgggtggtactgaaaagctgaccttaactgaatattcgggagtcctaccagtcgtcgaagtggacacgccattctatggtattccgaaagtgacgacggtcgcgaagtggcaaaaggccgtccctgataagtttcagtttattttgaaagcaaatcaggtgatgacgctgcatgacacttatgacgaaggggtttcgatggatgcgctaaagacagcttatcgggaataccgtgcgatgctcaaaccgttaacgcagcaccagcaattaaaagcggtgctcttccaatttccgccgttttttgaacggtcgaaccgcaacttccattacctacaacggatggtcgagtggttacccggtgttccaatcgcagtcgaatttcgtaaccagagttggtacgaggagagtgtcaaagatgcggtctttagttttctgaaggatctggggattacccatgtgattgtcgatgagccgcacgctttaaatgatggcgttagtttcgagccggtcgtaacgaattcgaaattggcactcttacgcttacatggtcgtaaccagcagggctggtcagccaagggcgctaactggcgtagccaacggactttatatcggtatagtgatcaagaactagctgaattcaagcaaacggtggaacagttacaacagcaggcggacgaggtttgcgtcatctttaataataattctggtggtgacgcggccgataacgcgatggcactcaaagagttgctaggcgtttcgtttggtgatttaggaccgcatcaactggacttgttttaaaatgatttatgagtgattgatgtgatactttgcttaattgaacgagttatcagttgaattactatgttggatcaatacagtcactatgaccgtgaaccgttgaaatttggtagtacggttgaatattctttaattgatgaatcatgacaactaaaaatgtagcggtagttcggacattcaataatgtgagctgccgctacatttttttgcacttacaccttagttaatcaatatggccttagccatctgatttgaaagcgaacggttgggatacatcatttggaagtaaagttagtgtaaagtcaagaagtagtttatgtaaattcctgtttagttttggtaataattatctcgttggtcgtggatacgatggcttgggactgccttaaaactaggcagttataagtaccttaattcatgattcttaggtgaattagggtgattgagaaaagtgcgtgattaagatacactgacttcagttcaagcaactaagtagttgcctgccattatgtgagttgcagatagttatggcaggttgaagtgttgttgagaatcgaatgttaggtcataacaatatagattggggcggattgggtatgcaaccggatattatttgcgcaaatggggttttctgcgctgatggaaaagtcttattaacacgggaatcaaaaaacacagcttattattttcctggtggcaaggtcggtgtgggagagacgctaacacagactctgcagcgagaattaaaagaagagttgtcattagttgtgtcgccagatcggtttaagtgggccttcacccaccgtggtacggcctataatcaaccgggaaaaatagtcgagttaaattgttttttagttgcggggagtggcgcgctcaaagtcgactcggaagtttatgattataagtggtgtcggccggacgatagccggatcgcggaagtcgttcgtgaagcgctggcccgatattcgtgggttgttgaataataatagattaccaataaatgaccggttaaaatcaactcgtgattttaatcggttattttgtggtggttggttgggccatttgaagcatggtagttgactagtctgccacgatctttgcgtgtggagaactcttttgttagtgtttcttaataaacacaggaaatatgatacaatataagagattctacacattggcccagcaacatgttattttagaccaagacgtgttgtttggacgcgtgtgatttgttcatggattttaatcaaagacatgcttaacgagttaatcataaaccagtttgaagggaatttacgtcatggcagaaacaaaaccaacttattatattacgacgccgatctactatccttcggggaagttgcacatcggtaattcatacacgacaattgcgtgcgatactttagcacgttacaaacgtgcgatgggttacgatgtttacttcttaaccgggacggatgaacacggcctcaaaattgaagaaaaagcagaaaaattgaacactgatccgaagtcatacgttgatgggatggcaaaacaaatcaaggatttatggcaattgctagaaatctctaatgacaagtttattcggaccaccgatgattatcatgaacgcgcggtccaagaaattttcgatcggttacttaaaaatggtgacatctacttaggtgagtacgaaggctggtactccgttgatgacgaagaatacttcactgaaacgcagctggctgaagttttccgtgatgataacggcaaggttattggtggtaaggcgcccagtggtcatgaagtcgaacttgttaaagaacagtcctacttctttaagatgagtaagtacgcagattggttgttagattattatcaaagtcatcctgactttattgaaccagctaatcggatgaccgaaatgatcaataattttattaaaccaggtctggaagacttggccgtttctcggacgagctttacttggggtgtccctgtcaagagtgatcctaagcacgtcgtttacgtgtggattgatgccctgacaaactatattacggcactgggttacgcaaccggcgactccgaagacttgtttaacaagttctggcctgccgatgttcaaatggttggtaaagaaatcgtgcgcttccatacgatttactggccaattattttgcatgcactcgggttaccattacctaagaaggtctttggtcatggttggttattgatgaaggacggcaaaatgtccaagtctaagggtaacgtgatttatcctgaaacattggttgaacattacggcttggatgcgcttcgttattatttagttaaagccatgccttatggtaacgatggtttattcacaccagaggactttgtggcgcgggttaactatgacttggctaatgacttgggaaacttgctgaaccggaccattgcgatgatcaataaatatgaagatggtcaattatcagcattcaaagccggtgtgactgaatttgacgctgacttagaagccacagctgccacgactattaagaacttcaacgcttgcatggacagcctgcatttatcagatgcgctggctgaagtgtggaagttggtcagtcggacgaataagtatattgatgaaacggcaccttggcaattagctaagagtgacgatgcgaatgatgctgataagttagccagtgtgatggcccatttagcagctagtttgcgggtgattgctagtttgatcagtccggtcatgacgcatgcacctaaggaaatctttacccaattagggttggacccagcaactttagcaattgccgacttacaactggctgatttgccggctggcgcacaagtcgttgctaagggaaccccaatcttcccacgggtcgatatggatgccgaagttgaattcttgaagggtaagatgacgaaatccgacaaacagaaggggcgtaaagccatggaaaacgcgaaacatgaagctgaagtcgaacaaggctggaacccagctgagactaatttgaacctcactaaaccagcgattaccattgatgattttgacaaggtcgaattgaaagttgctgaagtcattacggtgcagaaattgaaaggggctgacaaactcctacaattccgtttagatgcaggagatgctgatcatcgccaaatcctttcaggtattgctaagtggtatccagaaccggaagaactgattggcaagaaggttatcatcgttggtaacttaaagccacggaagcttcgtggtgaaatgagccaaggcatgttactgtcagcagaacacgacggtcaggtgcaattaattacggtaccagataatatggtaaacggatcattgatttcgtaaaaactaaatgttgagtaaaaaatcgggcgcactgactagtgagctcgattttttatttgtaattcaattgttattttagttgtttttgacaaatgggttaatctcccgtacagtagtacgaacaagaaatgaggtgagaacatatgaagtatgaacagattctcgtatgcgtctccgtagatggaaaaggacgtttttccgaaaattaattaaatttaggagacttaattaaatgaaaaacgtccaaaaacaagtgccatcattattactattaatcacattagtgggttttccacaaatcagtgaatcaaattttacgccgatcttgccagcactcagtcaggcaatgcacgttagcgccagccacagccagctaaccatgagcagttattttgtggcttttgcagttggggtgctcttctgggggcaatatgctgactatcgcgggcgccgtgatgccatgttaggtggattagccttttatttgattggtaacttagggttatatctgagcccgggctttacttggttattggtttgccgcttgatccaagctttcggtgctagtgctggttcggttgtgacacagactatcatgcgtgagagctttacgggtgttactggtgcaaaaatctttgcgaaggtgagtgcggccatggcactatcacccgctctcgggccactcatcggaggtggcgtccagactgtgttcggctatcagcatgtcttctcggtcttgatcatgatagcagtcgtaatactgttgtacgcggggtgttgcttgccagagactcgaccagaaacggtcaaagtggcctcttggcggcaacaaagcgttgtcgtttcacggttattgcacgatcccgtggtctggtgttacggcctattgattagtggtattaatggtattttgtttagttattacgctgaagcgccgtttatttttgaaacgcacttcggctttagtgctgtgcaatacggtagtctcggtttagtcttagccgcggccagtctgctgggcgcgttgctagtgaattggcttgtcaactattggtcaccaatgcaggtcgctttaagtggcttaggattgagtttggtagcggcagttggcttggtgatgaccgctgttggcaatcacgtcattgggatgctgattgggatttttctagccttcttaggtctgaacatcaccctaccaaacgcgttgaatcgtgctttgattggctatgaaacggtgatgggaagtgccagtggctggtttagcctgggttattatctactagtgagtgtgctaacttacttaatgagttggctccaccacggtagtatcgtgacattgcccgtatacatgttaggcgtggtcgtcgtgatgacggtggtgtatgcgggactgtattggcggcgtgtacgtcattaattttgcttgaaagcttggggaaacccaggctttttatattggcattgtttttaggtccagtaagacgttttgaaaaatcgtgtcccagtattggatgtgtaaacagtgcacaatatcaagtgcttgactacaggcggtcaatggctggttgggcttagtcacgtagtccgtaatgccctgacagaattttagtagtaatgctggccgagttggtcagagggaaagttgatcgttgtcattataggatatattttagtaattagcttgggctgtttatcgtgaacagcaacgaacagctggttggctagaaatgtcatgaaggttaaagcttcgtcagtcaaccgttgatatttgtggaaacttttattagcgcttgttaataggatgatttgctgctctggcgtaagagtggtgaagatttggcgacataacatcaaatcatatttggaccacagttgaagattcaataggtcttgaataagcccgtcaatcgctgctcgtaacgttgaatccagtgcctgttgtggtgtttctaggtggtgcaaagccaggtgggttagcgttagtaactgttgataacgatgagcatgcgttgcattaaatagcttgtcaatttgcttctttaatttccaaagctcgccaatatcttctttgacgactgcgttttggatttgttgcagcaattgttcaaccgggggaatttgatagtgatgtaagatgaagtcaaattcctgaagggtaagttctaaccgctctagtagctgtaaaaagcaaacagccgagatgttgctgtgaccgttgatgaagcgatagtaagttgactttgagataatgcgttcattgttagtaacatcattgactgatagtcttttagcatgctgaaccatcttgacagttgcaccgattgaagctgaattagacaaactggacactcctaaataactggatttgctgatgatttcccatatctgggaatttttctcgcttagaataattaatgtgctacattaaactgaacgaatagttaatgtggtgaattgaacattgcgtgtatcgttatctgatgattttgaacattctattaactattattgttttatgttagttgatggaattaagcattgaatgaaaaagattagaataatgtatgaatttttgaaaagagtactttgtgttaaagcaggtgaatgttagtaaccataacactgaggtgttgttactgaaaagtgtcgctattgaattgagaaaattaaaaccagtaattttgaatatcgttgagatgggttattggttttaatgaatatactcaaatttggaagatgtcaaaatatgaaatgttagcgcagatattgactttaaactaaattattcttcgaaaaagtcacaatacataataaagattgtttgaagtcctctcagcggttataaagtttaaattgatagtctccattcagcatcgataatagtttttgtaagggtgatttgatgaagcgctggaatcgattattacaacgtattcaagtaaaatatggcagtttatcagagcagcaattgttaaaaatcgattattggttattagcaatctacctagtcttgtgtggcgttgcctacattcgtctgcttcattcccgcagtgctgtgctccaagttgtgccggaattaataattactctaatggcatttggattgttgcgaataattagatggcggaaaaccacgcccaagagtcggtttaagtttgcgactgaggattattcaccagaagagcaattagtttttgtgatgattgtttttttagaaaattttccgacccccgtggtaatggaggtaatcggaaatattttatttattctgattagtattcggaaatttttccaatataaactggaccgattatcagcgtatcgaacgttgaatattatcctggtttttgaaactgttatggttagctggatcgtcctatttggtggataaggcagtgctcgtgaattcaatgattggcatgggctgagattgaagaaaagtactgtgaatttttgtcaatcattctagttagaatatagttagttaagagggtgcctagtgcagcctctttttatggctaatgactagtatgtcgttattagtttgcaagaaataggttggatggcccgtcttcttttccgaaaacttgcgtcccatggtaaaatcaactaagataacaaaagtcgaaaaggggttattacatgcggatttttgattctcatacccatttaaatagtgaagaattcatccaggaagtgccacgttacttacaacaagcggctgaccttgatgttacgcggatggcaatcgttggttcgaatacacaactgaacgccgatgcgattaaactggcggaaacgtatcctcagttagtcgcgattgttggttggcacccggaagatgccaaaaactatgatcaggcggctgaaaagttgttgattgaacaagtccaacacccgaaagtcgtcgcgttaggtgagattggactggactaccattgggatacgtcgccacaagacgttcagcggcaagtctttgcccgccaagtcgccattgctaaagagatgcaattgccaatttccgtgcacaatcgtgatgctttcgaagatacctataagatcttgaaagcagctgatattcgtgacacgggtggcgtcatgcatagctttaatggtgaccctgagtggctcaaacggttcttggacttaggtatgcatatttcctatagtggtgtcgcatcatttaagaatgcgcgtgaagtccatgaatccgtcaagcaaacgccactaacgcaaatgctggttgaaacggatgccccttatctaacgccggaaccataccggggaaagcagaacgaacccggttacacgcggtacgttgttgaagcaattgccaagttacgtgaaacgacgccggaaattatagcggcccaaacttatcaaaatgcagaggaattttttaagattgaaaaagattaaagaagtaattgtggttgaagggaaagatgacacgaagcgtctcgccctagctgtcgatgcagatacacttgaaacgaatggctcggcgatttccgaagccaccttagcccagatcaaaacgttgcaggccagtcgcggcgtgatcgtgttcaccgacccagacttttccggtgaacgtattcggaagacgatttcggcggctgttccgggtgtcaagcacgcctttttgccccgcaaagctggtgtaccaactaaggctggggggagcctgggcgttgaacacgcgagcccagcggcgatccaaactgcactcgcccatctatatacggagcaaatcgacgagccccaacagttgatcagtcaccatgatttgattgcggcgggcttactagcgggtcccacggcgcgtcaacgacgcgaacagttgggtgaacgtttaggtatcggatacgtcaacggtaaacagctgcccaaacggttacaactatttcaaattcagccagctgatttttgggcggctgttgaccaactaaccacagaggagaaatgatgagtagagatttagatattgcgaatcccgcccgcacacgggcaattatgcatacgtacgggttacaagttaagaagagtttaggacagaattttttaactgatcagaacgtgttacacaacattgttgccactgctgacattggaaccaatgatgacgtgattgaaattggccctgggatcggcgccttgactgagtatttggcacgggatgcgcaccacgtcctggcctttgaaatcgatgatcggttactgccaattttggatgagacactagctgattatgacaatgtaacggtcgttaaccaagatattttgaaggccgacttagccgcgatgatcagtgaacatttagataacgagcggccgttgaagctcgtcgccaatttaccgtattatattacaacgcctattctgatgaacattttggcgggggacgttgcttttgaaaatattgttgtgatgatgcaaaaggaagttgccgaccgtttggcagctgaaccgggtacgaaggcgtatggtgcgttaacgattgctgtgcagtaccggatggctgctgagatggcgatggtcgttccccggacggttttcgtgccgtcaccgaatgtcgattctgcaatcgtgaaattgacggcattgccaccgcggacacacgtgccatttgacgaagcagcttttttcaaggtcgttaaagcgggctttgcgcaccgtcggaaaaatctgtggaataatttgcaaagcctatttggtaaacaacctgagacgaagacggccattcaacaggctcttgatatcgcgacgattgatcccaagattcgtgccgaacggttgacggtcgatgaatttattacattgacggatgcgttacatcaggctgacttactttaagttatctatgcttataaaatggttgcacattagaaaaccttgtgatataatattgacttttttgtgaaaagctagtatagtgtctttcatgaggaggattctcaatgccaatttcactagctgcaattaaagataaacttgactcacggatcggccaacgcatgaaggtcgttgcccaggctggccgtaagaaaacaactgaacgccacggtatcttgaaagaaacttatcgttcggtgttcgttgtggatttagatcaacaagaaaacgcatttgaacgggtctcctacagttatactgatgttctgacaaagaacgttcaaatcgcttttgatgatgaaacaactgaagcttaattcgcgtctcgtgaattctcaatattaagacccccaagcaaggtctttttattttgccttgatattagtataattgtatcaaagtaagtcagcgaccccgggtaatcgcggtcatggaagagggtgagacgcgtgcagatcgttgaaaaagcaccggccaaaatcaatttaggactggataccttatttgaacatccaaatggggataaagagtgggacatggtgatgacgtcggtcgatctggccgactatgtcatgttagaatcattgcatacgaaccgaatcgaagtggtcaccgatagtggctttttgccgaatgatcgccgtaacttagcttttcaagcggtgagtgttttaaaacggtattgtcatgttgatcggggtgtccgtatcaaaataagaaaggccattccggtagcggctggtctaggaggcggctcatctgatgccgccgctgttttacggggcttgaaccggatgtggaatctccacttggacttagccacgttagcacgtttgggattgcaagtagattcggatgtgccatactgtgtctatagtcagacggcccacgtgacgggaaaaggcgatgtggttaccccactgcctaagttgccgccgatgtggattattctcgcgaagccgaaagtcagtgtgtcaacgccaaatattttgcggcaggtcaattacgagcgcatcgaccagcatcccaatattgaggccttgttggctggtattcaacagcaggatttcgcggagatttttgcgaatatgggcaacgttttagagccaatcacggcaaaacgctaccccgagattttacagatcaagcggcaattgttaacgtttggggcggatgcggcccagatgagcggcaccggaccaactgtgttcggtgtgtgtcgcaaacaatcgcgggcgcaacgcgtgtataattccttgaagggtttttgtcgggaagtataccttgtgcggccagttaatttaaatgaacattagaccgtagtagtccgccgtgatggtgggctttttttattggtacggggttaggtgagccgagtctctaatttactgctacgcttaaacggtagcgctgagccatttgtcatcacgacctgtgtccagccagagatggtgtagcagtgcaattggcaccggaatgcgagtagccgcggctttgcttgcaggttgacacacgaagatggtcgttgccttcaacgcatcatcggttattcggacaacgcaatctctttttgtaagcaatttatgcgcgtttatgattaaataaggagtaacggaggtgttcggatgaagcagtcgacaaaatttggattgaaattggcgggcgtcattggtgctgcaacttatgcgggaacgttacttggtggcttagcggcgtatcaagtcgcgatgcacgtgagtgacgcacagaagcagcagggccgcgaacgttcgcgggcagaaaacactgaaattgagaatttttggtatttcaagcagcctaaacagcagtggatgatccagtcctttgatgggctgaacttagtggcaacatatatccctaatccgaaaacaattggccgcttggcgattttggcgcatggtctaggacattcgcgcgaacaaatgattccgtatgcgcgcatctttatgagcttggggtatgacgttttaatgcctgatgcccggtcatttggtgatagtcaaggccatacgattggttatggttggctagaccgactagattatgaacgttggattacgatggcgcttagtcaattaggtctggatattgacatcgtattgatgggaatttcgatgggggccgccacggtcatggcgactagtggtgagccgttaccggagaatgttaaagctattgtggaggatagcggttatgcggatctttatgatgaagcgaagttcagactgactcataagttccacttgccagcctatccgattatgccggtggcgaatcgcttagcacacgttcgcgcgggctatgggtttaaggatggccggattctgcaacgggtgattgatggtgggttaccgatcttgatgattcatggttccaaggatcagacggtgcctgtccgcaatgcacataccttgtacgaccagttaccacaacaaaagggcctgtatatcgaccccgatgctggtcacgttgaagccatccgaacgcacccggatcgctatcaagaagtgttggatgaattcttgcatgagcaggcggggttggcttaagcaccttaaattaaagtaatgataaacatgaattgaccgtgttttaccggcttaatggtaaaaacggtcttttttttgcaatctcgtcttagtgataagcgcattcaactagtggtcaaggtgttatttgattaggccccgatgattgccgcagctggtaatgattacggcattttgaactcaggtattgacaaatcaccgcattcaggtaaactaaaatagtaatcattacgatttactttaatttagaaagttggggtagtgttatgacggaaccgttaattgccgtccaacaccttggaattggctttccaaacaaccaggtgtttaaagatttgaattttaacattgaacaaggtgactttttgaccgtgattggtgagaatggggtggggaaaaccactttaattcgcgccttgcttggcatgctgaagccaacagccggtcaaattaagtattatccgaataaaaaagccattaaaattggctacgtgccccaatttcgcaacttagaccaggagtatccgttaacgattgaggactttgtcgggctgaacctaaaagggtggcagccgtggctgtctcgagctgaacatcgtcaggtagcgacagcattagccgtgaccaatttgaagaaactccgtcagcgaccgcttgggatggcttctggtggtgaaaagcagcgggcttacttagcacaagcaattgtgcaacaaccgcagctattaattttagacgaatcgacggctagtttggacaatgaaatgaagtatgaattgttggacctcgttcagaacttaaaccaaactagcaacattaccgtcttctttgtgacgcacgacttgccattagcgaagcaatacgccaaacattatctggccttaaagcccggccaccagcaatttggcaatatcgctgatatgtcggtagagcaattaaaggaggccactaatgtcaatgtttagcttagtatttatgcgaaatgcctacttagcaggaacctttattgcaattatttgtgggacgattggcgttttcgtgattgcccggaacctctcatttctgacacacacactgtctgaaattgggttttccggtgcagccttcgggatttttatgggctggaccgcgttgagtgggatgctgatttttaccgtgattagttcggtcatcgtggggcagatgagtgtgaaacaatcacgacgcgaagcctcgatttctgcaatttccgctctgtttatcggcttagggattctattcctgtcgttatctaatcaaacttcgagttatgcgacgagcatcctgtttgggagtgtgattgggattgccagtgcggatgtcatccgggtcgcaatcttatcggccatcgtcctactcgtgatgttgggcttgtaccggccactcaaatttgattccttcgatgcgattggcgcccgggtgagcggcttatggacgaccggcatctcagtggtcttcttggtactcgttgcgatgagcgtcagcgtggctgcccaaattgtggggtcattactgatctttatcttactcacgttaccagcagcggcagcgcgatactttgtccatacggttagcaagatgatttttctagcgattggtttcgcgttgattggggtttggctggggctgtacttgagttacgtcacgaatttaccagtcagtttcttcatcgctgcaatcgagtgtatcttctactttgccgcgctgggttatcagcgacttcgggtcggaagctagtggggctattcttgttcagctgtatcacgttaaaagtaggtagtttacagaattaagtggttcgttgtgacacgctaaaatgttactagtcgtttctggaattcattgggaattctagagcggctagttttttgttcgtgttggggttgcaacttttcgtttgcgtgggggggcaagtcacacaagaagttttctaaaagcataagtccaagggtagcgctgtaattgccacacttagtcgtaggacgggaatcagtaaaggtatcatttcgtttttgacggatatgattgggtataatgatatttataccattattacggggaaagatgcgctactggtaagaagcgttctcgtttgaagggtgcgttttggacagccttgaactttgtgccggtcgggcaactaagcaggcaatgaagcgtgcggctgaggaattggccaaacgtaagccggctaggaagacgaccaagaaagcagccacgaagtctcacaaaactacaaagaccaagcatgggacatcaaaagtctaagccccaaaagacttctcatgcgacaaaacacaagaccaagaagcacaacagaagcgctacaataagaaaaaagttgcgggcaaggcaagaaaagcttctcagagaaaacaatcctcgcagaataaagatagtcatgggaaaaaggagaaatctagcaaggaaaaatcttcaaaagatgggaaagataaaaagacaaataatgtcccattggaaaatggctcttatattaggaacggaaaaccttatggacgaccaacattaaccgggaagaaaaaactcgaattcgagcaggaagtatataataggcaagctaaagatggagtgcttattgatcgaaatacgaaacaagtgatacattggaagccgggctaaccccgaaaaggaaaggtcgatctcggacatctaccgggtaagtcttataaggaaatgttcaatctatataaaaataggaagatgacattgaaggattttcaatttaatcccaaaaactctagattagaaactccgtctgctaatcggagtcataaatatgaaacgaggtaaaaagtgtgctagtttacaatgcttttagtgcggtaagagatggaacatttgatcagtttaaaaattattattctggcaatgtggatgagactgataagtttgaaggacttaatttattatgcatggcaatgacaaacgatgacaatcctgaggaaaagttaaagattgttcattttttgttacaagcaggtattgatgttaactttgtcaccaagagtgaacatcgaaacgcattacattatttttacaattgtgtatggcgtccaaatcctaagtttgctatggaaattacgaaactattagtcgagaacggcatcgatgtaaatagcgttgataagtatggacatgtaccactgttttatgcggtttttgataatgatttggatactaaggaaaatgaagagttatatttttatctattaaaggcgggctcagattatcgtttgcgtgatccatttgggaaatccattatagattatgcacgagaaaccaacgagaggactgattttttagatattgtaaaagagtatgaaaacggcaaaaaatgattgcaggttgaaaaatggcaacgattataattattggagtagtaattataggaattacgctgggattaggatactggagttatttactgggaaaaaggaatcaatctaattttgttggccctattattccagtagcttactttgctgttcgagcaatcttagctgtgatgacacaaactacgacacatgggctagtatcgtcattactcggtagcttgttattcagtttgatttactatggcttatttgttgggggtaagcaccgggccaataagtaacatgaattagtcagattaagataaccgatattcgacaaggactaattgccgagtatcggttattttatagaaaagtttagtcggtaatttggtaattactgttgtctatatcctattgtttggggacgacaacgattcaataagcagaagccaataaaataaattgcttgaaagctcagaacgattccaaaattactcgttctgggctttttaggtgtaagtagcgaccaatcaatcgaactttctggacgctacgtcgtgtgaacgatggattcccctggcacattccgtatctactccgttataagttgcctaagtttattgttctcgaattcgccaaatatgagctgtacagacaagataattggcaaacatattaagaaattccgatggtttagtaaaaaaatgtgaaaaaattagcttatttccgaacgtttgtgttatcattttgcatagactttaaaaatgatgatttaggttgaggtggaagttatgaaagtacgtagaagcgaacgtttaatagatatgacgcgctatttgttggaacgtccccatacattagtttcattgacatacttcgcggaacggtacgcatccgcaaagtcgtcaatcagtgaagatttaacgattttgaagaaagtgtttcaggcccggggaacaggaatcttggaaaccattcccggtgctgctggtggtgcacggtttattccttatattttaaaggaagaggcccaagaatttattgacgagatgaccactaaggttgccgacaagagtcgggtgttaccgggtggctatgtttatttatctgatattttaggccaaccagatattttgcgccaagtgggtcgggtgattgcgactcagtacttgaatcaaaaaatcgacgctgttatgaccgttgcaactaaaggaattccgattgcccaaagtgttgcgacttatttaaacgtgccgtttgtgattgtccgcaatgattctaaaattacggaaggctcgaccgttagtgtgaactatgtctcgggttcttcagaacggatcaagaagatggaactttccaagcgaagcctaacggaaggcgccaacgtgctcatcgtggatgatttcatgaagggcggcggcacaatcaacgggatgaagaccttgattgaagaatttgatgctaatttaattggcatcaccgtttttgccgaagccagttttgttggcaatcgtttaatcgatgactacacgtcgttattacgagtaaccaacgtgagtgatagtgacaaggcgattaaagtcgttgctggtaactatttggagaaggttttcggtgcggaagtctagcctggtgtgttatccagaccagttttttgatatgatggacttatctgaggactaaggagtaatttgtaatgacaaccaaaaatgcaatcatcatggccgctggtaaagggacccggatgaaatccaagctagtcaaagtattacatcaggtctgtggcaaatctatggtcgaccacgtcttgacccaagttgaagccacccacatggcaaatatcgtgaccattgtaggccacggtgccaaagatgtggaagcagccttaggcgaccgaactgagtacgcggttcaaacggaacaattaggaaccggtcacgcagtattacaagccgaatcgctcttaaaagatgcggatgggatgacgctgatcgtcagtggcgacacacccttatttaaagctgaaacttttgaagaactatttgaatatcatcaagctaagggtgctgctggcacgattttaacgtccaaggcacctaatcctcaaggctacggccgggttgttcgcaatcggttaggcatcgttgaaaagattgtagaacaaaaggatgcgactaaggaagaacaagaaattcatgaaattaacacgggagtctactgcttcgataatcagaagttgtttgccgccttacatgaagtgaccaacgataatgcacagggcgaatattatttgactgacgtgattcagatcatgaagaatcagggtgatgtggtcgccgcctatcaaatggatgattttgatgaatcaatgggggtaaatacccgtgcagctctagcccaagcaaccaaagtgatgcaacaacggatcaacgcgcagcatatggaaaatggggtttcaattatcaaccctgacgatacctatattgaagcgggcgttaagattggtgctgatacgattattgaaccaggcgtcttgatcaagggccatacgacaattggtgaagattgcttcatcggcgcgcactccgagatccatgacatggtgattgaagatcgtgttcgggtgacggcttccttcttggaagattccatcatgcacgctgacagcaatattggcccgtatagccatttgcggccgcaagctgagattggtgaacacgtccatcttggtaactttgtcgaagtcaagaaggctaagatcggtaatcggaccaaggtcggccatttgacttatgttggtgacgcaacgttaggtcaagatattaacgttggttgtggtgtggtcttcgttaactatgacggagtcaacaagcaccacacgaatgtcggcgattccgcctttattggtagtaactcgaacatcattgcgccagttgaagtggctgaccactcgtttatcgcggctggttcgaccattactgatgatgttaacttccatgatatggcaattgcccgggcacgtcagacgaacaagcctgacttctggggccgcttaccacatgaaccagaaaacatgtaattattatcattgataattgaattcagagaccatccaagtgcgttgttgctgggatggtctctttttgttagctcatcggcgtgacttgtggtgtaataagggctatttagctgctaaataggacaaagttgatttgactgtgtcagttcagggcaactgagtgattttaattaagtcacgaaattggtataattggcgaggagtttacgggacggggaagtttggaggcatttagatgcagacgaagaagtggattcgcggccttgtttgtggtctggcattgcttggcggttggagctgggcattaccagtacacgcaactagcgttaaaagtgagcaaacagccgttaaaaagatcgcgcaacgtgatttgaaatcactaggtgggcgctggtcggtcaaggtgacccgattaggtcgacgaaaactaaccgtgcaaacgggaaatcagcgcatgactcgtcaacgttctgctagtacgatcaaagtttatgttatgctgacgatttatcgacgggtccaacaacgaaagttacggctaacacagcaagatcaaaatgattttaaattaatgattcataattccgataataacgcggctaaccggttaatcaaacgtgcggggggcttcaggagcgttaatgcggccattaagcattatcgattcaagcagacggttttacaacggtatatgcttgatacgaacgcgctacgctggggacgcgataattacacgtcggtggctgatctaactcgttttttaacgctgacatatcaacataagttattaggtaagacgtatgataagaagatgctgaccttacttaagggctgtcgcaaccacagcaagctaccatacttagttaaacacgccacggtctataataaaactggcgaatatcccgataagggtgtccaaaacgatgcggccatttttaagaccaaacaaggcacttatagcattgtcgtcatggcccagaatggcaagcagtaccaacaatatcaagggatgaatcgcttggggcgcgatgtcgtgacttatttaaatcagcaccactgagtgtgtttagataactgaacagtctagtagattcctgttcgtcagccggtgtgcgctctattccgacttctagtactggctacttttgaacgcgagaaacggcagcggtcaagtaccaactaagacaataactagtgcaatgcgtgtgtcagtaccaattacaactgatagcggtctcattaactaagattgttcggtaatcggggctcacgaaactttaatctttaatcacgaaggggcttagattgccgaaagtcgtgcttccagcccagtctcacgcaattttgccttgttgttgggacttgattttcactagcaaaatgcctattatttagtaagtaataaattttcgaatggaggaaattatgtcagaacagtattttgatccaaagttaaaaatctttgctttgaattcaaataaaccattggcagaaaaaatcgcggacgccgttggggttaagttgggtaagacttcggtcgatcgctttagtgatggcgaaattcgcattaacattgaggaaagtattcgtggtgatcaagtttatatcattcaatcaacttccgctcccgttaatgacaatttgatggaactattgatcatgattgacgccctacgtcgcgcgagtgctaagaccattaacgtggttattccttattacggatatgcgcgtcaagatcggaaagcacgttctcgcgaaccaattaccgctaagttagttgcaaacatgctggaaacagccggtgcaacacggattttggcactcgatcttcatgctgcccaaattcaaggcttcttcgatattccgttggatcacttgatgggtgcgccactgttagctgactacttcctgaaccaccacttggatgaaaatgctgtggttgtttcacctgaccatggtggtgtgactcgggcacgtaaattagctgaattcttgaaggcaccaatcgcgattattgataagcgtcgaccacgggccaacgttgccgaagttatgaatattatcggtgatgtcaagggtaagcgggccatcatgatcgatgatatgatcgatacggctgggacgattactttaggtgcacaggcactggttgatgcgggcgcaactgaagtttacgccagttgtacgcatccagttctgtctggtcctgccatcgaacggattgaaaagtcaccaattaagaaattagttgtgacggattcaattgaattaccagctgctaagcgaatcgataagatcgaacaagtttcagttggtcaattaatgggtcaagcaatcaagtttatccatgaaaataaaccagttagtccattatttaagaatcgtttccataacgaagaaaattaattgacgaagcgtcaaattggcaattgctgatttgacgctttttaagttgcagtaatttctaaaagtgatagagtaaaggtgttgtttggtgggcattatgacctagtcaaggttggactggacgccgtatatcaacgaatctttcgttttggcgtgcttcaacattaattaggtgatggcgcggaacggataacggaccaacgtcgggctaccggcgtcctttttttatccaataaacactagcacgaatccttaaaatgattacaatataagttaagggggtgttgcgatgacaccgttttattggggtagtttggcccttgctagtgcgttgaccttgcaattgacggaccggcggcattggttaacgggacatctttttttgattgcagtcattggcattttgttaagcgcttaccatcgattcagtgcgcaggcaagtcctacttggcaattcatgttggtcggtgcaaaaattttggcttatacgttgttgccaattgtaattttgattgtgggcattagttttgtcaggtatagttaccgattgattcgcaaggagggctgggcgtttcattacagcttgctagcaatcgtcggtggtgtattagtcataatgctggtcttatcagtaatcaacttaggagtttggcattcgcgacgcttgtggcagttattaggcctagcgttattattgacggcgtattttgcgttcagctttatcgcgtatctattagcttgcgtcatgacccgactaggacgtcatcgacagatcgattatatgatcgtcttaggagcagggttgatgccaaatgggcagccaacgcgaacactggcatatcggcttcaggcggcagcgaagtactatcgggtgcaacgggcgcgttatcatcaaccaatcacgatcgttgtttctggtggtcagggaccggatgaggttatggcggagagtaccgcaatgcggcagtacttagtggatcaaggggtcccccgtgatgccattcaagaagaaaatcggtcaacgtcgacaattgaaaatctaaaattttcgcacgcattaattgtgcggcaacaaccgttttatcgcgccgtgattgtcacgagtggctatcacgttttacgggctaatatttttgctcggcaactgcacctgaacctaacgggaatcggtgcgcacacgccactgtattatttaccgtttgctatgtttcgggaatacttggccttaattgtgatgtatcgctgggccaacttagtggtggtacttggtttagcggcttattatgtcgcagcgttagttaggttaatttaacaaagccgctactcagagctttgaaaaaaatgacattgcgattaatggtataatggagaatgataaaaaggaggggtttgccgtggatcatgcctatcgatcatcttggccactgattgtaatcgtcctactcggattgattacactttcaggctgtgccaaaaataccggaggcgtaaccgcaagttcggcaacgaccgcaactggtaacagtacaacggccgttttaaccaaagctgatcagcaaatttcgcaacaaaaaattgccgctgcccagaagactttagcgggtgcttctgaattaactccagcgatcaaaaagttagcccttgggttaaagtattatcaggaagctgaagaagcacttgataataatcagctcagtctagcaaagggttattttgacacgttaagtagttatgatggcacgactgacgccagttttattgctgctcggcaaaagctcgtcaagcagtaccaggcggtcaagctagccaatggttactataacgctgcccgtgatgaattaagtattcatgatttggccactgcgaaggccaatattgataagttggacgatgtgcaagccacacatccggttatcaaaaaattacagaaaaaagctttggcaatgaaacaagccattatgaattatgaggcgtcgcaatcaactagttctggtagtgatagctcaacggttgtcagttcgagttctgcggctagtgcgagtgatagtaggacgtctgccagcagtacgagtagtactagtgccgatagttcaacgatgacaagttcgtcgaatagcagcacgtctgccagcagtagttcttcagagctgacaacttcggcgatcatcaaacagtttcaggatgcgtccggtgttacgtttacttcggataccgaatttaatattactaaggagaccagtgcttattatcagattaccgcaatctatgcgacgaatgagtctagttcttctgcttccaagacagtaacggatacttatcgttattatccggatagtggtagtgttactaaggaaaatagtgcaactggtagtttcgaataaccagcattaaaaagtgacgatcaggtaatgactgatcgtcacttttttgcttgactggattgtttagaaaacgctgggtagcggtcataacagtgataaaaaagcaacgctcacggcacgttaaaaacgagccattagcgttgcttgaattagtttgaaaaatagtagcttaggcgagtgcccaagtgttaatggcgtgtgcgaccccgtcttcaacgttagtcttggtttcataacgggcaatttgcttggcctcatcaatggcgttacccatcgcaacactgttggttgcgtaacgcagcatactcaaatcgttaccttgatcaccaatcgccatgacttcatcagcagttaagttcagatggtcggtcaacgtggctagggcgttacccttgctagcggcgggattcatgaattctaggaaatacgcttctgagcgaacaatggtaaagcgcttggagaatgacgctggtaattgcttgatggctgcatccagtagtgggccgtgatcgatgaacatgcacttgacgattggtaagtctgggcgcatttcttccggtgtccggaaccgaatcggcatattgacgagtgcactttcgccgaccgtataagggctgatatttcgattggcggtgtagatatggtcttcactttcaacgtgacaatggatattgagttttcggctgagcgtttcaatgtcgatgtaatcgtcatgtgacagggtaagtcctgtgatgatcttaccggtgattgtctgaaccattgagccattaaaagtaatgacgtaattatcttcaccagcgattccaagttgctttaaaaagggcgtgacgccacttaatggccgtcccgtacaaatgacgactttgattccttgcgcgttagcggcgttaatcgcttgaacggttgcgggatttagttcgctgtgctcattgagtaaggtgccgtccatatcgatggcgataagcttgactgacataataataattcctccaaaattagtgtggtacgaccagacgatcgtttaaaatatattgctggaattcttggtaaattggtttgaataaatcgttttcggcgtttttgctgagcatttcttttggaaagaaaaaccgctgatcgccagagactttcccggtgatggctcgcactaggtcactgacggtggatagttctagtaaggaaccgtctttttgttgcagttcaatctgggtacgcggcttcttcatcttaggatcgtaggcgtcgtaagggagatcgtaactgtcgttgatgtcagtgtagtagtgcgtatcaaagccggcttgttcaattaatttttgtaacgttggaattagcggttgagtcgttgcatcgactcgtgctgattttaagggacgccggtctaagaaacgggttgctaggtcagcgagaatttgatcacggctatcacgccaatggctaaaataagtgtttaagacgccatcgtctaaccgtaaataatcgtgtaacgtaaagttattattgaaaaacggcaataacatcactggtgtggcttcagcgtcgaccgcgtggctttgataaagatcgttagcccgttccagtaggcgatctaggatgacttccatggaacgtgatactggatggaaatagacttgcatgtacatctggaagcgactgacaatgtaatcttcgaccgcgtgcatgccttccatcgcaaatgtaatgccgccttgatacggcttcataacgcgcaaaatacgggtcaaatcaaaattgccgtaattcgtacccgtgaagtacgaatctcgcagtaggtagtccatccgatcggcatcgatttgactagaaatcatctggacgacttggggattcgggtacgttttttgaatgacggccgcaacttgggccgggaagtcaggcgagacttgctgtaagacctgattgacctcggtttcaggtgatgtcaaaatctgaacagttagggcttcatggtcggtgtgaaagatgtgctcgaatgtgtgtgagtatggcccgtgaccgatatcgtgtaacagggcggcgcatagtgcgaccaatcgctcgtgatcatcccaaccaccgtcaccaggggcctgggtcgggtagttacgttcgaagttatcgcaaatacggcgtgtaatctcataaacaccgaggcaatgtccaaagcgggagtgttctgcaccgtggaaggtcagcgaggtcgtaccgagttgcttaatacggcgcagtcgttgaaattccgaggtgttgatcaaatcgagaatgacttgatgttggatataaatgtaatcatggaccgggtcacgaaagactttctccatgggtaatagttgctggcgataggccaaattaattccttctttcagtgatgcaagcgttgttgtcggcgttgcatttgttgataggcttgatttaagtgtgcttgaaattcaggttcttcggtgactaacggcaaacttgttgtgtcgaccgtcccatgttgagctaggatggctataaaacgagcttgtgtagcggtagtgtcagtcggcgctgccaaagcgtcagcaacggtcgtcatgacttgtggatcaacatctggaaaccgcgcgtcatggtgaccggctaagctgacttggtaaaaacgctgaatgagttgactacgggccatctgatcgccatcaacgctgacatacagcatgatgaccagcgcttcggcagtgcgccgttgcgacattccggcaattttacgaccggcaatactcaaatcataatcaccaggacaataggagcgtgtaatctcaccagtcgtgatatttaattgtggccaaactgcctgaacgtagtcgaccatcaattgatatgccgctgtaattgaatagcgttcacgagttgctggaagaaataaggagacgtttagtacaccagggtcagcaactacggctagcccacctgaattacggagcatgacctgataaccggcagcgtgtagatgtgctaagccagcagttagccgtggcaagcgttggtctaataggccgagaatgacggttggctgtaactgccagaaatgaacgattggttgctgacgagccgccgttaaccacagcagggcgttcgtgtacgcaaaactatccagcatcgctgccggttcgtatttttgactcaaagttgcaattgttgattccgtcaagaaagccaccccgttatccgttgttatcgggcacgagggatgtctcatgatgaaaccgccaccgttgtccgtatcatcactaattatactagaaaaatggtaccgttgcattggcttagacaaatcaacttaatctgtagcataccatcataggataatgaaacgtgcaagttagttggctttttgttcgtcagcaacgtgcggcctatttcgacctccggggctgggggacaattgttggaacacagccgactcaaaaagtttacgcgggttcgaactttttccagcagatctaagctgaccgcttttagtcctatttttagttattttggcatgaatggcttataattaaacaggaagttttacgatgggcgtgatgggagtcgcgcggtcgtgaacgctgaaaaggatatagcgagtgtggtaacacggtgatcgtagacgggcgttcagcgtgtgattttgaaatattaggaggtccaaatatggatgatttaacaactggtgtgccagtggcgattcatttagagacgcaggcgcggcaagatgacgatacggcgaactatgcactggatgtcgatggtcaattggttcagatgggtgacgcgttttatttacggtataaggaagttaacgatgatgcgccagaaccgattccagtgacgattaagctggcagctaatggggacgtcgtgttgacgcggagtgcggagaaccgacttcggttgcacttttccaatggtaaacgggtgcgtgctcattatcaaacgcctatggggatgctacctgttgaaacggtgacgccgatgttacgagtacggctacgtgaacggccattttcaggtgaggtgaacgttgattacgatttatacgcgggtgagcagctacttggtaactacaagttgcgattgcaattcacggcctaatttggtattatgtactataaactgtggaaaggacgtgcaccagtttggaactaaaacaatttgatggacaaaaaaagtccgaattatctttaatcgaggttgctcacgcgatcttatcacaacatggtgatgtgatggcttttgccgacttgaccaacgctgtgcaatcatatttaggtaaaagcgacgaagaaattcgggagcgtttatcacaattttataccgatcttaatatcgatggtagtttcatttcgctcggtgacaatatgtggggcctgcgtgcatggtacccatttgaatccattgacgaagccgttattcatacggacgatgacgaagatgaggatcggccaaagcgcaagaagcgtaagaaggttaacgccttcttggccgatgccggggatgatgacgacgtgatcgattacgatgacgatgatcccgaagatgacgataactacgatgacgatgatgatcaggacgacgatactgatgattcagcaagcagcaagtacgatgaacttgcgggtgttgatgacacagacgacgatgttgctgatgaaacgttgccagacggtatcgagggtcaattatcagagttaaatgatgacgatgatgatgacgactacgatgacgaagacgacgaatcgaaataagcttttcaagatttttccttgacgaaaagggaatctccttgtattatcttatttgggctctctggtagaaatacctgagacaaacgatcgtattagctccctatttctgctgaaatagggagctttctttatttataccaccccacgaaataaatctttaaggagttatcacatgaccaaatatatttttgtaactggtggcgttgtgtcatccattggtaaaggtatcgtcgctgcttcgctagggcgtttattgaagaaccggggcttaaaggtcacgattcaaaagtttgatccctatatcaacgttgatcctggtacgatgagtccttatcaacacggtgaagtcttcgtgaccgatgatgggaccgaaactgacttagaccttggacattatgaacggtttatcgacattaaccttaataaatattcaaatgttaccaccggtaagatttattcagaagttctgcaaaaggaacggcggggcgattatttaggcgccacagtgcaagtgattccgcatatcacgaacgctatcaaggaaaaaatcatgcgtgcgggtacgacgacggattccgatatcgtgattactgaaatcggtgggacggtcggtgatatcgaatccttgccatttattgaagcgctacggcaaatgaagagtgatttaggttccgacaatgttttctatatccataccacattgatcccatatttacgggcagctggtgaaatgaagacgaagccaacgcaacattctgttaaggaattgcggagttatgggattcagccgaacatgttagttgtccggactgaacaaccaattacgcgggaaatgcggaataagattgcgtccttctgtgacgtggaaccagaagcagtcattgaatccttagacgttaagacgatttattcaattccgttgaatgttcagaaacaaaacatggaccaaatcgtccttgaccattttgatgtacaggcacctaaggccgacatgagtgaatggattgacttagaacatcatgttcagaacttatcacggaccatcaagattgcgctagtcggaaaatacgtcgctttacaggatgcttatatctcagtaacggaagcattgaagcatgctggctatacggatgatgccgacattgatttgaagaagatttctgctgaagatgttacgccagaaaatgtcgaagaactactcggcgatgctgacggaatcttagttcctggtggctttggtgatcggggaattgaaggtaagattacggcaatcaagtatgcccgtgaaaacgacgtgccattcttaggtatctgcttgggaatgcaaatggccagtgtcgaatttgcacgtaacgtacttggattgaaggatgctaactctgctgaaatcgatccgaagacgccggacaatattattgatttgatggccgaccaagaagacgttgaagacatgggtggaacgcaacgtttaggcgcttacccttgcaagctgaagccgggaactgtggcggctaaagcttatcacaatgaagaagttgtgatggaacgtcatcgccaccgttatgaattcaataataagtatcgtgaagcaatggctgctaagggcatggtcttctccggaacttcgcctgacaaccggctcgtcgaagtgattgaattaccaaagaagcgcttcttcgtggcctcacaatatcatccagaattcttatcacggcctaaccgtccagaagggttattcaaggcattcatcgatgccgctaaccagactggtaaagtgaaggcataaatttagtacggtagaattaagaataaagcacgccagcgaattgttggtgtgctttttttgttgggcggccacgggcttgattaggtcaccgatattcacagtgacaactggtgttgcgaaaatacatggtaacaataaatggttctcttgataatagaaaaataaaatgataataaaaaactattgacaataaatggcgggaggtctagattataagtgtaaattgaaagcgcaaacataatgggttagtagttaatctggttatttagaaagccaacggttgctgaaagttggttgattggactgatgaatccgccatttagcgtttgacttcatttttaagaggtcgcggtgagacgatatactcgtagagcagtaaattgggtggtaccacgttgataaaaaacgtcccatagtcttttaggtgaagactatgggacgttttaattttaaggaggcttttcgtatgttaaatccaaagtttgttcgtaataacccagaacttgttaagactaagctccagactcggaaggttgatccggctgaggttgatgaatacttacagttagaccaacaaaaccgggatgcaattaccaaggttgaaggattgaagaaacagaaaaaccagttgacggaacaaattgggcaaagtgatccgcaatcggaagcgggccaagccctcattcaacaagtcaaacagctgaatggtgatattaagagtacggaagcggcccaaacggaagtaaacgatcggcttcattacttagcgattcgcttcccgaatttacctgccgatgatgtaccagtcggtcctgacgaagatagcaatgttgagatgcgtaagcacggcgatattccaacgtttgattttaaacctaaggcgcactgggaattgggcgaaagcttaggaatcttggattttgaccgggcagcaaaagtcgcgggcgcgcgctttgtttattataaggatgcgggtgcactcttagaacgggcggtttacagctttatgctagatctgcacacacaaaagcaagggtaccatgaaattattccgccatacttggtgaacgctcagacaatgtatggaactgggcaatttccgaagttcaaagaagacgtctacacggttgaatcttcaggaatgacgttgatcccgacggctgaagtaccgctgaccaattactatgcgaatgaaatcttatctgaagatcaattgccaacgtacttcacggcgatgacgccttgttatcgctccgaagctgggagtgcggggcgtgatacccggggcttgattcgtatgcaccaatttcacaaagtcgagatggtcaagtactgtaaacctgagaattcatacgatgagctcgaaaaattaacggataatgccgaagaagtgttgcgcgaattagggcttgcataccatgttattaagctttcaacgggggatactggtttctcatcagccaagacctatgatgtggaagtatggatgccagaacaaggcatttatcgggaaatcagttcatgctctaactgcttggacttccaagcacggcgggcgatgattcgttaccggaaagctgatgggacggtcgattacgtccatacgttgaatggttctggacttgctgttggccggacggtagctgcgattttggaaaattatcaacaagccgatggcacggttaagattcctaaggtgctccaaccttacatgcatggtatgacagagataaaataaaattattatgagaataaattattattcaaataattcatttgaatgttaaacttaatatcactaggattgagatggatacaggctaggactgttatgataatctcagtcctttttaatttggtgttaaaaatacttaatttttataatcgaaatcacatgaacggtaattgtcgccgtgataatattttatcatgaagaaaaggttttcacggcactaaagtgatgtttatcacaaagtggcgttttacaacgagtcgagacgttaaatctaatgggagggttattcatgcaggttatgttagcacattctctggtgtgaccagaacaacgttataaaaaggagatttaaaaatgacaaatatatttaagggttggagaaaaaatgatactttttggatgctgagtttgttcggaacggcgattggggccggcgtgctattcttaccgattggagttggcacggtaggtattcttggtatcatcatgatacttattttggctttgccaaccacattttttgctcacaggggcctgagtaggtttgtcttgtcggctaaaaatgatggtgatgacattactgatgttgttgaacaacattttggctttaagattggattgctttttaccattatttatttcttctccatttatccaatcttattagtttattctgtttctattacgaatactgtatcgaaatttattaccgaccaaatgcacatgcaaacaccacctcgttggctgttgtcgctagtacttgttgggattctcattggaattgctcgctttggtacctctttgattaccaaagttatgagtggcctggcctttccatttattattgtaatcgttctgttttccttttatcttattccgcattggaacggcgcaatcctctcaacattttccagttctgtatctgggggacatttggttggcactttaggaaacttgtggttacttattcctgttatgatcttttcgtttaaccattctccgatcatctcttcattttccgttgccgaacgtaaagaatatagtggggaaggtaaggacaaagtcgataaaaagatttcgacaattctattgtcggccgaaacgttgatggtcattgtcgcaatgttctttgttattagttgtacattggcgttgactccagaccaaatccttgaagctaaaaatgaaaatgtttcaatccttgattacgttgcgactgctttcaataatccaattattaaatatgtttctcccgtaattgcttttattgcaatcgccaagtcctttttaggacattatctaggaacgagtgaaggcttacgtgggattattcgtaagatggaagaaaaatctaacaagacgctttcaagtcgaactgtttcgacaattgttgatcttgttctgctactaagtgcctggatagttgcctgggtcaatccttccattatgggaatgattgaaaccatcattggaccaatcattgcgtttatcttgttcttgatgccaatgtatgccattcataaaagtcctaagttacagcaatatgccggcaaacacagcaatgtctttgttgtggtaattggattaatcgcagttagtggtatcctgttcaatatcatcaaattgtttatttagtaatctgactaaaatacgagatgaattcacattggttaatattattgaagccaatttttgtcataaatctcgttgctagtgttattgacgagattcgcatgacggtgttggggttcgtgagggtcgcgaatcgaatgaccatactggaggctggattaatcacaacggcggaattaattcagaaatgaaagctttgatgcaacggctttatgttttctgatcagtacaactgtggtgcttgcttgtgccgtaacttcaagattcataaagtttcgaaacgatgtattgacgatgaatgcgcaaagaagcgctagttgcccgtaccaaagcttaagttaacgtgatgattcaaataggaggatgactaaaatgacggtgaattacaagagtgtttttgatattattggcccgattatgattggaccttccagttctcatactgcgggggcgtgtgcgattggtcgagcagcgaatagcatttttcaggagaaaccgacagatattgtcattcattactatgaatcatttgcgcaaacccacaagggccacggaacggactatgcgattatcagtggcattcttggttttgatcctgatgatagccgggttccatatgccattggtttggcccgagatcaggggataaatattacctttatcgaagagcctggtgatagcccaatcaaccacccgaacactgccatcattgacttaaaaaatgatgataagcaagtgacggtcgctggatgttcaatcgggggtggaaccatcgaaattcgtgaaatcaagatggatggttttgatgttaaacccaaagggccacttcctatcttgttagttcaaggtggtgagaatgaccatcagcacgtaaccaaacagttggctgatctgactaaagtaaacgaccagcagcagtacaagacggctcggggcaatttatatgaatatgatttggatcgccgcctcaaacaggatgaaatcaaaaaattagcgcagggacacgcaaatttagtttacttataatcagggaggtcagttatgatgtacatgagcgtagcagaactggtaacagcggccaaggagaccaagaagccgatctacgaattaatgattgaacaagagatggaaacatcgcaaacgagtcgtgaagaaatctggcacacgatgggccggaatctagacgtcatggaagcagctgttaataaaggggctgcgggcgacggggtctattcaacaactggtttaactggtggtgaagctgttctcttgaaaaagtatcgtcaaaaagggcacactttatccggcgatacgatgatgcaagctgttcagaacgcaatctcaaccaatgaagttaatgcttcgatgggagtcgtttgtgcgacaccaacggctggatcgacggggacactacctggtgtgattttcacgctgaagggccgaatgaacctcaaccgtgaccagatgatccaatttctatttaccgctggcgcttttgggatggtcatagctaataatgctgggattgctggtgcgactggcggttgccaagctgaagttggtagcgcttctgcgatgggcgctgcggccgcggttgaagttgctggtgggacgcctgaacaaagtgctgaggctttggcgatggcaatcagtaacttgatgggattagtgtgtgatcccgttgctgggttagttgaactaccgtgtgttaaacggaatgcgattggggtcggtaatgcgttgattgcggctgacatggctttggctggctgcacgaacaagattccagcggatgaagtcattgcagcgatggataaagtcggtaagggcttgccaaaggcacttcgggaaactggactgggtggcttagcggcgacgccaaccggtattcggatgaaggaaaagatttttggacgatcgactaattcacaagttcatgcataaaaatgtcgcagaaagatgatgagctgactaaaggcggtatcatcttttttaattagatgtttatatcgttacatgtattaacattttatcagtgtgataaaataatattaagtcataacgttgtaaaaaaatagtgaggtgagtgccgttatgcaaaaaccattaacagctgagcaagaatacgtgcgcgagtttattccgtttgttgattttttagcagatatcttaggccccagtagtgaagttgtcctgaacgacttgttggatttaaaccactccgttgtggcaattcgtaattcccacatatcacatcgacaagttggcgatcctgcaactgacttagcgttgcgaacgatgaaggccggtaaagctgaaaagcgtgattatctagccaactacaagggtgtttcgcaaggaaagcactcactacgatcgtcaacttattttttgcgattagatggtgaaatcgtcgggatgatttgtattaatacggatgatagtgccctagacgatctgcaggaacaagtattgaaggtaatggcgagttacaaacatttgaactcaccaacgattaatcaactcaaaggaacaccagctaatgagaaggcccatgacacgccggtcgcgccggaacatctaaccacttctatcactgatttagctcgggaagtgacccaggctgtctgtgctaagtatggcgtctctgttgaatatttaaagcaaaatgaaaaattagaaatcgttcgtagcttataccaccaaggttacttcctattgaaggattcagttagtgaagccgccaaagtgctcaaagtctctgatccgagtgtttatcgttatttgcagaccgtcaaagatgaggatctccagcaggattaaacgatgtaattgtaagcgattaacgtcatgaaaccctgtcaaaatttagttcagccatagtggcgaaactgtgaggaagctactctgagttcctggacaggtaagaatcatggtcaccaccgtaaaaatgcggcagccaacacaaccagtttgtgtgcgggctgccgcattttaagtagttaaataaactgagcaatcaaatcccccgttgttcagtggtggctggtcgcaattggtgtggcgattagtgccaggggagcgtgtgtttttatgtgattcaggttggaacgtagcccctttttatgataatttggttagaatgacatctttgaggatgtcagtgggaattttctaggtcttatcaaaagggggattaaagattttattaatttggttatcaactgattatcatcataataaatctcatgcaattttcattagctgacagcgagttgaaaggctgatgtagcgggggtcaattgcgattattatcaattatcaaagattatcaaatcgtatcatggaccgttgattggcgcattatatggtattatggtgaataataaatggaggtgatgccaatgttgacaccgaacgaaattcgacgccggttacgacgcgatttggttacaattgccgaagcttatcagattggctttgagagccgtttatacacggaagccgagtatgaaaacttaaagcagacgttattgcagttgcgtgaacttaatatgaaaccccaacatatggaacagctacttgcgattaacgggtaacggaatgttgctaaattaaataaggaagtgattagtcatgaatgctgatagtccatcaggttcaattcagtccagagagtgctaatgccagtgaaatttatcacgcgcattagcactcttctatttttctagcgggcggtgtgttaataatcatttaggacttgagtaggattaaaataggtcgcttagttgaattattattcggtatcacgtcgttcccaatcatcgtatggagtacatagtatgacagtagtaaaatcggtggccaatcgtggcgttaattacgtgacaatgttaactgttgatgtcagaatgaattgtacagcatcgcacgtcttggtggcaccttaaattacgcagatttagcttaattatcttacaaaatcgttcatgaaagcgtttgaattagtcgagttaatgattttattgcgtaaaaagattacagtttcctgatattggttgtatttttgacggacattctttattatggttaatgattgtatgatacagtgtgacacttatttagcgaggaaagttatgttatgaaaaaaatgataatccatggcggaaaacgactttctggggaattaacgatcggtggcgcaaaaaatagtaccgtcgcactgattcctgctgcgattcttgcagacactccggtccaattcgatacggttccgcacatcttagacgttcacaacttacggctcatcttagagtcgatgaacgtccattccacttttgaaaatgatgttctaacaattgatccaacaaatattgaagaatctgaattaccaagtcatgccattaaaagcttgcgagcttcttactactttatgggggccttactcggtcgttttaaccgtgcaacggtgactttccctggtggtgataatattggtccacgaccaattgatcagcatatcaagggttttaaggcgctcggcgctaacgtcgttgaagagaatgactctgtctttatctcaacgggcacagagggccttcacggagcgcgcatctttttagacgtggtttccgttggggcgacgatcaacattattttggctgccgtcaaagctcatggtacgaccacgattgaaaatgcggctaaagagcctgaaatcattgatttagcgacttttttgaataatatgggcgctaaaattcggggtgctggtaccgacgtaattcgaatcgaaggcgttccggcactgcattcgcgggcaacccatacgattattcctgatcggattgagacgggaacgtatctatccctggctgcttcgattggggacggtattttgctaaagaatgtgatccctgaacatatggagtcattcacggcaaaactagtcgaaatgggtgtcgatttacagattaatgaagatagtatttacgtcccacggtccaatgatttggacccaattcgggttaaaacaatgacttacccaggctttgccactgatttgcaacaaccaatcaccccattattattgcgtgctaacggtagtagcgtggtgattgatacgatttatccgcaacgcacgcaacacgttgaacagttacgtaagatgggggcggacattcgcgttcaagataacttgattgtcgtgggtcattcttcccacttacaaggtgcacatgtcgaggccggtgagattcggtctggggcggcactaatgattgctggtctcgcggctagtggcgttacggaaattagtcgcgctgacaatattctacgtggctatgatcgggtcatcgataaattgcatacacttggtgcggatgtggaaattgcagccgacgaagaagttcccgaaaactaacgatgtacagctaagaaagaacagtggttatggaaaaaattttaacaatgcacgatctcgagcagaaaacgttaaaagaaatttataactatgctcgtgagtataaaatttcttattattcgcaaatgaataaaaaggaactctcattagccgttctccgtgagcaggataaaaagcggggctttgtacaaatggaaggcgtcttggaaattattagccaagagggctatggctttttgcggccaattaattatgggccttcgcaggaagatatttatatttctcagtcgcagattcatcgctttggtcttcgtaacggagactatgtggctggtcaagcccggccaccgcgacctaacgaacggtattacggtttaatgcgggtagggacggttaacggtaaggatcctaatgaggccaagcaacggccccattttccagcgttaacaccactttatccacaaaaacaaattaagttatcgacaacggccgccgttttagcgacccgtttgattgatacttttgtcccgattggcttcggtcaacggggcttaattgtcgcacctcctaaagccggtaagacgacgctgttaaagaatattgcaaatggcatcgtcgccaattatccagacgctaagctgattatgttactgattgatgaacggcccgaagaagtgactgatttagagcggtcaatcaagggagaagtggtgagttctacttttgatcaacaaccacaaaatcacgtgcgtgttgcggaattggtgcttgaacgtgcgcggcgcttagttgaagacaaacaggatgtgattatcttattggattcaattacccggcttacgcgggcatataatttggttatcccgtctagcgggcggacgttgtctggtggggtcgatcccacggcgttttacaagcccaagcgattcttcggttcagcacgcaatatcgaggaaggtggtagcctaacgattttaggcaccgcgttagtcgatacgggtagccggatggacgacatgatttatgaagaattcaaaggaactggcaactcagaattgcagctatcccgcgagttagctgagcggcgggtcttcccggcgctagacttgaagcaatccagtacgcgtaaagaggaattgttggttagtcgtaagaatttggagccagtctggcagattcgtcgatcaatgactggcaacgcgttagagtacaccgaacagcttttacaatttttaaaacacacgaagaccaacactgagtttgttcgtgatttagctagcttaaagttcactggtcaatcaacccggcggtcgcgtcgttaatactggcaggcgggctactttgtaggttgacgggaagctgtgattcgtgataacatgtttatcgttggttaaaactatgataatctctgtttcagcaaatgattcagggcaaaggagcgaaatacaatgcaaaaaggaattcatccagattaccatttagttgtgttccaagactcaactactggttttaagttcatctctggttcaacagcaacttcagcagaaactgttgaatgggaagatggtaatacttacccattgatccgtgttgaaattacgtcagattcacatccattctacactggtaagcaaaagtttaccaaggccgatggtgcggtcgatcgtttcaacaagaaatacggtctcaaataagcagacaattaaacggcgttccggcttcggcgggggcgtcttttttgtatgtgcaaatcatcgacgctcacaaacaaagccgcaccagttcgagtaatgaactggtgcggctttgtctcacttacgatatgattagtagcgcataatcgcgagagcagcggtttctacgggcatccggtctgcggggatgattcggatttgcccgttcatggcaatcacgacatcgaccaggtcgtcaattaaattatcaggagcagcaattggatcagttaattgaacatcggccgctggtaaggagccggcgacattcgcgtctgcggcgacaatcaaggtgtcgatccgcccacttagtgctggcttgatcatgtcaaaaggatcggccaatgctaactggcgggacttagcctgatcataacgttctagtaaaatgtcggctaattgggtatgccacatcgtctgaacgggttctgtggctgtttgcattgcgcccaccgttaagttttttggtgacttattgatcatgaggtgttgtgacaggtacggattcttgttgacggcacggaagactgcctggttatgtggtagtcccattaagatcaatggccgtcgcgtcttttgtgaatgggcctgaacgtactgcgccacttgttggtaataatttcgttggtcaatatcgcgttcttcggccttcgcattatgaccatgatagttggcaccgtgaacggggctggcgttgaaattcagatcaccgccacgtttttcagtgcccaatgcttctgtcagggtgcggggggcctcagctggcaaatcaagttcgacgaaactgccatcacgttgggcgtagagcgccatgctatcttcattgagtgctagcaagtcgaagtcgaattgatgctggcggtcggctagtactgggcgaatagctggcatgctattgacgctgacatggttgtcagtgggatattgtaagtcgaaaatgtgtaggtcacgactgttagtgatgatgcccgtctgagggccagtgtgctgtaaccagaaggcgttgtcattaattaattgctctagttgcgtcgcgtatggcgcaaattcggttttcggaaagtggtgggccatctgggtttcagcttcattaactaattgtttgaattgtaagcggcggcgattgaggtcgttgagcacaacggccgtgttgaggtaaattgcaatgtatgggccatcctcacgttgttgcattagttgattgagatcgttttttaccatcgtttccataggtccaacctgctttctgtttttgatacaattagcataacaagaatccgattacggacgcaaatataatgattatgataagctatagataattctaacgaactaaacgaattcggggctttattatgcgaactaattaaggtatatttaccatagaacctttgataaggggcgtaaacaaattaggaggcgggattaatgaagtccaagcaacatcccgggttaaagtggttaggtcggggcgtttttgtcctgctggtgctagtatcattggcattaattttcaatgaacagatcaagagctggttagtgagttcatactcgccgaccgttacggctaagacggttaagcagaatacgaagaagaagagcgattttaacttctcaaaggtcaagtcacttgactttcagaccgttgccaaggcccgcatgaataagaatgcaatcaacgtgattggctcgattgcgattccgtccgttgatttgtacctgccaatcggtaatggtgtcagcaatgaaacgttagcattggcggctggcacgatgaaagctaatcagaagatggggcagggtaactacgcgttggctggtcaccatatgatcaagcatggcgcactattcagtccgttgtactataagagcaaggttggccaaatgatttatgtgagtgatgccaaaaagatttatgcgtataagacgagtcagcgaacattcattaaagcaactgatgtccaagtaattgatgatgttcctggtcagaagctgattaccctaattacctgtgataagaccggggcgggtcgcttaatgattcgcggtaagtacgaacagcaatggtcgtttaagtcggcgccaactcaggttcagaaggcctttacaagtcattttaataacaaatattaacaattattacattctaggggtatcgatatcttctaacggaatttcacggtacaatataacttaaggtcacatgtctcagataagacataatttagagggggtctattgatgatagctttaattatcgttgcggtcgtattggttttgatcgcaatttacgtggtaatttataacggtttagttaagtcacggatgtatacgcaggaagcatggagccaaatcgatgttcagctaaaacggcggactgatttgattcctaatctggtcaatacggtcaaaggttacgcgaaacatgaaaagagtaccttagcggaagtgatttcattacggaatcaattaacgcaagtgccgagcggtgatcaccaacaggctatggcagtttctgatcaattgacaaattcgttgaagagcatttttgcgttagctgaaagctaccctgatttgaaggctaatcaagaattcggtaagctgatggaagagttgaccaatacagaaaacaagattgcttattcacggcaactgttcaactctagcgctgccagctataacatgaagttacaacaattcccgtcaaatattattgctggcattcatcacttcaagaacgttgaattcttaactgttcctgaagcagaaaaagcagcacccacggtttcatttgaagattagaggttatgcccatgttatttgagcaaattgcccgcaacaagcggcacacgttatacgtgatggccgcttttgtcatattacttgcagtgattggtttagcagttggctacgtgttttttaatagtgcgattgcagggttactagtagccttgattgcagcggtattttatatggtattaatgattagtcagtcgactgacattgtcatgagcatgaatcatggacgtgagctgcatcaagctgacgatgatccagagctctggcacattgtggaagacatggcgttggttgctaaagtaccgatgccacgtgtctttattattgatgatgagagccccaatgcgtttgcgacaggaaatgaccctgagcatgcggcagttgcagtgacaattggtattcaggcacgattaacgcgtgaagagatggaaggcgtcattggtcacgagatgagtcatgtgcgtaactatgatattcggttacagaccattgccttggctctgacagcggccgtcagtttgttagtcaattggggtatgaacgccttttggtggggcggtggccggcgcagtcgggataatgatcgtgacggcaacggtgcccaggtcttactaatgatcctagcgattgttgtcattattttagcgccgctagcagctagtttagtgcagatggcgctatcccgtaatcgcgaatacttagcggatgccggcagtgtggaactgactcgtaatccgttgggcttaatcagtgcacttgaaaaaatcgatgacagccaacccatgcaagcggcggatcctagtagcgcggccctttatatttctgatccgtttaaggcgaagaaatcatggatgcacttattcgatacccacccaccgatggctgatcgcatcactcgtttaaaaaacatgtaataaaaaaatgcgtttaggttaataacggattataatgaaaacaaatagaaagttgaaagagtgagacggttgcaacgcaaatatatttacgccaatttggaaaaactggataaccttgtctttgcttacgggatcgaccagagcgactttgtgcatggtatcaagcgcttgccagctaacttggtctcgttagtcggtgttgatgataacgagcatgcggtaaatgctcacacgggtctgaacgtcattaatgatgaaaatgaaattcggcgatatttgttacagagtcacgcgttacccgttaagtggcttgattatgatgaagttggcgatttggattttctaaccgcgactgagattgccgagctattgtatctcggacatatggatcgtccaattcgatcaccgtttaattacaaactgcgcaaccactacgttttcttggaacaacgcaatggtggtatcaaagtgtacttctattatatttccgcatttagccatattttaagtgctgccattgtgcggcacactttggcagcttaccgtggccggcgtatgtttatgcgttcactgagtgttccacgagtacctgaagcgattctcaagcaactcgttcaattgatgccagatggtttgttcatttactttgatcagtcaatggttcggcaacgccaattattggtgccggtgcacacggagacgacaggcaatgaaatcgaagtttttgatcccgctcgtggtggagagaatcggcgaacccaccatgtcgcgacccttacttttaacttgaattcaggcgtgtgggacttgcaagtgcaggaccaggctgcgttcgaagaacatttatagtattatcatcttaacgcttggctgatcattcagcgggcgtttttaagtcgtttggggcgggatttaggggctaaattggtctagccatagagtccctggggtcaaagtggtataatttttatgcgcgtagcttgaattgggctacgattcgagaaagtggaaccttagtcagaacttggctgaccgacaagtggtcgccatgaatggagagtttaatcgatatgaagatgcaagttgccgaaattgctaaggccgttcaagcggtcaatgccgaacaggcgtggcccgatgttaatgtaacgggtgtggcgtttgatagccgaaagctccaagcaggggatctatttattccgctgatgggcgctaatgatggtcatcaatatattcaaagtgcaatcgagcacggggccgttgctaccttatgggccagcgaccatgccgacgacgttccagaagacttacctgtcattatggttgctgatacattgacggcactacaccagctggggcaatactatttacaaaaaattaatccgaaagtcgtggctgttacgggtagtaatggtaaaacaacgacgaaggatatgattgcgagtgttttgagcactcagtttaacgtgacaaagacgcacgccaactttaacaatcagattggtgtgccagtgacgttactcagtatggaaccgaatacagaagtggtcgtcgttgaaatggggatggaccattttggcgagttggatttcttgagccgtctcgttcaaccagacgttgcggtgattaccatgattggggaagcccacattgagttctttggtacacgggatcgaattgctgatgccaaaatggaaattgttcacggcttaaaagaagatggcacgttcatttttaatggtgatgaaccactgctacaagaacgtgctaaggaagtcagtcagcatcaacggacgtttgggttggatgatacgaacaccttagcaggcagtgatatcacgactagtcgggctcaaacgcaatttaagacgagtctgtggccggacaacacgtacacaattccgatgatgggtgcgtacaatgtcaataatgcattggcggcgctcttagtagctgatacttttcacattcgaccagccgctgcgcaacaagcaatcgccagttttgtgccgacggagaaccggacggaatggttaactggttaccgtggagaagccatcttaagtgatgtttataactctaatccaacggcagctcgacgggtcctagccgcttttgcggcggtacctactaagggtcagcgaatcgctgtactcggtgatatgcttgagttgggtgaccagtcggatgcactacacatgagtttagccagtgaattggatccagccacgattgccagcgtctatttgaatggtgaacatatgcgagcgttggcagaagtgctacaagaaaagtacccagccggtgcggtccactattatcaaacggatcaacagccccaattgattgccgacttaacggcgacggttagtgcggatgatcaggtcttattgaaggggagtcacgggattcaccttgaaaaggttctgacggcgctggaagctgctcctgaaaaataaaatttaagtgattcgattaagcaggcccctcgcaatgactgggtaatggtgacgctaacattagactgataatgttgtttcccttccggtattgctaggggctttgcttgcttatttagaataaccggtgtatgataattcagttgtaccatatgaaagtcagaccgttggcttacatgacagcgtcttacgggaaacggattttttcctagctggcagtaatcccatggtgtcatccttaggaggaaacatatttgaagtttacagaactaggcttatccgatagcctacttaaagcagttaatcgggccggatacgaagaagcgaccccgattcaagccgaaaccattccaatggttctagaaggcaaagatgtgattggtcaagcacaaaccggtactgggaagaccgccgcgtttgcattaccaatcttacaacgcttggattttgacaaccataacattcaagcattagttgtttcaccaacgcgtgaattagcaatccaaactcaggaagaaatcttccgcttaggtaaagacgaacgggcgaaagtccaagtcgtttacggtggtgctgatattcggcgccaaatcagaaatctgaagcaaaacccacaagtaatcgtcggaactcccggccggttgcttgaccacattcgccggggcacggtcaagttagaccacgtcaagatgttagttcttgatgaagctgacgaaatgttaaacatgggtttcttggaagatatcgaatcaattatcaaacaagtgccggatgaacgccaaactatgttgttctccgcaacgatgccacctgaaatcaaacgcattggtgtgcagttcatgaaggaaccgcatcacgttaagatcaaatcaaaagaaatgactgctgatacggtcgatcaatattacgttaaagccaaagaatttgaaaagttcgatattatgacccggttgtttgatgttcaggcacctgaactcacaatcgtgtttggtcgaacgaaacgtcgagttgacgaattatcaaagggtctcgaagcacgtggttataatgccgctgggattcatggtgatttgagccaacaacgtcggacgcaaatcatgcgtcaattcaaggctggtaaattggatattttggttgcaaccgatgtggctgctcggggacttgatgtttctggtgtgacccacgtttacaattacgatattccacaggatccggacagttatgttcaccggattggccgtactggccgtgccggacacaagggtgtttcattaacttttgtaacaccaaacgaaatggaatatttgcgggtcatcgaaaagttgaccaagaagcggatgttaccattgaagccaccaactgaatctgaagcttttgctggccaattagctgctgcagaagcgaatgttgattcgttagttgctaagacttcgactgaaaagtatgctgatcaagctgctgaattattacaaaaatacgatgctactgatctagttgctgccttgttaaatgacttaaccaaggatgactcgtcagcggtacctgttaagattacgccagaacgcccattacctcgtcacaaaggtggcggcggtaacaaccggcgtggcggatatcgtggcggtaatcgcaaccgcaataacagtcatggcaatggtcgtggcggttattctcacaatggtcgcaatcgcgaccgtgatcgtaacggtggccgtggcgatcggaagagcaatggttataaaggtcgcagtcgcgatgataaccggagcagcaaccgcaaccatgatgaaggtcgcaagcaaagcagcaagcggagctatacgatccgcaccaatgattaaagtcaacgcacaaattaagttgaattaaattaactttgcacaaaagccgagcgcacgctcggctttttttatgccctacaatgttagaatacaagtagtcggcagatgttcgtatgaattattgttaaaacgttccaaacgcgtcaagtcaaagtcggccagcttaggccgctggaaaaaagtcgagtgagcgtaaacatgtttggttagcgcgtcctaaaaccgacctccaggcatttctgccaattgctggaacgcggtggacacagatttaagccgcagaccacgtcttaaatactggtcttccactaaccaagcaaaggacgcttgctaagtggaatttcaccgctgagcattggccgaaacgccttccagtcgggacagtgttcgaatggcggacatgtgtgtacccaacttttggtgaattcgtcattgtttttcataaaccataattttgtcaatcaactgtcagactgaaagtgatattgagataattcactaattctgaatcaaaatagtaagatttaatctctcgacaaagtgctagtgcacttaacgctttgtttaaagttccagtatcaaaataggcaacgatagattgtgctaagttcggtgccactaaagcctgtgttggctaggcaatgctcggcttcaacctgtggcctctcacaggcttgagactggaggggatgggtgacaatgctcagtagccaagttattcttaggcggaagtgggttgcttccggcttagaataagactcgtatttgagatgacgcgggttgggcgttagctcaaatcgacgtcggctgcgttccagcaattgtcacccagccctggaggtcggcataggacgcacaagtgctgacgaacaacaaaccaattaaattggaacgttttaacaataattcatgctgacatgaaaagattgcgtgtatgggcccttttatcgcggcggtagctgtggtaaattggaaacatcagcctaagttgacgtgataataatgagatagagggggtcacagcgtgatttatggtaccggcattgatttaactgagcttagtcggattgaagcgattctagcgaagggactgagattgcctgaaaagatcttaacaccggctgagttggcggtgttttcacgttacccggttaaacgccagatcgagtttatggcagggcgtttttcagctaaggaagcatatagtaaggcatatggcacgggaattggtgcggcagttggatttcaagatatcgaaattttagacaacgcccagggtaaaccggaagttacgcgccacccgtttgatggtccagcgtggatttcaatttcacacacggatacgttagtaatgacacaagttatattggaaagaggcaatttgtgatggttgtaattggggagcaccgccacacacaagtcacagtcgacttgcaggcaattaagacaaatattagtaatgaaatggcgcaaaaggatgagttgaccgagttatgggcagtcgttaaagcgaatggttatggacatggaattatccaagttgctcaggctgccaaagaagccggggcgaccggcttttgtgttgcaatcctggatgaggccttagcgttgcgggccgctggctttgcggaacccatcctagtacttggaattacggaaccggaatacgccccactggtagctgaaaaggatatttcactagctgttggaacgcaagattggctgactacggccgcagcaattttagcggctaatcaagtgacgacaccacttcacgttcatcttgcattagatacgggtatgggacgaatcgggtttcagacgcccgaagaattggcaacggcggttacgactttgcgtcaaccgcagtcaccatttgactttgaagggatttttacgcattttgcaacggctgaccaggcagatgatacgtattttacccatcaattaaataattggaaacacttgattgcagtggtggatgagctaccacgctatgtccacgtgtccaattcggccaccagtctctggcatcaagcttgcaatggcaacatggtgcgctttggggttgcactctatggtctaaatccttctggtcgcgaactcagcgcaccataccccttgcaacctgcgttgtcgctaacggcacgcttgacgtttgttaaacgcttggctcggggcaaatcggtcagctatggtgccacgtatacggccgcacaggatgaatggattggcacggtgccgattgggtatgcggacggctatgaacgccgattacaaggcttccatgtacttgttgatggtgagttttgcgaaatcgtcgggcgggtctgcatggaccagctgatggttcgtctgccacatgaagtaccggttggagctaaggtaactttggttggcacggacggtgctcgtaccatttcgttgcaagatattgctgactattgtgggacaattcattatgagattgcttgtgggttagcaccacgagtgccgagagtttatatagattaagttttatcagacgataggtttgcgaagattgtctcgtacaggctatggttacatggttggttattgagattaagccaataaaatgagtgccagagaaattctggcgctcattttttagagtctcctattttattgatgagggctgttaagtttttttcagtgattcgagtgatttatcggcatctaattataagttcgtttatttttaaacattgatgaaatcatcattgggcagtcttaattaatcggtctgaagtattagttttaacggtgcttagcgattagttctttggattaaattggtaaacggttgctaaaagtgaatggttcatgctattatgagtagcaagatggttatattggggtactatcagatacattgggtatcgaataaagggagatgaggcgatggccgcagctgacattaagcgtggtgacatcttttatgcagatttatcaccagtcgtaggctccgaacaaggaggcatgcgtccagtactaatcgtgcaaaataatgtcggtaaccattacagtcccacagtgattgtcgcggcaatcactgctaaggttcaaaaagcgaagatgccaacacatgttaacatcaacgctgcccatacggggattgaaaaaaattcggttgtgttgttggagcagatacgaacgattgataagcaacggcttaaagatcgcgtcactcatttggatgatcagacgatgcgccgagttgataatgcgttacagattagtattgggttagctgatcgaacacgacgtcggccacaacgcacgtttcaatcatagtcaatcgatggggattaattatttacataattgaactatttcggtgcgatgaccgagtatggataatcagcgggtttcaattcagttaatgactggattgaaacccgcttttagtttctaaattggctatcggtaaatgttacagggcctgttggagcatttagtgatgagctaacattattgtgcattatgattgtctttctgatgacgattaggtaagctagttgaacccattataacgagggacgattggctgtaactcgtgaatatcggtgaaaggatgggggcataatgagtaaacaggctcagttcaataagcatcgggtggcaggattgttagtcgcgatgggcgtcgtatatggtgatattggaaccagtccgttatacgtgatgaaggccatcattaccggtcaaggtgggatgcaggccgttgatgagaagtttatgttgggggccgtctcgctagttttttggacaatgacgttgctcacgaccgttaagtacgttctgattgcgttaaacgcggataatcatggcgaaggcggtatcttttcactattcgcattggtgcgtcatcgtgcgcgctggttagtcattccggccatgattggtggggctgcgttactggcggatggggcgctaacccccgcagtgacagttacgactgccattgaaggcttacgcgatgtaccagcatatgttcaactgtttggtgccggccaaaatacgattatactgattacacttggaattatcaccctattatttatgctacaacgttttggaacgaacacgattggtaagttattcggtcccatcatgttgggctggttcacgtttttgggagtcagtggcttcgttaatctggtgcaggattggacgatcctgcgtgcactgaatccctattatgcgtggttactcttgatcagcccggcgaacaaagtgggaatcatgattctagggagcgtctttctggcaacgaccggtgctgaggccctatacagtgaccttgggcacgtcggcaaaacgaatattcggttgagctggccgtatgtcaaagcttgcctactactcagctatttcggtcaggccgcatggattttaggtcccggccaagcgattcagggccatgtgaatcccttttttgcaatgttacctgctagcctgacgatggcggcagttatttttgcgacgctcgcggccattatcgcgtcacagtcgctgatcagtgggtcgtttacgttagttagtgaagcgattcgactgaaactattcccccgattactgactacttaccccggtaaagcagtgggccaaatgtatttaccggtcgttaactgtgggctgtggggcgtgacgagtatgctggtgattttctttcaaactagtgaaagaatggaagctgcatacgggttagccatcacactgacaatgctgatgacgaccactttgatctacgcgtttttacggcaaaagcgcttaccattaatcggtgcgggactactgaccggtttcttcgcgaccatcgaagtaattttcctgattgccagcgcagccaagttctggcacggcggctacgtagcggtcggacttgctttactaattttcctagtgatggctgtgtggtatcgtggcgaacaaattgtcagacaacataaccacccgcttagtttacgacaatatcaggaccagcttgctaagttacgtaacgatcagacggtggacaagttccagacgaacgtggtcttcctaacaagccgaatggatggcgaccaagtggagcgaaaggtattatattcgattttagacaagtggccgaaacgtgccgacgtctactggtttgttaatgtgacaatcacggatgaaccgtataccgcggagtatactgtcgacacgttagcaacggactatttggtaactgttaagttatacctgggctttcgtgtccgccaagatattaaccgctatttacggacgattgtccgcgacttaatggctacgggacgtttagcggcgcaaaagcagacatattcagtcacttctggccgcgatgtcggtgacttccgcttcgttatcatcgaggagaagttagaaaatggtagtcggttatcccgcttggatcgattagtgatcgagacgaaattaatgattaaaaaatacgcgacaacgcctgccaaatggttcggcctagaattctccgaggtgactcttgaaaccgttccaattctattcaatgagatcccggcgttaccgatcactgaaagacagtaatgccatgcagatttctgggggtcagaatcagccagcttagatttgcttgaaaaagttcagcgtagtgtaaacacgctctacgacatctaattgtaaggcgcttcacgtcggctacgttccagcaattggcaactagccccgaaatccggaataggacgaacaagtgctgaaaaatagaaaactaactgtcggcttgcttaacaactcatctaattttaatttttgcttgagcaactgataactcaaaactaatttcaatagctgatactggacgcaaaacgttgacttgacagcgataaaagaacgactgaattcaaatcaaaaattagaaacattaaattttgtgttgacaagtgtgaacttagaactataatctaattatattctaattattcaaatgcggtgatgagataagtaaatcaatcgtgggtttttcagagagccgggtcaggtgcaagccggtattcccgcatggttgaaaatggtcttggagcattcagtgccgaatgattaagcgctgacggtggtccccgataaacggacaaaggtatctcaattcagtgagattgacgtacctgctgaggactattttgcgaaaaatagtcgaattaaaggtggtaacacgagtcatcgtccttctgtcataacgacagtggggcgattttttattatatatttttggggaggcttcgcgtatgcgaaaaaaggaaattatttttgggttattaagttttattgcactgggaacagtattagctggctgcggcagtagcagtgctagtagtaaggatacatctaaaacctataagtatggtgaagtaacgataccagctaaggacggttctatttgtaatgcgccaaattatatcgcgtatgagaaggggttctttaagaaaaatggtatcaaggccaaactagtagcgaacccgcgggatatcagtgacctagaagcgggttttgcgagtggcaaatatgacgcgcaaaatggtgattttcaatacttacctgcgattcaaaacggggcgcaaatcaaagctgttggtggaatccaccaaggctgtatcaagttgctggttccgaaaaactcaagcattaagagtgttaaggacttaaaaggcaagacgattgggattccggctcagggttcaacaccacaatacgtgacgtccattgcacttcaacatgcgggtattgatccgaagacgggagtaacgtggaaggtttacagcactgatctattggcaaaggcggctgaaaaggggcaggtcgatgcaattgggacggtcgatccgtatgcttaccaagcacaaaaggaatctgggtttaagaccattattgataataataacaatagtggcaatgctaagatggctgcaatgggaatgaaatcaaagggtgcttgctgttacttgtacgtttcgagcaagttagtcaaagagaatccagcgaaggctaaggccattgtccgttcatacaaacaagccgctgcttggatcaataaccatcctgaagagacagcaaagattgaattaaataaggggtatgtctccaagacgaagtttatcaatgtgaagaatgtgacccagatcttgaaagatgaacattttgaactaaatcttaagacaggtaaagaagatttaagttattatatcaagcaattgaagcaagcaggatatttgaagaagaatacgaataacaagcaattgttgaagcaagcttattggtatccagatttatctaagaactaagttcaaggaggtagaatagtatgcaaataacagcagtccaattgagtcgaaaaaaagctgtgcaggcagctaagacaactggccgttattggaagccctggcacttgacctggaacattgttagtttagtcgtattagcaattgcgtattttgaaaaccaattggttgtatcacaggaaaccgttaataatcagacgtatcattggtttttaggtgggtactttgcttatttattgattgttacgctgattggcgcagttacaaatggtcgaattcgccggtataatggacattttgcccagttgaacgtttcgttagttggcttgctgatcgtgcaggatcttctgaccgaaaagtttgccgttctagaacagcctttcttcgtgagctttgcacaaatcttggaccagatgcgcgaaaatgccggcttgctctgggcttcgacgttgtcatcattagcgctttggttgattagttttgtgattgggaccattcttggaatcttacttggtttgggcatgggacgctatcgtgagtttaactactgggcattcccctacttgaaggtcatcgggattatccctgcggctgcatggatgccgctgacgatggtcatctttccgactagttacatggccgaagtcttcttgattgccttctcggtttggtttccagtggccttcatgacgattggtggcgttcaagggattagcaaggaatacttcgaatcagcaaagaccttaggatttagtgagtggcagattatccgcaaaatcgtccttcccggagcgttgccaagtatctttactggcgtttatacggcaatgggattgtcgtttacaatgctggtaatttccgagatgattggtgctaaggtcggactgggctggtttatcaactgggcaaagggtaccgggaattatacacaagtctatgcggcaattgtgattatggcgattctgttttcagtgttatttgcggtgtttaccaaagttcaagattactgcctacgttggcgcgatggtgctcactagaaaggagcttataagatgggattacttgcagttcaacatgttaatcagcggcttcaagacaatgatggtcatcagatcgacgtgctagatgatattgatttcaccgtcaatccgggtgagttcgtagcaatcattgggccgtctggttgtggtaagaccacgttactacgcctgatttctggattagaccatcccgctagcggtcagctaacgatcgataatcagcagattaagcgaccagataattctcgcggttatgttttccaacatggcagcctttttccatggtcaacaatcaaggagaatattagtgtcggcctgaaagtgacgcgtggtcggcattatgaccaccaattggtcgaccattatattgaattgatggggctaaaaggctttgaaaatgcttatccgcatcaggtttctggtgggatggcccaacgagctgccctcgcgcggtcaattatcatgaacccgcagctcctacttttggatgagccgatgggggctcttgatgcgtttacacgtgcggatattcagaatgtcatcgaacaggtttggcagcagacacagacgacgatgattttagttactcatgatatcgatgaggcagtctacttgagtgaccgaattattgtgatgacgcctcgtcctgggagaatcaaagaaattgtgacaaatccattaccacatccacggtcacggttgagtgtcgattttgctgaatttcggcatcggattcaagataaattaaactttggcgctcatgatggacaggttgctgggtgatgactaaaaaatgcttatcaagatgattggcgagataccagtcttgataagcatttttgctgtgaaaaaacaggatcgcatggtggtgagcttgatatggccatccaggggacttcgttagttggactaagtacgaagaagcaggcttattcgcttaccatcgttgtcgtactggccaatagggtcttaagcgtatcaatcgccgtaatcaatggttgtccatgattcaatgcagcgatagccacgggattgtcagtttggtcattaagtgtgaaacccactgctttagtctttgcaggccaatcagtcgtgttagcgattgttgtgacggtgaggtggttagccgcgaacagttcctggaccgcgggttgcgccacagtggcaatatcggtgatgagaccatccactgtgtgccaagtctctaagtgataactatcagccatggcggcatgccaagcggtcgtgaaagtcgggccgataccaagagtctcaccagttgatttcatctcaggacttaaaacgactggtgattgtggcaatttattgaaagagaagactggggcctttatagcaatttgttgtggagcgggtgtcaagagtccggggactaggccaagggttgctaaactttgaccgagaattagccgggttgccaattgtgccagtggcaagtgagtaaccttgctcatgtaaggaactgttcgacttgcccgcggattaacgtcgattacgtagacatcatcggtgacgacgaactgaatgttcatcataccgacacagtggaggtgttgtgctaatttggtggcaatggtgacgatcttatcttgaacagcagggctgaggtgctgtggtggatagactgtaatggaatcgccagaatgaacgccagcaccttcaatatgttccatgattcctggaatgaagcacgacgttccatcggagagaacgtcaacttcacactcggttcccgacaagtattggtccattaagataggcgcaccatggccagctgccaccgctgatttaataactggcgtgagctcatgatcgttatgaacgattgccatggcccggccgccgagtacaaagcttggccgtacgagtaaggggtaaccgattgcgtgagctgcttgacgggcaccggataactcagttacggtcgttccagcggcttgggcaatctttagtagacgtaaacagtccgcaaaagattgccggtcttcggtcaaatcggtagcggacacactggttcctaggacggtgactcctaatttagtgagctgatgggcaaggttgatcgcagtttggcccccaaattgaacgatgacgcccgcgggttgctccaacgcaatgattggcatcaaacgttcgattgttagtggctcgaaataaagcttatccgaggtagaaaagtcggtggagaccgtctcggggttgttattgacgacgattgcatggtagccagcttgttgaatggccttgacacagtgaacggtggtgtagtcgaattcgatgccttgtccgattcgaatggggcctgatccgagtactaaaatactgtgtcctagtgggtgactctcgttagtttgtccaaaagcagtgctgtaaaaatatggtgtaacactggcaaattcaccagcacacgtatcgaccattttataaacgaagggtaaatcagcagtcatggcagcaatggtcgctaccgaagtttgggcataatgcgccatggtcgccagactcacaccgtactttttcgccgataagaggtgttgggacgtcggcacttgcttgatattccggatgagttgggcgatgtgctgtaacttactcaagaaaaatggcgtgatttgcgttagcgtcgctaattttgctaacggccaacccgcttgcagcgccgccaatagatagaagagccgctgatctgtcgggtgggtcaattggtcgatatattcagtcgtggtgacgtggtggtcaggggtcaaggaagcttgggtcttgggatcgatttcaagcgaagcaatcgccttgagcgtggcttcctccaaggttgacccaatcgccatgacctcccccgtggctttcatctgtgttcccaagtgagcgtcggccgttggaaacttgtcaaacgcaaaccgggggattttggcaaccacatagtctaaagctggttcaaaggccgcataggttgtctgcgtgactggattcttgatctcagataaatttagaccaattgcgatatcggctgcaattttggcaattggatatcccgtcgctttagaagctagcgccgatgaacgactgacccgcgggttcacttcgatgacgtagtactgacgactattcgggtcttgagcgagttgaacgttgcacccacctctaatgtcgagggcttccacaatcgtcaaagccgccgttcgtagctgctgatattcagtgtcagtcaaagtctgaacgggggcatacacgatagaatcgccagtgtgaataccgaccggatcgaagttttccatggaacagacgatgatcttggtaccctgattatcacgcatgacttcgaattcaatttctttgaagccggcgatactttgttcaatcaagcactcggtgacgggggacatggtcaacccccgctgtaacgtttgggtcaattcggcggcattattggcaatgccgccacctgaacccccgagtgtaaaggctggacgaacaatgaccggataaccgattttttcagcaaacgacaatgcactggtcacgtggtgaacagtggtacttgctggaatcggttgatggagccgcttcataagtgctttaaatgctgcccggtcttcagcttgattgatggtggctagggaagttcctagcagttggatcttcaactcattaagaacgccagcctgatctaacgccatcgctaggttcaatccggtttgtccaccaagtgtcgggagcaaagcatcagggtgggtggcccgcagaattttagtgacactggtcaaagtcagaggttctaagtagacttcgtcggcggtggccgtgtcagtcatgatggttgctgggtttgaattgatcaaaatgacatgatagccggctgctttaaggcttagacaagcctgagtaccggcatagtcgaactcagcggcttgaccgattttgattggaccagaaccgatgacagcaatcgaatgaatggcattgtttttaggcattaacaaccgcctccttttgaattgttagtaagaaatcatcgaaaaattgcccagcttcctggggccccgggtgtgcttcgggatggaattgcaccgacattacggcctggtgcggtaggcgcaagccttcaatgctgccgtcatttaattcagtgtgcgtgacgatcagcggggtgcccttgatcgatgccggatcgacggcgtaatcatgattttgcgaagtcatgataatacgaccgtcagcgcaggcttgtaccggatggtttagcccgtggtgaccaaaggaaagctggtaagtctgagcaccataggcgagcgcaatcaactgatgaccaaggcaaatgccagccagcggataacgttgtgcgagttggcgaatggtcgctaagtaagtgtgatagtcagtcggatcaccgggaccgttggataacaaaattccgtcagggtgatacgcggccacggccttgagactagctgtaggtggaaggacaacaacgtccgcgccccgggcttgcaattcagcggtgatagctgctttttcaccaaagttgagaatcgcgacgcgtggacggatggtggtcgtcgctactgggaggggggtagccgttagtgcttggggtgcgaatgtggcgagttgcgcttcaaaatcagtgatgggatgattgctcaagattgccatctgggctcccgtttgacgaatgtgaatcgttaggtcacgagtatcgacgccttcaatgccggctacatggtggattgtcagaaaacttgccagtgattggcgactagtatagtgatcattaaaagtggccagctcgtgaacgatgatggcttgtgcgccaatcgttggtgcctgggccacggtcggatcgataccataattaccaattaatgggtaagtgaaggcaatcatttgatttaggtaggatggatcagtcaatgtttcctgataacccgtcattcccgtattgaagacgatgcgccccgcagcctctagctggcaatccccaattgccgttccaatccactgtgtgccgtctgctaaagttaagtatttgttcatcccaatcgcaccctttctgataatttggttaaaatttcattttggttaatgggataagtaaacatcattttattgtggatgtcaattaaaaatacatattaaatgcataaacaactgaataaagctaaaaacatgcaattaatagagcaaaaatgaatattttttcaataaagcttgcaattttaaagcgatgagaatatagtgtgaatcatactttctgcatgaacatgcagctaatacactatttttgaatatttgaggtgattatatgcaagtcgcgctagttggcgttacggggtacagtggcatggtgttgtaccggctcttgaaacaacatcccgagatcgatcgcatccaattatacgggcacgtgggagcaactacggtggcattaaagacggtggcagccatgtaccagaaggaaacggcggttattcgaccattcgatgcgacggcaatcatgcgcgataacgcgattgtgttctttgcgacatcagcgggcatcacgcgacaattggcattaccattcatcgctgctcattttccagtcatcgatttatctggtgacttccgcttgcatgatccagagcaatatcagcggtggtaccaacgtgatccagcaccggcgaccgctttggcgcaggcgagctacggcttagctgatatgccggcgccgttgtccacctacattgcgaatcccggctgttatgcgactgctacgttattaggactagcgccacttgctcagcaacagttggtcgaaccgacttcgattgttgtggatgctaagtccggcttatctggtgctggcaaacgagcgacagctgcgagtcattacgtcgctgtgaatgataatttgagtttatacaagttgaatcaacatcaacatatccctgaaatgatgcaacagttacagcagtggtggtccgcgatttctgcgattgaatttactaccactttgattccagtaacgcgtgggattatgacgacgatttatgccaaagcgaagtcagcattgacaacgacgcaggtccgcgcagcttttaccgcgacctatcatgagcagccgttcgtgcaagtgctaccaacggggatgccgacgctcaaggacgttgttgggtctaataactgtgcgttaggcgttgattataatccggtcacgaacaccatcgtggttgtgagcgtcattgacaatttgatgaaaggtgctgcggggcaggccgttcagaattttaatcgctattttgatttcgcggttacggccggattaccgacgttacctgtatttccctgataaggtgcaataagagaggaagttatgcagatgcaagttttaacgaatacgaagtttgaaacggttgcctttcagtggccggcaggtttttacagtgatggcattcatattggtcttcgtcgtcataaaaaagattttggttggctattttcaaaagtgcctgccagtgcggctggaacttatacgacgaatcagtttcaggcagcaccaactaagttaactaaacagatgatcgaccagggccaccaattacagggactgctgctgaatagtgcaatcgccaattcttgtactggcgagcaggggtggcagaatgcgctgcaagaacaagcctggttagcgaataaactaaacgtggagccgaacttgattggcgttgcttcaactgggctgattggtgctcagttacccatggataaaatcaaaaacggcttgccgcaattgacaccaacgaagagtgacgcggtgacctacgccgtgttaacgacagaccagcatcccaaaaccgtctgtgtgcagtgtgaactcagcggccagttagttaccttgaccggttttgccaaaggttctggaatgattcatcccaagatggcaaccatgcttggttttgtcaccaccgatgcccaaatagacgggccagttttacaggacatgctaagtactaacgttgatcagacattcaatcagattactgttgacggtgacacgtctactaatgacatggtggtcacgttggcgaatggtctggcagataatccgagtttacaagcgggtaccaccgactatgatatttttaatcaggcgttgcactatgtcttaggccaacttgccaagcaaattgccgctgacggtgagggtgcgaccaagttagtcgaatgtaatgtggtccacgccgctacaacgtttgatggtcagcaaatcgccaaagcaattgttggctctaacctcgttaaggcggccattttcggtgaagacccgaattgggggcgaatcattagcacgattggcgccactgatgcagacatcgatgtggcgacggtcgatattgaaatgaacggcgttttacttgttcaacaaagtctggccgttgactttgatatggcagcggtgcaggcgaccttacgtgataaccagattatgatcgatgttgatttacatcacggtacagcaagtggtcaggcttggggttgtgacttgacttacaattacgtcaaaattaacgcgagctatcatacttaaacggaggtggtgaaaatgacaaaattaattgtaattaagattgggggccaggcgattagccaattgagcaccactttctttgaccaaatcgcacagtggtaccaacagcattatcagattctgatcgtacacggtggggggccaatgatcaatcgactgacgactcagcttgctttgcccgtgcataaggtgaacgggttgcgggtgacggatgcggcgaccttagtgctcaccaagttggccctgctaggagatgcgcaaccagccttacttgcaaaattaacgcaacatcacctacctgtgttggggctcaatgcggcggataatcagttactaactggtgaattgattgattatcgacagctagggtatgtcggccggctcaccgctgtcaatcaagtgcaattaatgcaattgttggctcatcatatcggtattttggcccctttagccttaaccgagacgggacaatggctcaatgtcaatgcggatatggcagcgaccgtgctagcccaacaactacatgctgaaaaattggttttgctaaccgatgtcccgggaattatacatcacggtaatgtgatgacatcactatcgccacaacaagctcagcaattgattcgaacagctgtgatcaccgcgggaatgcaacccaaagttcaagctgcaattgccgcgattcagacgggagtcaagcaggctattattacgaatgcaatcgatcaaccaggaaccgcaattattcaggaggtggccgtatgaccatgcaacacgtgtttccaacctatcaacgttttccatttgccattacggatggtcagggcgttcatctgactgataatcatggcaagacgtatttagattttacggcgggaatcggggtctgcaactttgggtatcaccaaccacaaattcaggcggccgtcacccagcagttgacgcatatctggcatacgtcgaatttatacgaaaatgaattacaagatgccgttgccggcctgttagcgaatggtgaagagcgactcgtatactttgcaaattccggaaccgaagccaatgaagctgcattaaaactcgcacggaagtacacgggtaaaaccggcatcttagcttttcagcattcatttcacggtcgaacctatggcgctatgtcgatgacgggcaatcctcatattcaggctggctatgcgccattagtgcctggcatcacgtttgcaacctataatgacgacgcggctttggacaaaatcacaccagagttggcggccgttattttagaagtcgttcaaggtgaaggcggcgtctttgcgggacaaacagcttggttacaagcggttaatgcgaaatgccaagcaacgggtgttttgttgattattgatgaggtgcagacgggaatcggtcggactggttaccggatggcctatgaaggttacggcctggatcctgatatctacacggtcgccaagggcttagcgaatggcttgccagtgggggcaatggttggtcggcggcaattagccactgcctttggtccgggcagccatggctcgacgttcgccggtaatgctgttgctatggcggcggcaaaacgtgtcttgacccaattaacaccggcgctgttaacgacggttcgggcccatgccgaacttgtctggcaagccctagcgactcaagtcgaaccgataccggtagttaaacaaatcacggggaagggcctaatgattggaatccacttagatgaacaaatgccggttaatcaagtcattatccggctacaagtagaaggcttattgacgttatcagctggcgataatacgttacgtttgttacccccaattgtgatgcaaccggccgatttattagctgggattgccttgattgcaaaggtactgacaactttgacaacggaggtcacgacgaatgaataatcaatttgaaggtcggtcattcttgaaggaaatcgactatacaccaacagaattagcttacttaattgactttgctagtcacttgaagacccttaaagcacaccatatcccacacccttatttacaaggaaaaaatattgcgttgctgtttgaaaaaacgtcgacacggacacgttctgcgtttactgtggcggctaatgatctgggcgcgaatccagagtttttgggtaaggacgacatccaattcgggacgaaggagtcagttgttgatacggcgaaagtactggggtccatgtatgatggtattgaatttcggggctttaaacaaagcacggtcgaagacttagcgacctatagtggtgtgccagtctggaacggattgaccgatgagtggcacccgacgcagattttagcggattttttaacattaaaggaacattttggtcatttaaaagggttgacgttagcgtacgttggtgatggtcgcaataatatggctaatagtttacttgtggcgggagcgatgctcggcatcaatatcgctatcggggccccggtagcgttacagccagccccagcagtggtcgcgttggcccaacagtatgcgcaggcagctgggagcacggtcgtgattacggctgatccgcaacaagccgttactcaggctgatgcgctttatacggatgtctgggtctcaatgggcgagcaggtcgactatggtgagcggatcaagcaactattgccgtttcaaattaatactgcgttactcgcagctactggcaagtcatcgacgattgtcatgcattgcttaccagcactacacgatctaaagacgcagctgggagccaaattaggcgaacagtacggaatgacggcgtttgaaattacggatgatgtcttccagagtaagcaggcggtcgtctttgaagaggccggcaaccggatgccagcaattaaggcggtaatggcggctacattaggtaacttatttattcctaccagcattttcaattagcaagcttgcgggaactactagagcgtgctacgattatattcgctttgtttcaatcaatacgtggttcgtaaccatcccacgttaaaaaaactaggaggaattaagcgaatgacacaatcaaaaattcgaccatggattatcaacgccctagtcgctgcaatgtatgttgtactatgcctaggccccgcagcttttagcttagcatcgggcgcaattcaattccgcgtttctgaagggttgaaccacttagccgtgttcaatcgcaagtatatttggggaattgttgctggcgttattttgtttgacgcttttggtcccggtgcgagtctcctcaacgttctctttggtggcggccaatcattattagccctgctggtattgacgtggttggcccctaagttgaagacggtttggcaacggatgttactgaatatcgcgctattcaccgtttcgatgtttatgatcgcactgatgattaccatgatgagtagcggcgtcgctttctggccgacgtatctaacaactgctttatcagagttgattatcatgagtatcaccgcgccaattatgtacagcttggatcgggtcttgcactttagtgaccggattcagtagggtgtgatttttacaaatcagactaaaaaccgttatttcgatgaaggatgagtcattgaaataatggtttttttgtcgagtcattacgatgtcagttgaacaaaataatctaatcgactcatagtgaagttggcgatgagagttcattatgggcagatatagtgcataatgactggtgtttatttcagaacccagacaattatttgaagtaagcacgcgtataatcgttttcgccaaccgcatgatagctgacaccatttaaattagaatttacaaggtgactttcagtcatgttgtaaagcggtacgactgctgctgtttggttgagacgtttggcggcagttctcatattttgccagtatgattgtgtgttagttgcgttctggttgtgtgcagcggtgatttgttgattgaaaacagtgtcatcatagtgcccgtagttttgcggattgttctttgtcagaatgtcgaaaaaggaaatcgggtccgcgtagtctgctagccagagtgtataagtcaaatcgtaatttccgttagtaactgcttcgccggaggcctttgaaggtatcgctgaaactgacattttggcatgtttcaggttttgtgctacagcggcttgaacaaactggtcaatattcttagcgaccgtcgtgtcatcactaactagctttaatgttacagaagaacggtcaagttgcttgagacccttattccataatacttgtgctttagcaacattgtgtcggtaggtgctttgagtttcagtaccaaaatccttgcccgtagtgggatcggtggttaaacctggtgtgacataattgtaagcaggtgttgaaccatcactcaaaatatttttggtgagtgtttttttattaagcacaagattcaaggcttgacgtaaatattgattgtttaaagcccgatttttttgcatgttgagacgtaaataataagtgccagctttactgacgtgtttcagatgcgagtcattttgaacaccctgcgcggtgacgccggtgacagtagcgtcatctaatttattttgtgagaagagattatgggcagttgtggagtctttgacaacttgcattgttattttatttaacttgatgtcacttttatcgtaatagtatgtattttttaacaaattccaagaatcattagtcccgttccaacctttaacggcgaacgggccattgtaggccatttttgtactagtagttccgtaatctttcccgtatttggacaccacttgatgatcctgggaaagaaagcgggcatggtgagcatcttactcaagtatggcatggcgtggctgagcgtaacttttaaagtgtgcttattcactgcagtaacgcccaatgatttaacagatttatgtccggctgaaatttgagcagcgtttttgataccttcgtatatgtaactataaccagaggtagaagtggcactgacagagcgttgccaagctgttacgaaatctttggcagtgacggtgtgaccattactccactttgcatttcgtcgtaagtgaaaggtgtaggttttgccatgatttgttggtttaacgactttagtggccattgcaccgaccactttattctgagcgttcatgcgatagaggccttccatggattgttgtaagacgttccattgtgtaagtgtggctgtatttgaggtatccaatgaggttaattcactatcctgcatcaaatgcagggttttcctggtggttgtgacattggcatgtgcttgcccacaagcggttagactacttagtactagtaaaaggcaactaatagttgtcaattttttcatcaacattagcgttcctcctcaattaatatgctgtaaattgattggtttcgacatcggtgagatagcgtctcaagctatggaagaaagcggtgggattatctacactatgacaatgaccaccatctggcgttaaagttaaccgtgcctttggaagagttcgctgcatacgccgggcaactgatagcggcatcgtgtcgtattccccaaaagtgagtaaagtaggtgtcatgattttatggaggtttgcacgttgatcccagccatttaatgccccaaccatcacgaattcgttattgccctgaaaataattataaacaggggtagctagtgttgagactaattgacgaggcgcattttccggatgacgacaaacgaagtgccggttgagagtcgtgacaaggcttttgtattctggatcatcaaaggcctccgcgttttcaatatcttgcatatagctaacttggctcgctattaacgtttgttcgcgcaatttattgacgtgtggtgtgtattcagcgatgttatcaatcatactcatgataattaagcctttgaggtgctgaccatatttcagagcatattcttgagccaataagcccccccacgagtgaccaagtaagtaaaagtcttcgagtccgagctgctggcggacttcttctaattcagacaaataataatccaaagacaagaactgttgattttcaggccttgaaaagtcaggttgatctgagtaaaaggagcctaattgatcatacatgctgatttgaaaattttcttcacctagctcagtggcaaagttttcaaattcagtatgattactaccagggccaccgtgaacgcataatactttgactggcccgtgaccaactgtccgagtaaataaatgaaaaccattttttagctgtattaaatgagttcctgttaacatagaaattcctccttcgattagacaataaaaacgccctataccaatcaagtagttgattgatatagggcgtttccgcggtaccacctattatttgccagtaaactggcctcacttcacgcacggtaagttaagtgacgatgcgctagcatgataatggatgctgccattaagtactcacaaataatgatcgcacttaccgtgattaggggattttcacaagatagcaatatgaattcctttcaccaaccggaacctctctgaacaattgcttaagtgctactttcctaatcgtcgcgtttaattattttctaatctttatttaatgttgactactttatcattgactattatgtttgtcaaacgattttagataaatgatattggtcgttaaaattagcaggtagatttaaatagtttgaaattagtcagcgataatttaatgcttcatcaagattccagtgtgtgttctactaagacttccggagctgggtgccaattgctggaacacagctgacccgaacacgtttcgtcaatatggcattagggagtgaacggccagcatttgagacgcgatattttgactcaaatctgcgcccaccacgttccgacaattgacaaaaatgcctgtaagtcggtggtaggacgcttcagccagacaggtttacgctaattcgaactgttttcagcagtcttaagctggtcgcttttgaactgaaaattcatctcataaaaaaagccccaaggtaacctcggggcaactgtgattattcagcttgtaaatcttccacttcgatgactttaaattgtttgcgattcaagttgtcgataattcgtttgagcttttcactgtcgacattttctggcaaggtaaagagcgtccgataaccgagtgtcccgttttggacgtctaaggtcaggcagccggcgattgaagtatatttcgtgataatcttagccatggctgcaagatcaccacgttcaccaacggagacaactgttaaaacatagctaccaacattaacgttccaagattgtgagagcatgtcgagcagacgcgtatgagtgagaatgccatagaaatagccgtgttcatcgagcaccgcaatgtatggcaaatctttgatggagaagaagatgttgtagaaggcggagtcgacttgaatcgttttcgtggcatttttaagcagggtcgtcacgggaagcgacatgtcgccgccccgtgacttgtgccgatagatgtgcatcttatagatgttgccgcggaagatatgaccggtttcatctaagattggaatacagcggaagccggaatcctccaagacttttaaggcgtcctctaaggtcgcgtccgccgtaatggtgacgaggcgttctttaggctttacgagtgtttttaatagcatagcagttggtcccccagatttattagtttgttttaataaataataccataaaacgaccgcttacacgtatcattatgacatcaaacgacggctaaaagggatgaaaaagccggcctgataacattcagaccggcttggttaaattagatttaaattagaaaacaatgactggtgttccgactggcacggcagcaaaaacttttttcatgacagaaggtggggtgttcacacaaccatgcgagccgtgcttcttgtaccaagtaccaccatattgagtttgccatgaagaatcgtgaattccttcgccagtgtcatcgaacggcatccaataagaaactggttgggaataacttgagccatcgtcattatcacctttaagggtcgcgttcttttccttattccagatgtaccaaacacccgttgttgtagcgtgtttaccgggctttccagtaacgatgtccgttgaaactttgagcttcccatcaacgtagacgtacatatgctgattttctttatcaacttcgacgtaggtgttgccgatgtcggtgcccttgttgttatatccggaaccactggtgattggtgagcgggtaaagtccttgcctttcaaaatttcagtagcaagggctttggcctctgcttcggtcttaatggtccagccataaaacccaccgctgacggatacggtcccacgcgccgtactcttgaactgacgcgtcgtatgataggtatgatacttatcattcaattgcttcacgtaagtcagaacagcgttttggtctaaactcactttgccttgcttatcgactttaatccaactgagaattaggtcgtgaggaatcgtgaatttatgaccgttgatattataggtggccttttcggtagcgtatttcgctgattttactttggccgtctttaaactagcactcgtgctggtaacggtcggagtgacgtaggcgtctttaagggtgatatgactgtcaccattactaattgctttggtgacgaccgtcttaagtttagcttgatctaattcggttccttgaacttctttcttaatctcaacttggttatgttgataaactaacttggcgttttcagtttttgttcgtttggtttgattggcagtcgtggtgattttttgtagtagggttttcaaatcagtgtgattgatggttagttgtccaaccgctgagctatcatcagcctgagccgattgcaatagtgcaaggggccaacgccagtagttttgtttggtcactaatttggttaaatcttttttagtattgattgtaataccggctgatttgctggtaaatgagtactttgtttggccgttttcaataattcgataagtgcgatgttctaaagcgcgattaactttcggtgctgcttgagcggcggttttaccactgacgtcaacaccagcgaccgacgtattactgaggaacgtttgttgatgttgccagattaagctcgtggcaacatatccgatgacgaggagaccgaggatactgcccccaatcataagtccacgtttatgtttcataattaagttggtcctccatatattcgtaatattctcaccttataacagaagtgagatgagtgcaaacttcaaggccggtaatcgtgataagaaagttttaaaaatagcctttagtgcatgttgcgctttaatgaatcgctaaggtaccctcaagcaaacaaaaaaacgcccgtctgctatagacgagcgttcatcatacatttaatcgtatgaaatgattatttattttctaattcagctaaaccgtcgttaagcacttttttcaaagttgcggcggaatcttgcatcttcttgagttcgtcagctgaaagtggtgattcgatgatttgtttcaaaccagttccaccaatcacagccggagtcccgatataaatgtcgtttaagccgtattggccgtccatgtaggcacctactggtaaaacggcattttcatcacgtaaaatggcttgggaaatccgcattaaagcagtcccgataccgtagaacgtggcacccttcaagttgatgatgtcgtaagctttgttacgaacaccatcttctaacttggctaaatcttcgtcagaaacgccttgttccttagcgacatcacgaactggacgtgtcccgatggttgcagttgagtaagcagcaaattcagaatcaccgtgttcacccatgatgtaagcatcaacggaacgaggatcaacattgaattgtttgcctaacgcaacgcgtaaacgtgaagagtctaaggaagtccctgaaccaatgacacgatcctttgggaaacctgagaatttccaagtagcgtaagttaagatgtcaacagggttagcagcaactaagaagatgccgtcaaagccggagtcaacaactggtttgacaatggatgataggatatttaaattcttgttaactaagtctaaacgtgattcaccaggcttttgaggcgcaccggctgtaataacaactaagtcagcgtccttacaatctgaatattcgcctgagtaaatcttcttgggagcggtgaatgcttgggcgtcttcaagatcaagggcgtcaccctttgtccgatctttaacaacatcgacaattacaaattcttcagcaattccttgttgtgccatggcaaaagcgtaactagaaccaacagcgccgtcgccgactaacacaactttttgatgatttggcatgcttgacaaaataagtcatcctctcgtagtgaaaatttagtttttacggttaaagtataccatgtttgtgcaaaataagtgttagattgagcatgcttttaatacaattattaacaatgtccgcaaaaccctttggcgggcgtcaataagccctttgtggtatacttatcgcacttaataaacgctaacttttgaacacttgactggcgggcgcgtcggtcacggtgtgagtagtggtgccaatacgacttaggtggtatcgttactcagagttgccgaatcgggtcgattaccggttcggcctgttttggtatgcaaagtaataggagaagataaaattatgaaaatgatcgttgggttaggcaacattgggcggcaatatgcccagacacgtcataatgttggttttatgattgtggacgaattagctagcaaactaaacgttacgtttcaaacgagtaaatttgaagcacaggtggcaacggcttttcaagacggtgagaagattttactggtgaaacccgccacttatatgaatgattctggacgagcggtgggaccgttgatgagctattacaatgttgatcctgctgatttgctcgttatacatgatgatttagatttgccattaggaaaagtacgcctcaaacaaaagggatcggcgggtggtcataatggcatcaagagcattattagtcatgttggtgatcagcacttcaagcgcgttaaagttggtattgaccatcctcagaagatgagtgttgttgattacgtgttggggaaatttacgccagccgaagtggcgaagtttgacgatgctaagattacggcgctagcggcggtcgaagcttggttagcaaatgatgattttgcggcagttatgaatcaatataactagcccgggaggaaacgacagaatggatattgaaacgattgttgagcaaacgcccgactttcaaacaattttagcaggtatcagcccgcgtagtcggcaactaatcaccggattgaacggttcggcacgaacggtttatttaagcgcgctatttcaccaattaacgcattcattactgatcgtgaccgataacggttttcacgcgagtcagctagtggatgatttaacgagtctcttagatgaagaccaagtttttttattcccagctgaagaaatgattgcgacggaggttgcgacaagttcaccagagtcacgagcgcaacgggtccaggctttaaacgccttattgcgtgacattccggcagtgatcgtgacctcggttgcaggtgcccggcggttcttgccgcccgtcgcacaatttcaagcagccacgttaccggtagccgttggtcaagatattgatttggaagacttgcagcggcaactacacgacatgggttacgttaagaaaaagttagtcgcacgcccaggagattttgcggtacggggctcaatcgtggatatttacccgttagatgcggactaccctttacgactggacttctttgatactgaagttgatacactgaagtattttgacccggaaacgcaacgttcggtggaaaacttggatgagtatacgattttaccagctaccgactttatcctaacatcagctatgctgcaggccggggcacagcgtcttaaaacggcgattgcggctgaaagtaagaaactcaagccagccgaacgccagactttggccgataatttagcacaacctttagctgacatggaaaaaggaattatcggaaacgatttattattatatggcgattatttatacgaccggaaaacgagtatttttgactatgtggccgctgacgggctcgttatcttcgaagaatattcgcgtttgcttgatagtgagcagcagttattaacgcaagaagctgactgggttacggaccaattggcacatcaccgggtgttggcaactgcgagttacggcaatgatattcgggatttgctccgggatgaccaacatgcacaactcttgatttcgctgtttcaaaagggcatcggcaacgtcaaactagcgcaagtaactaacgtgcgcacacgcccgatgcaggaattttttgggcagctcccagcgttgaagaccgaactggatcggtggcataagcttaaacagacggtggtcttgatggtatcagaggctgagcgtctgacaaaggtcagtgatacgcttgatgattttgaaatcgaagcggtcatgactaaggccactaatttacaaccgggtgcggttcaaatcgtgcaaggtagcttgcaaaatggatttgagtttccggatggtaaattagtcatcgtaaccgagcaagaaatgttcaagaaggtggctaagaagcgtccacgtcgtcagaccttggctaatgccgaacggttgaagagttatacggatctcaaacccggcgattacgtcgtgcacgtcaatcacgggatcggaaagtacgttggtatggagacgctggaagttgatggtgtccatcaagactacattacgattgcgtatcaaaataatgcgaagatctttattcccgtgacccagttaaacctagttcaaaagtacgtttcgtcagaatcaaagacgccacgcatcaataagttgggtggtaccgaatggacgaaagcgaagcgcaaagtcgcggcgaaaattgaagatatcgcggatgaactagtcgacctgtatgccaagcgagaggcggagaaaggttacgcctttccaccggacgatagttatcaagatgatttcgataacgattttccgtacccagagacgccggatcaaattcgtagtattaatgaaatcaagcatgatatggaacgaccgaaaccgatggaccgcctattggtcggcgatgttggttatgggaagacggaagtcgcgttgcgggccgcgtttaaggcgattgaggccggcaaacaagtggcctttctagtgccaacgaccattttagctcagcaacattatgaaacgatgctgaatcggtttgaaggctacccgattaacgttggcatgctgtcacgattcagaacaactaaggaaatgaaagagacggtccaacagttaaagagtggtgaaattgacatcgtggttggtacgcaccgcttactgtctaaggacgtcgcgtttgctgatctgggcctgctcattattgatgaggaacaacggtttggggtcaagcacaaggaacgactgaaggccttgaaggctagtgtggatgtcttgacgttaacggcaacgccgattccgcgaacattacacatgtcgatgctcggtgtacgggacttatcagtgattgagacgccgccaacgaaccgttatccgatccaaacgtacgtcatggaacagaattttggcgtcattaaagagggaattgaacgagaaatgcaacgtaatgggcaggtcttttatttgcataaccgggttcatgatattgataaagtcgttgcacagatcaaagacttggttcccgacgcggcggtggcccatattgatggtcagatgcctgagtcacaactcgaagggattctctacgatttcattcggggtgagtacgatgtgttagtgacaacgacgatcattgagaccggggttgatattccaaacgtcaacaccttatttgtggaaaatgctgaccggatgggactgtcacagctataccagttgcgtggccggattggtcggagtagtcgggttgcctatgcttactttacttatcagcaaaataaagttttgacagaagttggtgagaaacggttacaggccatcaaggactttacggaacttggatctggctttaaaatcgcgatgcgcgacttgtcgattcggggtgctggtaacttgttaggtaagcaacagcacggctttattgactcagttggttatgacctctatacccagatgttgtcagaagcagtggcgaagaagcgtggtcaggcggctaaagttaagaccgatgccacggtcgaacttggaatcgaagcctacttgccgaccagctatattgaagatgaacggcaaaagatcgaaatttataaacggattcgccagctggagaataatgatcagtacatggaagttcaggatgatttaatggatcggtttggtgattatccggtagaagtcgctggactattagcagtaggtaagctgaagttactggcggatgacgcgctgattgagaagattcagcgtgacgatagtgagctacacctaacgttatccaaacaagggacggctaagctagatactaaagatatttttaaggtcttggcaaaaacaaaattaaaagcgacagttggaattgatgatgataaaatgaaggttaaattagtcattcagccaaagatgcaacaggatgagtggctggcgcaattaacacagtttgtcgaacaactgagtttgatcttagccgaagacgatgtcgctagtgcgtcttagctcggtagttgttgttatgaagcatggttgcacggggtgggttaagcgctatcgagtggaaccaatggcaaatagcaggaattatcgtctgatggggcgttgtcctggctagtcagggcgcggctcaaatgaattagtatgagacaccgagttgctcggtagaagggatttgttatgccaaaggatcacttgaacaccgtgttcaaaggtgcgttaattttatcgatatcatcattagtcgctaagattttaagcgcggtataccggattcctttacagaacatggttggtaatacgggattttacgtttatcagcagatttatccgctgtacggcattggcatgacctttgcattaaatggatttccaaattttatttctaagttagtggcagaacagccagacgaaacgagtaagtcgctgattgcacggcgggcgtttcatatcttatccggattatcgttggtcgtctttttcggcttgcagcttggtgcaacgtggattgcggcccacatgggtgacgttaatctagcaccaatcattagtgccgtggcttggatgtttgtctttatgccatggttagcaaccggccgtggttactatcaaggaaaatttttgatgggaccgaccgcagtgtcccaactgatcgaacaggtcgtacgggtcgcaattatcatcatggctgcatatttcagtgtccgtctcggttgggataattatcggatgggaacgtgggcaatgagttcagcgccactagctgcaatctgttcatcactgatttttactgcttttggtctacgctatttattggcgcccgcacccgcaccgacccacccgttacctagttatcgcaaattaaccaaaagatttgtaattgaaggtgggacgctgtgtcttgtcgccgctgttgttatcttactgcaattagtggattcatttacggttatgcggggcttggtgcatcaaggtcagttaccagaagtagccaaggcactaaaaggggtctacgatcgtggtcaacctttggttcagttagggttggtggtggcgacggccttttcagcaacgttattgcctgctttgacggatgcgttagccaagcgtcaaccgattgaattcaagcgccagacacaggcgatggttcacgttagtttagcattatcaatggcagcgacggtcggtctagttgcgttgatgccacaaatcaatcgcttgttatttggttcattagaaggaacaacggcattgcgaatctatatcattagtattttatttgcagcgttgattacgacgtatacaagtgtgttacagagtttgaacgaatatacggccatgatcattggcatcattgctggattagcgacaaaagtgctggctaattacatcttcgtggtccactatggcatcaacggtgccagtgcggtgaccgtattgagcttggccgtgatgtttgcggtcatgtggttaggttcgccggaagacttgcagcgggtgctattagagagtggttatttgataaaattgctcgcattaagtgccgtaatgggtatcgtggtgatccttagttgtcatcaaatcaccgccttagtaggtccgatactagcgaatacgcgtggaatggctggaattataacggtgattggggtgctaatcggtgtgctggtgtttgttgccggggccgtctatgcccgattattcacgattcgcgagtggttagtgttgccatatggaaagcggctaattaaggccgttgcaaaaggaaaggaacatcattcatgagtatgcgtttagataagtttttaaaggtttcacgaatcatcaagcggcgctctgttgctaaagaaatcgccgataaggggcggattcaaattaacggtaaggtagcgaaatcttccagtaatgttagcgttgatgatgaactaattattagttttggaaataagacattaacagtcaaagtgacgcagttattggaaacaactaagaaaaatgatgccgagctgatgtatgacatcatcagcgaagactacaaaacggattatcgccaaccatttagtgattaggtcggtgtatccgttcatcgaaatggtcgtaaacgttgacttaatcagcatgatgtcgtttacaccggccgatgaagttgttataatttaggcaacctaatttgaaaggactggaccaacatgacgaacgggtcacgtaacaaaatcaagcagttagataatgattatattcgtcaagttgccaccgacgagcatgggcaagcccagcgtgttgcacaagtacggcggcgacggtttattttgattgttgcggtgttcggagcattgatactattctttggttttcagttgattaatacgcggtccaatctgcaccaggtaaaccgtcaagttgcgaccagtcaagttaaattaaaaaaggtgcagcaaaaaaataatcaacttgagagtcagatcaaacagttgaataataaggattacttacaaaagttattacgttcaaagtatgattatacgaagagtggcgaaacggtctacagcttaccaaatgataatgctgccgatgtaactgccaactaatcggggttgtggtctgctttatatgagtagaccactttttattaattgcttaaatgtataactcaacgtttcacaaagtatgctatactaaaaccattatttcataggaggaacaactttttttatggcaattgaagtaggtacaaaagtcactggtaaggtatctgggattactaattttggtgcatttgtaaacttgggtaataatcaaacggggctagtacacatcagtgaggtttccgatggctttgtaaaggacattcatgatgtcttgagcgtgggcgacgatgttacagtcaaagtgttatccgttggtgatgacggtaagattggcttgtcaattcgtaaagcggttgacaagcctcaaggtgaacatgaacatcatggcaaccatcagggtggcaaccggccaaacaatcatcaaggtaacaaccatggtcatggtgaacgtcaaagcaatggcaatcatcacgatcggtcaaataatttccatagtcgtgggggaaatggcggcggtcgttaccaatcacgacaacatgaacctaagaagcaggactttgattcattgatgtctggcttcttaaaagatagcgaggatcggctagcaaccttaaagcgtaatactgaaggtaagcgtggtggccgtggtggtcgtcgtagctaaacttagtgacttgccattaatctagttaaattttgaagcacggtgcggctatttagagtcacgaccgtgctttttttattgaaaattgccgattgttcaaggtcagtcagcgagacacgttggaaacggtgtgagttaccgtaaacttgcttggctagttcatcttatgctatccagtcggaataatgttcaaataggtgacaaacgaccagccaactaatcggcaagttttaacaataaataaatccaatgtatttataatgaagttagatgggaggttaagatgacaccaattcaaaagttcaatcggcaattagctgcagccaaactgttatcaccacagcaaacagtggtggtagcggtgtcgactggggtcgattcaatggtattgttgcatttgttgcaacgattgccagcagcggaacggccacgggtagtggtggctcatgttaatcatcatttacgcgaacaaagtcaaatggaagcggactacttgcgacaatattgccagcagcaaaacttgaagctagtcatggccgattggctacccgcggcacatcccaagagtggtattgaagcagctgggcgtcagtttcggtaccatgtttttgctaaggtgatgcgggaaaatcgtgcaacggcagttttgactgcgcaccacgccaatgatcaagtcgaaacgtatctgatgaagcttgcgcgtggtggcgacatctcacaattgacaggaatcgcaactagtcggccctttgcaacaggccgattaattcggccgttgttgacgtggtcgaaagatcagctacgaaactatgctgccgagcagcatgtcgtttattttgaagacgttactaatcaagatgtggccttgacccgtaatcggattcggcaccgtgtcgtgccagaacttatgacggttaatccccagttattaaagcatgtggccgattaccagcaacagttgacaacgctgttgacggctaaaaagcaaatggtcacggtactactgtcgcaggtcgtaacggccacaggggcgttggttgttgatcagtggggcgcactcccgagccagtggcagttagccgtttttgcgacgtggctcgagcagcagacgcaacaactattcaccgagtcgaagttacaaccgctggtctcgtggggacaacggacgcggcctgccacgagtagattaacggtaaacgcggcctgggagttgtaccgtaacgctggtatcattgaagctttgccaataaaaaaaaggggtaaaaagttaatgccccgtgaaaaaattatggtagacttaaaccaatggcagaaaattactgcaacccaaacggtgggaatctttacgcgggtgccaaatgttgtcagtcagccattttggttaacagaagccgattggccgctagtgtggcggccgtggcaagctggtgatcgaatcgttctcaagggcggtggtcatcagctggtacgtcgactgctgattgatcgaaaagttccggctgaacggcgtgaacaggtgcaagtgttagtgaatgctcaagggaacgttctgtgggtggtcggtcataagtttagctatcgtacgactggtacccagacagtatttttagccttaaaacacgagagttgaaaggagtacatctgaaacgatgaacaacgacattgaacgagtactttatagtcgcgaggatatccatcaggttgcacaaaaattaggaaaagaactcacaactgcatatgctggtaagaacccattaattatttgcgtactcaagggtgccgttttatttaccacggacattattcgtgaaatggatatttacgcggatcttgattttattaatttatcaagttacggtaatgaaacgatctctagtggtgaggttcaactaacgaaggacttagatgctgatgtgacgggtcgtgatgtgttagtcattgaagacatcattgataccgggcggacgttgaagttcttgatcgatttgttgaagcggcgcgatgtgaactcagttaaggtctgcacgttattggataaaccagctggtcgactcgttgatattaaggcagattatattggttttgaagtaccgaatgagtttgtggtcggttacggtcttgactatgcagaacgctatcggaacttgccgtacgttgggattttaaaacctgcgatttacgagcataaataattggtcaatgatagtcaaatgtgctattatttagactatcgaagtactgtatataaaagtttcgatgaaggaggcacatatgaacaatcgacgcaatggactctttcgtaatagcttattttacattttgatgtttctgagcttgatgggaattatctactttttctttggcggtaattccggctcacaaacgcaaaatattcgttatagcgaatttgtcaaacaattagataagaataacgttaaaaacgttagtatccagcctagtggcggcgtctacaaggtaactggttcataccggaaagcacggacgacttcttctgcaaacgcccttggtatcaagagcgcatctacaaagacgacgtcattttcaacaacgatgttggaaaacaactccacggttgaccaagtttctaagttggcggctaagcatgacgtcaaggttacggctaaggccgaagaatctagcggcatctgggtcacgttattaatgtacatcgcgccagtcatcctgatgttattcctcttctatatgatgatgggacaagcaggacaaggcggcgggaacaaccgggttatgaactttggtaagaccaaagcaaaaccagctgatagtaagcaaaataaggttcgtttctcagatgttgccggtgaagaagaagaaaagcaagaattggtcgaagttgtcgaattcttgaaagatccgcggaagttcgtgtccttaggtgcacggatcccatctggggtactcctcgaggggcctcctggtactggtaaaacgttgcttgctaaagcggttgccggtgaagctggtgtcccattcttctcaatctctggttctgacttcgtcgaaatgttcgtcggggttggtgctagccgggttcgggacttattcgaacaagctaagaagaacgccccatctatcatctttattgatgaaattgatgcggttggtcggcaacgtggcaatggtatgggcggcggtcatgatgaacgtgaacaaaccctgaaccaattgttagttgaaatggatggttttacaggtaatgaaggtgtcatcgtcatggcggcgacaaaccgttctgatgtacttgatcctgccttacttcgtccaggtcgtttcgaccggaagatcttagttggtcgtccagacgttaagggtcgggaagccatcttaaaagtccatgctaagaataagccattagcagctgacgttgatttgaaggaaattgccaagcaaacacctggattcgtgggtgccgatttggaaaacttattgaacgaagcggccttgttagctgcccgtcgtaataagaagcaagttgacgctgcggatctcgatgaagcagaagatcgggtcattgccggacctgctaagcatgatcgcgttgtgaataagcatgaacgggaaaccgtggcttatcacgaagctggtcatacgattgttggattggtcttgaatgatgcacgggtcgttcataaagtaacgatcgtgccacggggtcgtgctggcggttatgccatcatgttaccacgtgaagatcagatgttgatgtcgaaacgtgatgcgaaggaacaaatggctggtttaatgggtggtcgtgctgctgaagaaattatctttggggcgcaatcatcaggtgcttctaatgactttgaacaggcaacgcaaattgcccgggcaatggttactcaatatgggatgagtgaaaagcttggtcctgttgagttagaaaatgccaaccaacaagcagcttaccaacagggtatgggtgcgagtgccttttcacaacatacggcacaattgatcgatgatgaagtccggcgtttgagccaagaagcgcatcaaactgctacggatattatcgagtcacaccgtgaacagcataagttaattgcggaagccttattgaagtacgaaacattggatgaaaagcaaattctcagtctgtttaagactggtaagatgcctgaaaaggatagtaatgaatttccaagtgagaaagcagctaccttcgaagaatccaaacgtgaattggaacgtcgcgaagctgaaaagcacgcgcaaaaccaaagtgcggatgataagcaagcagactcagctgacactacgactaatgtgagtgttgctgaaccaagtttcccaagtgaatcggatgctagttcagaagttagtgctgacagtagtgtcaattcaacagctaattcagccactgaatcagctaccgacagtgatgtcgcaacttcagccaccggtttaccaaatgctgaaagtgccacaccatcatcgcaggatgatactaattcgcaagcatagtattgaataaagtaaaatgaaggagctgggactttgtctcggctccttttatgcgttatgatatttcaggaaaataaatcaattgcgttaattcggttatgagcgtcgggtcgcaattaaagacggattgagataggagtatgattaaatggcagattatttagtaaaaagcgtcgcgggtaatgagatgtttcgagcgtacgcagttagcgcaacgggcgtggttgctgaagcccaacgccgacatgatacctggagtgcagcatcagcagcgttaggccgcagcttggttggtacgttattattagcatcatcggttttaaagggtgaagaacaaatgaccgttaaaatcaacgggaacggtcctgttggtggtatcgttgttgatggcaatgctaaaggtacggtcaaggggtatttacagcacccccatgtgcacttgcctttgaatgataagcataagatcgatgtgaaggcggctgttggaactgatggctttttatctgtgactaaggatcagggggttggggatccattcaccggaacggttgcgttagtttctggtgaattaggcgaagactttacgtattacttagcacagtccgaacagattccatcagctgttggcttgtcggtgtttgtaaatgacgacaattcgattggagttgccggtggctttttggtgcaagtattgccaaatgcgacggatgaagccatcagctcgctagaaaacaagctcaaagacatgccattagtctcccaattgatgcgtgatggtaagtcaccagaagatattttggatttattatttgatggtgacgttaaggtattagataaaatgccagttaagtttgaatgcgattgttctaaagaacgatttgccgaagcactaatggctttgcccaagcatgaggttcaagcaatgattgatgaagatcatggtgccacggcagtttgtcatttttgtggggaccagtatcagttcagtgaacgcgaactagaagcagtgctctcacggtccaagggtgacgcttaatgaatcaagagtggcagatcggtgatgtgacgattcccaatcgtgtcgtagtggcaccgatggccggcgtgactaacgcggcctttcgagtaatctgcaaggattttggtgcggggttagtcgtttgtgagatgatttctgatcgcgggatcatgtatcataatcgtaagaccctggaaatgatgtttgttgatccaaaagaacatccaatgagtattcaaatctttggtggttcgaaagcaacactggttcaagccgcccagtttgtcgatcagcagaccaatgctgatattattgatattaatatgggctgtccggtgaataaagtggttaagactgatgcgggcgctaagtggcttttaagtccagataaagtctacgagatggtcgcggctgtgactgctgcggttaataaaccagtgacggtcaagatgcgaactggttgggacgcagagcacgtatatgccgtcgagaatgcgcgggctgccgaacgagctggtgcagctgccgttgcaatgcatggacggactcgtaagcagatgtaccaaggccatgctgattgggacgtgttaaaacgggtggcggatgccctcacgattccattgatgggtaatggtgacgttcagacacctcaagatgctgcgcggatgcttgatgaagtcggggccgatgccgtcatgattggccgggcggtagaaggtaatccgtggatgcttacccagacagtacactatttagcaaccggggagttactaacgccacccacaccgatggctaagatgcaaacggcaatggaacatttgcagcggttagtggttttaaaaggtgagcggggcggatgtcatgaattccgtgaacaagcgccgtactatctaaaaggcatcccaaggtcggcacggaccaaagtggctttaatggaggcaagctcgttagcagaaatgatgcgcattttaacgcagtttcaggagcagacggcaacttatttggctagtcacgcggtaaagtgaataattaacttgcattttggcggcgtgattgtcaaaattaacatgtagtgattgtttaggtacggaataaatctgtacgctaactagaaatggaggaacactagtggcacgacaagaacagacgatgaacgaccaactgaaggttcgtcgcgaaaaaatggatgaactgcgtgaagaggggattgatccctttggtcaccggttcgaacggactgatttagcccaggacttgcaagacaagtatggggatatggataaggacgagctagacgctaaacaagtggtggcaaccattgctggacggatgctagctaagcgtggtaagggtaaagtcggttttgctgatatctgggatcgctcaggtaagatgcagttatacattcgtaaagatgtagtcggcgaagatacttaccatatcttcaagcgttctgatattggtgatttccttggaattaccggccaagtttttaagacggactttggcgaattaacgattaaagtaactggtttaacgttcttatcaaaggcgttacgaccattgccagataagttccatgggttacagaatgtggaacagatctatcgccaacggtatttggacttgatctctaaccgcgatagctttgatcgtttcttgaagcggacgaagatcatttcagcgattcggcatcatttagacgatcaaggcttcacagaagttgagacgccaatgttgcataatcaagctggtggtgcggcagcacggccatttgtgactcaccacaatgcgttgaacattgatctctacttacgaattgcgttggaattacatttgaagcgcctgatcgttggtggcatggaaaaggtttatgagattggtcgggttttccgtaatgaagggatggaccgtgaacataatcctgaatttaccatgatggaaacttatgtcgcctatttcgacttccatgatgtaatggctgagacggaaggtatttttaaagccgcagcgcaagccgtaactgacgatggcattgtcacttatcatgatcaaaaagttgatttcaatcaaccatttaagcaaattcacatggtcgatgcgattaaagaaaagactgggattgatttctggcaaccaatgtcaattgaagatgcacaaaaattggcggatgaacatcacgtgaagtatgaaccatactggaaagttggtcatatcattaatgcgttctttgaagaatttgttgaagacacgttgaatgaaccaacctttgtttatggtcatccagttgaaatttcgccattagctaagaagaatgaagaagatccacggtttactgatcgttttgaactcttcatcttaggtaatgaatacgccaatgcgttcagtgaattgaatgatccaattgaccaacggcaacgtttcgaagctcaggctgcggaacggactgctggtaacgacgaagctgaacatattgatgaagactttgtcgaggcgttggaatacgggatgccgcctactggtgggttaggtatcgggattgatcggttggttatgttaatgacggatgcggactcgattcgtgatgtcttacttttcccaacgatgcgtccagaagaagataaataattagatttaaaacggcagttagcttaggttttcctaagctaactgccgtttttgttgggtcagattgagtaactttagttcggaaagcgatttattgaaaaaaagttagattatttttacccgaacattgttgagacatttggaggctaaacttaagtaaaagcggattttatggtggtggtaggtaggatttgaagtcaattaacatgattatggttttaaataccgtatattatcaaagtggattgattaacatgatattattgactggttatttttgcattttagggcttgcaatttatcaggataattggtaaattagtatacgttgttgaggcgcacaaagcggttagccgcttgcttccaacgaaaattaattataaaaagttgttgacaagatgttgataacttgatatgatgattaagttgcgttgaggtaatcaacgaacgatttagacctttgaaaactgaacaaagtttcgacgaatcaaatgtgtagggtctcttgattttgaatcaagag

SEQ ID NO: 13 - DNA, 98546 bp, synthetic construct
  source 1..98546: mol_type = other DNA; note = Lactobacillus plantarum PDG8 - contig 13
attgcaacgcgttatgataagctcgctcatgtttatctggctacggtctacattgcctcaatttgcatcttacttaagtagttttaagacggaccctagatgaaataattcaacaaaaaaattgcgcttcagatgttgattctgaagtgcaattttttgtctaagttaggcataaacatactagcatgtttgtatttaaacggagtggcttgcagggtgaattataactttagtatcgacatgcgcgctggcttccgcaatcgtacaccgtcagctaatctggcagcttatttgtgggcatctttctttgcttgttccactaaaatattatcgaccacgtcttgtaagctagtcttagctaaccgtgcttcggccgccgtttgcgcgtcttgatagtattgtttcagaacggtttgaatattgccaccaacaatacaatccggattggtcttaggatcgacggcgagtagcggcttatcgccctcaattgcgtagaagacgctgagcagtgaaatttgacttaaaggtttggcgagtgccggttgagcagtaccgggcgttgttgtgattagtccggcttgtcgaagcttgctcatcaatcggcgaacaacgactggactagtttcaatgctgcgggcaatggcgtcacttgttaatttagtatctgcgtaaattttaatgtaggctagtaaatggatcgagtcgctaaagcgggttgaaacacgcatataatcacttcctgtaacttaattggttactatgattataaataaatccacttataaaagcaattaacgagtttagttaagctgatgatgtaacttttataaagagggttgttttgggggaccgaatcagttatgatgtaaatgccaaaattgagcagttactgcaaaaaaggagcttatcatcatgagtgaaattgaaaccatccaggcctattatgcggcttcattgggaaaggatggtcgtattacccggacccaacggcaaattttagccgccgcgctcgacttatttgcagaaaaaggttacgaagaagttggcactcgggagattgcagagcgggccggtgtcgctgaaggaactttatttcataattttgttaataagaacggtattctggacgccattatgcagccgattgtgcagaatattttgccaacgatgttgaacactttggaccaggcagttttagatagtcctaaccagactttgcaagcatttgttgtcgcccttgtgcgcgatcgggtcgcatttgtcacacgtaaccgagcctccttagccgtcattttgtcccaatttttcaataatgctcaggatcgagcggccgtcttagggatggtcttacctagcattttggcgcaggcgaatgaagcgatggatcgcttgaaagccgctcgagaattagttgattggccgaatcgcatgattttacaattggtgttttcaaccattgggggatatttagtcgaacaggttctctacccacaactggatgatttgagtgatgagcaattgattcactatctcagtgattttttagttaatggtttgagcccacggagaatccccttacaagatgataataccgcgtcataacaagctttagggatgccaaagtaataattaataatagttgactaataggttaatggtgctatactaccaattggaattaaagtgagtgctcaattaaggggacgcactgttgaggatcacgtagtagtccacaacctgaattctaaaccaatagaagagagggtttcataatgaaatcagcaaaaacgaaggatcacgctaagatgaaagctgccgaagaaaaggcgattcattcaacgggtgccgatagtaagagcttggacgaagtcaatgggagtgtccgggtccctaaggatgccagcttctggcgaactttaattgcctacactggaccgggtgcactagttgcagttgggtacatggatcctgggaactggatcacatcaatcgcaggtggatcacagtacaaatatgcattactttctgtgatcctgttatcaagtttaattgccatgttgctacaagccatggccgctcgtctgggaattgtgacgggtaaagatttagcacaattgacgcgggaacgaacgtcaaaaggaatggggatttttctctggattattactgaactagcgattatggcgaccgatgttgctgaaatcattggttctgggattgctttgaagttattattcggatttccattaattgtcggtattttgattaccactgccgatgtcttgattctgttattattaatgaaacttggtttccggaaaatcgaagcaattgtggcaacgctggttgccgtgattctcttcgtcttcctgtatgaagttattatttcacaacctaatattccagaaatgttaaaagggtatgtcccaactagtcggattgtcagcaaccgttctatgctatttctagcactcggaattgttggggcaaccgttatgccgcataacttgtacttgggatcatcaatctcacaaacacgtcaagttgaccggagtgacgaaaaagaagttgccaaggctgttaagttcacgacaatcgactccaatattcaattgtcagtcgcgttcgttgttaatagtttgctattaattcttggcgccgcactgttctttggaactaagggggatcttggccggttcgttgacttgtacaatgcacttggcgatagtaaggtcgttggctcgattgcgagtccgttactcagtatgctctttgccattgcgctgttgtcctctggtcaaagttctacgattacggggacgttatctggtcagattatcatggaagggtttatccgtttgaagatgccactctgggcacaacggttactaactcggttaatctcggttacaccagtgttggcttttgcgatttattatcatggcaatgaagcgaaaattgaagatctgctgacgatgtcgcaagtcttcctgagtatcgcgttaccatttgccatgattccgctagtcatgttcacgagtaatcgggcgctgatggggaacttcaccaaccgtgtctgggttaagtggacggcttggatcgtgacggtgattctaatcatcttaaacatttaccttattttacagactatcggtctggttaaataatcaaacattaaaatgagctttccagggattgcaaagaattcctggaaagctcattttgtgttttgggaacagctgcaatgcaagataccgattcaaagcgccaagtgctaatacgtaccagtaattggcgattaaccgactttggatggccagtcttgcttagttggtatgatggtaaacggggtcgcagtgatgaggtccgtgaggcaggggagcaatccggtctcaaggttatataaatcgtgaacgtgtgcgctagtttgaccgtgctcagccatcttaagtagttgaggctgggtgaactggagttgactggctggtagaatcaggtccggttggctgcggcgtgtcaacggttgagcgtggtcgtgaaccaggtaagcaaaattaggcgccgtattgagaattagcgttaaaacgctgatttcatggggatctaatttggttgctaactggttcgtttgactaggggaataaaccatggcggcgtagatttgaggcgccagctcgggtaattggcgactaggcggtgtcagggtgaccgtcagtcccaattgccagctggcaagcaacaatcccggaatcgttacgacttgtgcggggctcagtagaatggcttgtccggcatgcacgttctgttgttgcagactagtttcacacagtgcgaggtcttctaaaacatcggccccggtataccagttgccatttagatctttcagaactggttcggcatattgacgttgtaattggcgggtaatggccttagtcagctgactcatcgcggggcctcctttaagggtttaagtgacggggcggaaattaagggtggcagtactactttgcgttagtgagatacttcatcttagtgatactctggctactagcgtcaatggttgctaacacttgattttgggtggatttaacaacaagcttagttggctgcggtgttaaatcatgtttcggttggctagtcgtggcacctgttgcgagtttagtatcacgagtgactttattgacgagtgtggtggacgttgtctcaggcttagttgtcgtcgtatcagcagaggcggaaacggaagtggcaaagtgggttccggcggccattaaagttagggttagttttttgaatgtgtttttcataataatcgaactccttttagttgttattatcggtggcggtcagtgaatgattattgggcagctggcattaaccagtcgttagagagtagttgatggaagtgacgaccaagtgggacccataattgcgaacggcggatgttttttaacgtgtcccagaataatggatcttgtagttgttcatcactaagtttgactttaacgaattcgccctcttcagttttcgcaatcaccagtgggtaggtcaccttaaccaattgaacagcggtgatatttttaatttttggatcagtatctaataacatatctacatagctccttagttgttgtgagtcattctgtttttatgagttaatttttaaagttggtttgtttaattgaatgactatagtttaccggcatatcgccgtgggaactatcgactttccataaactttatctaagaaattcttagattcagacttagaatataaaaaataccatgaaaattgaatctgagcaggtaatactttggcaggatcaagtactagttaaattaacaaccgtttcaagactgttaatgtccttaaaacggttgttaagagtttgtttgtaaatgaattagcttagtgtgcagggcggttaataatactaatggcaaagcctaataaagcacaaataagagaaacactaaaggaccaggttaaaccatgggcaaaccaagcaggatgtgctggcaagtaagtactaactcgatatccagcatcgatgctcattgttgtaaatagtgcaagagaaccaagtgcgacgcctaaaatattgccaatattatttcccaaagactgtagagaacccgctactcctagctgattttgtgggacgactgacattagtaatgtgttatttggtgcaatgaaaaatccagtgccgataccgttggaaattaacaaagaaataatgagggttaatgaagtatgtgaatctaggaataagaagccaatttgcgtaattataattaggactaggccggttagtagaacaagctgttgagagaaaagatcactcaaccagccaccaagtggggcagcaatagccataataagtggaaaaatcagcattaatattccagtagtaccaactgaccagttcaaataatcttggagatagagtgggaatataaagctgaacagtgcattaataagtggtatcagcattccgactagcaatgctaagctgaaggtacgattcttaaaaatggatagtggtaatagcgcattttttcgatgcttttccaaataaataaagtatagtgtaagtgctaatgtgataatgaagccaatgataattagcggctgcctgaaaccaatagtctgccctgcttctaatacaacaaagaatagtgtgatgataatgaatagaatccctgcgccccaaccatcaagtttagtggcttgttgccggccatgatttttgggaagaaataggtggcctaaaataatggcaatgattccaagtggaatgttaatcataaaaatagcattccaagcaaactgctgtagtaaaaagccacctaaggcaggtccggcaacaaaaccagcggaaataaacattgtattgatacccatggcagttccccgggtgtgattatcaaacagttccgaaattaaaccatagctgtttgaaagcgttgcggcagcgccaactgcttgcacaaaacgagccaatagtagaaactcaaagccgaagttgacactggccattagtgagccgatagtaaagctatacatacctaaagtaaagattctacctttaccccaaatatcaccaagtttaccgaatgttaccagtaagcctgatagaatgaccatataacccatcacggtatatgtgatctgactaattggaaccgcaagtgattttgacatgataggtagtgcgatattaatgattgatgcatcgagattagccataattgtaaaaataccgatgacaatcattgctaaccaagaacgagttgttgttttcatgataaaaattcaacctcctattttttgaacatttgaaagtataacaagttcgtgttacactaacgcaagcaaaatttaggaggatacgagtatgtttacaattacggcgaccgctcagaaatatggtgtgtcgaataatgcactacgttactatgaaagtgttggcctaattggtccgattaagcgtgatcaaaatggtatccgacaattttcggctagtgatcaagagatggttaaccgaattgtacatctccggcaattaggcgcgtcaattaaagagattcagcaatacagtttccgtcctgaagaagtaacactagaacgtacagttgcactaaaaaaatttctgttacgtttaaacggagatctagaagcacaagaggcacgaattaaaatagaaaaacaatatttaaaagcaaaaatagagcatttggatggtgatattttgagtatgaaatctcataaaaccacgcagatgggttagtaataattagtttctgcatatcaattcagaatagtcttggaggtatctttgtgattgggtggcacaagaccaaaagcgagtcctagatttttctagtgactcgcttttttatgagagtaattattagaaaataatagtacttgttactatagttgccagctgaccgtaaagatactcccggatggctggttgtcggtaattttaatgttggcctgattcaatgtgactaactgttgaacgattgctaagcctaggccactgccttcgattgcttgtgaccgagattgatcaacgcggtaaaaacgctgaaagacagcctgtttttggtcgtctggaattccctcaccatggtcggctacagctagttcgactgcttgatcagtctggtgcaaactcaaggtaatcggttgatcatgtggcgagtatttatgggcattatcgagtaaggccacaacgatttgttgtaacatttccgcattaccttgaacgtggatgttcggatcaattgcgagcgtcaatggttgatcaattgatggctggtaatgttcagccagtgacaacattaatagtgataggtcttggtcagttaagactagcttagcgcgatcagctcgtgaaaggtgaagtaggttctcaatcagatgttgcattcttagtgattcttcatcaataaactgtaatgattctggaatcacttcggggtgggcgtcaccccgccgcttgattagactgagattaccgcgaatcgcagcaatcggggttcgcagttcgtgtgaagcatcagaaataaattgacgctcatgctgcaatcgttgattttgcgtgaccaatagttcattaaaggcccgaccgaggtcgttgatctcgcgggggctagcaggcacgtctaaggtgggctggtcgctatctggattgttcgatgtgtacttggttgcgtgtaacagtttaatggttgggtcactcagtcgtagtgctaaacgatgggcccaccaagtccccaatgccagggcggcacaagtgacagccagcatgagcagaatcaaaataagcagactgttgaacaatcgccttaagctgacccatagttggtaagtgttatgcccatctttttcactataagataagaagaaaccaaatccgcgaacgtagactaacggccctactagcttagtctgttgcttggtgaaaaacgatttggacgatggggtagtgatgatcgtccgcttcgttttagtggcggtcgtcaaggttgctttcttggtggttacccggataaatgccggttgtttcgtattgcgtgtcgtcgtattgttccattgaataaaactggggacgtctttgatattcgcctggttaagactgctcatcaagtcacgggcttccctagtcgtattgattgtttgctgagtgccgaccatcagaagggtgatcaagctaaccaacaacgtaattgtcagcattagtcggcggatggccttattgatcagctgttcataggtcggagtggtgttatttttgggcatcagacatcggctcccttagtttatacccgacgccgcgcactgtttgaatgagtggggaggcgccgtttgtcgtgattttattacgtaaataaccgacataaacgtcaacgacattttgctgaccgagaaagtcggcgccccagacttggtcaagcaagtcatcacgggtaaagacttcgtcgggatgagcgaggaagaattgcagcaaatcatattcacggtgagttaaggtaacttcttcctgcccgttagtaacgcggtgggctttggtatctagctggatatcatccagttggtagacttgattgggttcaacttgattttcaatgcgtcgttggataacccggattcgggccaataattcttcgatttcaaatggtttggtgatatagtcgtcggcaccattatctaacccggcgactttatcaccgacataatctctagcggtcataataatgactggtacttgatcgtgtttgcgaatgcggcgaagaacttccataccgtcaagttttggcaacatccagtctagcaggatgaggagcaactcgttttgatgcgcttggtaggtttccatagctgccaaaccgttagccgctaccaaaacgttgaaatcctcaaattgtagttctttagtcaagtagccagatagactgccttcatcctcaacaattaaaatcgtgtttttcaatgttatgctcctcccaataaccctggtttatgtctaattatagcgaataattatgacgcttttccgatattttgacttatttttatggatttgtgtgaactaaatgaaagcgtcaccggacttatgctaaaattggactatgaaaatggaaggtaagtgagtgacatgggactttttcgtgacgccatgcaggcactgtatcatagtggtcattatggttacaacatcaatgtaaagaagtcggctcccgccgttgatccgaaggaagtaccagcgattgcggcgttaggacgtattaatcgaacgcccaactttaagacgtggtccgttgattcgccatataaaacggccgaatttacggctaaattaactgacgcagtagcaacttgtgatttggaaatgcaggatcttgagatcaaaccgcagatcgatggtcggtggggcgatcaataagcggaatttgttcccataaattctaatggtcatattaatttaatgatagaccaattaatcaatagtgacggggtgagtcaatgttttcgtacgatcaggtccagcagttaaaccgcttggaaattgaaatttataagtatattgtgggtcatcccgctgaagtaagtactatgacgattcgacaattggccgaccatagtcacgtctcagcaacgactattttgcgttttctaaagcacatgggctatgatggctacgcagaatttaagttcacattaaaagaacagttacggcaagatgccacacaaccgttagctcagacagttgtaccgatgcggacgttttttgaccgcatgaacttacctgatatcacggctaaacttcatcgggtcgcagaactggttcatcaagctcgaatggtcgtactgattgggtcagggacgagtgctggcctggccgcgtatggcagccatttattcgctaactttggtttatatagcttgatgattagtgatacgagtcagccccatccggttcagcaacaggatttatcggataccgtctttttcgcactttcagtatctggagagtctgaagatattattgaacaaagcgtttattatcggcagagtggcgcgaaggtggtcgctattaccgctagcagtcattcgacgttagctgggattgcggacgtggtgttaacttacgataccccggaagttcaagcaatcagtggtggtagcaccttgtcccagttgcccatcgtttattatctggaacaattagctatgattattcagccattaacgtaaaggtaattcaaaccaatctttggaacatgttctaaaaatggaacaaattccgatggatggaacaacacccattttagagtgaaagggtatacattttgagaatgacaggtataatgaattttgtaggaagcgtattcatgggtacaaatgtcagatgacaggactactttgtaacggacgaactcaattttatgtaaacggttaactattaattgaccgttagcttacttaaattattctgattgtttgagaatgttcgttaaatgaatatgcacaacaaattattttagggggtcacgacatgagcgaaaacaataacaagtcgagctttgttaatgaccgacttgtccctttctttggcaagattgctggttctcgtcacttaattgccttacgtgatgggatgacattggcagtgccaatgattattatcgggtcggtcttcatgatcattgcgcaattccctatcaagggttatcagacctttatggccaatacctttggttcgaattgggcaacgatcgtccaatatccaactaacgcctcgttccatatcatgggcttgattgcggttattgggatttcttataacttggcaaagagttataaagtcgatccaatctctgcctcaattgtttcgttaggcgcttggttcttaacgattccattaaacaccgataaggcaggagcactgtgggtaccattaacccaacttgattcggcggggttattcacggcgctactgattgggttgtttattactgatttttacgttttcatggtgcatcgcaattggacgattaagatgcctgatagcgtgccaccggcagttagcaactcgtttgcagccttagtacccggtttcgtcatcttattcttgatgtggttactgcggttggctgttgaagcatcaccaatgcagagtattcctaacgtgatttcattcgtcttagctaaaccattaggcttgttgagtaacacgttaccaggggccttggttgctgaattcgttgtatgtattctttggattttcgggattcacggtgccaacgtggtttctggggtcatgcaaccaatctggttagctgcgatgtctcaaaatgcggaagcgcttaaggctggtaaggctttaccaaacgttgtgacacaacaattcttcgacaactttgtccacatgggtggttccggtgcgaccttgggactggctttcatgattgcctttgttgccaagagtgccgaattcaagacattaggtaagctggttatcggacccgcattgttcaatatcaatgaaccaattgtcttcgggttgccaatcgttatgaactatcggattgccgttccgtttatcttggcaccgttagttaatgttacgacgacttacattgcaatgtcgacgggcttagttgcgaagaccgttggggtcatggttccttggaccacgccgccaattatctctggttacttagcaacgatgcacatctcaggtgcggtattacaaattgttaatattgtgcttgatggtgccatctactacttcttcttcaaggccttagatcgtgataaggttaaggaagaaaagacctttgctgctaaagaagctgctggcgaaacggtcgaagcttaagttaaatcattaatgtagtaattgtataaataccaccattagcgacttgctgaaagtctgttgatggtggtattttaatgtcgatttttgagaagcgcgtgcagattaaagcgaaccgagtgacttggaattgtcaccgggttcgccttttattaacgggtatgaaattgtgggtgcaacattcgggggtgaccatggtcagtacccttgtactgcaatagccaataagcgttttgcggcaaagcgctacgggcaatgacgtgtgcaacggtgtagcgaatcgtgtcggcattagcgtcagtccataaacgccaagttggtaacttagctgcttgaaccggttcccaatcgcccaattcttgttcactagtagttagtgcggtgagtaaatcaggccgttcggaaccagtcagttcgatgtagtagcaatacgcttgcggatgcagggtgttgggctggctcatgatgagattgctcctttggatggttttaacgagttatcgttgacttaaataaccttatcatcaatcatagtacaaccgtttgactaaattgactagctttttcgcttactgttattaaaatgtaatattcaaacttgcaattaaaaataattgagtgttgcgccttgacctggaacgcgtttcagcacgtatattaagtggtgaaaataacgagggggtgcagcacgaatggaaacgggaattttaaaacagattgatttaacaacgacaacggaacggtatttcttcgtgcaagtacaacgactggccgactatgtctggattcgctcagttcaaaactttaagcctttagaattaacggttcgggtgagtgatttacaggtgaacaagcaccaggccgttgctgaccgggggaatatcaaatatgagtttaacgacgataccgggggactggtgacgcaacttgctggctgggtgcactaagacggtgacagacaagcagtaactgtgatactttaggcaatcaacaaccaataatactaatggcagcaatcaattttaactaggctaggactaaatcaggcgcgccactgaaggctataatgcttcagtggcacgcctgattatcattaaaagatcacttggtattatcactgtaagtgattttatctaaaccttgggtgtcataattgagattggttttgccgtcatacacggtattcttggcgtttagcttggtttccatgttggtaagggtctcagtactgagccccagttgggtccgaaggcggtccgacgtttgttgcaaggtctttgtacttaaaatctgataggaactcgtattgatccaagcgggtgagccaatgacttgagtcgactgaatgtgtttcatattggcacgatcatgcgtcgctaacccaacaaggtcgttaaagctaaggtcagtttgtaaattacccttcagtgaagtgagtaattgattgtagcgactataggtcttagtctcggcgagtttggcgagaaccgcccgcatgacttgttgttgccgtaattgacggccgtagtcgccccgggggtcctgataacgcatccgtgtataagatagcgcctgtttaccattgagatggtgtttgcccttggttactgtgatgtggtcgaatgaaacgttgagtggactagtgatcgtcacacctccaacggcatccacgatttgtttgagaccgcccatattgatagttgcatagtaatcgataggcacgttgaatagcttgctaacactagccttggccatcttggagccaccaatattgtaagcggcgttgagtttttgaacatttgtgtcctgatcaccgaccatttctgctaatgaatcgcgtggaatgctggtaatgagcgttttcttggtctgcggattgatcgtaacgaccataatggtgtcagaatttcccttatcaatacgaccgtctgccccggtgtcaacacctagtagtaagatgctgagtggcttagtcgtatcaattttagtactgctgtttcccgtatagatcgtcgactggtagcgcgcctgtgcctggcgaataattaagccaatcgccacgaatgcgataacgataatgatgccgaccgcaattaacactggccgtaattttgaagatgctgaatgccgcatgttcaaatcctcccttaattaaaggcgttaagatggttccccggataacgtctttgtcttgaaatcactgtttctagcatacccggtcagtacgatcccggaaaatacttattttgagtgtacttaatttaaaaaatagataccacctaaaagaattagattggaaactgagcaaattaggagcggtcacttacggacagtattacggcagaaaacggattcttggcttatactgacagtgaacttaaatatatgaagtgaggtttggtaatttgacagtctttcgcgcattttctaaccaagaagttttagattatttagcaacgcaagtcactgacgggcaggtcttcactgacgaggagacgctgaaaaaatactctttcagtccgcggttgaccgatgacgatagtggccttgccttagcctatgtcgaagcacatacgaccaaggacattcaaggaacgttgaaaacggcccgtaaataccacatcgcagtgattccccaagaccaaacaacgagcactgttatcggtgcggacaggttaacggacagtctgattctttcaaccgccaagatgaatcgaatcatcgaaattagcaaggctgattccatcgccgtggttgaacccggcgtcgttaacggtgatctggataaagaagcacgcaagcagggtatgttctacgcgccggaccctggttctaagcccatctctggaattggcggtaatgtggcgacaaacgccggcgggatgagcacggtcaagtatggggctactaaggacaatgtcttaggcgttaaggtcgttttagccgatggtcgcgaagttaagttaggcggtcggacgctaaagcaggcctttggttatgatttaacgcaattgatgattggttcggaaggcacgttaggaatcattaccgaagtaatcgttaaactgttgccgattccgctagggacccccgtgatgggcgtcgcctttttcgataatatgacggccttggctaaagcagtcacggcgattcgaatctccggtgtttatccaacgatgctagaggcattggatggcaatacggttgcggcactcgatcgttacgagaagacgcactatgctaagaatagtgcggcgatgttgatctttaagcttgataatggtggtcaggatagtatggcagtcgttaagaagatactggccgaacagcaagccaacgatgttaagattacgaccgagcctaaggaacaggcagcgctagaacaattacggcgcgacatgctgccggcagtttttgctggtcagaatcatattatggaagatatggccgtgccattatcgcaattagccccattaatggactatattcaagaactatccaagcggttagacgtcgaaatctatacggctggacatgctggcgatggcaatgtgcacccgaccttagtgtggtcaacgtcggtaaccgaagtgcctgaaaaaattattattgcgctacaagaaatgtttaagaagacgctggcacttggtgggacgatttcgggtgaacacgcagtcggaatgttgaaaaatcaatggaacaatgccgaattaggcgaagatgttgatatgttgcaacatcagatcaaagcactctttgacccgatgaatattttgaacccgaaacgtaaaatcaattaacccaacgattacaaagcgcttaagttttgatagcagttgttggtcagatattgcgtaacttggtcatcgtgtcttattattgagatagtcccaaaaatgagttgttggttaatgagtcactaagaatgtgcagtgtggattaaccgatgcgaaggaggccccaagtgatacctaagagtgcgcgaatccgaattgaatttgatgccgaagtactccgcaacgagatttttgatgtgcatgacttcgccagttttcaaagtttctggcagcgatttgagaatttcttggccgatcgcatggtcgttggtcacctgaacgtgttagagggccgcggcctgattcctagtgattttgcagatgttgacggacacttagcttaccaagttggtgaagatgcgcaccaaattgcgtatgaccaaattgcgcgtgagtggaccatcacgatccgttaaggtagattgagagagaatagagtcttatattggagcgatattgattgagcacaacaaattcccaagcaagtgcagataatgatcagcttttgccagcacacccccggaacttttgcaagctgttgatcagttgaaagcttattcgttacgttatgaagttgcgatgaagctcgttttagataagttagattatattagtcgagagtatgagcttcgttacggctacgcattaattgatagcaagcagtcccggatcaagtcgcctgagagcattgttggtaagatgcaacgtaagcatttaccgttaacgttaaatgcggtgtttaataatttgcatgatattgcgggtatccggttgattgttcgtttcctaagcgatgtcaagacagtcgagaatttattggcgactcaggctgacattaaagtattacgagtgaaggattatattcatcatcctaaagctaatggctatcagagtttgcatttaatcctcggggtgccagtctacactgttgatgggccgagcatcattgaggtcgaactacaagtacggacgattgccatgaacttttgggcgtcgttggagcatgaattaaattataagaagaacgttccgcatcaggacgcattgcgagcgtcattgactaagaaggcgcagttaattacggagctggatcaggaaatggacgatatcaagcaacggatgtatgaacctaagacgcccccaaaagaagtctaaaaaatgcccgattattagcaggtaattgctaataatcgggcattttggggttttcttgacgcgaatcaagtccatccatgcacatgactggtatcttatatagaagaaagtaattaagaagttagattgcttttgcaattaaagggttcatgttacttttaatatgcaagataatttccaagacatattgataataattaatttaatgggaatagctagattaattaaactaacaatcgaatagtggggttaaattcagtgttcagccaaatttttgactggttttcctcggtaccaccagtcgttgataaaactggccagttcttccggtgattcatgtagtcctgtttttaaccaataacggacaacaccaacgataccattgagataatactcaaacatgtactctttttcgcgattgccaataccagtgatctcagcttggttatgtgctaagatctcacgcttagttgttgcgataaagctcatcagaaaatcctggtcggttgttaagatgaaggaagtaacggcgtggcgtttcttaaccacctcaaaaattcccgtcagaatggcttgtaaagagtcgggattaagatgtttatcaataacagctagcagttcttccgtggcatcttgttccatcttctgcatgcaatctttgacgtcttcataatgggcgtaaaaggtgccccggttgatatctgcggccttgcagacagcagtgaccgtaatctcatctagcgactgatgttggagtaagttgattagactatcttgaattaggcgttcggtcatttgcgaacgacggttgtttttagtacctaccactgaagttcacctcattatttgaacaatatactattgtttgtttatttaatgacgattttatgaaaattgttggttgaaattacaccggttttcatttaacatgttgttattatttaaacacattgttgattaaatgtcacgatgtcgttttaagaatctgaattagggaagggatataacgtgaaagggagccgtagacgttttacaatccaagcgattgtttggctagttgtgatggtagcggccatcatcttcctgccaaatatcagcagtctggtacgtgataagggccagaccaagttgccaagtagtgccaagagtcaagtcgcacaagtcattcagaatcattgggggcgtaatcaaaataatacgcgccaagtggtggtggtcttcaataatggtgattcaccgttaacgagtgaccagaagcaagcaatcgatgggacgattcaacgcttcaaagtgcagaaatcaaaatatcacgtgaaatcaatgacggctgccagtgataatgctgctgccaaaaagcaattgatttcaaaagacaaatccacccaattactacaattaatggttggtaagaatcagaccgtcgcgaacatgaccaagaatattacggctggtgccaaaacggctggggttaagacgtacgtgacagggagtgacatcttaaatgatgacttcactcaggaaacggaagctgggattcagaagactgaaattattaccgttattttcattttcatcgtgttaacgttagtcttccgctcgccgattacgccgttagtttcactgttgtcagttggggtgtcgttcattatctcgctgagcgttgtgatgaatctcgttaataaatttaactttccattgtcgaactttacccaagtctttatggtcgtggtcttgttcgggattgggaccgactacaatattctactgttcgatcaattcaaagaagaactcagtcatggcgatagtccggtcgccgcgactgggcgcgcgttaaagattgccggacgaacgatcctatacagtggatcgtcactattgattgggtttagtgccctcgggttagcgaacttctcaatttacaagtcagcggttggggttgccattgcggttgctatcctattgctcgtcttgttaacgttgaacccattcttcatggcgttattaggaccacggttattctggccaacgaagaagtttgctggtggtagtacgagcaagatgtggcacggcattgcagcgtcatcagttcgttacccaatcatcgccctagtcgttgttttgggtgtctcattaccgtttatcctaacgtacaataatgaattaaactacgatacgttagctgaattaaacgacacgattcctgcgaagaaagggttccaagttgttcaggatcacttctccaaggggacggctgaaccgtcaacgttatatatcaagacggatcatgccttcaacaatgaaaaagatctaaaagtcattgacagcttaacgaagcagttacaaaaagttaagggtgttaaaaccgtggcgtctgtcacccaacccggtggctcacaaatcgatcaattatacgttggcaaccaattaggcaccgtcactagtgggatgaagtctgctagcaaggggttgactaagattggtagtgggttagatagcgccaatagtaagttgaagagtgccaatatgtcggatagcgcgaagtcggccaagaagttggcggatggggcggatgaagtttcatcaggactcaatactttaaatggtaagactggaaccctttcaagtggggctggtcagttggcaagtggttcgagctcgttagcgagtggattagttacttatactaatggtgtctacacggtcaataatggtttgaaccagttgaacagtaagactggaacgttggctagtggagttaatcagttgttaagcggcacacagagcttgtcaaatggacttgatacgttaaataataataaaacaactatttctcaaggaactgcaagcttaacctctagcgtagcacaattgcaaagtggttcgagtcaactttcaaccaagctagctgaactggaagcaaaagtgaaagctggaagcacggacgttaatgcgtcacaattgcagacattgattgatggactcaatacactcaatacaaagatggagacagttgctaacagttctggcaaagttaagtctggaattgcattgttacaagacagtgctaagaatgctaattctgcgcaaactaaaatgactaatgatatgacgactgttcaaagtgcgctggaaagtgcggctaaaactgatgctgctaatgcagccggtacatcgtccagttcaacggcaactgtgaatgctgatacggtcgcttctgcagcggttgctgctgcaggttcaagtgtgactgatgaccagaaggctgctattagttcggcagtaacttcggccgtgaacgcgcaaaacagttcgaacgctagtgcaagtacttcggcgacaaaggcaacaacgacgaccacgtcgggtgcaaaagccgggctggaagcattgtctgatttgagtgcgcaactcaagacaattgcggatctcaacaaccagttacaaacagcgagttctcaattgagtggcttgtcaggccttggtgacttggcaacggcaagtatttcagcaaataataattcaatcacagcaattaagggattacaaacggcggttacagaaatgcagacgcttgaaactgcgactgaacaattgtcagcaggctctgaccaactcacttcaaagctcggtcagttgctaagtggtaccaatacacttgcgtcaaaactggatacttacacaggtggtgtgactaagcttgcttctggggcaaacacggttaataatggaatgagcagtttaagcgcgcaaattccaacgctaacgagtgccatcagtgcgcttgattctgggactaaccaattagctgccaactcttcaacgttaaatagtggtgcttcacaattagctagtgggactgcaagtttgaactcgcaagtaccaaccttggtaagtggtgtaagtaagcttaacagtggtgcctcgcaagtggcctctggtaatgaacaaatgtacaccagtattcaaagcttagtaggtcagatgcagacgctccaagatggtttgaagactgccagcgacggaactaagacaatcaacactggtgttggctcagctaacagttacttgactggcttaaaggattccgcggctgcgaagacgtattacgtgccaaagagcactttgaagggtaagacttacaagtctgctttgaaggcttatatgtctggtaacaaccacgcaacgaagttaacaatcgtcttgaatgaaaatccaagttcgaagtcagcgatggataaagtaacggcaattcaaaagcaagcgacgaatagcttgaagggaactgcgttagatggtgccaccattgcgattggtggtcaaacgtctgaaacgaacgatacccaagcaattgcttctagtgacttcgttcggaccgctgcaattatgttggtcggaatcctaattgccttgatggttatcacgcgttctgtcttacaaccgttctacatcttagggactttgttattggcttacattatgtccttgagtattacacggatcttgagcaactggttcttgggtcaaagcatgttaacttggaacacaccgttcttcgggttcatcatgttgattgcgcttggggtcgactacagtatcttcttgatgatgaagtatcgtgaatttgataattcggctgcgacaccaagtactcgaattgtcagagcttccgccgtcattggagccgtggtcttatccgctgccttgatcttgagtgggacgttcgccgccttgatgccatccggtgtcttgacgttgattcaagtggcgatggttgtgattatcgggttgattatcctggtattcgccatcccaacgattattccaagtttgattcgcttaacttatccgttgacggatcgtatggaagacgaaaccactgctgaaaagcagacgaaacgaaatcggcaataaaataagtcagttatgcgataataagtgtaaccaactggcgccgtctaacgattcaagttggacggcgctttttttaggggctgcacttagattttaaaaacagtgttagttttagtctaagagtatgcggcgagtatgagatagccggattggatagtggcgataaggagatgtttttaatgcaacgatgtgcatgggcggattcatcaccagcaatgcaagcgtatcatgacaacgaatgggggcggccgcaacataatcagcaacgactttttgaactgttgtgcttggagacttatcaagcaggactgagctggcagaccgtcctgaataagcgggcggcttttaatgaagattttgcggattacgatgttgaccaggtggccgctatgacgaccgccgatgttgagcgactactaaccgatgctcgaattattcggcatcgtcagaagttaatggcaacgatcaacaatgctcgtgtgattcgagattggccggccggggaagactttgccacttggttatgggcgtttgttgataaccagcctatacgccaggcgtggccgtcaatcgatgaggttccggtaacaaacgacttggcgcaacaagtgtctaaagagatgaaacgccgcggcttcaagtttgtcgggccgacaaccatttattcttatcttcaagcgactggtctcattaatgatcatgtggcggactgcccatttgctccagaaaatttaccggcctaacgcgcttaattcccggcgcggtgagtaagtgagccgtcaatttaaaaccagcgcgatgacaactgtcaggcgctggtttttattaaaatcaatatgttttggtataagtgtgattgcttaaattttatgtataaataaatgcttattataacaataaaaataattgacatgatgtcgcttaatttgctaagatacggcgtaagaatagctgcggaaggcaagtgatgggagcgacgttaggtgaaagaagtaaggttttggggactcttgttaggactgtttgtctgtttaggggcagtgataccgttagttagtaaggctgacgtacttgatacggcacccgctggactgaatctggaaggcttatttgaaccgggaaagtttgaccgtaattcggccacaatgcagactgttttaaagaatggccattcgcagcatgttatcgaattaacaaatgacgataatcaagttggggcaatgtggtcgacccctgttaatcgctttaacatgcgggtcgataaccaagtctcaatgtgggtgaactttggggacaaagccgtgagtgaaggactggccgttgttttacagaatgatccccgcaaaatgagtgcgattagtcggtatggaaagaaaagcattattggtgagaacttgggtgtttatgggacggatacctatacacggcgaacggcgccggccacgattgctaagacggcgattcaaaaaagttgggcgttggagctggataccaaagtgaatgacggtggtttttggggattgtatccccgggggaattctttcgatgaaaagcctaaaaaaatgcatatggccgcgagctaccctgcaagtccggatacttatacgcaacggggtggtttaacgtcctcttatcgttttgaacagaaccatgggagtatcgctgataaattaccactcgcggacggtaactggcaccatcttgtattgaagtgggtcgccagtaaacaaatcatgagttataccctggatcagggaccaacacgaatgaccacaattgatacaacagtctttggaaaggatatccggaatgttacttggggattaactagtacggcgacaaccgctaatgccagaacactggtcgtctttgaccggttgccacaaccgattgaaatcgagtcagatttaaacgtaaccaatctgactcaagagcgaactgtccatgaaggagactgggttcatggtggggatgagttggaatatgagtacgttctgagctatctcaatggtgacaatgaatggcaacaggttaaggccagcctaccattacccgaacaagttcactttagtcacgcgaagatccgctatgcggatggtaccgaggaagagatcaatttaccagcggacgataacgaatcgtcggtggcccgcttacaacacgatttgcagcggacactatcaatgaaaaatccgcacgcttatattacgctgattggtgaggctgccaaggtcgatcgggatacttttgttgatgatgacatgagttactttgagggtcacgagatgaagaccgcaacggccacaccgcacttcaccattacgaccaataagaccgttaacctgacaattgaaccgttgacacaagtgaagaaaggcgatcccgtcatcattaagggccaaattaagctaaatgatgggttagactttgacaatgatggcatgcgtatcgagtaccgggtcaatggtgaagcgggagaagactatcagttgagcatggacgatccggttggttatgtcgaatttgaagtggatgccgaagaactacaaatcggtgaaaatcagattacgttacgggctcatagcaaagataacgcctactcagaaccagtgacagtaacggtcacggtcattggtggggagttacagctgaaaaaagtcagtactgaaagtgtgtttgcaccaatcaagctgacgggaacggctcaagtcagtcggcccgagggacttgaagtagttgtcaatgatgatacgggctcgaaagctgcttggcgcttagaggcgaccgcgacccctctcgtgactaatcagggccgcacactagcgggaaacttgtattatcaggatggtgccaagctgacaatgttgggaaaggatgccgtggaaatcgcgcgccaaaagacggccccggggatcgactatgacgtgaccgcccactggtcatcgcaacaaggtttggtgctcaaaacaacgcccgccgctgttcctggaagttatcagggtacgatcacgtggcacttaagtaccgtaccggaagagtgagtttacgattgtgtaagtaattcgtttaatcaataagttcaatagtcgcgacaagaattaattgctaattcttgtcgcgactatttggcgttcagcgaaagtgctgactaacgcatttaaacgggcctccgatacggtgcaatgctagtagtagcaagcacaaccagcctttcaggggcttagctagcaaattgaaaaatcttcggtttcagacccataaataaacccagcaagttcacaaattagtcagatttcccgtgtaggttaaaagcagtgcaaagcaattgtcataccaatactttatctgaaggagggtttaagcgtgaatttttttaaacgcgcatggctcaatctaacggcaaaaaaggccgttcaattctattagtacttgttacatcagcaatcatgctgtttgtattggccgggttattgattaggaatgctgccgatacggcaactagtaatgccaagaaaagtgtcggggcgaccgtcactttatctgctaaccgggaggcggcttttaagaagatgcgcagcgccacgtcgacgagtaaaagtagtcggcctaagttgacgacatcgcccgttaaactgagtgatgcgaagaaaatcgccaagcttagcaacgtttcaagttacaatgcgaccgtctcaacttccgctaatgcgaagggctttgatacgatttcaacatcaggtagtagtactggtggtgggatgaaaggtatgggtggctcaagtagcagtggtactggtgatatctcgattactggggtcactaatacgagcagcgtctcaacctttgaaagtagctcaagtaaaattacgaagggccgcggtattacagctagtgatgaaggcactaacaacgttgtcatcgaaagtgaattggctaaggaagatagcctgagcgtcggtgatacgattaagttaaaagcaacgaccggtgataagaagacttacacgatgaagatcgttgggatctataaagcgtcgtctagtgcaagtacgcaacaaggtcctgtggtagtaccgatgtcagcaacagtgtttacacgtcatacacgttcgctaacacggtcaagggttctaagtacaagaacacagctgattctgtgacttttgcaatctcagaccccgctaaagttagcagcgtcaaaacgtctggtaaacagttgatcaatacatcgaagtattcgttgtcaacggatgatagcagttaccaaacggttaagagttcgatgaataacgttaaatcatttgcggataagattgtctggctcgttgcgattgctggaacgattatcttagctttaatcgttatcttgatgattcgtgaacgccgctatgaaattggtgtcttgttatcattaggtgagagccgttggaagattgtcgctcaattctttgctgaaatggtgatggtcttgatcgtctcagttgtcttagccggattcggtggtaagtttgttggtaataagctgggtgaccagttagtttcacaacaaacgacgactgcaacgactacgacgagttcaactagtcagcagggtcagcctggtggcggtgggggcgcccctagtgataacactggtggtagcaagccaagcggcaatatgcctagtggcggcggtcagactggtaatgccagtgccacgaccgacacgaacttagatattaatgtcacggtaatggatttagttgaactcggcggctttggcttagccatcatgttcctgtcgattatgctggcttctggtggcatactacgactacagccgaagaaagttttaattgattaggaggggcggcaatgttaaaagtaaatgatcttggttactggtatgaccgccaagaaaatagtctatttgagaatgtaaaccttgaatttaagtcggggacttcgtatgccattgttggtcaaagtggttccggtaagacgaccttcctctcactgctggcgggtctagataaaccgcgggctgggcaaattgaactcaatggtgaaccaatcaataagattggtctgacgaactatcggaagtccaaagtggcaatcgtttttcaatcatataatttgttgacgtatatgtcaccattgaataatctgatgactgccatggcaattacgaactcggaacaccgtggtgacaaggattatgcgatgaagatgttacgacggttaggtattacagatgatcagatgaagaagaatgttcaacgcttatctggtggtcagcagcaacgggtggcgattgcatggaccatggtgtgcgatgctaaactagtggttgcggatgaaccaaccggtaatttggatgaagaaaatacgaaatatgtgattgaccaatttcaaaaaattgcgcatgaacaaaagaagtgcgtcattattgtcacgcatgaaccggatgttgcggacgtttgtgaccactcctaccgattagaaaagcacaaatttgtggcggaaacctagggtgctcttacgattgaatcagacgtgagttgacgcgtacaatcgcatttttgtcaagataagtcactaaaaatgagttctcagaatgatttgattctggggactcattttttgattactgtgaattgctaacgagacaacaatcgtttttgagggcgaacttgccagcgaacgataaaggcgatgatgataaacaagacgagatagagcaccgagatgccaatcgcgtaagcaaccggaatactcaacttggccgcggtgtgggtatgcgtggccaaactaacgacgacggatacgtccgataaggcgtgcaagaaaatcggccagactaagttattggttcgtagataaaggccgcaaaaaatcaggccacccgctgcagcataaaagacttgtgggatgacgtagctgagggtcagctggctgcagttaatgagtaggtgggtaagaccaaatagtaaactgtcgatacaaatggctagcatgagtcggtgagggaagcattgtcgtagtagtggcaggagcatgccccgatagatatattcctcagtgatcccgataactagggcgtagccaatatagagaattaacgttggggtccaagcaagatgacataccttgatgaagttgctcgtcattggtagtaataaaataataattcccgggatgagctgcaagcattgtcgtacgagtgattgcgattgccaccactgaatcgatattttaaaccaaaaatgatttaatagcaggaaaataagtaatacaagcaagtcttggaccagcccactgtataaagttggtactggtagccaggcaattaatttaaaaagaattggtactaaaatgaaaatactaatagcggctccccagccgcgtttggttgatgacatcgaaatcccctccagaagttaatgctaactttagtataggtcacattgaaggtgttggttatattaattacggatcgattagttgccggtggtcattatgacagccactggtgattttggcgtagaatcggcagtattaataggataatgaccgcgatttcgatgatttgaaaactagtcgtcgttataccgggcaaattgattggaggttccatcatgctaaagaagtcattgacggtgtgaatcaacaatggccatagtagcgatgttgtctgtgccgtgattaaacataatagtagccccagtacgaacgtaaagcccaattgcaatagggttaaactaagtgtttggtgaccaagattgattagatgggtcaaactgaagaggatactagtgaagactgcagctctacctacacccaatgttgactggctggcctgaaacaacattccgcgaaaaaaggtctcttcgaacaggctgatcaatatggcaacgaataacagggtcagggtgtttgtcagttgttgggcggttgctaacgtatataatccaattagtgcggctacgattaaggttggcatgatgggccggatttgccgacgccaagttgccgataccccaaattttaaggtttgccgtagccagtcacgatttaatatgagtgcaattgctaaaaagaacagctcttcgaccccagttgttaatgaggatgggagttgggttaagcgtggtagctggaaaatcaggccaatcaacaacatactgcctaacatgccaccccatagtgtgatgactaatttggtttcgtggcgcatctcctcagatccttcctcgtattctcgctactaagcatacgccttttaaatgaatctgagcataaaaaaacagcgtaacgacaattaatgtcattacgctgttcgttagtaatcagttattttataaagcccaagcagccatgccttgtgcgttgtataagctaacggcagcgttaacttggtcttcaacagagccactgctgatgtgcatgttttggaataaaccataggcaccagaagtactgttcttgaccgttgagttccagtttgattcacgcgtgatgatcgtgttccaagttgaagctgaaacgccagtccgtgattgcatttggcttaatacgtagctctttaagttactaccagtgtagcttgaagtcgttgaggttgttgaagctgttgatgatgcagctgagctagtagcacttgatgaagcttgactagtggttgcagcagaacttgaagcttggctagcagctgattgcgttgagcttgctgaagaagcagcactcgttgcaacgcttgaagtagcttggctagcagctgaagaagtagcagcagaactagtagcttggctagcaactgattgtgaagaagcactagtagcactggcactcgttgcagttgaagcaactgaagaagtagcttggctagttgctgattgtggtgcagcacttgtagcagcagaagtcgtggttgtagtagtagtaccattgacttcaagcttatcaccaatgaagattaagttaacattagctaacttgtttgccttttcaatggctgaaactgaagtgttgtgagcttgggcaattgctgaaacagtatcgccggccttaacagtataagtatcagcgttggcaaccgttgttgagatagcgaataaagctaatgcagcagttgatgataatacaaggtttttgattttcataataattaatacaccctcctataatttgcgtgtgttcgattatttacatatattttctattggtcgagcagttgatgtctcaaccaatcaacagtgactagtataactagtgagtgttgcagtgcaataatcagaacattacgtttttagggggtgcttgtaatataaggccgtttttgtaatgaattgtaatatttgagccggatttcatgtaaaatagcgctaccaatcccgattaactagctagaaaatcaataacgacaatgattaagcggggaaactaatgatgaaaattagccgctttatccgataaaagtgatcacttttggtcgatttatgaaaagtcaacgaggattatcgataattttaagcacttaactagtgaattttgacgggttaatttgtcgggaagtctgattatagtgacacttaactagtcattttattgcttggagacgtggcactgactaattatttttcggtaaagcagataattgatagaagttgcgcatcgtgtagtcaattgtggttggttaacgaaggcgtcgattaattaagtattactatagtaggtttatgccaaaagtagcccatgacgatcgctactaaaacgttactgggttagtattacgccatagctgaatggtatgtggttgtcgttgtggactagtcgtcaaactgtcgggggttcgggactgtacttagtcaggaaattagttggattttctccgttaaggttggtgaattgttaaataaaaacatgcggtattttggttgggagagtgggtcgtcgattgggggagacaactagcaggtctggatcgtgtccgtcttaaagcggttgctagaataagcatatcgcatatctaaataacgggttgtcagcatgctctaaggcctattataaagtcacttagcaactgagtaactttgtaatgggtattggtggggggacacacgtgcttcagcacggacttaatagtagaaaaaaagattgcgaatcagaaatgatccgcaatctttgcatttatttattaatttaaagtggctttttagtaccagccattagcaagccagtaactcttggcgttgctccatgaaccataacgtgaagcaacataactgttagcaacacgttcttggttggcagcggagtagtcaccgtttaagtatgaagcacttaattggtacttaccgatgtattgaccgttacgagcagaatatgaaccaccagattctttaccagcaatccaagccttagcagcactatcagaaccattgttgctatagtttgatgttgaaactagacgttgagtcgtcgtctgagcagcaggtttgctagtttgtgtttgacttgattgggtctggctagcttggctcggttgagcttgagtttgactagtctgagctgatgattgtgtcgtggtcgtttgttgagtcgtctgtgttgaagtcgtggtagtgctatcaccatttacttcaagttgttgaccaactaagatcaagttaacgtcttttaagtggttagcttgttggattgcatcaatcgtcgtgttatgatcagcagcaatggcagaaaccgtgtcaccggctttaacagttaccgtagcagcttgagcggtagcaccaatggcaaagagactagcagtagcggcagcagttgataataaagcattcttaatcttcatttgtaatgtacactcctattttttagtccgaatttggcttggccccgcgaatcttccaagcactcaatggtacctagtataactggcgattgtgacagggaaatagcaggagttttacgaattaccctaattcttgtaataaacggcgtgttttgtaatcttttgtaatataacgcgcggcgcaattgtttctgagcgggtcaatcaaggctgtttacaaatgaagacggtgtctgttggttaacataaccaaatgttgtgattaaagttcgaagcgtgatatcactgggactggcaaccgctgatgtcgtgactaagcttagttaagccaatttacgagttcttttagtggaaatgtaagcgtttgtttgaatgtcagccaacttacttttggtaactcgaaattagtcggcctttaattggaccagccagttgtcggtttgtttattgttaatgagcgattggggtgccgcttgtaggtctttgttaagcttctgaacggtgccactaaagggtgttgacaccagatgcgccccttgatcgtccgtaatcgtgacgagcggatcacctgccacgaggtgctggcccttagttggtaaatcgagttgatgaacgacacccagtttgtgttgtccttggtcacttaaccccagtagaagccggtcatgtgatttggtcttcagccaaacgtcgccgtataacatcggagcatgttgctcttcgtaatcatgacgatagaaatggatcatttgtttccaagcagattcttgttttgccatcatttctcctcaattcagtgctagtagtcggtgcatcaattgaaagtggtgcatgattgctaatttcttaattattcctaaccctgggaatttatcaccctcagcgtaggccaatagggtggcaagcgcgggggtgcgattgagtcccgtcaggtgtgcgggtgcccagtcggtgagctttgttaatgcttcaaaaaacttttgcttttgaccacgcatattggcattgctgtccgaaacaaaatgatggatgcgcaggtcaccgttaaccgtaacataaataagatgtaatgcaattgcgcgtgatggcataccgtggtcaaaatagggtcggcccatgagtgagtaatcgccaaaaccatcaaagccaaccggtgtttggtgccagttagcgggggcaaaataggcgtcagttatttcttgatagtccgcaacgtgcgctggggttgccacgggatcagtcaataagaccgcgtgttgtggtaatagttggtgcaaacgcgcttcatcagggattaggacatgaccagcatgctgtaaagtggtcgtatgctgataggccttaagcaacggatagttaggcgcgatgagcaagcttgtttgaccaggagtggttgtcagaaagtcgcgactaaaatcagccgcaagaattgcgcccggccggtaaaatgggtagggacgcagatccggaagtggatggagcttaacggtattaagaccatagacactcacttggggattcgcaataatgctaaatggttgttgggcttcaataaaagtcgtgactgtttgttgtaattctttggagtcacggactggttcaattactgggatgatgtgtgggccaagttggtgttgctcgcacaatgttcttaaggctaacaaatcatacatccgtccacgtagataggggtagtaagtgctcataactggtcacgcagatctggtgccgttagcgcctgatattttagtttgagtgtctgatattcggcattgcgggcatctaattctgtttgtagcgcagtcaccgcgtcattctgggtgtcatcgatgaagcgatcgtacaagttttgttcagaatcataaacgtcgtagccggtgcgggcccgtttgcgtaattctttgaagagttgatcatcagagtagagctgtagtcctttcttcacacgcttggctttatcgacctcacgaaagagcgatgtgataaagtgactgataaggggcgtttgctcgacttgtaagtcttggcgttgggctttcttagcgacagttaggaaaccagacgttcgcaacggttggggtgcgagctctagggcccgctgatcaaaagcacggtagatcaatacaccaatatggtctggaatttccgattgaacttctaggtaaagttgttgcggcaagacaaagtaattgtaatgaccgataaatgaaagtttggcctttgaatgaaaatctgctttggtgactttcaattcgtagcaacgccattcaatctgaccatcggggagttgttgatagcttaatgtatcaacgatccctttatcagcgggcatcgcaacttcttcaaccacgtaggcgccctgttctagacagtactgatagagagtactttcaagttgtttagttaatttagtcttcattaatgagtcacctccatttggtgccaaaagttggcaatcgttgcttcgagctgcgggactgattggatcgtctgatagtactgccaatgttctggaaataaatctgtgtagcgccgactagcgaagcgttggtctaacaagagaacgattccggtgtccttggcactgcggatcaggcgtccagcagcctgtaagacgttgttcatgcctggcagttggtaagcgtaggcgaatcctaagccgttttgatggtcgtagtagtcacgaatcaagttcgtttcagggttgatacccggcagaccgacactgacgatagcgactccaatcaaacggtcgccacgtaagtcaatgccttcggagaagataccacccagtacgcagaaaccgagtaaggtttgcgagggtgctgactgaaactggttcaaaaaggtctgccgggcagttgcatccatcgtcgaggcttgggcggtagttgccacatcagggtaggcggcttcaaaggcagttttgatctgcaacagatagccatacgacggaaagaacacgaggtagttgccatgtttagccgtcaacatggcgtgcaagctggcaataatccggggcacgttatgttcgcgttcgtgatacgttgtctggacgtactgggtgacgagaatggcctgatgctttggtggaaatggtgatggaagctggtaggccaaactgttggcttcaccgccaagcacccgctggtagtaagccatcggggtcagcgtcgcagaaaataggacagcaccactgccgagctctaatgaccgattaagaaagtcactgggatctaggcagagttccttgatcgttaagtgatgaccgtcaaggacgaagcgcgtctggtagctgccatcatataggtcgccaattttaacaaaggtcagacaggcgaagaaatagtcacggacggcgtcgagcagtgaccccggcttttgttgcgccaaccagtcagtcacaaattcattaaatgttctgagggtgcgtaataatttgtccgggggatcaggtagcacctgttccgttacttggtcatcaatcaaggttttactgatgcgcgtaaaactacgccggactttcttgagttcgcgttgtaagtcgtcacttggctgacttttatcgggcttggctaattttagcaacgcactgattggctggtcactaacggctgcagagtacatatcacgggagcgactaacaaggttgtggacttcatcgataaggaaaaagttgtcgtcatcacgttcgctaaagaatcgttgtaaatagactaatgggtcaaaaagatagttgtagtcacaaataatcacatcacagaagagcgacgtgtcgagtgaaaattcaaacggatcgacagtatgcttgcgagcatactgttcaatcacggaacgggtaatctggtcttcatgggtcaacagatccttgagtgctggtttaagtcggtcgtagtagccaatcatataaggattatcttccggaagtacatcttgttcctcgggaaaccgaatctgatccttggcagttagcgtaatgcttttcagtttgagtccgtcatgactcattagcgtgaccgcttcttcagcaacgtggcgcgtactttgcttagcggtcaggtaaaagaggcgctcaatcacgtcttcgcccattgctttgatagccggaaatagcgttgagatcgttttccccgtcccagttggtgcttcgacaaagaggcgtttttgcaaccgaattgtcttataaacagcgccagccaattcatgttggcccggccgaaaagctggaaacggaaatggcaagtcttcaatagaagcgtttcgttgtcgtcgtaaatcggctcgtaatgtcaaccagtattcatattctgtaattaagtcgtggaagaatgcgtctagttcagcccggtgaaggatttgctgggtcttcgtgattttttcattgatgacttgaaagtaggtcagctgcaacgtgacctgctcaagatcgggatgttcttgcagtaacaggtaaccgtagactttgatctgcccccagtaaagtgtcaacgtgttggtacttaagtcctcgaagacttgatcggatgttttgatttcttcaatcaacgccccatcatcatttaactgaatcccgtctgcccgacccgcgataatgtaatcagtatcgttcatcgtcacaatttttttcaggtaaacttcgctatcatagtcttcaccacgactactctggagctgacgatgaatcttagcaccgttcaatgcagtgttctggctattctttacttcatttaaatcgccttgtcgcaagacgaattctaccaattgtcgaattccaatcctagttgccatcggagcatcccttctgaatttagtcgcttcctattataaaacatctgttcgtgtttgtctgctgttgattgatgatgccgggcggggctctgtgatgtggccttaaatgatggttaagctgcggcagaccaatatttaagacgcgggcttcggcggcttgaatctgggctcgtcgtgttccagcaattggcgaaaatgcctgggagtcaatgtaggacgaactagccagacgggtgcatgctattccgaattttttccagcgaatcttagctggtcacttttgcctttgaaaaactgatacgggttaacaatctggattgaaagctaaataaaaaagcatcgcgataagggcgccgatgcctgttgcgatgtttagattgacgattttgatttagaagaaaatgaatcagactaggaagttaatcgtaccaatggctgtggtgttggcgaatgctcttgcggagactaaaaccgtagctgatgatgccggctgtgataatggtcgctaaaatcgcaagcaaccatgaaccggacgtgctaaagtaggtggcgtaaccaaggctgagactgactaatgtgatgacgggaattagaattctcacaggggctggatgtaagaagacgacaccggctagccacagagccgctgctgtgaccatggcgtcgacactgattggtgaaccaaagctaataccaagagtgatgatagcaagaattgttcccacggtcaggaggaggacagcaaagccgttgctgacggaccaagtaaacgtttttttcatcatgatcgcctcactttctattaactatattataggctaatttcgccttatgaaagaaataatatgccgacaattaagtttgcaatgttatgaaaattgaaagtttgtgaacaaatccttgaaagcgtatccactattagttaaactggcattaggcacacttgatgatggatggaggaaaaatagtcatggcaaaaattttagcaattaacgccggcagttcaactttaaaatggaagcttctcagtgttcccgaagaaacggtaatcgcatcgggaatggttgatcggctgggattgccagattccgttttcacaattaagaaggcggatggtagtaaatattctgaaactaaggatcaaattgatgcaaaagaagccgctgcaatggtcttaacacggctgaagagcgataatattgtgactcatcttagtgaaatcactggggttggtcatcgggttgttgcgggtggcgaagatttcaaagactctgtcgttattacctcgcaaaccttgaaaaaaatcaaagatttatctgagtatgcgccgctacataatccaacgcaggcttattatattgaagtattccgtgatttattaccaaaagcgactcaagtagccgtgtttgacacttcgctgtatgcggatatgcctaaagttaattacctatatagtattccttacgattattatgagaaatttggcgcgcggaagtatggggcacatggcacaagtcatcgttacgttgctaatcggacggcccaactattggggaaaccattggattcgcttaaattagtgacattacatttagggtcgggtgcttcgatcacggcttttgatcatggtaaagccgtcgacacttcaatgggctttacgccgctagctgggattaccatgagtacccgttccggtgatattgatgcctcaattattccattcttgatgcgccatttagggatctctgatgtggaagactttgttgatattttgaatcataagtcagggttacttggtatttcaggtttgtcacctgatatgcgtgatcttgataagacgcaagatacccgtgaacggtcaaaactagcaattgatatttttgttaaccgggttgtgaagtatgtcggcagctatattgctgaaatgaacggaattgatgcccttgtcttcacggctggtgtgggtgaaaactcatggatgatccgcgaacgcgtcactaaagctttaggatactttggcgtgacagtggatgatgaaaagaatcatatgcacggtaaggaacaaattattagcaaagatgacgaaccggtaacggtcatggttgtcccaactaatgaagagttgatgattgtgcgtgacgttgaacggttatctaaagctgaataaatgagtcaattaaaaacgcgtgattcggattgtggtccgagtcacgcgttttgagttttggattctaatcagcatagcgctaagtcagctcttgtccccgcatatgtgccgatgtgatgtgctcagctattggcgttgtcgcgcaggtttagtcattttgatgtggggcgtgtggttgaatagaaaaggggtaccgctcgaagtgaagccgaaatgctggtaaaatctttgtactggcacttgggcttcaatttgaattggcaaatcagcatagtgttcctgtacgacctgttcgatatgggccattaaatcagcgcccaagtgttgtccgcgttggtttttgtccaccacgacccggccgaaggagagatggtcatcttctgtaaagattcgtgcgtatgcaacaatattttgattgacggttttaaagacatgataagcttttaaatcagtatcatcgacttcctgatagatgcgctgttgttcaacaacaaacgttttgacgcgcaattcataaatagcgtataattcagttgttgttagttctgagaatgttttaatcgaccacatggtgatgcctccttagcatagtgctaagtttatcatcaaatgattgcatatgcaataataaaaaggagcttctatgataccaacattaagattgatgggcacgttgtcgcgaatcgtcacgaacgagggtaatcaacgttttgcgaaatacggcctcaataacaatcagtttatttatttaattcgaatttgtgagcagcctggcctattttttagtcaattggctgaccaaatgaagatggatcgaaccacgaattatcgcgccgttcagaacttaataaaaaaaggttacgtgattaagcagacacatccagagaataaaaaggtccggtgtttgtacccaacgagcgctgggcaagcgttgtacccggaattgcatgcttatgagcagtggtgtgcagacttggttggtgagcagttaacgccgggccaacaacaagttttgtttgaaagtctgtcgttagtcacggctaatgtcacccagcatattgagtaagtttaatcactaaactagattaattgtgaacaattaaaatggcgtggcgttttagctgaattttaggcgtgaagagtgtaccatgtagttatcaagttataactggattaatgtgatcaacgcaggttagcacaattgctggacaggcggcattagtcaacaggaataatgaaaggggttaataaatcatggcaacaactttggtgttaggtgggggttacgcagggatgcgagccgtcaagtttttacagaagagtctaccaactgaggatgaaatcattcttgttgatcagacaccgacgcatacggagaagactaatttacacgaagtcgcagcggggacgatcgcacctgatcgaattacttatcagattccagatattatcggtaagcgggtccagttcgttcaagcaacggtcaagagcgttgatattgaacaaaaacaagtgacctttgaagatcatcctgaaatgacctatgactacttagtattagcattgggcttccagtcagaaacatttggggtagctggcgccgatgaaaatgccttgccaatggatgatttggcaacttcacaggctgtttatgaacatttggaagaacggtttaaagcctaccgtaccagtaaggacaaaaatgatttgaagattgcggtctgtggtgctgggttcactggaatcgaattattaggtgaactgacccagacgttaccaagattgcaggcgaagtatcaaacacctgctgctaagttagtttgtttggaacggatgccatcaattttaccgatgtttacgcaggaattgcgggactacgctttgaagtttatggaaaagaataatgtcgaaatgcggttaggtgccgttattgaggccatcaaaccgggtgctgtggtttacagtgacgcggacaagaacgaacatgaatttacggctaacactattatttggacggttggtgtcagtggttcacacgtcattgctgattccggttttgatcagcgccgtaaccgggtcgtagttaagcccgacttatcactggaagggcatcccgaagtattcattgttggggatgtcgctgcagtgatggatcccgaaagcaatcggccatatccaaccacagctcaaattgcactggcagctggcgaacaagctgccaagaatattggcgctttgcgtcataaccaagcaacggcgacgttccactatgaatctagtgggaccgtggcctcattgagcgatcgtgacggtattggtgaaatcttcagtagtaacaaaccggttcatggctacgcggcatcagcattgaagaaaattattactgaccgctcacttttggaaagtgcgcatttaggaacggtcttcagtaaagggcgttttgacttatatcattaatcattaaattaattccagtagtatgataaatagccaccacagaaatcgaatttctgtggtggctattttggactagttaaccgtcgaatggctcagctggttggctgattcgggcaattaagtaaccagctgttgggactaacgatactttacgggcaccccttacaattaaggcatgataagggggcggtcaaaatgacgactaaatcaatacgaacaccaattcaaccgtggtttaccctagtggtagcgggcagcttactgataaccttgttttctaccgcactttggtggttggctagcagtgcgttttgcgcgttactcattttaaacttacaatttatcgtctttccaaccaccgcggatcgttattggctaaatcggctcagtttaggattggtactagtgctagtagtgctcgcgaatattaaatttttaatcattagtggcttgacatggcagtaagcgcctagacattaaaggacctgacttgaagcactctgtttcaagtcaggtccttttgtctaatgatgccagtcatttgaatcaagtaggctgatccgattagtgatgcatcttaaattccaaataacggtcattatacaagccgactttggctggtgataaatcttgatagatttgaagatgcttgattgtgttattgtctgggtaaaattggcgatcgttgcgaatggccttaggtaatagcgccttggctttccgattaggtgtcgcgtaaccgatatattccgcattttgggcggcgttcttgggttcactcataaagttcaagaaggcgtaaatcgccttaaagtgtttggccgttttaggaatgaccaagttatcaaaccacaagttactcccttcggatgggacaacgtaatgcaagtgtgaattgccagccaacatttcactagcctcaccggaccaatcgaccgcgattgcggcttcgttttggatcatgtacattttaatttcatccgctacgacggccttgacgtttggtgatagccggttaagcttgtttcgcgcagccaatagagtggctggatcggtcgtgttcatggactgattcattgatgcgagggcgaaccccattacgtcgcgggcgctatcaatcagcataattttgttatggtattttcgttgccacaaatcattccagtgttgaatactgcccggctgaacgtacttgtcgttataaatgataccaagcgttccccagaaatatgggactgagtaacgattgtgttgatcaaaggccaagttcatgaagcgcggatcgtaattcttcattccagtcagtttacttttattgagcggtaagagtaagtgcgcttttttcattttttcaatcatgtaatcactaggtacggtcagatcgtaactggtgccgccttgcttgattttcgtatacatagcttcgttgctatcgaaagtttcgacgttaacgtgatagccagtctgtttttgaaacttagtgagcagactagggtcaatgtagtcaccccaagtatataggttcaaaacctttttgccagtactaccagagctcgtctgcaagcgttgcgcgccaaaggccagtaagccacagacgactagtaagctaacgataatgcttaataattttttcacttccgccgccccctaactgctggccgccggtgccgactactgtattggttaatgaagtagtagccaattactaacaccagtgccatcaggaacattagaccggacagggcgttgatttccaggttgatgccttgacgggcccgtgagtagatttcaaccgacagcgtgctaaagccgtttccagtcacgaagaaagtgacggcgaagtcatcgagtgagtaggtcagggccatgaagaagccagaaaagatcccgggcatgatgtagggcacgatgatttggctgagtaattgccaattgttggcacctaagtcagccgcggcatccagtaaactggtgctcatttcttgaatttttggtagcaccatcaagaccacgattggaattgaaaaagcaatatggcttaacaagactgagccaaaaccgagcggaattttaagggcagtaaagaaaatcaagaaactggccccgatgatgacgtcgggtgaaaccatcaagatattgttcaacgataacaaagtgttgcgggtaatcggtttggtcgtactattgattccgagtgcccccagcgtgccaatgacagttgctaataatgatgataagagcgcaatcaaaatggtgtcgagaaaaatggcaattaaacggctatccgcgaataagtcttggtaatgttgccaggtaaaaccatgaaagttgttcatagtcgtaccttggctgaaggagtaaacgactagaaaaataattggcgcatacagcacgatgaaaacaagccacaggtataagttgcgccacttgaagttacgtaaggtcattatttcgtcaacccctttcgtgcgcgctttttactgctgccagttagccacatgatgatgaccatcgcaataatcaggacgaccccgatcgtcgaacccatgccccagttcattgtcgtcaagaagtgttcctcaatcgcagtcccgagtgtaatcaccttattgccgccaattaaacgggtcaacatgaagagtgacagtgagggaatgaagacggcttgaatgccagccttcacaccggggagtgtcagtgggaaaattacccgattgaaggtctgccaatttgtggcaccgagatcccgactagcattgacgtaagatgggttcagttcgctaatcgagttgtaaatgggcaggaccatgaacggaatctgaatataggccgcgacaaagatgaagctgaaattagtaaagagcaattgcttgggcccgattccgatgaaacttaaaaactggttggcgatgccggcttgactaaaaatgccgatgaaagcgtacgccttaagtaataagttgatccatgttggcataatgattaagagcagccacagctgcggatgcttcgtttcgttgagtaaataagccgtcggataactgatcaataatgttgcgagtgtgatcaagaaggcgtaccagacagagttgagcgtcatcattaagtaggtatttgatgaaaaatacgtttggtagttgcccagtgtaaattgcccgttaatgttgaagaatgattgatagatcaacaataggactggggcaatgacgaagaggatgatccacaacatgtacgggataaagtaggcggtgttacgacttaatcgttgttttggttgcatgttgacacctcctaatcatcttcgtattgttcaagacgagcatcaaaagcagcttcgctctcgtttaaccgcatgacgtgaatgtcttgtgggtcaaaggtcaggccgatcggttcgccttctgcggcagggttagttgaatgaacgagccattcgttatgatcggtatcgtaagcgacgatttcgaaataattgcctcgaaatagttgggagtcgacagtgacgactaacttgccttgatctgcggccacaatgtcgagatcttcaggccgaagaacgacttcgacaacttcattaggctgcattcccgcatcggcgcattcgaattgtttgccgacaaactctacttcaaaatctttgagcattttacccggaataatgttactttcaccgatgaagttcgccacgaaatggttgatcggttcatcgtaaatatcaactggggacccaccttgtaaaatctcgccagcgttcatgacaaagatttcatcactcatggccaaggcttcttcctgatcgtgagtgacaaagagaaaagtgatgcccaggcgttgttgaaggtcccgcaactcatattgcatatccttacgcagtttggcatcgagagccgataacggttcgtcgagtaagaggaccttaggctgcataacgagtgcccgggcaatggcaactcgttgttgttgtccaccagagatctcactgatttcacgttccccaagatcagctagttggaccattgcgagtgctttttggacccgcgtctcgatttcatccttgggaactttgtgtaatttcaagccaaatgccacgttttccgcgacattcatgtgtggaaaaagggcgtaatcttgaaagactgtgttgacttgccgctgattggccggcagagtgttgatgacctgaccgtcaaagtaaacttgaccggaagtggcatccgtaaaccccgcaatggtacgcagaatggttgttttaccacacccagacggaccgagtaacgtatagaatttgcccgcttcaagatctaagttgatgttttttaaaacttgatgttccccgtaacttttagtgacatttgtcaatcgaatgattggttgtgtattaaccgccaaagtaaagacctccttaaaacgtgtaccaagctagtgtaacctaataccagctcgattggttgtgacatgattataagtaggacgcggtcgtaaccaaggtgaacgtgcaggacgtggtgccaagattacgaatctgatgcgtcttagtcgcatggaagtacagcgtatctcccgccgtggcagtatattgctgagctccgagctgtaagcttaaagtgccggtttgaaccataataaaggtctctgccggcgacggctcaaaagatttgaagcgaccactaggtgccagtgtgacggtgaccggttctaactgattttcgttagacgcgggtacgagccatttcacacggtatcctaaggcttcatcgtcatacgtggtctgatctgctggatggtagaccactttgtgagtgggctgctcagccgcaaaaaaatcagcgggggcacaaccgagtacttcaagaatcgcgaagaacgtctccattgaaggcgatgactgattgtgctctaactgtgatatgtaccccttgctaaggtcagttcgttcgcctaattcttcttgcgtgagttgcttttgaatccgtaagttgcggatgcgttgaccaatgtccatgacattcacctcgaatcggtagttttgttaaactaaacaataagtttagtacgagctttaattataatgaaaaatgacgtggtgacaagcattttttacaattggcagcttcttttttttagtctgccagcttgtctggtcaaatcgcccagaaacagtggtgttgaggggttgaaactgtcgtttggttagtgaataaattaggtgcgttgtggacggacttttcgtggcgtgccgctgaagcctgcgcttgctacgccaacgaatcaatgcaaaaatcgcattaatccgctggctaggcaatgctcagcttcaacccgcggcccctcacactctaataaaaaagcccaagacatccgtcttaggccgttagcgttgttgattaatccgcgcggtaaacgacttcaaaaacttcactgaccatcggtgtgtccgatgagaggtttttgccgtgttcttctaacgtcggggtgaattctgccgtcttacgcttgcgccaatcaccaattgtgcgatcaccatcgccttcatggtaagcgtgttctgccgagatgcgataaaacggaatgagttcagacaccaccgttttcagaatcgcgaccggtttcatgtcaccatttagcaagacgttgtagtcgccaacttgtggaatggcaatttgttccgcggtataactgtccagcggcgtggttgtcgctgtcttcgtcccagccagaattgcgtcggctaaagcagtcacttcggcagggttattttgttgaccgaaccaacgtgtttgataagaagccccgtttgtgtcggtgctttcgttataagcatgccataattgttctgctgattgagcgggcataaaggtcacctaatttcgattagaattattgaattcgaatgcatgtaaccgaattcacaattcaagtatagcatgacatttctgaaaacgacacgttcgacactggtttttcggggaaaattaagttagtcaactattgaccgacatttgctataatatacgtacgaattggagggcgaaaatcaatggaaattacacctgttaaaatgctggatttaccacaaatcatggcgatcgaaaaatctggtttttcagaagcagaggctggcagcgaggctgcttatcgcgaacgcattgagaaattagcggatacttttctggtcgcccgcgatggtgcagtcgtacttggctttatcgtgggaccagctgtcggtgcccgctatattgaagatgagatgtttgtagagacaccgactaacttaccacgtggcggccatcagctggttttcacgttggcagtttcgccactagcacgtcaccaacagatcggtagtcaattattgaccgcgctagctgagaaggctcaagcagacgggcggacaagcatggcgttgacttgtttggaacgactaattccgttttatgaacgtaatggttttattaatcaaggtgtggcgaactccgaacatgctggtgaaacttggtataatttagagaaagtctgggattgaatcatgaaattagcaacattacaagcacaattaccggattttgagatccgattactaactttagctgaccaggaagcattgctagagctggaacaaagtaatccgcgctatcatcaatatttctcaccggaaccactaacgatgactgaggtacaacatgatttgacggcccacccggacgagttagcggcggcacaaaaacaggtttttggtttttacttagcacaccgtttagtagccgttttagatgtactcaatcagtatccacaagaacaatttttattcgttggattactcatggtcaataaggcttaccaacgtaaatcagtgggccgagttattgtaaccggactgatgcaagcggcacttcaagcgaatataacggcgatccaactaacgcgcgttactgctgatgaaggggtcgcaagcttctggcagaaactcggttttgaagctggtaaccagctgttcttacctttaaaagccggtggtcggttagcggtgacgacgatgacacggctactccaatagaattctcatggaactcttagcaataaggcctagtaagcgatatcagacatgttaaactcgtgatgactaataaatagaaatgaggttaacacgatgattaagcattggggaaaggccgaaactggcatgttgattgcagccgtattgttattaatggtaatttttaccttttttgaaattacggctagtttaacagttagtgtcattgcttttccgattagtttgattgtgttgatggcgattatggaattcgccgcaacggaattacggcgcaagtaagtgactcgcagatagatcgtaacctaatatcgtgcttgtttagcaggagcatgtatatatagaagcccgtatttaccacgattggcagatacgggcttttttcgtgacggctgaggactattcctactaggtctaaaggacactgtttggactgtacaagtggcctgattttaacgttttcttagcttgtttataactgtactatactgtactatttaacgtaagcgaagtaacgactgtgtattaaatggaggtgggccatgcaaattgatcatggaagccgacaaccgtattacgctcagatagtaaccggtattgaacaagatattgctcatggtgtgttacaaagtggtgaacaactgccgtcggtgcgtgaaatggctcgtcaacacttgctgaatccgaatacggtcagtaaagcctataagcgactggagacacagcaaattatcgagacggttccgggaaaaggcacgtacgttaaagtggtggattcaacgctgttccgacaagaattacgggaacagtttacacaaattgtcaggctagcgggtcaaagaggcgtcagtattgctgaattgcatggctggcttgatcaaatgggggaaaaataatgagtttagtgattaatcagttaagtaagcgcattgaccatcaccagacgttagatggcattagttttgagattggacttggtcaaatcgtcggtgttgttggccgtaacggggttgggaaaacaaccctttttcggacaatcaatgggcagtacctcacggatcatggtcaggtcctggttgatgggcaagaggttgttgatcaaccggaaatgcggacgcaactgtgttttattgatccactggcaaatttttttaaaggcgcgacgattgtgcaaatccagtggtattatcaagctgcttacccggactttgataatgccgaatttgcgcaattgttagaccgttatcatctgacgtccaaacaaaaattacgccatttctctaagggaatgtttggtttgtttacaatcattctcagtgttgcgacgcaagcgccgtatctctttttggatgagccgctagatggtttggatgtcctaattcgaaaaaacattcttggtattctaattgatgaagtggctacgggaaaccgttcaatcgtgattgcgtcacataatttggctgaattagagggggttattgaccgcgcgttgatgcttaaacacggtcgcattgtcaatgactatcaattagaagccatgcgacgaagtgcacgaaaagttcaattagtgtatcgtgacaagcagattccagccgttgttaaacaattaggccatattgtacacgtttctggtcgggttatcgtggtagtgtttgaagattataatgctgaggtccaggcgcaattagcgacaactaacccggtatttcaagaagatttaccactctcattagcagacttgtttatggctaatctgacggatgaagctgactttgaattattatcttagggggacgataaaatgacgaaacgaaagttatggcagttgttatggcgccactatcgcacgttgttattaacggcgggcggtgtcttactactagtaggcataaaggaaggctacagtattgcccataatccgtcacggtatgttgcacaaaatgtcagtagttttgcgttgatggaagccactcatcttcggatggaaacggtggtcgccatcatcgttagtctggtgctaggagtcgcactattcttaagcgataatttcacgaattttaatcaatatttatttagtttgccggtcgctcgaaagcaaatttatcggcgtaagatcgggttacttattgggatgttggtcagcgcatacatgttggcggaagctgtttttggactgattgcttggcgcgtgttggctaaacagcaggtgcggattgattggcttacgacattgtatgaagaacttggaatcctggcagtaatgttagtgtttggattattagccgctacgttcgggttatgggttggccatatctttgcgagtgcgcttgcgacatttgtcttcgtttgtagcttgctctttgcatatgatggcttgatcaatcttgctgcaggattaacgaagcttaaatatgagcaggtggatgttttaggtcagctgccgagctggaaacccgggggcttactaaccacttgggtgatttgtggtgttatcggtggcggcctgtatttgcttaaccgctgggcgtttgagcatttatctttggaaaatagtggggattttttccgctttccgcagtggcgcggagccgtcctgggcttttcaattatttatctaattgttgcaatttgctgttcacaatttggtaatggtgttttagggttgctaacggataactatcatgcgcatatgccattatcgactgggattataatggcgctggtcgttgcctatctaacttggagtttggggcggtggtttctgtaccgaccggatcgttttcgcgatgcgtggacggttaagaagttggcttaacttggtcataaatctaaaatgcgcccgttgaagttaagcagactgacttcagcgggcgcatttgttagcggcaattttaaatttattatcctgattgatgaaactttagcgaatcttagttaagcgttttgcaacggtcttaatatttagtagatcccaatcttccaagttgtgtgaaatcgagttatgcccccatgttccacaaccgagtgttaaggatggtgcgacgttatcatatttataaccaatggcaccttgtgaagacggcacgttgatcaatgctcgacaagcagtcatttctaaggcaaacttgttcataacagcttcgtcggtcgtatgcaaggcggccgtatgtcccagtccgccaagtgctaggctgcgtttcatcaggttgaagccggcctcagtatccttggcatgaacgacggcgaggactggtgataacttttctcgtgataagacttggtcaccaccgatgctaggcaattcaactgctaatactttggtatcggatgggacatcaaagccagcccactgagcgatttgccatggcgtttgcccagctactttcgggtcaacagcctgtttatccaggttcatgacagttgcttctaaggccttgaagttctcggtaccgacaaagtacacaccgttgtgacttaattcacgtttaacttgatcatagatctgatcagcaacgattaagtttgattcggaagcacagatcatgccgttgtcgaatgacttggaagtgacgacatcactgactgcctgttgaatgtctgcggtttgctcgatgaagcatggcacgttaccagggccaacaccgagtgccggtttaccagttgaatacgcggtcttgaccatgccggcaccgccagttgcaataatggtagcgacgcccggatggttcatcaaggtgttggttgcttcaaggctaggcgtcttgatccactgaatccaatccttaggagcgccagcggcaatagcagcatcgcagatgattcggccagtttcaacacaagatttttgtgcaaagggatggaaaccaaaaataatgggattgcgagtctttaatgctaacatggcattgaaaatgacggttgatgttgggttggtaactggggtgacccccgcaataattccaactggttcagcaactttcatcacgccactgactggatcgtcattaatgataccgaccgtcttgtcatccttgatgtagttataaacgtttttggctgcaaagtcgttcttcgcaactttatcacgataatttccgcgacccgtttcttcgacggccatagcggccagcatgccacgagcagcgtgggcagcgcgggccatggcagcgacagcctgatcaacttgactttggtccatgacttcaagacggttggcagctaacgaagcatttaagactaaccgatcgattgaacgtgatacggttgtttcttccatttctttcagcattcacggttcctcctatgcaaaatcaacttgtttcttatttcacaatcactattataaatactttttcacaaatgtaaatagctaatatttaatttcataaattgcttttaaaacactataattattgatttaatagcgtatataaatgtaaataaactgttcgcttacattttcaccgaacggattgctgttataatattcacaattaattattgattaaattcaaagcaacttttggcttgatctgtaactgattttatataaatggaagggtttacaaacgggcggttgtcaaataagcaagaattgacggggaatcgttggttaataaatatgacaaatcggttatcactcctatgtaaaatgtgctaaaatgaatgtgattcaaaaatcgtatctcttaattaacctaggagggttattttatgtcatttgtaaatgctgttgatatgacacaagacgcatacaagaaccattatgctattggtgcgttcaacacaaacaaccttgaatggactcgttgcatcttgaagggtgctcaagacactaacaccccagttattatccaagtttcaatgggtgctgctaagtacatgggcggctacaagctcgttatggacttagttgctgatgaaatggaaagcatgaacatcactgttcctgttgttatgcacttagaccacggtaactacgaagctgccaaggaatgtatcgaagttggttactcatcagttatgtttgatggccatgacctaccatttgccgaaaacttagaaaagactaaggaaatcgtcaaattagctcatgctaagggcatctctgttgaagccgaagttggttcaattggtggtgaagaagacggtatcatcggtgaaggtgaattagctgatgttgaagaagctaagactttagctgctactggtatcgacatcttagccgctgggattggtaacatccacggcaagtacccagaaaactggactggcttacacttcgatcgtcttcaagaaatctcagaagccgttaagatgccattggtacttcacggtggttctggtattcctaaggaccaaatcgttaaggctgttgaattgggtattagcaaggttaacgttaacaccgaaaaccaagttgcttttgccaatgcaactcgtgcttacatcgaatctggcgcagaccaaatcggtaagggctacgaccctcgtaagttattggcacctggtaagaaggccatcgttgatgttgttacatcacggattggctggttcaagactccagctgttaaataattggatttttgattcagaaaaagtcgactcctcggggtcggcttttttcctgcgcttttttggagaacttgggactgacttaccacctgggagtgccagtgttagtgtgcccttttccggttgctattatcggggaaccgattatagcgtgatttttaattttgcggtttgttaaaataatcgtaacttaatgggatgctgttggtatccaattgaatgaaggaaaaagtgaggtcagtgattctcgaatgccgagggtcactgacctcattttggtgttaagaacggataactaaacattaatcgcgtcttgcaattgctgctcattgtaaaaaattaatacgataaacatcaccacgtaaagtaataatggtaaccacgcatagttcagggtaatcatatgctgagtggcgatattttgcgcatgattggccgtgtagccgcttagatgaaagagtccggcggtgactaggccaccaagtcctaagccgacattgacgccgaagtcatcagtagaggctaaaataccttctgcttgaatgccaagcgccgtgccataacggatcgtatcagcaatcataattgagaccaaaccaatgatgagaccgttaccgacagcgttgatcaacgtaccaccgaagacgaaggccagttgattgatggctgtcccgagaccgaggatcagttgtcccacagcggcgattgcgatacccgccaacatggtattctttttcccgtggtggttggctaagcggacaatcaaaatgacaccaatcagtgacgcaaacgtaaagccgttaacgactggcactaagtcctcacgctgaatcaagtatttaaagtagtagatggtcgtttgattcttgatggcggttgttaaccaatacagtaaaatcacgctggataaaataaaccacggctggttttgcttgagcatgccccacaccgcactgagtgattggtgcggacgctcaggttgactaaagcgttccttgacttggaagaaggtgttgaggatcagtaccaacgaaataatgccaaatagaacgattgtcagtaaaaaccctcgttgctgatcaccctgaccaaataaagcaactagtggcaaggtgaagacagcgacgataatttgaacgctactaccgaagaattggcgaatcacgcctagtaaggttaattcacgttcattctgggagagtgctggtaaaatcgatgtgattggtaggttgacggcggtatagaagaatcctaaccctaaataggtcacataagcccagacgagtttaccagttgctccgaaattcggggtcacaaaggtcaaaacggcgaacaagacgtagggtaacgcgtaccataagaaaaacgggcggcttttaccgaagcacgaatgggtatggtcaatcatgacgccgataatcagactttcaacgacatcggctaagcgcgcaacgacaaataaaatcgccgctgcactcgtggataggccgtaaacatcggtatagaagaataataagtatgtggtcatcatctgaaagactaagttatccgcggcatcactgagcccataactaattcgttccggccaagctgtttgccaaggttgtttcaatattaacacctctaagtatggttttgcacaatctaattctaacctagttgcacgcttaaacctaacggaaaggtttacaaaattgattaggtcttagattgatcagaaaaaagcctgcaggtggcgttcgtcaacctgcaggctgtgcattgtttgtcctgattaaaagctacttagttgttaatttgctgaccttggtgagtgctgggattaagcccaagctatctaacgtttggtttggtaaaacaacggtgttggcattgccgtccgctaaggctttgacagcttccgtgttttggaagataaagtagttttcggatgattgtgccaaggcttcgtttaagatccgcgtccggtaagcatcagcatctgcttcagtttgaacggctgttgctttcgcctttgcactattcactaaagcttcgttttgggctttattggtggctagtaaggcccggttattggcttcattttccagtgtgattgacttactcttaccttcagcagttgcgatggtggcatcccgttcccgcgtagcttgcaggagtttattcatggaagcctgaatatctgccgaagggttaacggaatcaatattgacccggtcaacgtttaaaccgtagcccgccgtaacggaggagatctccttgaagagggcggcattgatttcttgcgtcccattcaggacttcgtttaattctttgttcccaatgataccacgcagtgccgcgcgggtatcttgaatcatactacgaacggagtcttcgtttttaaaaacgaagtcttcaatattagtgacgtggtacttaagcgaaatcttaactgagatttcagcgttatctttggtgataacgacttgttgattaagatcaacgggtgtctgagccgtgttaacggtgatgacacgtgagatgaacggtttaataaagtgaaagccggaactaatgacgcgctcgaactttccaaatgttaagacgacaccttggttcggttgggtgatgatgcggatggaagcgattaggactaaaacgaccagtagaatgacaataattgcaacgatgatacctaccataataatttccccctattgttgtggtgcgataatcgttaccgttagaccatgagcactgacggccgtgatttcaacggtatcgccggtgtgcaatggtgttgcggcgtgcaaatggtacaagatgccatagaatgcgacgccgtcagttagatcggtcggtttgataatgaagcgctgaccgattaagcgctgatctaagtatccctcttgcatagatgacccacctttaatgtgataataattaaattatatgctgtttttggttagattgatagggccgttataaaatagtgggtgagttttggattgttgataaagtatggcgataaatggtgaattcatgctgcatatcgctcagtaactatttggataagctcgttttagagggcggttcagtaatacggagttaaaggagcgcttgaagtatttaagccgacaaaaaaccttcgtacgggaatacgaaggtcaaaaggagtaggtcagcatatgacggggaatcatatgctgataacttgatgagcgtttattcatataagcggggggacgttcacatgccgctcatcaagctgtcaaagttgttacgctttgacggatttcattactttggaggagtaaatgaaaagaatgttaattattatagtagcaatcttggagggggatccttaattgctatagatacatattaacaacgaattgtgaagaaaatgtgacgatgatttttcaaatttaagaattattgattagattacgaaaagatttatgactattgataaatttatcggcaattaaaattgcgtaagaattatctgtcagcgctttcgcaatggtggctttttaaattagagcgtgtatcattaataatgatcacggaaattaaagacaggagatgcttgcatgtacgaacaagcttgtaccacaattttagttgggaagaaggcgaccgttgatggttcaacgatgattgcccgcaatgatgatacgtttatgccgattacaccgcaaaaatttatcgtccatcccgccgttcatggtcgcaacgaaacgttaacttctgggaagaatgggtttaccgcaccacttccagcagatggctaccgttaccaagctgtcccgaacattgaagtcgccgaaaagggtgtttttgaagaaaatggctttaacgaaaaaaacgttggtgtttcttcaactgaaagtgtttatggtaatgaacatacgctgacttttgatcccttcgtgccgaatggtctcgcagaagattcattgccaaccatgctcacgccgttcattgattctgcccgtggtggggttgaatacttgggccagttgatcgctaaatatggttcgccagaaggtaacggtgttttgttcaatgataaagatgatgtgtggtacatggagatcgtcactggtcaccactgggttgcacaacggattccggatgatgcttacgcggtggctgccaaccaagttgcgattcaatgggttgattttgatgatcccgataactttatgtggtctgatggtattcaagaatttgttgcggaacaccatttgaaccctgacaaggaaggttttaacttccgtcatatcttcggtactgataatgaaaaagaccggcattataatactccccgggtctggtacggccaacgttatttcaatccagagatcgaacaagatccacagtcgagtgagctaccgttcatttgtcacgcagccaagaagatttcagttgccgacgttgaatttgtactgggttctcattataacgaaacgaagtacgatcccttcttgaatacaccagaagctaaaaagtttcggccaatttcaatgaatcggacgcagaattcacacgttatgcaagtgcggaatgacgtaccagcagaacaaagcgcgattatgtggatgacatttggggtaccagcttttgcgccatacctcccattccatgcgaacgtttctgaaactgatcctagttttgcgaacaccccgctaaaacatgatatgaatagtgcttactggctctaccggacactatcaatgattgttgaatcacactatgctgatttcgttcaggatgatattgattatttgaaagaatgtcgaatcgaactgggtcaatttgtggctgcgaccgataaacaagcggcgaagttatctggtgacgagttaacggctttcttgactgaacaagataaagtgatggtcgcaaagatgcgtgataaagcccaagctttgattggtcaattagtcaccaaaggtttaacgctctcgaaactaacctataatgttgatatcaatctttaaactttcgttatgacggtatcagcgtgtataattaagttattaagaggacaaggagctgatggcaaatggatgaaaatgtcttatttaatcctggtgacgcaatttcagaatcgcatgactacaatgaagcgctccgtagtgcggatatttataatgcgcgtcacggacgtaagcgcggactcatgattgcgcggccgctagaacaggatcacggttattcggttttttacgcggatgacttactgacagcagatacgccaagaccagaagcacgtcaatatcacgttgaaaagcgtattccaaaagaatagtgcaatcatcccatgatcagtaacaagggtcatgggattttttattttctaaacagtaacccatgatgttgatattgggttactgttgttttataatagcgtttaaattgattaacaggggtgcgatgatgacgaatcgacagacgattaaacacctgacccagacggcgatggtgaccgctttgattattgtattaggtttctttccgggaattccagtgggctttattcccgtcccgattgtgttgcagaatatgggcatctttttagccgccgagttacttggccgcaaatatgggacgatcgcagttggattgttcttaggattagtggcactgggactacccctattatctggggggcgtgggggtgccgcgatttttctcgggccaacgggtggctatctcgttgcttggttgctggcaccaatgctgattggaacgttgatcaaaataactcgggcgatgacaagtggttattggtggctagaagttggcattgtctggttggctggtatcttatttgttgatgtaatcggtgctagttggctagctgttcagtctcatatgactttgacggccgccttgctgtcgaacgtggcctttcttcctggtgacatcattaaagggactttggccgtatttattgcccggcgtgtgcgggccatcgttgattttggattgccagcttagtaaatagctaatgtgattggcaggtcaggaggtcataatgacaactaaagaacaagtcttaacaattttattgcgtcatcatggtgagtggcaatcgggggaccagcttgcccaatcagtcggctgtagtcgtgagagtatttggaaggcaatcaatgctttgagaaagcaaggacaccagattgagagtcgtaaaaaccggggctactgttatctgggaagccgtaatttggatgccaaagccattcaaatctatgggcaacggcaatttacggggccccttgaagtggtcgcccagacgccgtccactcagattctagctaagagctttttaagtcatcatcagccacagtttgccgccttcttcgcggacgaacagacggctggctatggccgtttgggccgggacttctattcaccggccaaaactggactgtattttagcttggttgttcctaatcccacgaatgcattggtcaatgtgggtttactgacaactggtgtcgcggtgagtgtcttgaatgttttacagcaattttatcctaataagaactttgggttgaaatgggtcaatgatatttatcttgatcagcataaggtcgggggcattatcacagaagcaagtttggaattagaatcgacttccgcaacggcctttattgtcggtgtggggctcaatttaacgaccaccgattttccgcgggaattgcaagcccgtgcccaggcggtcgacccgagcataccagtggatcgcaatcggttagcagcggccttattatcagcactagtagcgctatcaaaacgctacgctacggccgactttttgcgagcatatcgggctaaatcactagtgttgggtcaacaagtgacacttcaagtgggcgattccgtggtgaatggggtggctgaagatatcgatgaacatggtggcttagtggtccgcatgttgaccggggagcggcggacatttacgagtggtgaagtgatcagggtagggttaccagtatgactgagtgggtaccagtgatttacggcatcggtttagacgctgccggtcggtgccaacattatcaccttgaaactgatattgcggcattgtggtgtcggcgatgtcaacgctattacgcgtgttaccggtgccatgatacgttgtgccagcatacttttgtggccagcgctccgacggatttagccgtgatgtgtggtgcttgtcgttatcgaatgacggttgatcggtatcatgaggggcaatgcccgcactgtcaccggccatttaacccgcggtgtcggttgcatgaccaggtttactttgaaaagtaaaattgagacgtatttttggtagttttggctgaatttagtgattaatagaaaaacaattaaaaaattgacatattctaattaaaaactcataattaggcttgagagtatggttgattgtaaattagtactgacaaccattgacagaagggaagcactaattttgaaatttgaagagtccaaaattttacagcaattaccaaaacagttctttgcgaatctggtcaaaaaggtcaatgccaaagcggcggccggtgcggatgtgattaatttaggtcaaggcaatcctgaccaacccacccctgagtttgttgttaaagcaatgcagactgcaactgccaatcccgcggatcacaagtattcgttgtttcgaggtttgccgcgattcaaacaagccgcggctgatttttacgaacgcgagtacggtgtgaaattagacccggagactgagattgccgtattgggtggcagtaagattgggttggtcgagttaccctttgccttactaaatccgggcgatacaatgatcttacctgaccccggttacccagactatttatctggtattacgttggcacaggtgaagttggctttactacggttaacagcggacaatcatttcttaccggattatcagcaggttgatccacaagtggctgcggcggccaagctgttgtacctgaattacccgaataatcccactggtgctgttgcaacgtcgcagttttttcaagacacggtggattttgcaaatgaacatcagattggtatcgttcatgactttgcttatggtgcaattgggttcgatggtcagcgaccagtgagcttcctacagacatcgggggctaaagacgttggaattgagatgtacacgttatctaagtcctttaacatggcaggttggcgcgttggttttgccgctggtaatgctgacatgattgaagccttaaatttgattcaggatcatctgtttgttagcgtctttccggccattcaagatgcagcgattgcagccttgaacagtgaccaacagacggtccacgaactggttgggctgtatgaacgacgccgtaatcagttctttacggcggcccgcaagattgggtgggagccctacccatcagggggctcattttacgcttggatgccagtccctgaagggtataccagtgaagcatttgccgatttgctgttggataaagcggcggttgcggtggcgccaggaaatggctttggcgcgggtggcgaaggctatgtgcgcgttggactcttgattgatgaaccccgcttcacggaagcctgtcagcgaattgcaaaactgcacttattcgatcgttaggatgacctcttagcattaatgatgacagtcagtcacttgcttagcataattcatgcaacgggggcgcaactcgttcttgattgctcggaaatattgagctgtaataacggtatcaaaataacgcaactggcatgtgaatgccagttgcgttattttgattcgaggtattgaattattataaattaccggtgctctttaaccgcttctctaacaggtacgcgtccatgtacccaaaggataattcaacgacctgatcgagttcgatcatcgtgccaacatgattaatttgattatcatcatccacgttatagaagatgaagtgcccgttcgttaacgttcccggatagccagtcattgctggcaacatggggttttctgtcgtgatgtgaacgaggttattgaaagttgcggcttgtcgcaaaattgaatcaaaaagatcagttgtggcgtcaaataaccgttcgtcgtttaagacgggttgaacatttaactcatactggcgatttaattcaataaagccacgcatcgtttgtaaatagtcggactgggttgtcaccgattcaattagtgaacggcgacaaagagtgtagcccccaaattggcccgtcatatcgatcagattgagcaggacactatcagcgttcaatgcgttaatgaagccaacaaagaacatgtcagacccgtctgctgaccgaattgcaatcagttggtgctcatttaaggcgttgtttaaagtatgatcaacgtcgtcaaactcgctaactttgatggttgctcgatgcgtatggatggtcttgacaaaggcgctttccaataagagctcattgccgcagaactctaagatctgaatagcagccaatggaatttcctgttgcccgttgtttttaaagttaaatttgtcaaaagttttaaaggtaatcgtttggtcagtgacttgttggacctgaccttctaaataattttcgttgtcttcgaggactagtagcacaacttgatgatcggtttgggcttgggtgactaactgtgttaggactggccgttgatcgtctaaagctacggttggttgtggcacactgttcaaaccttcagtagttgcattttcaaggcgaaaggccatgttatcaaggtcttcactcatcatttcaacttcatcaatgacgtcgtagcgcatgaagacggcgccgtcctggagcccagcatcatcgtaagtattcacgacaacgccatcaggtgccagacggtcgatgtagccggtgtaaaccacttcgctattggcttgatataggttgatgaggtgaacctgttgtgcggctaattgtaaattctcaataattgaactcatcgtgtctaacccccttagttaatgttccctcatcatagcactttttgaggtgaagacgccattataagtcattattcagctggtttggtaagtgtgttatgactaggtaagtaaacggatgctcacgtgctattcaggtcgctcatctcattagaagggccttgttctgcaaatttaaaaccgttttcgcttgcacccggacgctgttaccggcattgagtgcggctgtttggtatgtgtgcaacacaacacggttctggtcatcgctacataaaaaatagtgttccgatgatgcgttcacagctagtgatcttaaagtgcaattcgatattcaaatgatgattgccaaaataaacgcatacggtttttttaaaacacaacaaatgtaagggctttctttacttgtgaaataggagtatcggtcaataagtatctattgataataggtaaatatttaataaaaaatgttattttcggtgctattaacgaggtttatcgttataatgtagtctgcggtttatcttgaccgtaaatctgtcatgacctttcaagaggcgcttgatcgtgttgcgacatacatttaaggagtgcactatgtttacgatgtttaagacgattggcgatcagttcgccaatttcaagattattcggcgaatggcgaagtatgatgatcgggccacataccaaagccattaccttgggttagcgtgggaatttctaaacccactgattcaaatcggaatttattatttagtattcggggtcgcgttaaaacgtggcgatccgatgccaggaatcccgtatttaccatggatggttgtcgggattgcaccatggttatacatgaacaaaacgacgctggacgcgtcttctagcatttatcgtcaggttgggttagtttcaaagatgaaattcccagtcaacgtattaccgtcaattaaaatttatggtaacttatatagtttctggacgatgattgcttttggaatcttcctgatgttcgttaatggcatttggccctcagtttcttggattcaatttatctactactttggttgtatgatcgtattaatgtattcacttgggatttttaatgccacggtcagtgttctgattcgtgactggcatatcacacttcaatccgtattgcggatgctgttctatatgagtggggtgctatttaactttacaacgtctaacttccccgcagtttttgtgcgcctactagaactaaatccgttctactacgtgctcaacggaatgcgggaatcgttgcttaatcgtggttggatctggcaacagcctaatatcacgttgacgattgtcttttggctcttcaatctcgttgtgattctgactggaacgtatctctataacaagttccgttcgaactttgtggatttgatttaggaggcggaactgatggaaaatcaatataaggttgaattgcataatgtcactaaagaatatgatttatatcgtagtaacaacgataagttaaaacacttttttaacattggtaatgttgatgtcccgcggttttggtcgctaaaaggggtcagcttaaacgttaaaccaggtgaagcgttgggtattatcggaatcaacggttctggtaagtcaacgatttcgaatatcatttcgggaatcattcctcaaacgactgggacagtggatgtgcacggtgatacgtccattatttcaatcggagccggcttaaagtggaatttaaccggtgatgaaaacattcggttgaaaggactcatgcaagggttgagtattaaagagatccaagcggttcgtgatgatattgttgatttcgcggatattggtgattttattggtcaaccagttaaggactattcgaccgggatgcggtcacgattgggatttgcgattgcggtgcatatcaatcccgacatcatgattattgatgaagcactctcggttggtgatgacaccttctatcaaaaatgtgtggataagattatggaattcaagaagcaagggaagaccattatctttgtcagccataatttacggcaagtggaattactttgtgaccgggtcgcttggatgcactttggggatcttttagaagtcggcgagaccaaggaaactgttgatcattaccggaaattctctaaggatttcaaagcgcaaacggcggcttatcgtaagaagtatcaggtcggtaagaagaaggaacaagcggactttgacattgtcgcttatgaacgacaattagtcgaagaaaaggctaaggatagcgataagagtaagcaggcagttagccgtcaagttcatcggacgctatacaagcaaatcttgccagaaaagatgacgattgccaccaagctcgtcatgttagtggcaattgtcctgttcgtcttctttgcgttagtgaatgtttcaggtcactcggttacttcggcgattgagaatccgacagtactgttacatccagtcaatcattatattaaaagtcagtcggtcttattcaatagtaagtgacggcggctggttagtggttgcattaagttaacatactaatatcgatgggtgattgcgatggcaatcacccattttttgcgtgaattcaagctggctttggttggaataaagtacaatacaacgtcgcgcattattcggactgggggccgctgatgctttaattcgaggggataagcttgggctgaccgtactaccaatttgaaaggaaaatgtctaaacttcaatgcacaatttatgagttggtttcgggttaaattaagcttgattttttgtaatgcttcagcaatctagttatattcgttataagcattagattattttccgcctggaataccatttggtgggttatcttaatactagagcataaagggggtcatatcatggatatgccactattcttaaatgttgtcgcctatgtgctattaatattggtattacaatatatcaaattcaaatttccagacagtacctttatccgtttctttcaaaaatacgggtggtggttaattgggctatgttttgtcgcaatactggtgattttggccggaccgcaatttcagaacccctttaatgcgttagatgtaccggctattggggtcatgttagtattcgggtacttctttattaaagataaaaaatcgaaacataagtgatgattaaatgagatagcacctcaaacgatgatgtcgtcctgagaggtgctatttttttgcctaaaaatcgatttgagaagcgctgatgtttagccgttttaatctagtattaaacgtgaactgggttattcggtaacggaggggcataattaaaaaatcagtttggaaccttgcaatatatctaaaagatatatatatacttaacagcgcgaaggattggtgaatttaatgtatgaattgtttattttaggacagttgatggatcatccgatgacgggctaccagttgcgtaaagcgctggtaaacgtagtcggttcagaattaaccattagttttggcgcgttgtacccgttgctagataagttagccgcggctgaagaattaacactggcgtttaagcggaccactaataaacggccacaaaagttagccacgataacagcggctggtcgcacgcaattttggcagttagttatgacgccagtcgcgctcaacaagcaaacgcagttaacgtttcaaataaagctgaattttttacatttattaagtcgtgatcagcagcaagtaatcttgttggattttcagcaatttgcacggggacaggtcgcacgcttaacggcgcagcacaaacgggtgatgacgaatacccacatgcttgccgctgatattcaagatgcgttgatggtcaatgagttacaacgggtacgagcccaagcacaattagactggcttgaccgccagttgcgcaatggaggggaagttaagggatgaaaacaatgtcgtttgcgactgatccacaaattcaaaagcatcgctggtggatactggttgcggtatgtttatttacgttcatgtcaacgttagatgggagtattgtgaacattgccttgccagtcatgagtaagaatttagcgattccaatgaatcaggcggaatgggtcgtctcaatttatttgattgtgatttgtgcgttattgttattatttggtaaattaggtgatatttacggtaagattcgggtgtttaaaatcgggtccttactattcattattggctcattattgtcaggattcagtgtggggttaccatttctactaattgcacgcagtattcaagcagtcggagcggcaatgacgatgagtacgaacaacgggattattaccgaagttttcccgtttaaggaacggggccgggcgctaggtatgattggctcattcgttgcattggggagtattgctggccccggtatcggtggtttgatcctagctcatttgagctggggctatattttctggatcaacgttccggtgggaatcttggcgatgattttaggtgcaatgattttgccaaaagacgttacgacgacgcaacaaccattggataagaccggggcggggctatttgccgtactcatggttgcactatttgcaggtgtgtttatcgggcaacagattgggttcttgcagccggttatcttagccttgtttgcagtggcaattgtgacgctgattatttttgttcgcgtcgagttgcgccatgaaaatccgctgctagcgctacaattatttaagaatgcctgttttagcattagtatcttatgtgcgttattaatttttattgcgaactttttctttaacgtgattgccccgttttatttagaaaatgctcgggggctagcggcaaactatgcgggctacgccttgatggtattccccatcgtacaagtggtggtcgccccgattgctgggacgatttctgacaagatcggaccagaattgttaacgttcgtgggattggtcctgatttcaatcagtcaagtgggttacatggttgtggggctagcaacaccactttggttcttcttattattcgtcggattagttggatttggcaatggtatcttcatggcacctaataattcgatcgtgatgagttcagtggcggtcaaggacttgggcgttgctggcgggattaacgcgttggcacgtgaattaggcatgattgttggaatttcggttgccacgaccgtactatattcggcaatgagtcaatcagcggggtataaggttacgtcatacctgccagctcacccggagatctttattgatggtatgcacattgcgttcatggtctcgttagggatttgtttagttgcgacggtcattactggcgggcggttactaaaacatcgacgcacggcacctgccaagtaaacattagcaaatcaaaaaacgtgttgcgagaaatctgagatgatttcttgcgacacgtttttatattcttgcatccttgatgttgctgaaagggggtctggttaaatcaggcttgttttaaagatccagggcataagctcactgaaaaaaacctcggattagcgccgttatgacgccaaactcgtcgtttaattccctagttaggctaatcctcagtcttctcccgtctgatttatgcccgcttgtgatactgagcattgatagaaatgccatgcgactgctttctcgaacgcactgaaacctgtgcatattacgcccatgattccgattatcggaatcgttgttgcttatctagcagttgcgctaactgaccacgaaattcatcgctatggtgttggatgttcgtcaagtcgtgactcatttgaacggtgtagtcagcgacttcgccgtgttcgccttgatcgagtccgagttcttcctcttgttcgtcaacgcgcattctgatgactcgtttcaatagtacgataatgacgatgcaaacgatggtagtaaagccaatggtaaagatcgttgctaatagttgtaatccgaataatttaaagccgccaccatagaaaagaccgtttagagaaattgtgttattaacggctttgctagcgaatagcccagtcatgatactgccgaccatgccggaaacaccgtggcatccaaaggcatcgagtgcatcatcgatacctaagcgtggtttgatgaacgtaatgaagccgtaactagttaatgtggcgataaggccaatccaaaaggcaccagaaatggtgacgtagccacaagcaggtgtaatcgcaacgagaccacaaagggtaccggtgcagacaccgactagggttggtttgcccttggttagcatatcaacgaccatccacgtcatcatggaagcggcggtggcaacggtcgtggttaagaaggcttggatggcgatgtcgttcatggcaagcgccgaaccggcattgaaaccgtaccagccgatccataaaatagcggtccccagcaatacccataagatgttatagtgctgggtcatatccttgccatacttgtggcgggcacctaagaatgctgataagactaaagcggtgataccggcattgatgtggacgacggtaccaccagcgaaatcgatgacgccaagtttagctaataaaccgttatcccaaaccatatgaaccattggatagtagatgaggagtgaccagaagatgatgaaggctaataagaatttaaaacggatacggccgaccaccgcgccaacaaatagtgctggcgtgataatggcaaacatcatttgaaagatgagatataaaccgttgggaatctttgtcgcggtaagcgcggtcaagtccacaccatgcaaccaagtggctttgagattaccgacaaagccacctaaatcaccggaaaaagatagtgaataaccgaatgcgagccataacaagattgctaagccacaaatcatgaagacggataacatggtgttaacgacattccgtttggaaactaagccaccgtagaaaaatgctaatccgggcgtcatgaataataccaatatactagataacactaaaaacgttgaatttgcagcgttcatactcccaacccctatccataccatttgatgttagaaattataacattgattattgagcgacgcactctttttttgtgtttaggttaaatattaaacttacaaacgggctttggtgtcattatggaactgttgatgttagattttgtgacgcaaaactattgaaaacatgagtggactccttgtaaattcttagcaaaagccggtcaaggttgcttattggcagaaatgtaggaagtgacttccaagagtggtcgcgattagttcggtaatgaaaataattaggcaatgggggggcaagtgattaattatcttaaactaattaggggaattggtaactatagtgcgtgctattgcttaagaaaatgatgatatgaaagataaggcgctttcagcagttgaccattagtaaccggagcagtaaggttatcaccacataaattaaaagatggtgagattattacataacgtcttaataattaaaacggaggttcagcttatgcgaaaatatgcgattattggggtcggtcacgttggagcgactattgcttatacattagtttgtaaaggaattgcggatgaattaatcttgattgataccaatgcggccaaggcccgcgcagaacaactagatttacaagatgctcaagcccggttagatagtcgaacgattattaagattaatgattatcatgaattagacgacacggatatcttgtttgttactagcggcaacattcacgcgttagaccacgcttccggtaaccggtgggctgaatttgaatatacgaagcaaatcgttcaagatatcgcgccgaaagttaaagcaaccaaatttaatggcgtggtcatcgatacaatgaatccgtgcgacgcaattactcactatttccaacgcgcaacgggattatcacgccaacaggtctttgggactgggactttcttggatacggcgcgcatgcaaaaggttgtcgcagaagccttcaactgtgatccaaaaaacattagcgggtatgtttacggtgaacacggcgaatcacaattcagcgcgtggtcaacggttcaggttaacggtattccaattacatccttagttgataagtatgatttggacttagatgcacttgaggcagctgcacgccatggtggctgggcggttcattctggtaaggggtataccagttttgccattgctacttgcgcggttaaattaagtgaagcggtctttgcaaatgctcgcttagcatgcccggtctctgcgtatagtgagacctttgggacgtatgttggtcagccagcaatcattggcaaagatggggtcgagagtgtgacgacgcttgctctgactgctgatgaacaagctaagttccgtaattcagcggacacgattatcgagaaattccacgcctttgatgacgttttaagcgatcaatcagtaaaaaaacgtcaacaagcctaaaaagtgacggttgttaattgtcttgtttggcaaacttctaccaaaatgttaaaattttactaagcagaacgttgactgcattaactatatggtgggatgaatatgcgccgacaattaacaaaccggcaacggtggttcgtgattgtgatcgcgacgattttgggagtaggctgtgccttgcttggtcaatggggccagttcttcggagtcatcgcagcaacgtttgcgctaatgttgttaaccagtggctgtttgactttttgtcatcgccgcgggtggcaacctggaagcggcatgttgctagcattagtcacggctacagggtatgtactagttattttaggaagctatggttatttactgcacagctaagcgcagcactttgatacgaggaatcgaccgtatcaaagtgcttgttgtctgcaatcatttttagcgtgctaattaagttatgtttcaacaatgattacggccatcggtgctcataaaaaaggtcgcgactcatcatcgcggccttcctgggtgcggtattgattgtaaacatcaaagtggggtcaccgcacccaaggtattaatggcagacctagttggatagctttacctaaagcctgccaacaggtaagcggtaacgcagacgcaccgccgcgctatcggctgcactaataccgttatagcgattatcagctaacatgacactgtggcgatcacggctgtgttccaaaccaatagtatgtcctaactcgtgttcagccacgtggacttgatccgtataagaatagtggtagcgtacaaaattacgtgttaacaagtacacttgcgcttttgtgtaataaccattggtataaccggtcgaaaaagtaataccagctaagcgataatactgcccactggtggcattactggtccccaaagtaatttgatgatgagcagtggttcccggcacgaatttaaagtgaccagtcgcattccaggcttggatggccgcttgatagacgtgccgctcgtatgatgatgcttgaatgacgtaggtcacttgagcgtgtggccaacgactccgtgaatatggtgtcgcaatcgattttgcgttggcaattggtgtcagcccaagaccaaaaatcacggttaatgtggttaaacctaacttagcactgtacttattcttcattgttgtaaccctctttcccccaaaaacgaaggtcgccatcaataattgtattttaaaacgttgctgagataggggcctcatcctagacccgaatttgaccaaaaatcgtgtgatttggttgcgattaaagttagttaaataggttatcgcgtgctatgatgagaatatcttgtgatgatggaaggaaattgatatgacgattaaacaggcaattgttcaacaagctttgacgttaataaaaccgcaaatggttgttggttttggtggtggctcgacggttggtgaactggtcaaggaggcagccaatcatgtgaatgatattacggtcgtcaccccatcaccgacgacccgccagcttgcgaccgttctcgggtataccgttgtagatactgcatattgtgaccgggttgatattgcttttgacggctgcgatcagttagatcattacggtaacgcgctcaaaagtggcggtggaatccatgctaatgagaagattattgccagtttggcggatgaatattggctgttaacgatgcaggatcggttagtcgatcaatttgatatcaagacgccactagtcttagaagtactaccagcggccttatcgttagtcatgcggacggtgagtgatcttggcggtcaggcaaccattcgaactgctaataatcgggatggcttcacgttaaccgatagcggcaatttattgatcgattgtcattttccaacgtatgccaaacttacggacctgaatgttgaattggcaactttggctggtgttgttgaaacgagctattttgatcatttggtgacgaatgcttggttgggcgatgcaaccacgaatacagtcaacgcgctattttaagtgttatcagggacgacagcatgaccttaatgattagcaattgagcactgaaattcgtttgacacttttttaaaataattctaaactgaaggtgacgtataaaagcgccaccattttttgaatctaagttattttaaatatctaaggggatgtcaacatggcaaaaaaagtctatactgattatttttttgaggaacctgcttacaacacacatgacggtggctatattccactagttacaccgaaagtcgagccacaaccgttagcgattccgccgttattgaagccggatcgccagacggatacggatgattactataccgtcacggcacaagaaagcgaaactcagtttttacctggtaagaagactaaaacgtggggctataatgcgggcttcctaggccaaactatcgtctttcgtaatggtaagcagacccatattgacttggaaaataaactcccagaattgacgactttccattggcacggcttgaatgtcccagggcccattaccgatggtggctgccacgcaccggtctatcccggtgaaacgaatcacattgactttaaagtacatcaaccagctgcgactacgtggttacatgctcatccgtgcccatcgactgcgacgcaggtctggaaaggcctagcaacgatggtgattattaaggatgacgttgaagatcagttaccgttaccacgtaattatggtgtggatgatattccgttggtattacaagaccgtgaatttcacgatgataaccaatttgattaccgggcggactatgatccagatggtgttcaagggcatacggcgttagttaacgggacggtcaacccatattttgatgtgacgacgcagcgggtgcggctacgaatcttggatgggtcgaaccggcgtgaatggcgtctgcacttcaatgacgatttggaatttgcacaagtcgcttccgatggtggcattttgccggcaccggtttatatgactaaagtgatgatgacctgtgcggaacgggacgaaattgtcgttgatttcggtcagtatcagccgggcgatgaagtcacgctgatgacggatgatacgccgctatgtcgtttccgaatcaagtcgttcgtaccggatgacaccaaactaccagaacatttagttgatattcctgatgaaaccccaacacctgacttacctgttcgcacaatcacgatggatgggatggatgatgaagtcgcgctggatggtaagaaattcgatatgagtcgcatcgacgctcggcagaaagttggggatgtcgccatttgggaaatccgcaacaccaacagtactgaaaacggcatggttcatccattccacgttcatgggactcagtttagagttttggcacggaatgatggtccagtttatcctaatgaacatgggctgaaggatacggtcggtgtcaaccctggtgaaacggtgcggatcaaggtcaaatttgagctgacaggagtttacatgtatcactgccatatcatcgaacatgaagatggtggtatgatggcccaaattgaatcatatgatccacaacacccacaaacttatcatttaatggatatggacaccttacggaatgcttttgcgaaggaacaaggcatcaagcccgaagatgtttggatgcccggtatgtaagtgtagattaagctaatttggtaatgagatgtgaataaagtccggttgcaaccagcaagttatctgcttggtcgtagccgggctttatcatttaaaagcacctcggggtcaaaacggtggcagttttgaccccggatttaccatgttttaatcatgatttgtgacgaattagctcgtataaagacaagtaagtctgtatttctacagtttaggcgcagtaactggtacaattcaagtaaggaccgaaaaaaggaggggattaggatgcacgttgcagcaatgattatggcgatcttggttgccgttgaacatttatttattttgtggctggaaatgtttaatgcggatagtgaaatggccgcaaaagcgtttggaattccacggcaaacgctacagtcgccgtcagtgcaattattgtttaaaaatcaagggttatataacggtttcttggccgtcggtattttatacagcttgtttgtgattccggccgtcgcgagcgccggtgcaaccctgtttttcttagcctgtgtgatggttgccgcggtttatggtagtattactgtcagtcgcgcgatcgtcgtgattcaggggctaccggcattaattgcgtttattctgatgtattttgcttagctggttctttgaagtaatgccattatattagtgttaataaaaaacgttgctacgtgattctgtagcaacgtttttggttgtctaagctatccatattatatggcagattggattacactttgccaatgaccgtcgttttagcagttgctagcacgtgaccggcaatggcatcatgaaattcgttgagccagtatccaggttggaggtctaactcagtatcaagtgcaaatagtttaaatgaataacgatgatccttgtcaggcggatacgggccgacgtagtgttggctaactttcggatcagtctcgtgaacataggcgcccgctgtggaattattaccttggaccatcggaatagcaccggtctgactggcattttcagggatgtgggtcgtggttgccggtaaattggcggcaatccaatgaatccaggtgaagccacctaccggaattgcatcgtggtcaacgaaagtgaacgccagtgaatgggtgccagctggcacatcactaatgtcaacgggaaacgagatgatggggtggcccttatacgtttgggtaacggccgcttgtttggaataggtggctgcaagggcgccattgatggtcggaattgatagttgcattgcaaatccctcctcgtgtaattagtcttattataacgctaatagtcgctggcgtagtgctgggtcaaccgcataaatataaagcccataacgaccacgtttcatcaagacgttgattgagttaaagataatctgctgtttaaggggacgcagatcgcctaagtctgtccggtttttgaacgcttcttgatcttcatagcgttcagggcgaacgacaatccgatcatggtcttcatcatagcccacagaagggccaagaatgacccccgcataattcaaatcaaacccttgaatggtataaatagaaccaacttcattcagtgtctcaggtcgtaaggcccaaggatcatcagttaagttgactttatcccacggaagcttcaattgtccggccgtcacgtaccaagtgccatgattaacgacgtacgggaagtcagcggttgccaccatccgagcgagtccatactgctggtcgcgttgtttgatcaggtcgtataagggttgcccgtcatcaaaaaagcgtagatcaaagttatcgctaacgggttttggttgtaattgcccgcgggtaaaaccatcgatccagtcgacaacatcggcgccgccagtgacccgaaattgctcgtctaagttgtagttcgcgtgcgggtactggtctaaaaatggcttgagatcgttgctgtgccagtagctctttaacttcaagacttgacgggtgtcgaagacgaggacaacgacgcgactatgattgatcagttccgttaactggttgtgacctgtaaagcggttatagcggtctggttgcgtgagtaataggtgcgcttcgtcgataaaaacaacgtctgcttgccggtgttcttttgccaaccggttgatcaacggagtgggcttttggaagtcttttttgcgcaagacgggatcttcaccagctaagcgcttataaattttgagcatttcattgtgattgacgacgagatagttgtcagtggcctgcaaatcgtttggtgtcaagctacgattgagggcttgtagccgagcaaacgcggcggctaatacggcactcttgccagttcctgcatcaccatgaataacaaagaggctgggctgtttttgctggcgatgggtacggataaaagttaatagttggtgctctaatgattgttgtgccggtgacaacgcagcttgatcatttagcttgaacgttgcggcactgattgtagatgacatattttttcactcccaaacacattatacctgcatattggggctaattgaaatgagagtcattacagttggtggtagaatagaattatgacaaagtgtgggaggaagtaacatgaaacttgatttttcggtggcggtgcatagtatcctgtaccttgatgcacaccgtgatagtaaggtcgctagtcgggaactcgcgcagtcactgcatcttaacccggtgatgattcgcaatattttatcagttctacataagcatgggtatttaacggggacggttggtaaaaatgggggctaccaattagacttggcgttggccgatatgaacctcggcgatctatatgatttaaccatccccccaacaattagctatgcgcgcttcattacgggaccatccaaaacggatgaacaggctgatcaatccccgattgcggccaatattagtgaaacgttgacggatttatttacagtagctgaccgtcaatatcgggcttactatcatcagtttacaatggctgatttacaagccgacctgaaccaccacggtacgtttttacaacacgaacaagattcagaatcttaagtaaaaagcgtcacttgattgaaaaataaggcgattttcgttaataaccttaatttgaaacgggtttgccattcaggattgtcagggctaattatcggtgctatcttagatgttattatgaaagtggcattgagattgaaaggggccttggcaatgacagcacggttagtgttaattcatgaagttggtcgttatcgagaattatcggaacaacggtactggttagaatccgccgatttttggggtgtcgatgggcgtggcgcgacggtcaatgaggccgtcggtaactttttgaccaacctcgtgcaatattgccgcgactattaccaacgcggcttgtggcaacttgatgatcggttgttacagctagaccacgttgatacagtgttagcgtacgcgcaggcaggtaagtcaccagcaccattatttttgtttaaattagttccggcggatcatgagttggcgtctgcttaaacgaaatattgacgaattcttaaagaagcgttcatacttccaccacactcctgcgctaaactatgcgttataatcaaagcgtaaattaattggagggtgttgtatggaattagataagatttatcagttaatggacaagtttgaacaaagcagtttaactagttttgagtatcgggaccaagattttgaaattcaaatgggtaagaagggacacggcaagacgacggtgaccccgcagccggcgccacttcccaatcagccggtgattgacccaacgccggtcacaccgacaccggtctcaacagttagtaccccagttgttgcggaggcggaaccaaccccagtggcgaccagtacggctagcaatccgacgagcgttgtaacacctgatcctgaaccagaaccagcgccgattgatcctaaggaatgcgtgacggcaccggtcgtaggaatctattacccagcgcattcttcagaagaagcgccatacgttaagttaggcgaccacgttagcgttggtcaacaagtcggcctcattcaagcgatgcagatgatgcggccagtggttgctaagcaagcggggacggtcaaagccttcctagtgaagaatggtgaagaagtcaacttcggtcaaccattgattcaattagtcccagatacgccggatgacatttaatcaggtacggtcagtggttgctgagcgtattaagcactttgagtagcactacgttttgataaaagcgtaacgcaaactaaaaatgaaccacttcaagcgcacatgataattgtgcaagctgaagtggttcattttttagcttaattaatgacgattggtagtggtttatttaggttggtcaatggctgccacggtttctaggaaccacttgttgaaagcagccgcatcaatatcgacacaaacggtcgcgttggttttgccgtcatggtaagcaccacgaatatcgccaacggtctcgccattagcggggccctccgtctggacatcaatccacatcttttcagtcgtgaaggcttctggatgtagtaagtagaagagcgtattgacatcatgcatcgcaacgccagtctggttgcggtcgttgtaatgaccaaagagggcgtggagcatttcgccagttttaccgagggtcggtaactgttcaatcgattcgcgcgttaaaagggccttcatcgtcacgtctaagccgaccatggtaattggaacgccggattggtacatgatttcagccgcgtgcgggtcggtaaagacgttgaactctgcggcgctggtcatattacctttgcctaaggccccacccatcgcaacgatttctttaatgtgtggcattacttcggggtaggtcttaaataagagcgcaatgttggtataggctcccgttggcactaacgtaatcggttgttcagcagccatgatgtagtcacggagcgcttcaacggctgtttctggtaatggttccgcaaggtcagtcgggaagtcgtaacccggcattcctgaaacaccgtgaattcggacggcatcttcaaacggtttgatcagcggttgggcagccccacccgctacgggaacgtcactgttaaagaagcgcgttagtttgagcgcattcagcgtcgttttgtcgaccgtcacattgccggcgaccgttgtaattaattgtaagtccaagtcaggatgatttaacgcaaaggtaattgcggcggcatcatcaataccagggtcagtgtccatgataatctttgttgacatgttcattcctccaattaaattgacgtgcttgaaattagttctattttagcatactacgggcaatgaattcgattgcaattgtgaagggtttgacgtagcatgacagtaaatacagttaacgatggaggaacggattatgagtcaaccacgggtcatcttaattacgggcgcatcttcggggatcggtaaagcaactgctttgaagttacaagctcaggggaacattgtgtacggagccgcacggcggattgaaaaaatgacggatttagcagcggctggagtgcacgttttaaaagtcgacgtgacggatgaagcgacgttaatcgcggctgtcaagacgattcaggtcgaacaggggcgcattgatgtcctaatcaacaatgcggggtatggctcatacggttccttggaagacgttccggtcgcagaaggcgagtaccaattcaaggtcaatgtctttggtgtgatgcggttgacacaattagttttaccgttgatgcgggcacaacatcgtggtcggatcattaatgtttcttcaattgggggaaagatctatcagcctttaagtgcttggtatatggggaccaaacacgcaattgaagggatgagcgattcgttacggatggaagtcgcaccatttggtatagatgttgtcatcgttgaacctggtggaatcaagactgaatgggctggtattgcggaaaaaaagctgttggcagtttccggtgagacagcctatcatgaacaagccgttaaggtcggtgcgatgctgtcattgttcgatcagtttgcttccaatccgggagtgattgctaaactgatggttcgcgctgtcaatgatgtgaagcccaagactcgctatcacgcaggtatgggcgcgggggtctcattaacggctcgtcagtggttgagtgatcgtcagtttgaccgcatgatgaactcagccgtcaatggtgcggctaagctgtcaaaagttacgcggcgtaaggaccggcgaaccgggagtcggcattatcggcatggaaaaatacccgctgataataattaatctgaataatgatgctaagaagcgagcccaacgatcacagttgttattgtggtaggggttcgcttctttatttcaagtctaaactttaagcttcccccatgtagcatgggagagatagggtctcgttagttattattttagctggtgcttggatgatgacaagcaggtggattcttgttcggcagcaatgatcgtcctattccgacctccggggctgggtgacaattgccggaacgtaagccgatatcgatttgagcccgtgcacaaacccgcccggtctcaaatacgagtcttattctaagccggaagtagcccacttccgactaagaataatttggctactgagcattgtcacccagcccctccggtcggtaagccgctcgaatggctgatgaacggccacttaacttggtataattggtcgctgactattttgataatggagccttaaactagaggttagggttacattaaccactttgttgaaacgtttgattactactatggtgattccgaaatagtaagctatcacaatgtcactttctgcctgacagttgctcgacaaaattactgtttatgaagaacaatgatgagtccaataaaagttgagtgcctcaccgtcagccattcgaatactatcccgactggaaggcgtttctgacaatgcccagtggtgaaatttcacttagcaagcgtcttgttcttggttagtgaaaggccagtatttgagacgtggtgtttcgacttaaatctgtgcccaccacgttccggcaattggcagaaatgcctggaagtcggtgtaggacgaactaaccaaacatgtttacgctaacccgaacttttccagcgggcctaagctggctgctttggacttaggtttgcaccgccattatagcttcgtcatcaccgccgttagcgtagtcgttgcggtggtcatcgcgggatcgtccacggggtggtaggtgatggtgaggttgggaaattcttcgataatgggaatcagcgtttgccattggggtaggtctggctggtcggcttcgggaacgtcccagttgttttgccgccagcttaaataacgttgttcgctaataaccgccgccacttgttcagttgtggtgtgaacatgaacgggtaaatcatgacgtttcaacgtggcgagtgcggtggtcagagcactcaaggccagtgaagtttcggtatgtccgtagccaccgtcgtttagcgccttttgatggtcagcgtatcgcagaatgacgacccaggcagcgggggttgttgcggtgatgttggtcgattggtggttggtacttgcaaggtaaagatgaatcgtagccattgttggggcctccttagttgtaatgataatccattgagtggttcatctaatagtttcgtaaaaactagccagcttcattttaaattaatgaataactttaacatgaaactacaatagttacaaaatttagtgaattgtcagtgcgtattactatgatttttggcggattatgctacgattaaatacatggataattaagaagttattaagtaataaaggtgagcactggaggttagcatgcagacattaatacagacgtttatggatcgacgcggggatttgctgactgcgctatggcaacacttggggatttcattagcatcattagtcatcgcaatggtaattgcgattccgttggctatttgggtcgttcgacgaccacggtgggccgagggattgttacagctcacgagtgtcttacagacgattccgtctttggcactgttagggttattgattccgttagttgggattggaacggtgccagcagtaattgcgctggtgatctatgctttactgccaatttttcaaaatacttatttgggtatctcagaaattgacgcctcaattgaagaggccgccgatgcctttgggatgtcacgaatgcgtaagttgtttaaagttgaactacccattgccctaccacagatcattgctgggattcggaccgcgctcgtcttaattattgggacggctactttggccgctttgattggtgctgggggtctcgggacctttatcatgctcggtattgaccgtaatgatacctcgttattattgattggggctatctcatcagcattgttagcaattctgctgagtgcgctcgttcggtggtttcaaacggctaaaccacgccacgccttaatcgtctttgtcggtattttagctttactaggtggtggcggggcttatagtgtttatgccaatcgagttgaaacaattacgattgcaggtaaactcggttccgaaccagaaatcttgattaatatgtataagcagctgattgaagctgaagatgagcatgttcatgtgacgctcaagcctaactttggcaagaccacgttcttattcagcgcgttaaagaataatcaggttgatatttatcctgaatttactggctcggtgctggagaccttagttaagggaaataacccagctggtcaaacagctaatcagacctatcagctcgccaaacagcgcctcgctaaacaggaacaaatgacttacttgaagccgatgcagtataacaatacgtacgcattggcagtgactaagaaatttcaacaagaacatcatttgaagacaatcagcgacttaacgcaagttgaatcgattctgaaacccggaatgaccctagagtttattgatcgtaatgatggcttaaaaggaatcaagaagacttatgggttagacgtgactgccaagtcgatggagccggcgctacgctatgaagccatcagtaaggggaaaatcaacttggtagatgcctatgcgacggatagtgaattacggcagtatcacttggccttattgaaggataacaagcacttcttcccaacgtatcaaggggcaccgttgatgaagacgaactttgccaacaaacatcctaaggtcgttaaagcgttgaataagttagcaggaaagatttcagaaactgatatgcaagaaatgaactatgaagtcaatgttaagaagcagtccgcttcgacggttgcacatcgctatcttgtgaagcacggcttattgaaggagggacgttaaatgacaacggcaattgaatttcaacacgtccagaaagactttaatgggcagaccgtgattcccgaccttaatttaacgattgaccagggtgagctatttgttttggtagggacttctgggagtggcaaaacgacgtcacttaaaatgatcaactgcttagagccactgacggctggtaaaatcctagttaatggtactgatacaaccacgataccagtccgaagtctacggtggcaaatggggtatgtcttacagcaaattgccttgttcccaacgatgacggtggcgcaaaatatcgccgtgattccagaaatgaaagggacagctaagaaggaaattaatcaaacgattgatgagctattggcggaagttggcctcgatccaaaggaataccgtgaccggatgccgtcagaattatccggtggtgagcagcaacgcatcggtatcttacgggcgattgcggcgcaaccagatattgttttgatggatgaaccatttagtgcgttagaccccatctcgcggcaacaattgcaagacttggtcttacggctacacgcccgctatcacaacacgatcgtcttcgtgacgcatgatatgaatgaggcgttgaagttgggtgatcggatcggtgtcatgcaacacggtcagttaatacaagtcgatacgccggctgctctggctcagcatccagtgaacgactttgtgcggaacttctttggcgcgagccgagctaaaaatgtctatgatgtctacgttgggcgtgtagggcttattcagggttatctcacagaagaacccagtgttgcgagtggtcggattcaatcgttagacgttcaagccacgttacgcaccgcctttacggcattgacagatcacgattatgtggcggtcacggaagaaaatcgggttgttggctatttggatcgccaacgaatcgtggcttacttgagtcaacatgaagaagtatcttaatcgtcaattaaggatgaatcagttacactaggttgtgataattgatggtcgctaatgaatttaaggaggaatttcgaatggcggaacagtacgatgttgttgtgattggtggcggaccagccggcaatgccatggctagcggattaaaggcccagggcaagacagtgttgatcgttgaagcggatctgtggggcggcacttgtcctaaccgcggttgtgaccctaagaaaatcctgttaagcgccgtcgaagcgcgacaagcggcgcaacatttacaagggcagggcctgattggcgcgcccaaaattgattggccagcactgatggcgcataaacgaggctatacggatggcatcaacgatgggacgttgaacggactaacggggcaagatattgcgacgttacatggccaagcacactttcaatccgacaatcagttagcggtcggggatcgagtagtcagtgcgactgattacgtgattgccactggtcagcgtccggcgattctaccgattaccgggcacgaatactttaagacgagcactgacttcttagatttggaccagatgcctaaacgcgtgacatttgtaggtggtggctacgtaggctttgaattggcgacgattgcgaatgccgctggcgctgatgtgcacgtgattcatcataatgaccgcccgttaaaagcttttgatgcagatttggttaaggatttgatggccgcaatgacggctgatggaatcacgtttgacttgaatacggatgtccaagcaattactaaaacggcgaccggtctacaattgacagctgataatttcgagctgacaacggatctggtcatcagctcagcgggacggattccgaacgcggaccagttaggtctagccaacgtgggcgttacctttgatcggcatgggattcaagtcaacgatcatttgcagacggccaacccgcacatttatgccattggggatgtcagcgatacaccggtaccgaagttaacgccagttgcaggttttgaagcgcgttatctggtcggtgagttgacgcatcccggcgcagccataaagtatcccgttgtgccaacgcaggtttttgcagcgcccaatttagcgcaagtcgggatcagcgcggccgtggcgactgagcatccagatgagtatcgtgtcaatacacttgatatgacgaagtggttcacttattaccgctttggcgcacaacaagcccaagctaaagtagtggttgctaaagcgagtgggcaggttgtgggtgctacccttctaagtgatgttgccgacgagatgattaactacttcacgttgttaattgaaaaacacgtgactttaccagatttacaacggttggtattggcttacccaacgccggctagtgacttacaatatttgtattaatgtgtggttgaattaaatcaaagtccagctattcagcttaactgaatatgtcagcactaacggagtgaccaggaatgaccggtcactctttttttgtttgaccggcgtttggagtggaatacgaaggccaaatgatgtcgcaaacagacggtcgtcattttcgttgtgcgactatcttggcgtgtaagtactgtgaaaaaatgtcaaaattgtagctcgtcgcggtggcactaatgttagcaaattaattattttatagaactagaagcgatcgcttaaatgctacgatgcttgctatggcagtatcgaactgtgacatagtacaaactagttttaaagtaaattcaattgtgcaaaatttaatttatgcaaatctattcacaaaacggtcgcgacatggtatgattcaatcatcaattatgatagcgttttcataaaactgttatgactaaggagtgacacaccatgaccgacaagtacattatggcaattgacgaagggacaaccagtacccgcgccattatctttgaccatgcgggccataaagtggccgactcacaacgggaatttccacaatatttcccgcagccgggctgggtcgaacataatgccaatgaaatctggaatgctgtcttgtctactattgcgaatgccttcattgaatcgggaatcaaacccgctcaaattagtggtattggaattacgaatcaacgggaaacaaccatcgtttgggacaagcaaactggcttgccaatctataacgcaattgtgtggcaatcacggcaaaccgcgccgattgctgagaagctggttaaagatggctatggtgatttgattcatcaacatacgggactcgtcacagacgcttacttctcggcaactaaaattcgctggatcttagaccacgtgaagggggcccaagaacgagctgaaaagggtgaattactctttggaacgatcgatacgtggctcctatggaaacttaccggtggggccacccacgtgacggattattccaatgccagtcggacgatgctcttcaatattcatgatttgaagtgggacgaccagattttgcaattattaaatattccagcggcgatgttgccagaagttcgcactaattctgaagtttatggcaagaccaaggactaccatttctttgggtcggaagttccaattagtgggatggctggtgatcaacaagcggccttgtttggtcaactggcgtttgaaccgggaaccgtgaagaatacttacgggactggggcttttatcgtgatgaacaccggtgaaaaaccccaattatccgataataacctattgaccacgatcggttacggcatcaacggtaaagtgtactacgccttggaagggtcaattttcgttgccggttcagcgattcagtggttgcgtgatgggattcgcctggttgaaagcgctcctgattctgaacgggcggcgcgcgaatcgcataatgaaaatgaagtctatgtggttccggcctttactggtttaggggcaccatattgggactctgaagcacgtggctcagtctttggcttgacgcgtggcacgactcgtgaagattttattaaagcaaccttgcaagcattggcttaccaaacgcgggacgtggttgaaacaatgaagaaagattccggtattgagattccagtattaaaagttgacggtggcgctgctcgtaatgactggttgatgcaatttcaggcggatatcttggatacgcaaattatgcgggctgctaatctggaaacgacagcgcttggtgctgccttcttagccgggcttagcgttggttattggcaggatttggaagaattaaaagcgtcgtataagcccggcacgagttttgaccctgagatggggccagctgaacggacgaacttatacgagggatggcaggcagcggtcaaagcgacccaagtctttaagcacaccccataccacgcaggaaaatagaggaggacaacaacatggcattttcagcaacgacgcgtcaacaaaatattgaacgcttacaaaatgaaacgttagatttactcgttatcggtggtgggattaccggtgccggtgtcgccattcaatcaactgcaatgaacatgaagaccgggttgatcgatatgcaagactttgcagaagggacttcatcacggtcgacgaaactggtccatgggggcattcgctacttaaagacgtttgacgtgggggtagttgccgataccgttaaagaacgggcggttgtccaggggattgcgccacacattcctaagcccgacccaatgttattgccgatttatgatgagacgggagcgaccttcgacctcttttctgtcaaagtggcgatggatctgtatgataagctcgccgaagttaaagatcctaaattcaccaattataccctttcacgcgaggaagtcttacaacgggaaccacagctgaaccctaaacatttagttggtggcggtgtttaccttgattttcggaataatgatgcgcgcctagtgattgaaaacattaagaaggctcacgaaaatggtgggattatggcaagtcatgtgaaggcgaccggcctcttacatgatgatgatggccggatcaatggtatcaccgctgaagacttattgactggtgcatcgttcgagattcatgcccgaatcgtcatcaatacgaccggtccatggtcagacacgattcgtaagatggaccatactgaaaagtatcaatcccagatgcggccaaccaagggtgtacatttagtcgttgacgctgagaaactcccagtgccacaaccaacctattttgattctggtgatcaagatggccggatgatcttcgtggtgccacgtgaaaacaagacgtatttcggaacgactgatacggattatcatggtgatctgaaacacccgaccgttacgcaagaagatgttgactacttgttggaaatcgtcaaccgtcgctttccaactgctaaaatcaccttagatgatattgaggctagttgggccggattgcggccactgattgccgctaacggtagttccgattataacggtggtaattcagggaaaatcagtgataagagcttcaaggaagttatcaaggttgttgatcagtttgaaagtcaggaagccagtcgtgaagatgtcgaaagtgtcctgaatgacttggaaacttccttggcagaggacaaactcagtccgtcagcggtgtcacgcggtagttcgttgactagtagtccagacgggctgttgacccttgctggtgggaagattactgattaccgtaaaatggctgcgggtgccatggcgctgattgccaagattttagcagataagtatgatgcccactttaatgaaatcaattcgaagaacctccccgtttctggtggcgatattgatccgcacaacgtggatgcaacgattgcattttatgctaaacaagggacggataatggtttgacgaatgatgaagcgttgcggattgcaaatatgtacggttccaatgctgcgcgggtctttagtttgattggtaaagttgaaccgacgcatggtctgagtttagccgaaacgattagcttacgttatgctttggatgaagaaatgaccctgacgccagtcgactacttgctgcggcgcactaatcacttgttattcatgcgagatacgctggatggcttaaaggatggcgtcatagcgacaatggccgattaccttggttgggatgctgcaacggtcaaagcacaaaccgaattattgaatcagacgattgctgaatcggacttaacagcactgaagcagggctaaggaatggggtggtcatgatgaaagatccattagcactacaattgttgggggaatttctcgggacctttatcttgattctgttaggtgatggggttgtagctggggtaacgctcaataaatccaaagcgcaaaatgcgggctgggtcgcgattaccttaggttggggatttgcagtcacgatgggcgtctatgcgtccagctttatgagccccgcacatcttaatccagcggtctcactaggaatggcagtggccggtaagttcccatgggcctacgtgattccatatagtgcggctcagattgctggtggggtgattggtggcctcgtggtttggttgcactactacccacactggcaagcaactaaggatgctggcgcgattctcggcatttttgcaaccggtcctggtatccggcgatatttctggaactttatcagtgaagtgattggaacgttcgtcctagtctttggcttgttagccttcacgaaaggccaatttacggcgggattgaacccgattgttgtcggaattctgattatcgctatcgggctgtctctgggtggaacgaccgggtatgcaattaacccggcccgggatttaggtccccgcattgcgcacgcggtattgcccatcgccaataaaggaacttctgattgggcctacagttgggtgccaatcgctggaccattggttggtggcgcgttaggcgcactgttgtttaatgtattgccataattttatgactgatttgatataaaccgtgaggactgttggaattgacaacggtcctcacggttttatttgtgagtaatggttgaaattcatgctttcattaactgagtaaaacggcaatagataagcagactaagacgtcgaataccgtcaccaataccattgacaatcaagcgaccatcacggtacatcattacatgaccgattctactgataaagttgctcctgatgaaacagtcaaagttggttacgggaaagcttatgatgttactaagcaggtcaaaacgataactggatataagcgtaatgccacattggatgaacatacccgtggcactgctagcaagactaccaaagaagccgtgatgtattatgatccgttgccatacaacattcatgtcaattacttgttaacggatgggcagaagctggacgaattggatgtcactggtctatatggtgatacttacacgactgagacaactgatttcgaagatttgtacacagttgatactgatcgcttaccgacgaatgcccagggaacggtaacggaaaagccaacaacggtcaattattattaccaaccaacgactgggcagtgggttgacgttggtaatcaaagtagtgttttagtacgacaagatacgaagcataatgtccgttctgtctcgcagatttatgccaacgatagtggctttacggtcaaatataatcaggatgctgctcaagttgcgattgcggctagtgatacaaacggtacccaagataacagcttagtctttgattataattcgaagtatacgtttgaattatctaagaatgagactgtcacttttaaggttgatgatcaaggccaagtgactgcgactagagtgttaggcgcagagcaaacggtcacgacttttgataaaagtggtcagcttaagacagtgaccacggtgactaacgcgaatggcactaagagtcagcagaccaacacggttgacgggttgaaatcaatggtgactggcgaacaatacgacttaggattgttgaatggggtgaaagttaccgcacaaaaagaaatcaatccgagtcaagcagcaacgactgagtccaagacaacgactgatactagtcagtctggtagtaatcagtcgacaagtacgacagcgactgaccaaactgagactaatgaatcaacagctggtagttcgaccaacgcaacgaacgcgtccagtagtgtcgatgcaagttcagcgaatagtcaaggcgacactgaggctacaagccagtcgggtactagtgcaagtgctgattcaaagacggatagtagtgcggcatcaagcactagtcaaactactgacggtgaaacaaccaataccgatgatacgaccactggaacaactactgacagtggactgggtttcaagtcaccatttactgaggatcaaaacacaagtagtgcactgggcagcgcccaaacttcgagcagtctcaatagtgatacgagtgcagcggtacaagcattgattgcagaacccaattccacgccggttgtcttgggtgaggacgcttcttttgaggaaggcgtgccagtcaatgatccggtattcagtaatgatgaaggggtttcgccgaacaacaatccaagcagcgcagcaacgccccttgcgcaagctacgaatacccgggcgcgtctgactcaaaatggcaaactgttatatgaaggaacgctgcaggctgatcaaggggaacagaacctttatgtgtcgccagatacaaccgttgaagttgatggtggggccgatggtgacggcttttacctagatacctatgatggtgataagggaatggcctatacattgggttcaggctatgcgtgggcagccgaaaacaatgatgtgactgcggcaccagcaagtagtgcgacgaccagctctgagagtgctgccagtgagtcgagcactaatagtagtgatagtagccgtacagcttcaagtgcggccgaccattcgactagttcggcaagtattagtgatgcgagccaatcaagtcattcaactagctcaagtgaaaatagtcgttcagaaagctcatcaagctcaagtacgaccggtgattcggctgacgcggataaacaggccgcagctcgttccagccaaactcagtcgaatagtgttaatggtagcagtcaagcagtaggctctagcacggtcactagtcaatcgtcagtaccaactaaagctaatacgaagcaggcttcatccacgccaacgaccaaggctaaccgagcaactgtcgtagccgctaccagttctacagcgccacggcagtcgcgggctacgacggcaagtgcgtcagttccaagtgtaacctcagcaagtgctgcggcggcaagtcgtgctaagcaacgatcggcgttcaagaagcaacatccaatcttgaaccaaattttgcctaaaacgaactccgcggtcgcgacctggttggtctggctaggagtgggtttattgatactcacggtagcgattacgatggttattaagaaacgagggcgtgactaatatgataaaattacgccaggttcttaaaaaaatcctcattggcctaatggtgtttgttctagttttcacggctttttccagctcggtcgacacagtctccgcacatcgccgtggtgtgacccacactcggaagcataaggtgcgacatagcgctagtggtcacgccaagaagtctcatcgtgcacatcgcaaagctaagcgcagagtcgtccaccgtaaagcaccgcatcggcggaaagttgcggtaaggcataagaaaaaaacgccaaagcgtcataaaaaggcgcataagaagaaggccgttaagaaacataagaagtcgcacaagaagtcacacaagaagaaagcggccaagaaacataagaagtcgcacaagaagaagtcttctaagaagcatggcaagtcgcacaagaaaaaatcttcgaagaagcacggcaagtccaataagaaaaagtcttccaagaaacacggcaagtcgcacaagaagaagtcttctaagaagcacggcaagtccaataagaaaaagtcttccaagaaacatggcaagtccagtaagaagaagtcttccaagaaacatggcaagtcgcacaagaagaaatcttccaagaagcacggcaagtccaataagaagaaatcttccaagaagcatggtaaatccagtaagaagaaatcatctaagaagcacggcaagtctaacaagaaaaaatcttcgaaaaagcatgcatccaaaggtagtgctgtaattgccacgcttagtcgtaagaccggtatcagtaaaggcatcatttcgcttttgacggatctagttgggtataatgatatttataccatgattacgggaaaagatgccgctaccggtaagaagcgctcgcggttggtaggagcggcttggacagccttgaactttgtgcctgtctcgaaagtcgctaagttagcaaaggccgcgaaggttctggcaactgctaagaaggccgagaaagttgcgaagaatggtggccggatcaaacgggccgcccgagcaactaaactggcgacaaagcgagcggccgagaaactagctaaacgaaagcccgccaaaaagactgcgaaaaaggcagctgagaaggctcgtaaagctaaaaaggtcaagactgccaaaaaagctaagcatcaacaggcaaagcccaaaaagacttcccatggcacgaagcataaaacgaccaagaagcagcagaagcgatataacaagaaaaaagctgcgggcaaggctaggaaagcttcgtatgcacggaaaaagggcggtactaaaaagaagccgggcaagcgtaagggtgctaaagctaagactacaaaacgaaaggctaagaataaggtaaaaaaggaccataaggctaagaaagccagtggggctaaagggtttaatattgacgaaattcatcccaaattaaaaacagagccagatactgcattcttttggtctggtagaacagatggcgttggtggagctgacatagcggctgatgtagctaaaagtaaaggtggcgttactttagaatcaacaataggaaataaaaatattaaaatgccagaatgggactttaataaacctgagtcaatgaaagcttgggatttggcttctggttcgtatgcagaacaagtttctggtgaagttcgtgcggtagttggttcagagttgagaaaagggaatatttgggaaaacgttgagctacctagattaaaaaataatcctaaagtaacgaaaataacaacgattgatcctaaaacaggaattgaaaaaataatttttgagaggaagtaagttaaatgaaaattacaggtagtagttcacatgtgaaatttgatttggagaatgagtatgcggtgaaggcagagggagaaatgttagtgggaggtcaatttgttgtattcaaagattctatgaagaattgggaaccgccacatgaagatgaaaagctttccgaagctgaagtacaagaaattattcaacaggtaaaacagaatacaaatgaaaacacagtacaaatttcatttgaataaaaaagtattagaattagagtaatcggttaattctgtgaggtaaaacaacttttaacgaaggaattaggtttttaatacgctattttgctagattttgagggcgaagtagaaaagattttaaagaacagattcaaatgctaaagcaaacgatgggcatgttatgctgaaaaggctcgaggaacaagttaaagtgctagctatttagtgagttcctcgggcaccaacaaactgactttctttatagtgttttatggattagaagagtcatttttctcattttcttccgcttcttgtagaagcagaagcaaacaaaatagttcggttgaagatccagaacgttgatgaaattacgcgttctggacttttagactgttaccagtattaatcaaggtatcatttcatgtctaacggatctagttaggtataatgatatttataccatgatcacggggaaagatgccgctaccggttacaacttggtcacggggacacgatgatactttgcttagggtccgcgatggtaaaataactgatggtggtattaatagtcgaccagttcctgctatgaaagatggaatgcataaagtttcttggtatatcaagaatggagtgaagttaccttgacaaaaagattaagtgaacaggaaagttacttttcaatgtctgagtttttggaatcctactattgggctagtagagacgatgatcttggaagtctattggggagtgtcacactttggagtgatgatggggaattgtttgatcaggcaattgcggaagactggcatgctttctttagcgacgtgagcaacgaaaatcacactgtgtttgagagctttcaagccgtcaagcagtttgtgaatgaatatttgccggatatcgcagcaacgacaccagtatcaggaagcttgacatataacattagaataatttgtgagatgacagaatctcaacgaaatcaggaacccgtgtggcaaaattgggtcgcggctgttaattggattacgaatcctaatgttgtgccagtcaatgaatcgccctttcttaaaacggggcaatcattgcctaatccaaaggaaaagggttttcggcaaaatcaatttccaattgccaaggttttgccagcgccacgaccagaaattccgatggggcccagtctggaaaaggtgaacttgacacagtcgtattatgcgtttgtgaaatttttacagcattattatcaggttagtgatgatagtgaattgggtaattttttgcagcaaaatagagctatcagtgaaaataatgaagaatatcgctattggaaggggaagttttcgagatgctctggtaataaaaagctattagatattttgaaggccttcttaatggtaagggattattttgaaattgaatttccggacaatgcactgcatacgcatcctgtacgtaaattgagttgtaatctctggaaggcagcgtatctgccacacagccaacgtattcagactgaggtttggcagaattggttaacggcagttcatcaagtaatagagtaagtgacaatgtcatttgataatcagttgagttctcaatttaaagatcaagaggatagttataatgcgattattttgttgtatgattatagctatgataaagaacaaggggagtgtcaagaatcttgtgtaaatgaaatgccttcgtacatataatatgtatctaacttaaataaatgatgcttccaaggtgtcctggagtcctt

SEQ ID NO: 14 - DNA, 86417 bp, synthetic construct
  source 1..86417: mol_type = other DNA; note = Lactobacillus plantarum PDG8 - contig 14
catcttccagttcgtatcgtttaggtgttgtcatcggaatgcctcgattcgtttttcctcagattatacctgaatttttagttttcagacagtccctagacaattgttgaattgttagttttttattaattttaggagtgggtcattattctagaacaattatttcatttgcgtgaaaaccgcacttcagtccgccgcgagttgattggtggtctgacgacctttttagccatgtcatatattttagccgtaaatcccgaactattgggaagtactggtatgagtaagaccgccgtcttcaccgcaacgattttagcggccattgttggttgtctcttgatggggctagttgccaactttcccgtagcattagcaccggggatggggctgaatgccttctttacttatacagttgtccaggaatggcacattccttggcaaaccgctttggcgggagtctttgttgccggaattcttttcatcctactaacgctctccaagttacgcgataaactgatcaacttgattccaagtgcgctaaaatacgccgtatctgccggaattggcttgttcattgctttttcaggactacaaacctctgggattatcgttgcgaataagtccaacgcggtcgccctgggtaacttgcacagtcccaccgttttgttggcgattttcgggattatcgtcggcatcatgctagtcaccgctaatgtaactggtggtattttctggggcatgttcatcaccgccgcagtcggaatgatcttcggtattattcccctaccaactgggattatcagtggggttccgagcgttcaaccgatttttggtcaagctgtgacacaccttggtaatattaattcgtttcaaatgatcattgtcatcctgacgttcttcatcattggccttttcgatacgtcgggaaccttggttggggtggcaaccgaagccggcatggtggacaaagaatccggcgaagtcaaaggcgttggtaaagcgctctttagtggtgcactcgccacaactttaggagcagtctttggcacgtcaccgacgacggcttatgttgaatcgacttccggcgttgccgtgggggcccgtactgggttatcttccgtcttcgttgccctcttgtttgccatcgccgcctttttctctccaattttgacggtgattacgtccgcggtgaccgcttcagccctgattatcgttggtattttaatgttatcaaacgttcaatatattgattggaccaagtttgaaatcgccgtcccagcctttttcaccatgattatgatgctactaacttacagtatctcagaaggtttggccgttggctttatcttctacccaatcaccatgacggtcaaaggccgttggcgtgaagtaaacgccctcatgtggacgatgatggtcgtcttcattctctactttgcatttgtcgcttagaactgatggttcgctaagcaatgatggcagtctaaaacacccctgagtcgtttaactcaggggtgttttttagtaggcacggctgcatctaacgcctactagtgtttaagaacttgttgattatggtaatcttcagcgtagacttgggcaaagtcagcaagtttaacatcgcctaatcgaggttgatgtgctcgataatccgcgtaaaaatcgtggtcacgctggtaagcgaccgttttaacatattcccgtgcaaatgcgaccggggttccggcagtcactaaatgatcttgcatgacctcatcaggcacttgtgaaacgcgcaaatccggcattttaagagcctgtgacagtacggaagcaacttccaaataagttttctcatcactcgcaacatatgtcaccgtttgccccggtgtcggttcggtcagcgccttaatcagtacagttgtaacgtcgaccggcgcaacccacacgttcttaacagccaaattggcatttgtgtagattcgatgactctttttaacggttggcacactgctcagtaaattatagtacattgccgttgggcggataaacgttaagtccacgtctggtaaagcggttgttaacgtttgttcgataatatgatacatgtaaagtgcaccgacttctgatcccaagtcggcccccacgctactcagattcaccactcgttttacgccggctgccttgatcgcagcggcatagatgtccgcttgtcgtttggcagcggtataaagatcatcactcgccgctataccagttaccatgaggtataccacgtcagcgcccatgaacgtcttggtcaaaaacgcttcgtcatcaagtcgaccaatggcaggggttgcgcgaaaaacctttatcaaactactgcgaattgcttgatgactgatgaccgtcacttcatgaccagcatgggtcagcttaggtaccaaggtctggttaatacgaccgattgaacccgttaaaacaattttcattttatgataaccctcttctatacttattaaaatatccgtcaaagtcattatcgattataagcgaccactaaaaccccgtcaatcactggtggtttagttggctaaacagtgttgatgtgcggttgcgcgattcgttcataagacaggactgattaacgctaatcaaaaattatttctatttatcaagagataatttttgttgaaactgtgcaaaattaggcctataatgtcaaaatgtttgacactgtcaactacgacggttagtcgcctttcctgttaccataagtttttcttacggagattatattagatgagtctagcacaattagaaataggattactgtggttgacaggctcaattgcggtcatcttcatcctgacgattggtacttactattggtactcccgcaaacgttccaacaattaccttgaaaatgatgattttaatctacgctactttattcaaaaacaagtcgattttcgtggccgcactaccggctatgaatgtctcctgcgtcaacaaaatactgatggttcgtggtcattaccaccacaacttgactcacttccacttcagcgggtgatcttcctgcttgaagatacctttaaggcgctacctgatgaagcgattacgttatcaatcaatttagaatacgaacaaatcatcagtcccgaattccgttattttgttcgctgggcaattgcgaacatcgaaccgatgcacttggcaattgagtacacacctcaataccaaccacgtcgtatcaataaacgcctatttcggcggcgaattcgtgaagcccgcggttacggcatgcagtttggaatcgataacgtcggtgcaagtctagccaatcttaaaaacattcagtggcttttaaaagatatcgacacgctcaaatgctcaatgcgctcatttcgcaaggaagacccatccgtctggctggacctgaacctccaattctggaatcagctctctaaggaaaacaatattgatctaattctaatgggaatcgaaaatgaggccgatgaacagctcgccgagcaactgcaaatcagcattcgccaaggctacttattcggccatccaatcaatccccagcaatcaaccacaaaggagaaccacgatgcctaaaccaaccactgatgatgttaatcggcaacaactatactctgatgcgtactttgacactggccattggggactcaagattcgccaaacgatcgttggtatcgtgggttggctcgcagtgattgtgcccatcaccgtgacagtcctttccatttggtcaagttataatccacacattccgcgtttctggcactaccatgaaggtcttttcgaatttaagttcatcggtatcttactagccttttgctttgcactcgcatccctttttgcagtgaccatgaccattatacagaatcgtaagcgtgaacgtgtcgttgaacagtggccaacctttaatcccattaatcagaaaaaacggcagcaactgctcgctcagttcatggcggaccgtttcggcaatgccgaatttcgtgaacatacccgccactaccgggtcaagccagaacaaaatctcgatactaatcagattcagcaactttatcaacaaaataatttagacgatattaacgattaaccagggggcgccatgacaaatatttttattgaccacatattcgccgcaaccttatttaaatcggtaatcaacatcgcactcctgattttatgcctctaccccatcgttggctcttttttctggttcgccggcgcgctatcctaccgctttatcaagaccaataagcgtgatgatgactggcagtacattccggctgaacagcaaccaatgattaccatcatgatcccggcgcacaacgaagaagtcatgattgaagaaaccatcacatacttatttacccagctcaattatacgaactacgaggtcctagtcatgaacgatggttcgaccgacaagacggccgccattattcaacggttgcagtccgtctatccacggctacgaaccgttgaaattgagaaaaacaagggcaaggcccacgccttcaatattggcatgtactttgcccagggtgagtatattctcagcaacgacgctgatacgattccagaaaaggacgccctgatgaagtatatgaatttcttcatccatgaccgcgatatgaatacatccgccgtcaccgccaatatggatgttcaaaatcgaacgtcgcttttaggtaaatctcaaaccgttgaattctctagtatcgtcggtgttatcaagcggagtcaaacttccatcaacgactctatgtacgcgtatagcggggcaaataccctctaccgcaaacaatttctaattgacgttggtggctttcgacaaaatcgcgcgacggaagatatcagtattgcctgggatcaccaaatggtgggcgccgtcccgcggtttgcccctaacatcgtcttccatatgaacgtccccaccacaatccgagacctttatcatcaacgcaaacgttgggcacagggtggcacggaagtgtggttaacgaacattaagaaattcattttccacccaatcgttcatcgctatcaactatcaatgttcgtcgattcgacgttgtcaatcatctggtcctttttcttcgtcatcacttccttgatgtttttgattctgatgggttacttcctgataaccggcaattttgaacgagtctaccacggcttgatgttgtcatttgtctttgttagttttgaactattggccgggttcatgcaactgttagcggcactcctgttggaccatcatggtgcgaaactaaagtactggttcttcgccccactctacatgttattttactggatgatcaatcctatcaccgtcgttgcaacgtttattcctgcactcaaaaccattctgggctttggctccggaacgtgggtcagcccgaagcggcagtcattgcagggtaaaaagtaaaacggtgtcttaacactttcaataattgatgacggggctactggtgcgagaacttgcaaccagcccaaccaaaaacgtgcacttacctgagtgataactgactcaggtaagtgcacgttttaatattaatcccttttgatcgttttcttagctatgcaaacggagctgcccaggccaccctgtgactagctacgctgagtaacaggtcccatgtgtcacgtgccactcaacgcagagatcggcaggtaaatcacgaacggcctcacgacttacctgtgtgccaagttcagtaattgagcacccttgctgactgccgaggccctggcgattcagctgaatcgtccgcgcaccaactcgatacaagtcactcatgatctggtggtaggctgcggccaagtcatgcaccatttccgtatctgattgatagactcgattaagtgcgcgcgcattatcggaccgtttgagttctgccaagcacagctcgggagcgggcaaaatttgtttatccacagttccaccactgatttgattgcccatgaattcaaaatgcgcaacggcaggatggttgaagccactgattttaccggtcaacgcgagcgccggcaccaaacctatcccggattgggtgatgccttgtagcccccagaaaaagttaaagtgccaccaatttagattatgcgacttatcaaccggtttccgaatatgatgcataaaagcagcgtcctccatccgtttaagtcccgccgcgttaatattcaacgttgttgtgccccgatgcaaccctttttgagaccgcattgccatttgccaaccatgtacacggtgcctaaccatcatcatcaatgtgccaaattccatgcccgtttagcctccaaattaattgcattctgccaatataaaaatcgtcccctactgcttaaaaaggacgatttcaacgtttgggtcagcctttaactgccaacaccaaccattattcttttatgacgaatttaagtaatgtttccagcatagaatggtgctcaccgaatgtcaagcgctaatcgtgggacgctgtcatccccttaacgccaatatcagttcggtacactagattaccgactctgagttggtcgatttgttgataaacagcccgctgtgctgcgaccaagctcggggcacttgcggtaaccatcatcacccggccacccgcactgactaattgatccggggtacccgcaacgctagcataatccgcaccagcaaccgtcggaaccggtacaccggcttcagttggtcccggataaccgggagcagctagtacgacgccaagataagttgccgtcgtttgccactgcgcgtgtggttgccgatgttgcagtaagtcgacgatgacttgataaaaatcactctgtagttgtggtaataagatctgcgtttcaggatcacccagtcgcaaattatattcaataacttgaacaccggtcgcagtcaggattcccccaacatagatgaccccttcaaagcttaacccatcggttttgagacctgcaatcgtcggttcaataattgtcgcaatcgtttgatcgataaccgcgggcgtgatttgcggtactggtgaataggcccccataccacccgtgttcggtccccggtcatggtcctgtaaccgtttatgatcttgggcggtcggtaataacgcatagtgctcaccaccaaccaaaaccatttgggaaaactcaaagccagcaacgtagtcctcgatcaagaccgtcgaactagttttaaaggccgtcttaatcgctgccgcggcttgttcataactcgtcgcaaccgtcacccctttaccagctgccagcccatcgactttgataacttgcggcaccgcttgttcatgactataagctagtgccgaatccaattcatgaaattgccggtagtcggccgtcggaatgtgatggcgactcatgaaggccttcgcaaataccttagaactttccaactgtgccgcaacttggttggggccaaagatagccaggccggctgcttgaaagtaatcaacaatgcccgtggctagcggtacttcgggtccgacgaaggtcagggtaaccgtattggcccgtgcaaagttgaccaaccccgcaaagtccatttcgtcaatcgctagtgtccgaataccatcccggatcatgcctggattaccgggtgcacaatagacggtactgacttgcggacttgccatcattgccttggcaatggcatgttcgcgaccaccaccaccaactactaatacgtttgccatgcacgcacccatcctttcattaatgccggaagtgtcgaacaccagtggtgaccatcgcaataccataacggtcggccatggcaatcgaatccttatcacgaatactaccacctggttgcacgattgcacgaatgccgtgctgcgcagcatattcgacgcaatcatccattgggaagaacgcatccgaagctaggatagcattttcgtagccagcttgtttcatcgccttaccaatggcaatcttagttgaatcgattcgattcatctgaccagaaccgattcccaatgtccgatctgcggtagttacaacgaccgcattgctcttaacgtgcttcacaacttgttggccgaaagcgagtgcttttagctgcgcaggtgtcggttgggttacggtaactacggtaaaatcagctggcgtttcgaaggccgcgtcgacctcctgacgtagtaagcccccaccgactgaaatcgtttcaaacttatcggccgtgtgcgtttgctcaaagtcaaccgtcatcaagcgcagattcttcttcttggccaaaatagcaaaggcatcgtcatcaaaactcggggcaataataatttccaagaagagtgcgtgcatcttctcagccgttgcgagatcgactggtcgatttaaggcaatgattcccccaaagattgaaatcgaatcggcttcataggctttgtcccaagcagcctcaatcgtcgtacccaagccaaccccacacggattcatgtgcttcattgcaactacggccggctgttgatattcactgaccatccgcaaggcagcatccgcatccttgatgttattgtaagaaagctctttcccatgaatttgcttggcacccgtaatcgagaagtgcgtcggtaaagcattttcgtaaaaggcagccttttgatggctattttcaccataacgcagggcctgcttcttatcataagtaagggtcaacttttctggaaattcttcagtcgttaaatattgggcaatcaaggcatcataggccgcagtatgttgaaaaactttggccgctaatcgttgacggagtgccggtgtgaccgcgtccgtctgcaaatcagccagaatctgctcataatcagcaggatcaacaattggcagtaccgcggcaaagttcttagctgcggaacgcagcatcgacggaccaccaatatcgatttgttcaatagcttcagcttgtgtgacgtctggttgttgaatggtcgctttgaatgggtacaggttaaccacgaccatgtcaatcggttgaataccagctgcttttagttgcgccatgtgcgctggcaggtcacgtcgtgctaatagtccggcgtgaaccttaggatggagcgttttgacccgaccgtcaagcatttcaggaaaaccggtcacttcttcgattccgatgactggaatatcagctgcttccagtgcctttttggtcccacccgttgaaatcaattcatagtcaagggcaacgaggcccttcgcaaaatcagttaatccctgtttatcagaaacacttaacaacgcacgttttgtcatcttaaattgctccttcattaatgagtgtctgtaatacatctggataaaattggtgttcacaatcatgaatccgggtcgccaggctggctagcgtatcgtctggtgcaaccggaacgacccgctgggcaataatttgcccggtatcgattccggcatcgatatagtgaatggtaacgcccgtctcagtcacaccagcggcaaaagcatcctcgatgccgtgacgaccaggaaactttggtaacaatgctgggtgaatattgatgattttatgagcatacgcattcaagagggtcggaccaataatgcgcatgtacccggccaataataccagttcaatttgccgtgcttgcaaggccgtcaaaatgattgcttccgcggccgctttattcgcataatcatgaaaatcaacaattaatatcggtacgttagctgcccgggccttgtcaattaccggcgctgtcggttgatcacacacaagtaacccaatcactaccggtaattgtcgttcaataatcgcttggtggagtgcaacaaagttggtgccattacccgaagcaaatactgcaattttattaggcatgctcagcctcctcaaaaacaacgggtgtcgtaccagtttggactgttccaactcgataataggactgagcgttggccgtcaaattagccgtcacagctgccacttggtcggagtgaacgatcagaaccattcccaagcccaagttaaaggtcgaccgaagatccgtagcagtcagcccaccgagttcggccaataacgtcataatcggcggtgccggccattgacccaattcaaggtgcgcactcaagcccgccggtaacgctctggcgacgttctcaatcaagccgcccccggtaatgtgggcgatactcgtcactaatttctgctgtaataatggttgaactgcatcaacgtaaatggtcgttggtcgtaaaagttccgtttgtaaatcatgaccaagttcgtcaaaaaccgtggtcaattggtagtcgtgttgtttgaataaaatatcacgaactagactaaacccattcgagtggaggccattagacggcaacccaatcaagacgtccccagcccgaacatttgctggtgataacaggtccgcgcggttcgcaattccgaccgcaaaaccagcgaggtcgtaatggtcctgaccatacatatcgggcatctccgcagtctcgccaccaatcaacgctgtatgggcctgctgacagcccgtgacaacgccagtcaaaatggctttgacccgcttctgatccgtatgtccaagacctaagtaatctaaaaagaactggggggtcgcgccttgtgccaaaatatcattcacacacattgcgaccaagtcaattccaatcgtggtatgttgatcagcagcgattgcgactaagagcttagtccccacaccatccgtccccgctactaacacgggatcgttggcagttgcatccggactaagtggaaacgcccccccaaacgcgcctaattgctgattgccactcatttgtttgaccgtctttaagacgtcgtaaccagcgttgatatcaacgccagcccgcttatacgcatcgctcacttgatcaccccttcatgattggcttgtaattgcgcaatttccgcatcatactcggcttggtaatcatacagggccgttggataatccccattaaaataggccatgcatagtccaccatacggttcggtggtcgacaagccaactgcatcaacgacgccctgttcactgagaaaaccaagtgagtccgcaccaaacgtctgacacatctcccgaatcgtttgctgagccgcaatcaattcattagtcgattgaatatcgataccgtaaaaacatggatagcgtaatggtggcgatgcaattcgtaaatgaactgactttgcacccgcatctttcaataatttgacgatccgccgactggtggtaccacgtacaatcgaatcatcgattaagacgactcgtttaccagcgacaacacctttgaccgctgaaagcttcatccgaaccccctgttctcgcaatgcttgggtcggctgaataaaggtccgtgacgaatattgatttttaattaatcccatctcgtaaggcaggccactcgcttccgcatagccggtcgccgctgataaagatgaattgggtaccccgacaacaatgtcggcgtccacgggctgttcaacagcgagctgagcacccattcgtttacgtgcagaatggacgttgacgccgtgaatatcagaatctggacgtgcaaagtagataaactccattgaacaaatcgccaactgtgtatcagtcgtataatggtcgatcgtcaaaccatgatcatcgatcgttaacaattctcccggctgaacatcttgaacaaacgtcgcaccaatcgtatcaagcgcgcaagtttcactacaaacgacgtacccgcccgtgggtaactgaccgacgactaatggtcgtaacccgttaggatccaaagcggcaatcaaacaatcattcgttagtagtaagtaagcaaagcctccgtggacttgacgtaaagcatccttaacctgttccgttaacgttgctgcggggctgcgtcgaatcagatgcattaaaatctcactatcagaactagcatgaaaaatggcaccatgctgttccaaccgtcgccgcagtgtcaccgcgttcgtcaaattgccgttatgtgcgagtgcaaactgtgagtcgctaaaattaaaacccaagggttgaatgttttccaatccatgattaccagccgtggcataacgtacatggccgactgcagcttgacccgtcaaacgtgccaaccgccgtgggtcccgaaagacatcagccaacaaccctagtccgcgttccgtctgcagtttgccgtgatcattcgccgtgataccggctccttcttgcccccggtgttgtaacgcatggagcccaaagtacgttaattgggcggcgtccggcgagccccaaaccccaaagacgccacattcttcattcagacttcttacttcagtaggcatggtaaggccccttcccacaactgtttggcgaaactaaccttaatatcaaacgcctgatcagcagtttgaacgtgtagccgatccgttgcagttgttcgtcctaaataggtcacatatggttccattaaactttcaaacgcggcttgctgtgctggtgtcaccgagataacaaatcgtgactgcgtttccgcaaagaagttggcagcgggcaagtcactggccagttccaccccgatattttgtggaaaacatgattcggcaatcgtcgtaatcaagccaccttcagaaacgtcgtgggcactagcaactagtcctttttgaatcgcagttaacaatagacgctgattacgattttcagtcacaaggtcaaaatcaaacagctcgccactgattgttcccgtcaacatcttttgcagctcactaccattgaaatcggcttctgtggtacctaacacgtagactgcatcgccagcgtgtttaaaatcgctagtcgtaatatctttctgatgcttaattaacccgaccatcccaatcattggggtgggatagatggcttccccgttcgattcattgttcaacgagacattgccagaaatcacgggcgtattgaataattggcaggcacgagcgatgcccatcgccgattcgtccaaatcgtaaaattgttcaggtttctctggattaccatagttcaagcaatcagtgatgcctaaaggttgaccaccggaagcgacaatgtttcgagcagcttccgcaacggcgatttctccaccgacacgggggtttaagtataagtatcgcccgttaacatcggtggtgaccgccaacgccttatccgtatgtcgaatccgtatgacccccgcatcggaacccggcttgacgaccgtattcgtttggacctgcgagtcatacgttccatataacgacgctttggaagcaatcgttggctgttggagcatcttcttcaatgtgccagttgcatcaactagtcgtggcataaattgatgatggctctgatggttcaagcgcgttggtcgtttcttttcgcgttcatagaccggcgctttggtcgcaagtgcatcgacgggaacatctgcaactaacttaccatgatggaataattgatactggtggccggctgtcactttaccaattgtgacagcatcaagaccgtacttttcaaagacttgataaatttctgcttcggcaccagctttgacacatagtaacatccgctcctgtgattcagagagcatcagttcaaacggcgtcatgccagtttcacgttgtggtaccaagtcaagattcagtgacaacccactgcctgctttggacgccatttcggctgaggaggaaactaggcccgccgcgcccatatcttgaatcccgattaaaacatcacgatgatcatgaataacctcgagacacgcctccatcaataatttttccataaagggatcaccaacttgaaccgcggaacgctgggtttcattggcgtcattaaattcagcagaggcgaaggacgcaccgttaatgccgtcacgccccgtttttgcgccgacataaataacggcgttgccaattcctgttgcttggcccttctgaatatcagcttgatccaagattccaacacacatggcgttcaccaacgggttcttctgataactcgcatcaaataccgtatcaccaccgattgtcggaattccaatacagttgccataaccgccaatgccggcgactacttgcgaaatcaagtatttcgtatgagcatcagtcggttccccaaagcgaagactgtccagcagcgcaatcggccgggcccccatcgaaaagatgtcccgtatgataccacccacacccgttgccgcaccctcataaggttcaactgcagacggatgattatgactttcagctttaaagaccacggcctgaccatcaccgatgtcgataataccggcgccttcaccaggcccttcaagtacctgttcaccctgcgtccaaaattttttcaagactggttttgaattcttgtaggagcaatgttcgctccacatgccggaaaacaacccggtttcagtctcgttaggtaagcgttgaaggaccttatccgttaataattgatactcagcatcggttaagccccaatcccgatagaccttagaatcgcgaacatctgtaggtgataatggttgctttttaagcatgggtgacctcctcttgactcgcaatgaccgattgaaaaattctgagaccgtccgtggaacctaagatcatctccacggcccgttccggatggggcatcatcccaagcacatttcccgcttcatttgtaatgccagcaatattagccgtgctgccatttggattctcgacgtattcgaagatgatttgatgattagcacgtaattgcgccaaggtggcctcatcacaataataattgccttcgccgtgggcaatcggtaaactaatttgatctgtcgatccgtatgcggtggtaaaaatcgtctcatgattggcaattcgtaatgggctgtcctgacaaataaacttcgctgagcgattggcctgcaatgcaccaggtaataatccggcttcggtcaagacttgaaagccattgcagattccgatgactggtttaccagcgttagcaaatgcaataacggccggcatgatgggcgcaaagcgggcaatcgcaccactccgtaaataatcaccgtacgaaaagccaccaggtaacaccaccgcgtcataacctgctaatgaggtcgctgtcgccggaatcaaatcagccgtaacgtgtaaaatatcgcgcaaggcattcaccatgtcatgatcacaattagaaccaggaaagactggtacggcaaatttcatcattacaaagcctccatctcagtaatttcgtaacgataagtttccatattaacgttggctaacaagcgatcacacatctcgtcgatttcagcggcaactggccgatcatccgcgtgaattttcacctcaaaatacttacctaattcaacggcatcgacattcgtatatccaagtcggtgtaaggcatcatgaatcgcctcacccttggggtctagaattgattgcttataagtcacatagattttaactaagtacatgttaggcctcctcaacggttgctagccgcgtcaatacttcctgataaacactagtcaagtcgcctagatccttgcggaagacatccttatcaagcgatgcaccggtctttaggtcgactaaccgacaactatctggtgagatttcatcagccagcaagactttaccggtggtcgtcaacccaaattcgattttaaaatcaacgagctgtacccccatcgccgcaaaaattgccgtcaaacgctggttaacctgtaaggcctgccgtttaatttccgccacgattgccggtgttgcaacatttagcgcgtggatttgtgaatcattgataaatggatcatccagctgatcactcttatagaaaaattccagtactggttctgcaaatttggttaagtgtggcacggcaaatttacgctcaaaactacccgaagccacattccgaacaactgtctccaagggaatcatggtcacgcgacggacaagttgcacgtagtctgaaggttgctcaataaaatggttggcaatgccgtgattggctaagtctttgaaaatcaaactcgcgatgcgattattcaatcggcctttctggtcaatgggaaccttccgcttaccatttagcgctgttgcttgatctaagtattcgacccatagaatttcaggatcattagtggcatacatcgctttcgctttacccgtgtaaagcaaagcttgtttctcaatcgctgccgtcattattattgttcccctttcaaatttgccaccgacgctaatgctgcgtcaatatcgtgatttaatacggtgacatgacccatcttgcgctggggcttaatggccgccttaccgtagtcgtgaaaatgccattctgggtgttcaaccaactgttgacgtgccactgttaagtcatcacctagcagattacgcatcactgccggactggtctgcgtaatggccggaatcggtaagccacagatacttcgaatatgggcctcaaactgcgagatgttgcaggcctcaatcgtatagtgaccagaattatgtgggcgtggtgccagttcattgactaataaagtatcatccggtaaaacaaagaattcgattcctagcacgccgcgtagttccagggattcagcaatcgaaaccgcaattttgcgggccgcactatgaacactgggctgaacattagctggggcaatcgttgtgtgtaagatatgatgttgatgctgattttcaactaacggaaaagtcgtaacaacaccagcagcactacgcgtcaccatcatggaaacttctgttcgaaatttctgccgcgcctctagaatgcacggctgtgtcaataaggcactagcggattttgtcaccactgctgtgtctagatccgtttgtccgtgaccatcgtagccacctgccgccgttttgagaattgccggcgtaccaacacggttgagggcgtaatttaatgactgtaaatccgtcaccggtgcgaaagatgtgactgggatgccatgatcatgaagaaattgcttctcattaagacgatctccagtaatatgcaggagtgcagtgccctgcggtaactttgcataggcttgcgcagcaatcaaagcattctcatcaacgttttcaaactcgtaggtcaagacatcactacggcgcgctagatcaagtaaagccgcctgatcatcataagccgcaacaatctgaaaatctgcgacctgggctgccggtgctttgggtgtcgggtcaaggacacctacccgatagcccatcgccttcgcgctaagcgtcatcatctgaccgagttgaccgccaccaacgattccgatcgttgcgggtggtaagagtgcttccttaaaattggcgttcactttgttcagcctcctgacgttgacgagcacgaaattctccaattgcatgttgtacttgtggttcccgtaaaccgataatttgggcggccattagcgcaccattcttagcccccgcatcaccaatcgccatcgtcgccacgggtacgccagctggcatctgtacgattgacaataacgaatcaactccgttcaacgtatgggtcttaatgggcaccccaattaccgggagtagtgtattggcagctagcatcccgggtaaatgggcagcgccccccgcacccgcaataataacttgaattccccgtgacgctgcttcttcaccataggattgtaatgtctggggcattcggtgggccgaaataacgtgacgctcataagagactcccagtgccgttaactgttctgccgctaattgcatggttggccaatcagaaattgaccccataatcaaaccaactttcgccatcatgatccctctttccctgttttcaccattagtttagcaatcaggcgggacactgtcaacgaatttcttaactttatctattaattaacgttttaatgttcgtgttaatgaaattgataattagattaatgctacctcaacatgtacgaattacctcactgtttgcaggtttccggtgtctggaaaaagttatcaactgatttcaagcgactattttgataatattattaatattgaaatttccgaacaatccgtcatcatctaaattccaccataacaaacttactgctaccattatcaacaactatccgttgaaacgggccattaacttttgtcggtgcgcaccaacaattaacagcaatgactgggaatcggcgtaggacgagcaactaagcatgtttatgctaactcagactatttatagcggggataaactgactgccgctgaacttaaaaacaatcaacaacttaatttgcgaacgctttcctaaaggatcggattgaagtgaccaaaataacgcaaaaaaagtctcaaggaagcgattcctcgagactttttaaggtactaattattttgctgaagcgccggaaacactatcgacatcaggtgcttcaggcttggttggtgcttctggtgcggcttccgtatcggctgaagcgccagagacatcatccaccgctggggcagcatcaggcttcgtttccttcgccttcgatgaagctcctgaaacggcgtccgtcttagcatctggatcaggtgctaacatctggcccgtctgcttcaggtaatacttcacgattggtaagaggtcgagcacaaactcgttgatacctttgtactcacccttatcgtcatgcaaagcttgataatagtgcatcacatacttattagggataccaggtaccggtaacttgaagagatcagtctcaccggttcgtagcatgtgtaccgctcgcttaacaccaggtacggcccgctttggatgacagtcagctagtggattaccggcttgagcaggtgtccgtgaagctaacatcttgtcgccatccatttgatggttatagtataaaaattggttgttggcatcggcatacgtcaattccattggcatcgagttgaggaaccaatttaattggttgacggtcagcacaccccgatcgagcttaacgtagtcgtcaccctcagccgcatgggtcttggcagccgcttgttcgacccaatcagccgcatgcatgttgacgcccttgattgtcgtttcaacttcgcccttagcctcaaggtcttcattcttccaatcatcagcgtgtgcttccgcatccatcgcgttgaccatctttacaaacttcagaaacttgcctaacgtttcttgtaagaacgagacagtccgagcatccttcagattgttttggtcatcgaaagcctgcttaacttcgccgagcaaaaattcattaccaggcatgaccacagcatcaacacccggtgactctaaaatctggcgtagattcaactgtgcccgcgacgaaccttgatcatagtaagaagcgccaacgatcaatacgggtttccctgacatcgggtgaattttaaacgacaaccattcgatcacgcttttaagtgcagcagtaattgtatgattatgttcaggtgtcgcaataatgaccccgtccgcctgcatgatctttcgtttcaaatattgaacagcttcaccttctgtttgatcatcactctgattaaacattggtacatcttgaatatccaaaatttcaatatcaaccatgtcactaaaatgattagcaataaactttaacagtaaccgattataagacttatcttcaattgaacccgcaattccaactaatttcatcgtcgtcgccctctctataatttttcccaatccatttcacgaacttcttcatacgtcgtcgcgttggcattctttaattttttcgtgatttcgacaaagacttggaaatccttgaacaacccatcgagcttcgtcgctttctgttggtccgttaaattcccctggtcatcaaaggcttgcaatgaatgaccaagcataaattctgaacttggcatgatccgcgcccgtaattctggtgaatccaaaacttgccgcagatgtgcttgagcccgtgatgtgccgagtgccccgtatgaggctccaataatcatgacgggtttgtccacgaagggctggatatggaatgataaccattcgagggcattcagtaatgccgcgggagccgaatgatcatactctggtgtactaataatcacaccatcagcttgttcgatcttatccgccattgcttgcgcctgtgccggaatttcatgattttcgggcttattgaagattggtagacccttgatttccattaattcaatctctgcttgatccgcatagtgggactgcatatattgcaacaacttacggttggtcgactcatctgaattagttccaaccatcgcgataaatttgtgcattgagaacaactccttctatgatcaaatagtcaaatattatataatttcttagtcaataactatattgtagtagatttcactaaagaaagcaaaacaattttaagcgctttcagttttactatgcaaacaactgaactcactgatattaggcttatccgtgcaatcaagtaaattcagtatccgcgcaacgttgccgcaattatatctgcttaacaaattttttcacaaagctacgacgctacgatcaaatcaatcaaatccgccggggcaattcgaccaaagtaatgggttaagtccaacggtgctagcgccgtcataatcgcctgccgttcatatttcacaccagtcaaccgtgcaacgacgggagcaatcggttctgcaccgaagaaatcgccataaatcgtaactgcttcgatgcgccctgccaccacgtttaactgaaactcgacggtcccagcatcaaaatgccggcgctgcttaactgtaaacgctggtgactgaccgtaaatccaatcccagttggtaaaatattgttggttcagtgctgctacccctgccagtgccgtttcatctaactgatacgtcttagcttgactcaaatcagccacgcccaggatttcacgggccaacgtatcgcgaaattcctcaatcgtcaagtgctgataagccggcgccatgtacggtttcaagttcgtgactcgacttcggaccgacttgatacccttagaggccaacttatcggtcggcaccgtaagagctttcgcaatttgcgtctggtcgacatcatacatcagcgttccatgggagaacatccggccattctcaacgtgcatggcatttcctgagaacttcttgccatcaatcaataaatcattgcggccactcatcgtcgcaccagtggcccccatcgcgtgtaaagcctttagaactggtgctgtgaaccgcttaaagttaccaaaaccgtccccgtcgtccttagtaataaaactaaaactgacatttccaaggtcatcataaaccgctccaccaccagaagttcgccgcgtcaatgtaatgtggtgtgcgtcaacatagtcctggttaatctctgccttgacattttggtaacggccaacaatgatgcagggggcgttaatgtaaaagtatagaatcggttccgtcaaatcggcatgttccatcaagtaagtctcaatggcaagattcgtgcgaatatcatggctggagcttgcaagatagcgcatcgtcacacttcctattctaaataaatccgttgcaaatcattgatttcattgttagttaatttaagctcagtgtgtaaatagtggtttaaattacccgattgtcgtttaatttcggtcatagcggcgtccaaataagccgcatcaactgaccagagggcccgaatactttcgaccgttgcatctgatgcgccctgagcacgtgcttcggccatcgcaccattgatccggccaatcgaagcctgattagttaagagataatcctgcttgatcgtttcaaaatcgactccgagtgcggttaacaggtataccgcccccattccggtccgatcttttcccgcagtgcagtgaaatagtaacgtcgaatcgggttgatcatttgcaagtagattatcaaagaaccggcgatactcgtccttggcatgttgctcgtcggccaccatctgatagacctttagcatgtgcttgaatccactatctggatgcttctccaagttagccgtcatcttgtcagtaccgtcagaattccgcgtttcgtccacattgaacactggtgcgtacacgtacttagcattggcaggaattcgatctggcgcatctaagacttcttgtggtgaacgaaagtcaatatcgtagcggacgccataatcatccagcaaagcttggccggctggcgttaattgatcaagtccaccagtccgaatgaccttatgccacttgatttttcgaccgtctttagtcgagtaaccaccgagttcacggaaattaatgccacctggtacagttaatacacgttgatttgtcatttttgaaaccacctatctgttaacttttcattttctattctaacattatcggtcagtttaacggtgccccaatcaccgaatcagtcgctttatttccaagataattcgttagcaccatcgacaccaaccgacatcaacgcgtgctataatgtaagttacatagccagcgacggcccgtcgaatccagaacacgtttgctgacaaacagcatcacaaccttggaccgattagccataaatttccatactggcactaaataaaaaatattcactgaataatataacggaggatctttcgatgacatttgattatgcacaccaaactgattggcccatgactagtggtcaacatcagtcaccaatcgatattcaaacacaacacgttcagtcttcacagctatccgccatcagctggcgaggcttgtaccaagccaaaacgattacgggcgaagcgacaactttgaaggctagtggaattggtgccgcttatttgaacgaccgcgactttgcctttcaacagattcactttcatacgccggcagaacacttaatcgatgggcaagccgcaccaatcgaatggcatctcgttcatcaaagtgctaccggccagctcgccgtcgtcgccgtttttggacggattggcaagcctaattctagtttacaaggcttacttgaccagttcacagcccaaacgagccatgaactgacaacaccggtcaacttaactgagctcctcccagataccgggacggtctatcactacttgggctcattgacgacgccgccactaagtgaaaccgttgaatggtatgtctgtgccgatactgtcatgattggtgaacaacaattagctgcttatcagcaattatttgccgctaataaccgcaagattcaaccgttaaacgatcggccaatcattgccgaacgtttctaaataattttaatggggtgagctgatgcctaagaaagtaatctggggcttgattgcaagtggcctatttcttttattgatcgtcggtctcggactgacaacacaaatccatcaagataaagtcagtcacgtgattactgcgcaaaaacggccattgatcatgattggaggtagtagcagcacgcggactgactttgatgacatcgtccgttcacttaatgagcaacagcaccatccgctcatcaccctgactgttaaggcgaaccaaaaattggcgtttaaagaaaaacgcgtcgagaacaccaaccttaacgatgccctcatcgtgatctttttcgaagatagcacggactcaacagagaacattatgacccaaacgaacggcttagccaaagctattcgttatttgcaacgtcaccaacatctcaccacggccaacgcactcggttattcaaatggtggcctgatctggagtcgctatctagcaggtttgagctcgtccaaaccattagcagtccacgatttgatgttgattggcaccccattcttgggtactgatgctgcacatcctgataaaacgctctatacaccacttcttgatcacaagaaccaattcaagaaattgcatgcggtcatcaacattgccggtgacactggcgagggtaacgacgatatcgtaccgctcagcagtgtgaacgctggtggcaacttatttatgaacaatgttacccgctataccgccatgactgttaaccaaaaatcaattagtcacggtgacctgcttcacgaagcatatgttgcccggctcattcgtcaaaatctgatcaatcaatagtatctttagctttagctgataaaaaactgagccacccttcataatgatgaagtgatggctcagtttttttatgattgatcgtccgctatgactactggcgatcaaactatccaacaattttgtgtcacgagtagcccatacacgggttgcgcagggctcaaaggggcgccacgtcgattatgaattggcagtcgctacaaatcgagctagctcatcggtcgacataccggcactgacacccaccagtaacttaatccgggctttttgtccattcaatccctgacaaaaaatcacacccatttgttttaattgaacaccgccaccttcataagcatagacatcctgagcgataccgttgaagcaccgggaaaccagtacaaccggaatctgcatgtctaataatttttgcacagctggtaacgtcgccggcggcaaattccccgctcccaacgcttcaatgactacgccatgagtcgtgggttgcgcaatggcgtcaaatagttctggtcccatcccggcatatgctttgatcagaaaaacattatctgtgaccgtttgaatcgggcaaaccgttgaccgtagtaatgattcaaaaaagacaatgcctttattagcgactaacccaatcgggccaaaagtcggtgttctaaaagtggccacgttggtcgtatgcgtcttagtgacgtagcgggccgagtggatttcatcattcataaccactaaaacacctttttcggccgcatccggtgtactagccgtttgaatcgccgtttcgagattatgcagaccatccgacccaatctcattggcggaccgcattgcgccggtaatcacaacggggagctcattcggtaaagtaagatctagaaaatacgccgtttcttctagcgtatccgtaccgtgagtcacaaccaccccatcgaccccttcgtgtgcggccttatcgatccgttgctttaactgcaacatccgtgccggggtgatgtgcggcgacggcacgttaaagacgtcctcagtctctaactcaatatccgtgccaaatgaactctgataattgtctaaaggattttcatctccgggggtcacattgccggattcatcagccgacatcgcaatggtgccaccagtgtgtaataccaaaatcttcttcaagaatactcctcctcatcttttcacgtgcctacgcacatctaacagtaaaattattttaggcttgccatcgcctaattgcaatccaccctcactggttcttcatgacaacttccttagattctcatacaagtgatatcaactaaaaaaactatcaaccattcaaacaatttacaaaacctagcaaccagatcagtacgttttattagcctacatagtgctagtcactcaattagttcacttatcaactagttcgttaatcggttcgtcggttagttaccccttcaggacgaagtcactaacctcagtgcaccttattactcaatttcagtctcagggctaaccgattgactactcgctagacgttgataaatcagcgtttgacgtcccaatgactatcaagcgagaaaataatgattgacactcgcgttagttgcctttatagttagttacataagtaattaaccaaataacttaagagaggtatttaaaatgacaaccacaccaatcatgaccgtcagcgacctgcacaaaacgtatggtaaggcgggcagcaaacaatacgaagcgttaaaaggcattaatttcaatgtgcaaccaggggaatttgtcggaatcatgggcgcatctggttcagggaaaaccaccttgctcaatatgctggccacactggaccaaccaactagcggtgaagtgactattcatcaacaaccgattacacatctgaaaggcaatcaacttgctgatttccgggccaaagagattgggtttatcttccaagatttcaacttattagaaactatgactgcttacgagaatatcgccctaccattgtcgctgcaaaatacgccagtcaaaaagatcaagccagctgtcgaaaaagtcgcacaccaattgggaattgaagaattcctatcaaactatcctaatgaattatctggtggtcaaaagcaacgtgtggcagccgcacgagccttaatcaatgaccccgctattctatttggtgatgaaccaactggtgcccttgattctaagtcagcgcgtgaattactcgacctgttcaccaaaatcaaccaagaacgggctgtctctatcttgctggtgacccatgatccattttcagctagcttctgtcaacgaatcttattcatcaaagatggccggattgggcaagaacttaaacgtggggatttaagccgcagtgatttttatcaacaagtcctcgacaacctagggacgtttgaacagtaagccgaaacagtaaaaggagtcctttaaactatgttaactaaacttgccatgaccggcttaaaacaccgttggcgcgactacctcgttctcttttcaggactgatcatgtctagcgcaatcttctatatgtttgaagcactggccactaaccaagatttcttaaaacaaaatacgagtattagtatggtcggcctcatcttccaatttggttccgtactactcacaatcatcacattagtctacattggctatgctaactcattcttattaagtatgcgtaagcgagactacgggctcttcatgctcgttggtgcacgcaaaagtaagattggtcaattaatttggctggaaacactacttgtcggtatcactgcaaccattgtcggcattcttgtgggaacagccttaactgtcggcgtaagccagattctgattaacagtctaggcctgacgcttcaccattttacagcctggtacacgccagctgccattgcgacactgttactctacgttggattgttcttaattgccggtttattcaacctgctatccctgaccaagacaccagccttgaaattactacacagtaatgatcaacctaaccggccacaactaaaaccagcccgtcaactcatcgaaattgtcgtcggtgtcatttcaattgcaattggttactggtcaatggctaacctgaaaattttgcaactgatgggaattggaattgcgctcgtcacaattgttcttggaacttatctgctgtttaacgctatttttgtctggttaatggtcgcactcaaacgattctcatttgcccaacgtggtttgaatggcttcaccttatcacagctaagctttagaattcgtaattacactaagatgctgtcaattgtcgcaatgctattcgcactagctctcggcgcaattacagttggaatgggctttcacagtcaaattccatcaatggctaatattaataacgcttatgatatgggactggtcaacgctagtaccgctgaaaaagcacaaattgcagcgatgaagcccaagacaacggcgacctatcatttcaaagcaaccaagaaagtcgtttatttccaagctgctgaattcaatcggcaaccattcacgactattcatactcgcaataagaatcaactgacttttaataccgttcataataatgcggctaaattacaaaaatcagaagataattatcaactgatgcagcttcagagtggtgtcatggcaaccgcaacacccgtatttttatcaaaaacggcgtacgcgaaacttgcccagcctgaacagcgactaactgtgtttactaccaacaacgttatcgaacatcgcgttgcattgaacaaactggccaaacatcactttcacactaccagccctgaacaatttggaggtcgctatgcgatgtatctaatggttaacggcatgtactccgggctggaatttatgggtatgttcctcggaatcgcctttcttgcaatgctagctagttgcctgatgttcaagattctgtctggtgccgatgctgatcaacaccgttacaagatgctcgataaagttggaaccactagacgccagctcaacggtgccattaacaaagaaattgctgtgctctttattcttcctggaatcgttggtattgtacacgtcttgtttgggttacaaatgttcaaaatcataatggttacctcaccatataccggaatttggttaccattcttgatttttgccggtctctacctactttactatctcattacgatcaccatctatcggcgaatcgttttacaataacctttcggaggagggaaaaatcatggtatactttggattagtcgctttattaatcgttattacaccattacaccgttacgtgctcgcaagtcgtcgtcaattctggttaggggcgctcatgccgcttctgtggctgagcgttaacttcggtttagccacccagattatctttgaacatcaagacattctactggccgtactgggcaccctcctcctactctctagttggattgctgcccggatcgatcgtaccgaacgacaactgcaccagccgcaacaaaaggccacaacgaaatagggcaatcactgcaatgaggtgaataaaatgcagttcaactttaatagcacggaaccaatctacttgcaggttgccgaccaaattgaagaagctatctttacggaaaccttcgctgaaggtgaacaaattccttcgacaaccgagatttctaaagaatttcatattaatcctgcgaccgtgcttaagggcatgaatattctagttgatgcccaactgattgaaaaacggcgtggggtcgggatgtttgtcatcgccggtgcacaacaacgaatcgttgaaaagcgccgggatcagttctacaccgactacgttaaaaaactagttgctgaagcacaaaagctccacattacgcaagatgaattagctaaattaattgaacgggggttttccgaatcatgagtattcaagttcaggctgtccagcaggcctttcgcggtcaaaccgtcctggataatcttaacctaacgatcaaaccaaacacgatttacggtttgctaggccgcaatggtgctggtaaaagtaccttgctgaacattatcagcaatcgtatctttgctgacagcggaacggtcaccatggacaacgaatccatgtgtgataacgaccgcacgttaggaaaggtttacttgatgagtgaagttaacctctattctgagcgttcccgggtcaaacaactgtttaaaaccaccgcactactctatggtgattttaatgacacttatgctaaaaaactagcacaaacctttggcctcgatttaaacgcgcgatttggcaaattatcgacgggttaccgaacaatttttaaactgattattgcgttatgtgtaccggctgaatacatctttttagatgaaccagtcctcggtctggatgctaatcaccgcgaaattttctatcaagaactgattgaaacctatagtgaccatccccgcacattcgtgatttcgactcatctcattgaagaaattacgaacttgattgaacatgtctttgtgctggaccatcatcatattattgttgatggtgatgtcaccgacatcctagggcaatcttacgcggtaactggtccacaaactgatgtcagcacttatacggatggtttaaatattatcggcaaggatcatcttggcggaattacggcccactacgtttacgggccattagataacgaccgaccaattcctgatacggtcacggtcgagcatctggacctacaaaaactatttgttaacctgactaataccaaggaggaggccgccgctcatgtcaattaaggttcgcaacaccacccgttatttattaacggaacaattgaaaatgacggggtggtcggtactcgctttattcgtcgtattcggaatactaccactactatttgcagttattacgggtaatattcggcagtattctccacttggtaattttgctagcctaagcctcgggccactcttcttcatgcttatctttattgtggggtcactcacttacgacaactttaagctcttaatccaaaatgggatttcccgacaaacctactttcaagctcgagtattcgcattactcatgcttagtggtttgcttgtcatcatcaatgccatttattactacggtattcatgctccgtatttacactggagcaccaacaccgcgttgatgagaacgggctattcgctgtatagccatgcgctgggaaatcaggtctggctaaacattttagctagcttatgctttaactggattttctacattggcgttggccttaccggcatcgcttgtgggaccttactcgcgttatttggtaaatgggccaaaacgattttaatcattggcactcccatcattggcatgcttattatttggataatggtcatcattatgactcgcaatcaatcgaactataattacacggggcttgaaaacttcttgaaatttattattggttatcccagccacggtgaagcgacaactggttactttaacccaaccatgccattcatcacaatgctggtaggttgcggtatcattggtggtctcgcctatctgttcaaccgtaagttaagaatcagaaattaagctgataatctaaaaaatgaagcaggtcgtgaagttattgacttcacgacctgcttcattttttaatggttaatacaaacgtcacaccattcgagaagtggttttcccactaacgctacttttcaacctgcgtattttgcaaatccgtcttaaccacgattacatcagtcaacgcattacgctgcacatacgttgtaaccgagccttccagcacgcgttcaacggcatttaacccggttgcccccatcatgatcaagtcattatgatgatccttgacgaagtcctgtgaaataattggtttcggacttcccattcgaatgtggaaggcaatgtccgtaaagccatcctttttgacttgatcaaccgtttcttttaaataagcttcagaatcctgaaccaattgatacgtaatatcaccatccgccaaaccagctaaattatacccaaactgaccgggatcaatgactgctaacacgtcgatatgtgcctcattacgtttagcgactgcaactgctttatcaagcgcaatctcagcttgttgtgagccatcgaggggaactaaaatattcgaatattcttgtaccattgacgtcacgccctttccatctgttaattctattttaccatttatcagcgttggttgcgttatcatttatataaactaactaccagttatgcacagcagctcgccggctagcagtgtcgggtttacataatatttacaacaacgacatctgatatttacagttaccccttacaattggagttaatccacttgggggtgaatagtatgctttctttaggtattcgaccaggcctaatcgccagccatacaattgtaatcaacgatgccctttcatatcaaatccggttaagcaaattgcgtctcggacccgatgtctatcggctagacatccgtgcaaccactacactgggccgcttgaccgtgtcccacgcacattaccataactttgccacggcccagcaagcctttaatcatcagcgccaccaacttgaatcgcactaaaaatatccaacacgcagccatttaattatgataggatggtacctagtaataatcagctaaagtgagggtattcatctgtgggacaacttatcaaacaactctggcaacgctatcaaagcgtcctttcctatttaatctttgggggcttaaccaccctaattaatattattgtttttggaattttcaaccaattctggccctactggatagccaatacgattgcctggctcatctcagtgctattcgcctatatcacgaataaaatttgggtatttgactcacaaacacctactttccgtgctgttttaattgaaatgacatcattcttcggattccgcctactcagttactttattgaccaggggattatgattgtcggtatttcggttctgcacggaaacgaccttatcgtcaaattaattgatcaaattattgtggtattactcaattggttcttcagtaaactatttattttcaaggatcgtggtcattaaagcgaaccaacttaaacatcaaaacaagcgtcgtaggaatgtccgaaaattcctgcgacgcttattttattcataataattaccgacccatcttttttctgatacttaacttagctactattttagcaaccatatttttcacccaaactggcgttgcaccgtatgtaacgtcgctaactttgtgaccacatcatcaatattgaccccatcccaattataaaaaatatattggcgaccacagcgcatcttaatcaccaaatgacgtgctgatgaagcataaccattgcgaacttcggcctgatccgtcgtcaatgcatagtattgaatgtcatccgtatttaaagctaactctccaattcgtatcatgacttgttgactgacctcagtcggcggtcgaactgacaaacaagtcccatcatggtgctgataccgtaactctaccgcaactaaaccggccgcggttagctgtggtctaaaataaaactccgcgccaatatgcaacgcacttgacggccaaactgcggttagccgaaatttaaaatgccggccatgaaaatcagtcaggatgccttggtcgtaatctggttgcattaccgtaatatgcccaatcatgacgattcactcccttcacttagttattgataatgtatcacgcttcacaagcatagttgtgtttaaaacccataatcagtcgtttttaccattttttattaaaatagtaattaaattatccttactcatgctaatatttgagttaaccaactttattgattggaggtcccattttgatgacatttacaaatcaagaaactgactatcttatgaacctactaaccaaccagttaatggccctactaagccgcgtcacgcgctggcagacgcacagtctgagtcaacaccaatataaccaacaagtacacgaaacgctccaacccgaactgaacatgctcacgcaaatcactgctaaactccagggacaagcccgtgaccaaactcagctaggggccattcaaactggtttgaagaaacttcaagttgccaccacctatcagctaactgccgaccaacttgcacacgctaatgaacgccggctgaatcgccgataccgcgattaacttttacaacatcagcatatttaccaggagattcaaaactatttcgcaatccttaacagaaaattcaaatttcaatcacgagttagctactttttctcggtacaatggttttatcaactcatacaaccacttgactgaaggagggcttccatgttcttaattgtttactgtacgttcgctattgcagtttttttctggatattcggttacgttaaaaccgccgtcatcattggtatactggcactgagcttgattgcttactccttcattcgccgagagattactcgacgacgtttgctcaagcgacgcacggttaccaataaaagtcgttaaaaaaattccaacacgccggtgtcggaattttttggttatttttgcatttgtgataaacaagtgacgatccgctgagccgcctcacgcacattttgcggattagtcgctaagttcaagcgaacaaacccctgatcatcaggactaaaacactcaccaaagtcaactgcgagctgacattgatcttgaataaacgctttcgttgcagctggctgaacgtacgcgcgtaaatctagccacgtcaaatacgtcccctgcaaatcggctaaaaccaacttaggcgcgtgggcggcaaaggtggtgcataaataatgataattatcacggacgattgccaaaatctggtctaaccaggccgcgcccgattcataagccgtttggccggcaacctggcctaagacgctgatctcagtctggctgaagcgcccgatttgtgcatcatagcgttgtcgtaattttggattaggaattactagatgtgagttcaaaagcgccgccagattaaacgtcttagacggtgcattgacgacaatcacccggttactaaaccgcccattggctaccgttaacgccgatttgaacggatggttggtccgatcaatttctaaatcctggtgaatttcatctgaaataacaagcacatgatactgttcacataatgctaacagccgtgtctcttcatcttcagaccagattcgccccacaggattatgtggcgaacattgaatgaacaatcgcacctcgttcgccttaatttgctgttccacatcttcaaagtcaatcgtatagtgaccacgatcattgcgtaactcagatgtgaccagctgacgatgattatcccgcaccgcgttgaaaaatggatagtacacgggcgtcagaatcaaaacgccatcacctggttgcgttaaaatattaacgagcgcgtacaacgaattgaccacgccactaccaaatcgaatccaatcgtgtttcaatgtcagaccatggcgtgcctgttcccaatcgataaaggcttgataataacgatcaggcgtaatggaataaccataaatgccatgcgccactcgttcttgtagtgcttgcgtaacttgttctggcactttgaattccatgtcagcgacccacattgccaacaaatcaggattgccataccgagcttgtagtgcgtcccacttcaatgaatccgtatgctggcgcgttgttgcgtacttcttaataaatgctgcttgttccatcttaaaggccttctttctcaacaaaaaaacttcgtccttaacttactaaggacgaagtttatactccgcggtaccacctattattacagtcttgctgtcgctcacgcaacgtactcgttacgttcaacccaattatcggtggtcaatccgggctaatagcatcaaccattagccaactccgagttcatcttcacaataagctgatggtcaaattacaccactactttgactcgctaggcatcaacttattgttactcttctcatcaacatttaatcttcacgttgcttctaagttacaacgtgaagattaaaaagtcaacaacgtctttaaaattgcgcttgctctaaaacctggtagccatcgattcgttggtcagcggtaggaaacgccccggtctgtaagaaacgcttggcctgcatgacccgcggcgaactattcgaccaatttaattgatcaagtggcactcgagcggcccccgccgacattgattcggtgtaatgcggtcgtttgagcaacaaatggccccccaccggttccagtaaataataaatattaattaacgttgctggcaattctaatgttgttaaggctggaatcgtaagctggacggtcccaagttgctttgaaataacagtttgtagtcctgtttgaagttgtgcaatctgactaacggcctcactcaacgtggcccgtgtcgtcactggtgcggttactaaatcataacggttcttgaacggcccggttaaggatttattaaggaccatggccgtcgaatcaccaatgataccacaaacaaatagtggactaattgctggttcgttaatcatcaatcttttccttctctcagtcatacgattaaatagataaattaattagcctataaaaatataacagttacattttaccttagaattatgataaggttcctaaaaaaagcatgcgaatatgaatatttaacaacttttaataattctatgaaaaaaaccgaatcttggctactaaaacgcacaaggttcgattactttttttgttatttagttagattgcacatcggtcgtattaataaatgactgggctggcacacgaattaaccaccgcgtcatggcttgatgccccacatggacacctaagccattccagaatgacggctgataagtggctgtcagcttcactgcgtaggctttttcgtgctgccggtcttctttaaccagctgcttttgtgcccacggaatacccgcatccgccactttaacttgcgaaagattagtcaccacggtcgccttgttacttgaaacagtatatttcgcaccattaacccagtaattataaatatgcacgggtttttgggtcgtgccccgatccaccgcgacatagtaggaaccattagtcccaactcgcaaaaccagtggttcaacttgatacgttaccttaacgtccttagcatctgacaggtcgacctggtgattgaaagtcacgtatcccatgccaactagtaatccgagactaacgattaattcaacggtggtaatgataagatttccccactcaaacgtatgcttacgttccacgatcatcttgatgcgtcgtacgcgaatatgatgaaatacccacacgactaacgccaaaacaatgatccacgcaatgatcccaatccaattccatgcagaagtcattgattgccaaccctttctcaattacattattatgttctaattgtaaataatccaaccttaaataacaagtaatccagcaaattcaacacaatcattcagaagcagattgtgaaaataatcactgaaacggtgccaatgtaatcgaattcatggtaaaataaagttattaacttgtagaaagaaggagtacacatgatcgcgtcactaatttattgggtcgtcgttgttggcttgattgtttggggtgtttggatggccatcctttccgcatattgggccagccaaaaacaaaacggcaacattttctttattgcaattatgaatacattaggtgccttggccggcctcttagtatggtgggtcttcaacaatcaagactggcagtactactggttatccagcaccgttaagacaaccaacctcttaggcatcgtcctaatctgctacgttgtcttgattgtcatcgaattcattcaaggccggggcatcaagcctgagacagctaaataatgattattttaaacgccaagcaagttgctaggcgttttttattgtcaaatgcggcaacaatcttgctcttcagtgtttgttacggtgataacatttgatttgtcatgctgcatgcttcatcatgattaataaaaaaaaaacgattctcaaagacattgagaatcgtttttttataagcgactgtcctaatggcggctatcggtcttgaagatttcaactgggaaacacacagaacgctccaccagtcgacttgtgacactacttcacaactaagccacggttaattcaaagcctcccggtgccatctcatttgcggtaatacccgctgttaagattggcgatacgccacttactgttgagactgtctgtgcacctaaattaaagcggccttgaatcgtctgttcaacatccgtccgcgttaagattaagcagtgaccatcaatcgtccatgtcaattggctagttgctaaaaagtcggcctgttgccggcgaaacttgatcaaacgcgtgacaaattgtcgaacttgttgttcttgctcgtctggttgccagttcatgcaccgacgattgtcagggtcggcaccaccggccatggccacttccgttccataataaatacacgggctccccggcaatagcatcagtagcgtgagtgcagatttaaatttagttaactgaccatgcaacgtggtcagtagccgtggcgtatcatgcgtatccaacgcgttgaacatcgcctgttgattaggttgacgatacatcattaattccagattggttttaccaacgtaatcttcaaggttgagttgaccattaaacaacgccagaattggttgtgtcagtggataattcataaccgcgttaaactggccgttaccgactaacgattgactactatgccaagactcacctaataggtacacatcaggtttgattgcccgcaaggcaccacataacgctcgccagaaaccatggtcgacctcatcagcaacatcaaaacgccaagcgtcaatcccgaattgttcgatccaatatttggtcacatcaatcaagtaagcttgtaccgcggggttctgggtgttaactttcggcatcgctgctcccgtcgcaaaggtttcataattaagccgcttcgtcttcggatcacgtcccaccggccagccatgaatatgaaaccaatcagcaaaccgtgactgctcgccatttttaatcacatcttgccactgtggtgactgctcgccaaaatgattaaagacggcgtctaacatcacgcgcataccgcgcgcatgggcgccatcgactagcgcctgaaaatcggctttcgtaccaaagtggggatcgatttcaaaatgatcgatcgtatcatacttatgattagatggtgacgtgaaaatgggacacaggtacaggccattgacccccagtgcagccaaatcatctaaatgcgctgtaattccgggcaaatccccaccataaaatgaatcacggtgaacacgcccagcaccccacggttgaacattagccgggtcattttgccgcacaccatttgcaaaccgttcaggaaagatctggtaccagaccgtctccttaacccatgccggtggcagctccgcatcactgacgtgcatatatggcatgtgaaaatagttgcccactgtttgccagttagtggcaacgtcgtcaaagaagccaccctcaccatagccaaccgtcgcaccggtcgtatccgtgatcagaaaggcatagaccacccggttagtcggtacggtcagcgtcgtctgccagtactggttgccctgcgtcgctaatccgggctgcattatccgccgctctagcgctgttgttccttcttgccataagtaagaatcggcaaacaaaatctccacttgggcaacatcgtcacgcgcagtttgtagtcgtacctgtagttgatgtgcggctaagacggctgtatcttcactttcagggcggtgcctaattccagctagttgcattgtaagatctccttttgtgtaaacgattacattattaactagaccatttacgtcaattatcctcatgattttggtgaaaacgtccccgttcgcctcgattttagtgtatcatttagtcaaaatcagttgaaaggacgttatccatgaaaacactttatcgcagtacccgcgaaactgcaagtcacaccatgacgtcatcacaagccgtacttcaaggcctgacgccggatggtggtctctttgtgcccgtaacgctaccgaccgctaattttgacttcgaccagctcgccacgatgagctaccaagaagttgcttacgaggtccttaaactcttcttcacggattataccgctgatgaattacacgcctgcattgacgcggcttatggtgatcagtttgatgacccccaaattgcgccggtcaccaagcatggtcagcagtattaccttgaactttttcatggaccgaccattgcattcaaagacttggcccttcaaatcctaccgcatttgatgacaacggcagttaaaaagaaccatttacaagccgaagtcgttattttagcggccacctcgggcgatactggtaaagctgccatggccgggtttgccaatgttgatcagactcgcatcatcgtcttctacccaaaagatggtgtcagcgcaatccaaaaacagcagatggtgacccaaaccggagccaatactagtgttgttgcgatcaacggtaacttcgatgaggcccaaacaacggttaaaaaactgttaaacgaccaccaattacacgcggaattagccacccaccagttccaattctcaagcgctaattccatcaatattggtcgtttattcccacaagtggcctattatgtctacacctacgctcaacttatcaagcaggggcaaatcaagaacggtgatgagattaactttagtgttccaactgggaactttggggatattttagctggctactatgccaaacaactgggcacgcccattcataaactgatctgtgcttccaatcgcaataacgttctcaccgatttctttaataccgggacttatgataaaaaccgtgaattcttcttgacgagttcaccgtccatggacatcttagtctcaagtaacctggaacggctcctcttctacttgacaggatcagacgccacggcgactgctaaactaatgactgatttgcaaacgaccggccgttatacgattacaccggcaatgcgtgccaacttagctgatttttgggccggcttcgttactgaaagccaagatcaagctgaaattcatcacctgaaccatgcccatcactacacaatcgatccacatacggccgtggcctcggcggttgccaaacagtatcaagccgcaaccagagatcagcggcccatggtggttgtttcaaccgctagtccgtataaattcccacaggccgtcctaacggcaattactggtgagcttagtgcggtagatggcctagccgcagttgatcagttacatgagttgattcaaacgcccattccagcaacggtcacagccctccgtactgcgcccgtgcgccataagcgggttgcggatgttgatgatatgggaacgaccattaaaacaattttaaatcttaactagaaagtgtgaccaagatgattacgaccattgcgttagacctagataatacgttactaacttctgagaagacgatttctccgcgaactgaagcagttctcaaacagctgcattcggccggcaaacggatcgtactgtgtactgggcgaccaattaaggcgattcaaccatacttacaacaacttgaactcaaccaaccaactgactacgcgattacctttaatggtgggctcgttcagcaaaacacgactggtgacgtccttgctcgtactagtgtgaccaaacaagatttacaacccttatttgagcaagcccagcgcgatcatttctacttagacgtgattgatttgaagcaagtctactccattacggatctaggcaagtcaccgtacgaagaattcttgcaaggcttaatgccatttaagaatgttcgttttgccgacctgcctgctgatgatctattcggtaaagtcgttagtgctggtcaagatgctaaaacagtccaggccaaattaccaagtcaaattaccgatttcttccacgtggtcccatcccggcggactttgttggaattcttaccaccgcatactgataaggccagtggtttgaaacaactcctcggtcactttaatgaagactatgacaacttgatggcctttggggacgaagaaaacgacctaggaatgctaaccgccgccaaagttggcgtagcgatggcgaatgcgattcctgcggtcaaggccgcaaccacccatgccaccctgagtaatgacgaggacggggtcgccgttttcctagaaaattacttcaactgatcccaaactgaagcctgtaacgggcttcttttttagcacaaccactcaaaatcaaactaacgaggtgtcccatgcaagatccccgcattatcccagcagaattaacgactggcgcttttttcgatattttagcagatgaggaccacagcttaagttatattcaggttagtgaagaagacatgagtcaccagcacatcgatcaccccatgctggatcacgtgcacttcgaaaatgtccggtttacggccagtcaatttgaacggcttgacttgaccgatgctgtctttatcaattgtgacttttctaattgccagtttgaaaaagccagctggctacgcgttcaattcaaagattgtaagctcgtcggtgtcgacttgaacgaggctgccctcaataacgtcgcctttgaccactgtcagctcgacttagccatgctgtgcgacatgcggttcaaaaccgtgacctttgatcactgtcggctgaatggggccagctttatgaacaatcgactaacgaccgtcaagtttaacgaaaccaaccttgaccaagtcgctttcaacgataccgccctcaaaaatattgacctaagtacctgtcaattcgagcgtctcgaacttgatactgccgcagcacgcggtatgatcgtcaatattgatcaggctgcttatttggctgctgctttaaacggcatcaaagttaaaccctgataccggtggaacagtcaccgtatgagtgaccaactcacaatgccaaggacgattaagctgctggctggtaaatcttctaataacactgcacgtatctgtcagaatacttttcacgcgctgaacacaaaaataccacctccgtcaggtaacaacctgcgaaggtggtattttgtcgttcatcatgacaattcgaattgcgccccggtgtaaccagtgcggtcggccgccgtgattggtcgaataacttggcaagggttgccagccgcaatcacgttagctggaatatcgtgggttaccacgctcccaccaccaataatcgtgttagcaccaatggtcactcctggtaatacggtgacgttagcggctagccaacaaccatcaccaattgtgattggtcgggcgatgcagccgcccctaattcgttcggttgcatcaaacaagtggttgctcgtgtaaaggccgacttttggccccaacaagacctgactgccgatcgtaattggcgccccatctaacattacacaatcatagttggcataaaagttatcacctagatgaatgttccgtccaaattcaacgcgaaaattaggatttacaaatggcttgcgaccagctgaaccaaccaattgtcgcaataaagtttctttagtctctggatcagcagtcgcattgaccgcgttcgttgtcaacgtcgcttggtcacgcaacgccgttagttctgcatccgtatctcgatacggctgaccagtcgccatatacgcaaacttctcatctaaattcattccgcaccccacttctatcgaataaaattcaagtaccatgttattgcgcagattccttgtgctgaacgaatctggccattctttaataggtcaatcactttactgagcgggacaagttgcgtattcacgtattcgtccgcgtcaaaatgtcgttcgccatgttcttgcggatcaatgtgagtcaaaatcaagctgaccgtttcgtccgtaaaaccttccgacgagctaatttgcgtcataatttgtgattcatgggcaatgtagcccgtctcctcttgtaattcacgggccgcggccgttaacggatcttcccccgcattaatgaggccagcaggtaaactaatcgtctcggcattgcgaccgacccggtactctgaacctagcacgacttggtcatccgcggtgatggctaaaatcgtgacggcgttcccatgctgaatcaaatcgcgttttacttctaatccatcaggtgtttgaatcgtttgtttgaccaaatcaaaaatcggcccatgatacaccggtgtcgttgataggaccttaccgcgccggccaactttctcaaataaatctgccatacacattcactactccttaatctatctcaaatccggtacaccatccggcagcatcttacgaatgccacccgcggggtctggcacgtcaccttgatatcgcggtatcagatggagatgacaatgcattacggtttggcccgcagccggatcaacgttaatgccaatattatagccatccggatgattgtgcgcatctaggtacgcttttgcttgggtcagtaaggcgagcatcgcattcctggtcgccgtgggcacatcaaaatacgtggcataatgtgctttcggaataatcaacaaatgccccggactcaccggctttttatcgaagaaggccgctgctaggtcattctccaaaatatacggcaacggctgacaaaaaatacaagccataccaaagtccccttcctattttgctaaccaaccaccatcaattggaaccaccgtcccatgaatataatcagcgtgctgactcgctaagaatagcgtcagatctgcaacttcctgcggttgggcccaccgttttgcgggcgtctcactggcaacccatttcgccatcttaccatcgccagcaaaatcagcggcattcatcggggtatcgatagcccccggcgcaatgcagttggcgcgaattccctgagccgcatagtccaagtcaagttgtttcgtataaccaatgatggcgtgtttggctgcggtatacgctgcgccgcctccgccacccaccagtccagcgatcgatgccatattcacgaaaacgccgtgttgtgcggctaacattgcaggtagcaccgcattagtcacgataaactggcttgtcagatccgtcgccaaaatatcttgccacgttttcagatccgttgctaaagttggttgatagccgtctaacttaccggccgtattgcacacgacggttggcttgccgagtacgttaactcctgatttaatcgccgcgacgagcgcattagtgtcggtcacatcagcaatttcatagcgcagggctgacgtcgttactagcgctgatggctgtggttgccgatcaatggcaatcacgtcagccccctgggctaggaaactctggacctgggctaagccaatcccggaggcagctccagtaaccaagacagtctgtccacgatattcatcaaattgcattagtcaaccaactgccagtccgtcgctaaaatatcacaatctgttggtgaccacatactataggcttcatcggccgttttgattaaaaagtacgggttcagcgggtcgccgttgaaagtggttgccgtctgtaattcgacgaacaattcggtcccttcccaaccagtccgaacagcgcgcttaccagcttttaattcaggtaaaatagcttcaaatgtcatcatgatacctccaattattaatacccaaatcgtatcataatcccgcgtggagtgacaggcaaaaattggtaccaacaaattgtctattttactggtacggaccaattatttgtgcgataatgtaagcgaatacagaaactaattattatttggaggaattttaaatgagtaaactcggtgtttccgtttatcccgaacgatcaacctttgaaaaggatgcggcatacctcgatttagccgcaaaatatggctatcaacgggtattcacttcactgcttgaaatcaaaggggaccaagccgcagtggttgccaactttaaaaaagtgatcacttacgcgaaccaattagacttgcaagtaatggtcgacgtcaatcctgacctcttcaaacaacttggcgtgtcctatgacgacttgtcattcttccacgacctcggtgcctggggtgtccgcctcgacctaggattcactggtcaagaagaagcccggatgacgcacaacgaattcggcattaagattgaagtcaacatgtccaaagggactcactatgttgacacgattatggattattcacctgaaaaagataacttactaggctcacataacttctacccacaacaatacactggtcttggttatgattattttgttcagacttctgaacaataccgtcagtatggcatcaacaccgccgcgtttgtttcatcaaatgatgcgacttatgggccttggcccatgcaagacgggttatgtacccttgaagatcatcgggggttaccgattgcggcacaagttcaacatttgaaaatgacggggctgatcgacgacgttttaattggtaacgcctacgcgagtgaagccgaactaaaagcggctgctgaagtgttctttagtccttacccactgctacacgtcgaaaccgttgctgatctatcggcaattgaagaaaaagtactctttgcgcaaccacagacttatcgcggtgatttttcagattacgtcattcgttcttctcagacccgagtcatctacaaagacgaagcctttcctgctcatcacctagatgccattcataccggtgatgtcttgatcgataacgatgagtttgggcaatacaaaggtgaattgcagattgcacgccaaaatcttgaaaatactggccgaatcaatgtggttggtcatattactaagagtgacttaccttgccttaacttgctacaaccatgggccgactttaaatttgtcgctgccaaatagtactcaacgaatggaggggtcgcattaatgacaactgattaccgtttaactagcgatgctgaccgcgaagctttctaccaactttaccaatacgcgttcaataatcacgatacccccgcgcggcggcgatttttcatggatcgctaccaacatggctggatctacggccgtcacgatcatggtcaactggttagtgggctatacagtctgccactagcagtcaactttcatggcgtcacctaccggatgaatggtattggcgatgtgatgagtgcgcctgaatatgccggtcagggtggcgcgggacagttgctaacgacggcgctgacagaaatggcagccaaccacgtgacgctgtcctaccttgcccccttcgcgtacggttactatcgtcgttttggctatgaacacgtcttcgaccacgcgcaccaagtcatggccgctccagacctaccacgtgtcaaaccgacggactggtctggtacgatcacccgctatggcaatgacgggctggcccaaatcaacgatttttatgcacgacaaccgcaaaatcagcgtggtggtctgattcgaccagcctggtggcaacattacctgactctcaaacatcattggtcggtcgcaatttaccgcaatgcggctgccaatatcgagggctatttgatctatgaacggcaggccactaactttgcgattcaagaatgggtgactagcacgccgaccgctttcgaacgattggctaactttatcactaagcatggcaccacctttgaaacgtttagttatgatagcccaagtgcgaccaacggcttggacctactagccgacccataccgtttaaaagtgactgtccagccgtacatgatggcccgcattgttgatttatatgactttatcaagcgctatccgtttctcacggacatccaaccaattcgcctagcagtcagtgacgctaccctccctgctaatcaaggaatctggtcattgatgcggcacaacgggcaagtaacgctcaatcgggttagcgaccaattaactggaccggctgacattcagttaacgattcagcaattaaccactgcttgctttggcacccagagcttagcccgggcgtaccaacacggattaatcaccggtgatgtgaatgcaatcaaccgacttgacactagtctagttaaagaacgaccagcacttattgactacttctaagtgcttaatttagataagcagcatgactgactcaaagtgggccgccagaataatcattctggcggcccactttttgttcagacgctgactggtattgagatttgcatagattaagtcatttacgaatcagatggcaacagatactagcaccagtcgattaagctggagccgtgagcaaatcaacttaataataatgaattgccctcaaatcacggacctcattagtctccatgtttaagctaccttagcaaatacgttggttatttactcgacaggaatattccaacgcagtaggcttcaattgctattagaaagtgaggtcattattcgaataaatcacgttaatcatgatcatgctgtcgctatcactgcaacgccaacgacatttcccactaatacattaaacaaattatgccctattaccacgtgacctaaaccgaatttgctgaacacactgcaatctctaaaaaacaactgtcatttaccttgaaccgacgagccttcatgattatccttgtcgcccatcaaattaaaccagcaactagtttaaaagcacactgttgaatggcactggatttgaatatcgacttacaaactatcaaccataattcgaatccgatgtgattaaattcgaatgggcgactgcttaaatatgacagcaaccactatttttccaaaaagatctgtctctttcatttgagcaatcatgcttaatcttccagatatattcagaatcttcaccaactatacaaatacttaccggctacctgtttcatcatgactaggtgctgtctagcgaaaattgacaattcaattaaaaacattaaaattatattagattatccgtttttcatttctaatcaattcatactaccgaaaggaactcgccatggccatcaaacaacctgatttaaccatcaacattagtaatcatcaatctagcttgcaaatcttcaaagctgccgcaagtaatttcattagttcactaagcggtaaaatgttcacttttggccttggactcatgttactcgatgaaacacactctgccattagctttggtatcaacatgattatcagtccaattgttggcttgctttgccttgtcccaattggcaatctgattgatacttatccgcacaaaaccgttctcactggtagcctgactgcccgcacgcttgcactaattttattcgctgctagtatcaacttatttacggcaacagcaaaactcattccaatcgttctttttctaattatcgatgcaatttcgacaacccaaagtgcaatttctctttcctcgattctatcaccagcgttaggcgttggattatacagtttagtcggcttttctggcttcgttatattagagattgttgccacactcgcctcatttggcattatgctcacaatgaaatttcattatcacgcaactaatcaattcgctaattcacaacacgccccagtaacttcgcacagtcagtttgcaaaatttcattctggtctaaattacatgcggtcgcgaacaatgattaaaattacaattctgttgagtgttattctgaacttcttatatactgctgttacgattggaattccgtacatcttaaaagatcagcttcacacaggtaatggtcctattggcgtgcttgaaaccgggagcgcaattggtatgctacttggcagtctacttttaactttgctaccgccaaccggtcagaaacgtctctttttaaaattaattattccggtacttattcttgatagccaaatattgctattaggtgttctgttcatgacgtcccaatcaccaactggatatgccctgcttggtagctttatcatgggaatattggctttcgcgcttgttattcttaatataacttttcaggtctacttgcagcaaaccgtgccaactaaattactaggccgagtcgttgcaacattaacaacagtcaatagctcaatcatgccaatcggaacacttatgttcactttaatctttcaaagtaccactcatggcggtctcgtactaatcatcaacggaattctactacttgggtatacgttactgctgttgcggccattaaatcaggccattcatagtgaacagccatgagtcacgtatcatcaggcaattaacaatcccgattgcgatggaaaacgttgctttcgactttcaacgggctcaccaccgtgcttctatcacttcgagccctcataaaaccgccaataaacaaattattgattaacgaccgacataatacctaggaattataccagccaatgttacgatcaacatcacgaccaatcgttatgaacaactagcgcttttgcaacggcaaatagttattctattcaaaaaagatgtttgaagatccgactagatctccaaacatctttttactggcattatcctggttaatcaccagcatcgtgcgtaaataaaactaacgaatattaattgattaccaatgtaatattaaccatgtcttgacattaattttcatacaaataacccgcatcccgtaaagctgccttgatggctgttaattgttccggggtctgataagcaaccgtatggctatggacgccatctgttaattctgataataaatggccttgtaatttcttgagccggcccataaacagattaacatcaccaactgagcgaatctctaattcaccccggagccggccatacaatgggtgttcgacttcaacatccttgattatgccccctgcgtgaatgatcaaggccatttcctgcatcgcttcgtttggaaaatgacggcaaactaggacagcagttggctgatccgctttttctaattcatacccttgaagagtagcaacaatggccgttccgtgagccctcaataatgaaatatccccaacaatggtctgacgactaacgttaaactgcttcgctagcgttgttgcacttacggggacctgcgtttgcgataattttgatcgaatttgttcacgccgttctgatcctgtcatgactcacccttcttactctttcaatagaatcattctaccagaaaaccagtagaatagctttcatcaaatactaaattatgataaactaagttcatttatcataggtgtcaagacacctaaatcttaataacgggattgattagcaatgcgcaatttatctttattaaccgacttatacgaactctcaatggcaaatggatttcatcacgacttacctcagaccaacgccaccttcgaccttttttatcgccgggttcctgacaatggtagctttgtcattgcggccggcctccagcaagttgtcgaagctttacaagattttcattttaccaacagtgacctcgactacttccgtcaacttaacctatgggatgaatccttcttagccatgctggcaaattttaagttaacttgccaaattaaggcactaccagaaggaaccccggtctttcctcgtgaaccactattgacaattactggaccacttgagcaagcgcaattacttgaaacactcgtcttaaatatcgtcaatcaccaatcactgattgccactaaagctcgtcgactgagttatgctgcggcaggacgtccaattatggaattcggtgcgcgccgtgcgcaaggcccggacagcgcactttacggcacccgggcagccattattggtggcgccaatagtacttcaaacgttctcgctgcgaaactgtttgatattcccgttgctggtaccatggcccacagttggattgaagccttcccggatgaactaacggcgtttcgcaagtgggccgaacaatatcctgacaatagtgcgctactagtcgatacttatgatgtgcttaactctgggatccctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacttcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggtcagtgccagtcgcgaaaaactaacgattcctggtgataagcaagtctatcgtctgtacgaaccaggaactcagcgggcctttgctgacttgattgcactagctaccgagacgatcgtcgatgcgaccagcctaaccgtcgtcaacagtgacccactcagtgtcgaccgccaacagcgactcacccattttgaagcccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacaaccacactcagccagttacaaactagtttgttgaataaaatgacgatactagcagattaacaaacgaacacgcgtagcaacgactaaagccacttctgatcagcgttcaaatgaccgcttaatacagaagtggctttagtttataacaagtaacagttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatctgcttttagttgatttatgacacttcccatctgcttgaccatcttaggcgcaatctggctaagaatctgttcgcgtcgttcggcgtcaaaagctgccatttcaaaaatgacctttaactctttcacgttagctttagcaaatgcaactcggtccgtaaaaattgctgtgacgaatgcctgtagactgggataacgctgccgtaattcatcctctgaaaaatcactcgctaaaattggcacaatgtgtgcggcaattggtgctaagatggcatcccgtaaggcagccttagtcttataccgccgatagaccgtcccctccgcaacgccggcccgttgtgcaatatcactagtactagtctggtcaaaacccttttcagcaaacaaatcgagacttgcctggaggatggcccgttgcttaggtgtaatcgtttcattctgacttagatcatgttgaaaataatcccgtatccgtggtcgttccatatcctcacaccttccgataacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactcgccatgccatcgactggaatcaacccagcaaaaaagatttgtggtacaacaatcagtggaataaactgaatcatttgaaattctgagttagcaaaggtggaaataaagatacccaaggtcaaagccactaacgctaataataagttagtcagaaagaccagccaaatactaccaactaagtgaatcttgaagaccgtaattgcaaaaacaacggtcaggacagtctgaatgatggcaaagcccccataaccaattagatagcccataataatttcactccgtcgaattggagttgcaagtagccggcttagggttccagtagtgcgctcattcaaaagtgaaacgccagaaatcaagaacacaaagaagaagacaaagaaaccgagaaagattggcaaaaagttttcaaagaacgttgaatcactactaccataaatataatgactgctagtggtataggtcgtcgtttgtgattgactatttgttggcgccgcagcactcgctgtagcctgcctcaattgcttttgaattttagccgccgcagcagtattcccacttgcctgtgcttggaccaaggccgtctttagcttgctaaccgttgcctgtttttgcgccgcggtcaacttttgtagtgccacctgttgcgtttgcaacacctttttttgtgctttagtagccgtgaccaacgtttgaatttttaatttgaccagtccgctttgcaaagaagctttgatcaatgacgtattggtcggattactattagaatacgtgatcgttaagttgccatctttttgcgtcaaatatccatccaaatcatgctgcttaatcatcgcttttgcctggttactactgtaatggtgaatatcgacatgcttcgtattaatggctttgaccacctgatgatcaacattgtgaacacctaaagtcgccacttgagtcgtgttattttgaaacaaaaaatacatcaacgccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgctgcgggtgtcccctcagcaagcgcaatcccgtgccgaatcaacatgagataatcacaccgttctgcttcgtccatgacatgcgttgtcacgagcatcgacttaccggtatccttgagcttatttagttcggtccaaatttgttgccgtaattctggatcaatcccaacggtcggttcatctaaaatcaataattggggatcctgaatcagggcgattgccaacgacaagcgccgtttcatcccacccgaatagccactgacccgcttgtctaattgggacgtcaagtcaactaatccggctgcataatcaatcatctgtgctaactttatttttggaacactcattaattgcccaaaaaaggtcaggttttcacgggccgttagtgtctcatacaaggcgtcactttgggccatataccctacttgtgccattaccgccctattgggcatcaccgtatccataactttaacagtgccactatccacagcttccatccctaaaatactcttgatcaaggtggtcttcccagctcccgatggcccaatcaagccataaatcattccagccggcagtgtcaaatcaatctgattaagcacttgctgatgaccaaagtgcttgctgacctgcttggcgatgacataatccgttgccattttaataaccctctttctcgaagtgagtgtatactcactcacttaatggctttagtataatcagtacatctcggtttgtcaacagcaaaaatgagttgtcactcacttactttatttccagcccatttgtcaccgcactgcaaacaaaaatgcgccaccccgttgttgggatgtcgcattttaattaaatatcagcactgatataagcgttagcaatgttttaacgattgttaatcttggtcagcaatttttgtcctagctcataatccaactgacgctccgattccggcatcatgtcgccgccagttgcccagacaatgtgggtgacgtctttgccagcaagcgtgggaaattgggccatgatgggggcgatcgcggtaaagccggctgcagcggatggttcgaccattacatcttcggtatcgacgagcttcgtcaaataacgatataaatcatcatcttcaaatgttgctgttccgagtaatagcgtttgcatcaccttgcctgccaaccgtgatggccggctaacggctaacccatcagcggcagtcaggccatctaaaccaatgtcttgaacagcaattttttcattcagcttggtcatcatccctaaggtcacggacggcacgtgggtcggttcacaaaagacggggtaaatattggctcccataatcatcttgaggccaaaagcgacgccactaggactgccaccgaccccggccggtaaataaacgacaaccgggtgcgcagcatccatcttgatgccttgtacttttaattgatgttgtaaccgtaccccagcaacagcgtacccgaggaataagtcacgtgaaccttcatcatcaacaaagtgcgtatggtcatccttggccgcggcggcacgggccaccggaatcacacttgaaaagtcggtatttagttcctcaacggtgacgccatttgcccgcagtttgtccttcttccactgacgagcatcgtgagacatataaacggtcgtcttaaatccaaacgttgcggccatgatgcccacactgagtgccaagtttcccgtcgatgcaacgatgacgccgtattgtgcaaataactcgtgatacttagccgttgccaagacactgtaatcatccatatacgttaaatccgtatgggccatggctacctgttcagcaaacttgagcacttcgtaaatcccaccacgtgacttgatcgaacccgaaatcggcaactgactatcagcttttaaataaagctgccccgccaatgactggtggttgagagcctcccatgctggtttcatctgctcaagtggtaacaatggtgactcaataatcccattcatagctgccgtttctggaaaagcaacggccaaaaatggtgcgaaacgttcccaacgtgcgaccgcgtcaaaaatatcggcccgcgttaacggcaggtccgcccgcttcccataatctgggttctgccaaacaattggtcgttttgccatcaattccttaatctgtgggtgttcttcaatcattaccgttgtatccatactttcaggtccttttcatttaattgcatcatattacgtatcgtgagttaaaattatcagttttcgatggccgtctgcatgcgttcagcctattccgaccttccgagactaggtaacatactgaaacgtcaccacgatcagcacaaatgccgataagtcgatataacacgcactgagccaacaagcctcccccaacccgaccctttcaaccgaacctaagttagtggcttttctctgaatctaacgatttttaatcacaactcatgttagataatatgacatcaccttcgtccatcatttaaccatatttgatacttagaaacaatctttaggcactgattaacaataattgttgattagccaatcaaacaagctaataaggcaatcgaaaaacgacgttcaaagttcactcactttgaacgtcgtcttcaattagtggttattaattgactaataatcgtcgttcgaactgcataatcattcagtagtcttctagcacaacgagtttcctacttcaaatcggccccattcgtccgaatcactttttgataccagtagaacgaatccttcttcgagcgctctagtgtcccgttaccttcatcgtccttgtcgacgtagataaaaccgtaacgtttcgacatctgaccagttccagctgagaccaaatcgatacacccccacggcgtatagccaatcaagtcgaccccatcttcggtaacggccttgatcatttcactgatatgagcgcgtaaatagtcaatccggtaaggatcatgaatactaccatcggcttcgactttgtcgcgggcacccaacccattctcaacaatcatcattggcttgtgatagcggtcttgtaaccaattcaaagaataccgcaaaccttctggatcgattggccagtcccattcgctcgtcttcaaatatggattatcaacggcttcggtcccgacaaagtggtaacttgggttatcatcctgagcggcgaccgtgttggaattatagtaactaaagccaatataatcaacggtgccttccttcaagacttggcggtcttcggccgtgatatcagggcggaaaccagtctgtttgaagtaagcttccatattatttggataatagccccatgactgtacgtctgcaaaccaataacgccgctgcatagccttttcagcttgcatgatatcttgtggcttagcagttgcaggataaatcggtgtcatgttgatcatattgccaatctggaagtcgggattaatggcatggccaatcttaacggctagcgcactggcaacgacttcataatgagcagcttgatacatcaacgcttcagcgtcaggatcatcgggcttcaacactaaaccagaatccgtcgccatcaggaattggttcgtataagtcgtctgattattaatttcattgaaggtcatccagtacttaaccttgttcttatagcgcttgaagaccgtttcagcatagtgcacaaaaaagtcaataactttccgcgaacgccagccaccatattccttaactaagtggtacggcatttcaaagtgggccagcgtgatcactggttcgataccatattgccggcaagtatcgaacatatcatcatagaacttcaaacccacttcattgggttcttcttcatcaccatttggaaaaatccgcgtccaggcgatcgatgtccgaaaacacttgaagcccatctcagcaaatagcttgatatcttccttatagtgaccataaaagtcgatgccttcatggttcgggtaattcttacccgcaatcacaccatccgtgatttcacgaggaacaccgttggcaccggcagtcatgacatcagccacactgacccctttgccaccagcttgccagccgccttctagttgatgggctgcgaccgccccaccccataagaaatcagatcgtaaaccactcgttgttgccatgcattatcatcctttcactataaatctttaccatcactcgcaataacttgttggaaccagttaaaggagtctttcttagaacggtcaaaactgccttgaccattatcatcggcgtcaacataaatgaatccataccgtttcgccatttcaccagtacttgctgagaccaaatcaatacagccccacggtgtatagccaatcagatcaacaccatctaatacgaccgcttgttccatcgccaagatgtgatcacggaagtaactgatccggtagtcgtcatgtacactcccgtcggcttccttcttatcgtaagcaccaaagccattttcaacaatgaattgtggtaagtgccaccgatcttgcatccagttcatcgcatagcgcaacccagttggatcaatttgccagccccaatcagacttctcaacgtaggggttctcaacaaagtcatcgggttccttgaaatcgtaatcactgtcaccgtcacgaccctttgtaacaaatgacatgtaataactgaaaccaacgtaatccaccgtaccagcctttaaagttgccaagtcagcagcggtaatatccatatcgaagcccttgcgttcaaagtacttcggtaaccactttggatattcaccgagacagtggacatccccgaaccaataccgtttttgcatggcccgttccgccatcatcacatccgctggtttagctgttagtggatagattggacacatcgcgaccatacagccgatttgaaaatcaggattgattgcgtggcccgcttgcacagctagggcactcgctactaattcataatgagctgcttgatacatcgcctgttcccaattgtcatccttgctaagttgcaggccggaattttgtaacaatgggtgcggatcactccaagctgtttggttattgatttcgttgaaggtcatccaatacttgaccttatcctgatagcgcttgaagacggtcttcgcaaaatgaacaaagaagtcgatcatcttacggttgctgaaaccaccataaaccttcactaagtggtatggaatttcaaagtgtgacagggtcacaacgggttggatgccatgcgataataaatcatcgaataagtcatcgtaaaacttcaaaccagcttcgttaggctcgctctcatcaccattcgggaaaatccgggtccacgcgattgacgtccggaaacacttaaagcccatttcttcaaataatcgatcatcttctggatagcgatgataaaaatcattgccccagtgattaggatagatttcaccatctttgacgccatccgtgactttacggggaaccccgttacgtccggctgtcattacatcggcaatgctaacgcccttgccatcaacatcccaagcgccttctaattgatgggccgcgaccgcgccaccccacagaaaatctttgggcattttgtatccttttgtcatgaactaattccctccattaatgctgctcaggctatccctgagttacagtctttgttaccttaactaacgaaaagcgtgtaaccgccacgtcaccgttgttaagctgtctgccattataagcgaccacggcatgaatgaaaaaacaagcccagaccaacaccagcaggtatttgcctaggctcaaattaattaactacttcgcctcatcggcagctaaacgccgataaacgtctacaacttcaccagctaagtcgcggaaggtgatggcattcatgatgtgatcttgtgaatgtactaataacaatgacacgtgggtatgttccccttgtgcttccgccgttaacattgaggtttgtgaattgtgtgcttcggttagaaagttatctgcttcctttaacttggcatcagcggtttcaaagtcgccttccttagcagctttaattgcttcgaaagcggaactctttgcattaccaccattaacgatcaaacccataatggtttcgagacttgcttcaacttcttttgtttgttcttctgccatttaccctcatccttttagcatttattcgtgtgcatcacaatcaaaatgccaccggccgcgattgatctaccgtgggctggtagcacttacaatttaatgattagtttgcttttgcaattgatgcttcggcttcctttaaaactttttcgccgttcatcatgccgtagtcttgcatgttgataacttcaactggaatatcaacgcgcttttggaaatcacttaacatataacgaacttgtggtccaagcattaaaatgtcaggattcttttcagctaacttcgcatcagcgtcactggcagcggttgcaaaaatatctgcatcaatgccttctgcttccgcagccttttgcatctttgagactaataatgacgttgacatcccagcggcacataccaacataattgttctttcagccataataaacacgctcctagattgttttaaatttatatgttacagcggttgctttaataaaccgctttcattacaattagaattataagtcatgggtacaaatttgacaagccttattaatcagatatctgcaatttatttgatttgtacccacaaattattaaataacaacttaatattcgaaagaagtgaacaccatgtatcgtgacattgcaaccaaactcgttgccgccattcaagacggcatttttaccgtcaaactccccacggaagcccaattaatggaacgttaccaagctagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttccaagattctgacttttgatacgatccacggcgatagtgccctgagccgcaaactcaacattcccgtcgacgaagaactgtatcgtatcattcgcctccgctattggcacgaccaactgtattgtttggaaaaggcctactacttacgctctgtcgtcccctatctatcgaccgaagctgtcaatacgtcaatttgggacttcatcaacgaagcttacggcatcgggattgctaacagtgatgattatctttcactcaccaatcttaacaaggaagaggccgaactaatgaatttggcacagggcgcaactcacttggccttggattcttgtaactattataagaataatggcttactagatttttctcacaccatctttgtttatcccgaccttgcattgtattttcatacgacaaatcttgcaaataattaatttatggctaaaaaaagacgattcactataatttcatcacaatttatgggtatactagtaacagtatccaaatttacgatggaggaattagcgtgtcagcaccccttttttcagtggttgtaccagcttacaaccagcacaaatttatagatagctgcttgactagtctacaacgccaaaccttgacagactttgaagtcttcgtggttgatgattgttcgactgatgacactggtgaacagattgccgcgttaatcaaaggtgacgaccggttccacgtgatcactcacgcccataaccggggcgtctccgcagctcgtaactccggtatggctgctgctaagggtaagtacctttgctttgtcgatggcgacgattgggtcgaaccagactttctggcaaccttcctagccgcctaccggtcagcacccgatacccagctcgttgtatgcggtcactacggttacttagccgttccgagtcctgccaaaacatacaaccaaaaagacttgattgccaacatcaactttggcacggttggcggtttttcgtggaataaagcattcattcgcagtattattaccacgcatcacctcaagttcaacgaagatattgattttcttgaagaccagttgtttgcctttcgttacgctaactacgtacagtcctccgaatacgtaccggaccggacttaccattaccgttggcgttttcgaagcaaccttgctcacattggaattccattcttcaccgctcgtcgtaagatgatgaagattctcaagcaggaaaacaagcaagttttgaacgaagattggaataatcagtagcaacgttacgttgccatcgcctctaaaggtcggtagctgaaatagctatcaccctttaggggattttttgatacctagcataatcggctacgatgaccagaagatgcgcaattattcgaggctagtagccatccactcgcagcctcaaatgcgctttcgccgccgattaaaccgaccgtggcgcgaaacaagctagctgctcaagctctttttgatatcagcgacaaaataaagtggcaattaacaattaaagacttgttgaatgacgagtaacgctttacaattggactatattaattaatttgatgggagggttagcgatggctacgattcacttatacttagtccgtcatggacaaaccaagctcaacgcggccggccgtttacaaggcatctatgattcggaactcacacataccggtgtgcgctccgctcaacggttagcccgcatgctagcagatgttcatttcgacgctgcttacgtcagtgacttgggccgagcacaacaaacgagtcgcattatcaccgcactccatcctgaaataaaaaagccgacgattgacgtcggcttacgcgaatttaacttcggtgggcttgaaggtaccagaaacatgtggatcgtcaagcaagtccaaaaacaattgggtattggaacgtttgttaagttgatgttgagtcgtgaacgcttcgccaccctactatgggtctttaactccctcgaccagactcgtggcgccgagactttggtcggtgtcacggatcgaatcagtagcgcgctacgacgaatctgtttgtatgaatctcaggatagtcagcatgacaagaatattcttatcgtttctcacgggctggttctcagtgcattcctataccaaatcagcccccgtgagcttcccacccgactcctgaaaaatacaagtgttagtcgcgtggactacaaaaatcggcaattcaagttgatcgacattaatatcacccctaagaagcgggcctagttgtctcgatgctaacaggttgcgtggtacaactcggaaattgcaagcgcgcctgaataccaaaaaaggctttgattttgcgttgtaattcttgaccagttgcatgcactgaagcttcacttgcatctggatcgccaactacaattaaaatgcgactgcttttactatccaaattaggcctgattggggtggtagcatccgctgaaagactggccccctgtgccgttaaatgaagctgaacctgctcagtgccaagcgtattcatatcccacgcattgatctgcactggatggcgcgcgtgaatcacttgaagcaagtctgccaaagcattctgcggctgagcaacggcaagcccttgtgcagctaattgtttttcaattgctggattcaactcacggttatcaagattgctcatcgacaaaattgctaatggaatttccgtggtagtcgtcggtaaaatttcaattttcaacagttatcacttcctaaaaacacttcaatactaagtgtgccaaatttgacgtaaaagtcaattaccaccacttaagtcatagcaaaattttaataataccacaaaagcgattcccacacacgtgagaatcgcttttttaatggccttattgtcctcgtcgatacaccgatacgcttgtaagctgaccttacttagtcgttgataatgggtgggccgcgaagtatttttctaagaatagtgccaaaccatcattataattcatatcagttacatagttcgcaactttcttaacttgtggcaaggcgttgcccattgccaccgataagtcagcttctgccatcatcccaacgtcattcaagccatccccaaagacaaacgtgtgggcggcatcgacatgttgctcacgttgaatttgtttgaccgccgtccccttatccgtattcagaggaatcatctcaatattattcgggttcgatgatgaaagtcgcaacaatttactattagtgagcttttcgcgggcagaatccagccgtgacatgtcttcacgactgagaatgacgccgttcgtaatctggtcctcaatcgtggctaattgcgtaaagctcttcacttcttcatagccaatcgagacttcatccgcatcaaagttggccgcattacgagcaacgaaccgcggaatttgttccgtatagtaggccatgtctggcgtgaacaacatcattggtaagttatcacgacgcgcaatcagataggcaagctcaaccgcagcacccccgagtttggttagctcacggccctgggcaccatcgaacaccgccccattagatgtcaccaaacgaacgtcagcgtttactttgtctcgaacgatcttcgccagctcgtacatgcgccccgtagcgatgtaaaataacacgtcctgcttctgaaaccgttcaatcgtcgctcgagttcgctccgagacatattggtgatccgttaataatgttccgtcaatgtccataaagactaaatattttggcatagttgaactcctcctacgtatttacctatatgttgtgctagctaactgatcatctgtgacattcagcttgactgcttttgcttggtttgccaatcagtcggtaccatcctgccatcgtcagtaaatacgcaaattggcgtatccgcactgatgagtaagccggttggccggacttgaatgggcttaaattaaaaagatgacgcaccgccgccttttttagcaatcataattagcacaaggcttatttacactcccaattgtacgctattccctcctataatggaaatcgctttcaaaaccgaactagccaccgcattttcaccacgtaaggctaaacaatcttaagtttagaagctatttagagcattatttgccctcatcagctttatataccaaagaattcaatctcactacttgacattcactagtctagccgctaaattagagaacaattaataaatgatgataaaaagcattgaacagttcagtagttgccggtcgttagccttagcgagtctgagatggtgtgagcagacctaatccggtatcacgaatatcgactgtgagttgtatgggtgaaatcaagtaacccgtactggttaacacccactaacgtgtagtacatctttcatgatgtgcttaaggtcagtaatgtaaattgctgatgaataccggtggtaacccgcgctcgcgtccggcagacgacttcgtctgtcggacgtttttattttcatttattaataaatcattttaaaggatggtcatacatatgcattttacagtactcggcgcaggcgccatgggattacgttacggtgtgttattacaagaagcaggcaatcaagttgattttgtggatacttggcaagcaaatgttgatcaaattcatcgtcaaggtggcgtctacgtgtcgcgcgatcaccagaatcgacacttagttcccgtcaaagtctcaactcccgaagattataacgacgatcccgacgtgtgggtcgtatttactaaacagatgcaacttgctgattttttgactcggacggcccacgcttttaatggtcgccagtacgtgctcacttgcatgaatgggatgggtcacgttgcaaaattattacactacttcaaacccgaaaaattattagctgggaccgcactagtcgctacggtcttaaacggccctggtgatgtcgacttcattggagctcgcggcgccggcaccatgaatctcgccaattatacggaacaccctgacgaaatgacccaccgaatcgtgacagaattagataaatgccaattccaccctaatttaacaacgaacttccgcggcaccttgctggctaaagtcgtcttcaactcagtggtcaacaccctctgtaccctctttgaaattacgatgggcgaattcgcggcctatccaggggctgatgagctgagtcgtcaattgatcgatgaagcctatgatgtctgtgagcgtgatggtgtcaccatgttgaatacccgcgcggaagagctcgcctctgtcaactacgtcagcaaagtggctaatcccctccactacccatcgatgtatcaagatatgtctcataatcggccaactgaagtcgactatatcaatggctacctcgtcaagctcggccaaaagtaccattaccaagcaaaaacgcacgcgtttctgacccatctggttcacttagccgaaaccacccgccaaaccagtgccacaactgaacacactactgaacaaaatgctcagaacgcgaccgaacaggctagtcaacaagcaagtgcgtaaccgattccccttttctcagcaaaatcatgtacaatggagattaagttgattttactgaggaggcggtttgctgtgcaagtcagtcgggaattcaaaggtatctttcttgctagtatcagtgcgaccttctgggggatttccggagccgtcgcacaaacactttttgatacgaccgatattaattctatttggttaacgggaattcgcatgctgggtgccggaatcgcactattactggtcagtttgcttacccatgttgatttgtggtcgatttggcgtcaaccccgcgatctcctacagatcgtggcctacacactattgggtctaatgccggttcagttcacctactttttagcagttgaagctagtaacgcggcgaccggaacaattctacaattcatgggacccgtgttcattgctctgtggatgctagtcgctcatcggcaattgccgacccgtgcagaaggccttgcaattatttgtgcactactgggctcattcttgctcgtgactcacggcaaccctcagaccctagtcatctccgtctgggcgttgatctggggactcttatcgggggtctcgtccgctacgaataccttgctaccaaccaaactacttactaagtacgacccaatgaccgtcaacacctggtcaatgttgttagggggtatcttgtttaacatcgttcagccagtctggtcaatccatattccactgactatgcttaatatcagcaagttgacctttgttgtgctgtttggaacattgttagctttcctattcttcttgcaaagtttgcaatatatccggccaaccgttgtcagtctactagacgcttttgaacctttatccgcaaccatcattgcggtggttctactcggtgtcagcttcggttggctcgacattctgggcagtgtcctgattattagtaccgtctttattttggctattgggcagggtcccaatgatcgcacggcagagaatttcaagcaaccataaacgatgactcataattatgaaaccagtaaaagccggttgtgactaagtcctagtcacaaccggcttttacattgccgctaccgttacatatattcaattaataaccacgattcagatccacttggttacgtaccagcgtgccatctttgacaaactgtgcaaagttcgccgcaaagattggaaaaacggtcgcccgaaagtgggcaatttgacctgaaatatgtggcgtaatcagcacgtcatctcgttgccacaacgggtggtccgtcggtaatggctctggttcagtaacgtccaacgctgccatactgagttgatgatgatccagggcggtcattaacgctgtagtatcaaccgccggaccacgcccaatattaatcagcatcggttgctgtttggtctgctgaaataattcagtactaaacaaatgatgcgttgttggcgttaatggcaaagcgttgacaataaagttagccgttgctaacgcgtcggccgtcgcggtaaatgccactgtttcatgaaaatgatcagcggggtgaccggtcgtattgaccccaatcacgtgcatgcctaacgcactagccttagccgctaacgattgcccaatttggcccgtgccatatatcaacaactgttgcccggtcaaggtagatgtcgtcattggcaaggcccattgccgtgccccgcgctgattcagccaggccgcatggtacccccggactacgcttaacatcgcggctaagaccgattcactaatcgcatcggcgtgaataccactcgtgttcgcaaccaccaccccggccgcttgcaatgcctttaatggcaaataatcgacgccagctgaaatgacctgtacaaactttaactgattggttggccgcgctaggatcgtctttaataacggatgattaccatacatgacttcaatttggtcgtaatcagccgccgtgaccgccgccgcatccttgaacgtccagtccggataagtggtttgtaactgttgcagctgttcaggtttggttgcttgagccatcaataccattggcataacttattaccccatttctaatttcttgatcaatacttttatcataccactatcattcacttgaaccgtaatgatccacaaccggatattagctaagattggccaataagttaggctgacccttttttagcccacagtttggtttaaatcacaatgtttgacgctactgctgacaaacggctcacaaaataccaacaaaaaagcgatgttcgaaagtcgcactcccgagcatcgccaatcggtaactaacctaattgggtttaatcgttgaccaattatttaacaaccgcaaagccaccggtccagccgatttgttcactggctgctaatgtcatttgcataaaccccatcgcttcaagctcacgggcccgctttaacttacctgcatccttcacttctaacggactgtcagccaaggcgcgggtgaagcgttgcttggcgctatcgtcattaccagcaactaacacggttgttggttccttaccattgacctgcccactctgaagcgtcgccgcaaaagtcgtattgaaagccttgagcacctgactatctggtagttgctgctgtaattcttgggcagccgaactatcagctggaacaaccaagtcatcccacgtgtcaaaattcaaggggttcgtgatatcaacgacgattttgcccttcaactgagtcgcgtactgtttagccagcgcagctaaagcgggataaggtaccgccatgatcacgatttcaccgagcgttgtggcttggtccttggaaccataataagtgacctcgtgcccagcgatttcaaaattatgaccaattgcttgccccatgttgcccttaccaaaaattgtgatttccatatcaaaacacgcctctttcgctttataattaattttatatttacattctaacattgatgtcccatttacatcacttttatgtctgacagttaccgcaaaccggtcgtcaatcgccctagctagtagtcgctccttgaatgacgacaattagtggaactaatggctaatcagctcggatattcacctgcctgcacgcttcccaggttattgacacgagtcgatcagtcactaacgaccaaaaaccgaccaacttaattatgaattaattaagctggccggtttttaaattttcagtcgatcatcaagtttactggtctgttacccccaaaaattaattattgcccgttgccgtactataaccatctgtagaagaagcagtgccaccggtcgttgttgaagacgtatctccataattcgtcgttgagctactatcggtgtttgcactataactgtagctaggcgtacttgagcttgacgttgccgagctcgtgtccgtatcgttgctataactatgcgttgaagccgaactactgttgtcactactttcactataagtcgaatatgatgaactcgacgatgattctggttcactatagctatacgtgctcgaacttgaggttgaagacgatgcgttattcgctttcgccaacttcttgcgatccgtaatcaacttctggtaatcatcggccgctaactgcgactttttgcgataagctttcaggtttgcaagtactttatcgactgtcgttgacggggtcgaagccttgagtttatttttcttgttatataatttttgaaaatcagcatcatagctgaccactttcttaaccgtttttcccgttgtcgtaaacaacttgtcatacttcttagcaaagtacggcttactactcgttaagccagcagtcgtcaaccgctgctgacccttagtaatggtgtccatggtcacgtcggtcttaagtaaccccttagcgttgcgtaaatcttggtaactagtccggaccgtcaacatcttagcagccgtatcatgctgtttctgcaaacgggtcttttcacttgaatccttcatattatcaatattattttgcaacttggtcaaagtcgagcttgaggcactcgcccgcaagtcccgttgggctgatgatgtataaacttggtccacgatcttttccgcattggttcgtgccgcagcttgagtggcttgcccatggttccacatgaagaaagctccaccagcagcaacaaccagaatcgcaacaccagccaacatcaacttccagttatagcgccgagctggcttcttaagatgtggattcttttcatccgtttctaactcagaaaagtcacggtcgtcatccggctgatcatcatgtggtacccgctgttcttcgtgccgagcgacccgtgacatggttggcttattgggctgcttgccaccgttgggctgctgatcaccatacaactcttcacgtgataatggtaactcaggctgcgtgtcatcatccgcttgttccgtccccttgaccgcaatccgcggttgctgtttacgagcaaccggtggaatatgatcagctgggatgcgcctttcgaccttcggctgtttagcagcagtcgcttgcggatccttagcggttgtggccgtggcctgagatacagcagcctttgatgtcgctgacttggggactgtggacttcggggccgtggattgtgctaccgcagatgcggcggccgcggcactcgatgtcgaagcactagactgttgactgtgcgtcttggcctgactggcagcttcctgactagcacgccgggccatccgcgtcattggaacttccgacgttgccgccgactgatgaaccttggtacttgctgttgttttagccacacgcttctgatcagacactgcggtgctggttgcttgtgacgcttccttagcggcccgcgctggtgccgattgagccgcactagctgtcgtcgaagctgcgtgcttgaaacgctggtcacttactgcctgtgatgagaccgcgctggccgtctttggcgccgcctgacttgctgttgaggccggtttagttgcggcggactttttagttatttgcgcggattccgcctttgccgacgactgagaaccagccgagcctttttgcttaaccgcactagtcgccccatgcttgacgggtgccgtcgattgttttgcagcctggcgatcgtctccggaatggcgcgcttttttagccaccttttctggttcaattactgcgtcaacaggttgcttttcggcactgttattcgccgtcgagcggggaatattgaccgttgattttgcttcggcttcgtccgcctttgatgcggccgagtctttcagatcataggccaaggggatctgttcattatcttgttcagtactatcatcgtcgggaattggctcagtaatcgaattccagagccgtctacccaatccttcttttttattttttctagacaaaaccaacgctcctcgccaatttataatttacattagattcctggttaagcgccgaccaaaaatttttatcaatttcggtaaaataaccattaatagttaaattatagcatggaattggctactgagaaaccactggtcaagcggatttgtgaataactgcccaataccttaaattaaggttaaaactctgctataatcggcttatcaagatatttgaaagcgaggagttcatatggctactgcgaaagttatttttgctaccattaccggtaacaacgaagacgttgccgatattattactgaaaaattcgaaaaacttggggtcgatgttgccaaagaagaaatctcgcaagccgacgcaactgaattcaacgatgttgatatttgtgttgtcgtcccttacacctacgatgagggcgccctccctgaagagggactcgacttctacgaggacttacaggatttggatttaaccggtaagatttacggctgtgccggctctggcgatactttctatgatgatgattattgccgtgccgtcaccgatttcagtaacgcgttaaagaaggctggagctactcagggtgccaaggacgtgttcgttaaccttgcaccagaagctgatgatgtaaaagccctggatgcatttactgaacaactcgttgctaaagttcagtaacctgactagtttgattgagtgaataacaaagaaacgcttcaagaattcatgactaattcttgaagcgtttcttttattaactgttatcgacacatcatcctgacgctgataccgaaaatcacaatcaccgtaatcacttttattcagtccttacgatttcgagcacgttgtttaatggcgtttcacacgccgaaatccgagccaactaccgaacatggtcaaccccaatagcactgttcccatcacatttgcacgacttggcgcttcaccagtttgcggtaaagccgatgtgccgagtttggccgttgcgggctgaacagctaccgaagctgattcagtcggccgtgattcttgatgatgaccggcaacgatagtttgcgcgtgttgtgaactaactgtgttggacgtttggctccgatgcggccatgaagtgactactgatttagccccattagccgtcgtttgcatgccagaattacgatccgcaccctttccatgattcgtgccaaccgcgggtgttgcgtcatcaataactgcatttgcatcaacgtcagccgcatcaccctccatctggtcagcatcatccgtaggtatttctgcttgatcatcaccatcgatacttccagtcgagccgccgttcacatcgtcattggtattggtagcgcctggctgttcagtattcgtatcgccatcgctcgccgcaacgaccgtgactgttgccacgcgagtgaaaacttgaccactcgcatccgtatactgataagtcacctggtaaacaccggcttgattagtatcgaccgtgccagttacgactaggtcagcaagcgacaattcaccgccattaacatccgtagccaagactaaattatcgcttggttgccacgactcaccgacagtaatagttgaatcatgaatctgtaaatcgctttgggattccgcctgttcgtcggcctcctcgataaccaccgttaccgtcatcgttgccgtcaccaactgaccagtcttgtcagtaaattgatacgtcaaccgatagtccccggctgtagtccaatctggcgttccaacgacctcaatggccgaccagtctaacgtttgaccatcactatcagtggcattctgaaaattgctttggggctgccaagtactggttccctgcccatccgtatgcaccgttgcgtggttttgatataagttcaaactggcttggttttccttaacagttacagtaatcgtctgcgtctgactaccatacgtgtaagtaatctggtaatcacccggaaccatggtgttcacttcacctgttatcgtcacatcgttaaagtcgatggcgtgaccgtctttatccgtcgccccgtcaaaaccgtcctgcgcatgccaagtgccaccagcgtgtaactctgtatcatggacagtcaaacttgtctggtcagctttcacgatcaccaaagcagtgaccgtcttacctgcatacttgaaagtgacctggtaagtacccggctgacttgtatttactcggtcacccgatagtttcacagcctggggattagccacatagagggcctgaacatcgactttttgaccaaattggtcggttaaactctcgatactgtccgtccagttccaatcatcgccaacttccagggtaatgtcgttggcatcgataactgcttggtttgcttcccagatgtaggttccaatcggcgtattttttcctgaatacagattcatcagttcagcactagttaaccgttgctggggattggctacatttatccagtaaccggtatattggtcattagcttcaatgtccattagcccaaccgactcgattttggctggcgtcaaatcagtatccggaccaagtgtaattttttgtagacgctcacatcccgcaaacatgtcgagattttgttcaacgcgatgcaaattaaaaccagatagatccacctcagttaaattggaacatcctgaaaatagcaaatgaatccaagtaacctgatctgttttgaactgagacccgaatttaacactggttaagttgtgcatgtccataaaccaagcagccatattgtcaaggctatcagtcttccatttggataagtctagctccgacaaccccgttttgataaacaaaccgcctgcttcttttaggctttcaaagttcaaattctcgataccaataatacgagttaacttttcattgggaccaaacatgtagtccgcttcacttactcgacgagtgtcccaccctgaaatattgattgtcgttagttggctagtccctggagaattgaaaaacaggtaagacatatcagtcacatttcccacctgccagctgctcaaatctagctccttaacatgcgtattttctgaaaagaaatatcttaaatccgtcgcagaactaacatcaattttttcaagcccttcatagtgttcaacattcgtcaaattttcaaagaagcccccactatcacctataatgcgaattggctttgaaatcacaactttaactatttgtaacacccacgattttgattgccacggactatccccatagcaatcgtaaatatcgccaccgtccaacactaacacaccagaatccgcgtcaaaatgccatttaatgccatcggcgttgtaaccagcaccccagatgccggccatcgagtcatcgtcttccatatcatcgttgcgataaccatccgtgagatgtgggcgttctggatttcgaatcacgccagccaaatcaccgcttccccgctcattgatggtttccgttttatgctgcgacgacaagacttttgcagtactatccgtgtcaatatcttgcgactgctcgtcggcactaactggctgttcagaatcatcagttgtcgattggttcggatgcgtatcaagtgttgcagtatgttcgtctgacggaacgggggtctcactgtcaacttgatccgtgaccggtacactgacctgatcagaattcgcatgctcatcatcagattgattgacaatctcatcagtatactgttcttcagcggcctgcactttaattggttgagcttcagttaccagttcactcattgcggattcatccatggcgtccgttactggggattgctgctcagcgttaccttcagacaaagttgccactgccggttcagtcaatgcttctacgtgtgttgattcatctgctcgtcccgtcaccacattcatgttcaacgtaacgagcgtgattccagcgaacaaccacaccttaccactcttgtacatcttgtaccgtttcttcacttgttccattaatttctcactcctttattaattaaccttgccgacgtttaatgccgacgatgctggctaaaccagtcaccattaacatcatgagtcccagcaacccgaagcgattaacttgttcgctagtttgcggtagctcaccagctactgacgctggatggctgactggggccatagtcacttccggtttagctgtatcagccttagcataacgtttagcatcaattccgtcctcattgcgttcagccgtattcagtttcaagttatcacgaaacaccgtggtcacttgcttctctaaaccaccgttaaattctggtcgcactatcgtgtctgcttgctccctttgactgctggaaccagcgtttgcgcccgttaaaccactgttaggatcactagtatcagggtgttcagtagttcccggttgttctgattgttcaggaacttccggcagttctggttgatcaggtgtccctggcgctgacggttcccctggtgtttcgggggtttcaggggtttcaggggtttcaggctgttcgggtgttcctggttcttccggtaactccggttcagctggttctcccggtaacggcgtttcaccattgccagcaccttcgactaccgtaatggtggctgtttgagtccactgcaggccattggcgttcgtgtattgatacgtgatttcataagtaccgggttgcgtcgtgtcaacgtcaccaatcacaactaagtccgctagtgttaatggccgtcccgtcgcatcactggcacttacgaagttgtctgccgcctgccagtggtcgccaactgtcaccgttgtatcttgaacaaccagttctgtcaggtcttcaacgtcagcctcttgttcagtcaccgtgacggtcgttgtcgccgtgactaactgtccggtcaagtcagtgaactgataaacgacctcatatgtccccggccgtgttaagtctggttctccaagcaccgtcacgttctgccattccactgaacggccatctgcatccgttgcactcgcaaaattatcccgtgggcgccagacagcgcttcccgttgcgggatcaatttcaaccgcaacttcttgcgcatgcaaatttagttgactttgattagccacaaccgtgacaaccacgtttgtttgccgacccgcataagttagtatcacgtgatacgaccctggccggctggtgtcaacaggctcaccgctaactgtcaccgcttgggggtctgtactgaacaagactcctggatcaactaactggccattttgatcaactagttgcgcaatattttgtgtccagtcccatttttgattcaagaagagcgtgctgtctttaccggtaatcgcggccgcagagacggtttcccagacaaacgccgccgtgtcagcgtggtttcccgaatattgcgccaggagttcagcactcgtaaacgtttgcgagctatcagctacgttgacccatttgccggtatatttgctattcttaggcacttccggtaaatcaactaagggttgcgtgccgtgttgactaaaatcaagtcccggaccaagtgtcaacgtttgcaaacttgtcaaaccagctagcatttgccagttttgttcaacactctgcatattgaaatgggacaagtcgagcacctttagtttggcatcatcattaaacaaactattgatttgagtgactttagcgacggtaaactgcgtaccgaattcgatacgctccaaatcggacatctgcgcaaaggcaccatcgatttcaaccaggctggctgaatcaaagctcgtcagattcaagtgacggacgcctgtgcgcgcaaacatgttagccatcgtcgtcacactgcgcgtatcccagtcagtcaaaccgtcaatagttcgaagttggccgttgaactggaacatattttgcatgttggcgacattatgagtatcccagccactgagattaaggtatttaagttcagtacccatgaagttccccataaacatgttcaccattgtggtcacattgccgacttgccaagcactcaagtccagtcgctctagcgaggtattttctttgaacagagactgcatgttggtcacagcactggtatcaatcttttctaacccttcgtaacgcgtcacgctgtcaagattcgcaaacagactattcatgttagtaccggcaacaattttgtcagcaatcacgatacacttgatcatcggcgcccaagacttgcgacgccaaggattatccccataactgttatttaacgttcccccgttcagcgttagcgtgcctgtactggcatcaaagtgccaatcaacgccaaagttaccagacatttcatcctcatccgccctagtcacagcacgagtatcaacgtgctgtgactccaccttaaggtcatctaccagctgatgctgctcaacatgttgcaagtcagcggcgggtttacgttctgacgcgtcagcagtatcgagtaataactgttcactcgcttcaggctgttgttcactaacagtcgattctgcggcattactgaacagatcgtcagtccgtgatgcttcataactgttcgtcgcgggcgctaccgtgtttagtccgttcactgctgccatcgaatcagcggctacctcactattgggcgcgccagatgtcccgttcaacgcagccgttgatgcagcggattgcggctcgtcattagtagctggctgtgcatcgattaccgtctgattagtaatcgaagcgttctcatcattagccacgacaacgttatccgttttagaaaccgaacttgccagtgtttgattgctgctaccttgattttgaattgacacaccgttagtcgctacgacactcgtttcgctagtcgatgcagatgttggttcatccgcatgtgcggttaacagttgagtattcaacaataatagtgaagcgctcgcaaacaaccacatcttgccacttttatacattttataacatttcacttctgattcacggtaattgatagtaattccccatttcttcaaaaacaacctaactgacctaacgattaatctcattaaataaagtgttcttactatatttgattatcgtgtttaactagtacatcatttacggtttttaaatataccatggtaccctcataatgctcaactgattatcacaattctaattaacctgttatcattatgattaatccgcttgtttatcgcaaaaatataattatcaactccctatttctgcaatcgttttcatcgtggtgattcattaattctggtcgttttagtattcgaccaccactattcgttcaccatactgacagttgcatcatgcaccggtcagctgtcaccatggcgactgaccagtgtcttccagtaatccccggccatcaaaaaagccttgagcaatattactgctcaagacctggtttacccattctaatagcgtatttccctaatttgaatcgaaagactccccccgcgtaatcatgagctagtagatacgataattgtcactcggccccgagtcatttggatcgtcgtttcacaacgatttgtcgaatcgcattataaactagctcaacgatgacaaacagcaccgtgatacccacaatatcaattaaatacgaactaagtcgatagcccaccttgccgatccacaaatcatacggcccttgaatcagtaagaaatagatgactaacgtttcaaaaatcgtccgggtatgccgccaaaacgatcgccattgcattgatttcacgccccttcaagtggtgccaacatttgtaacgcctgtttgacctgactcactgctaattgactttgatcaccgacccggccgacgtgtccaaaggcaactgccgaccccgtcaactgactacagacactgttataacgaccaaacttgcccgtcgccgttgccacgattggcacaactaattgctgccgtgcttgctcagttgccgccattaatgccaacaccgtctgtgcatcatgtccagccactgtcacccgcacgacatcagcaccagttgctgctaattcgtgataagtcgccaataaatcgtcagttgttgctgtcgtgacggtctggctcgcaattaaccgaatttcgttgtcacgcatctgtttggtcaacgtcataaaatctggctgattgaccatggctaagtcaatatccacgccagccacgcttcgattattcactaatgtttgataagtttgataatattcggtcacttcagctggatcgtttgccagcccaaacatggcaattaatggaatcgtccccaaaacttgttgcaattgggccgctgtattgactaactccgcacggttatccaattcctgataaggatctaaccgccaaacaacaatttgtgccaccgaagttaaaatctgccccgctttacgcaagaggtcctcccgtgtggcccccgctaaaacaacaccaatcttaggcatccctgtcgctaacgttaactccccaactgtaacttctttcaagaccattcctgctttcattttcattcgaacaatgcgcgtccgttgccgttaaattttatctactcttaacaatagcaaattttcgctgttttgacactcaaaattcattttttgacttaaaatttaaagcgcttttaatattaacttgttaatactggcatcgctttcagtttggccttacaattaagcatactttagctcacaaaggagttcaacatggaaaacgaaaaacaacttcgatggtccaacattgctttaattgcattcgtggcggtctggggcctaggtaacgttgtcaataattttgcgttacaagggctttcagtcgtcacttcttggattttgatcatgattatttattttattccctacaccttgattgtgggtcaactgggttcgacctttaaggatgctgaggggggcgtctcatcttggattcgagcaacgagtaccaagcgcctagcttactatgctgcctggacttattggatcgtgcacattccgtacttagcacaaaaaccccaagggattctaattgcattcagctggctgttccgcggtaatgggaacttcgtcaacacgacacctgcgttagtcgttcaagccatttgtttagtactattcttattcttcctctggattgcttcattgggactaacgacactgaaacgcatcgggagcgttgctggtacggggatgttcatcatgtcgattttattcatcatcttggccgtatcagcaccgtttatgaccaaggcgactgttcagacaccgaacatgttttcactcaagtcctacttacctaagtttgactttacctactttacgaccgtttcaatgttagtcttcgcggtcgggggatctgaaaagatttcgccgtacgttaataaaaccaaaaatccgggacgtgagtttccgttaggcatgttagtgctcgcaggtatggtcgcaatctgtgccctgctgggttcatttgccatggggattctgtttaactccaagcacattcccgctgatttgatggccaacggtgcttactacgcgtttcaacgactaggtgccttctaccacgtgggcaatctgttcttgatcctctacgcaattgccaatgtgcttgcccaaatctccgccttagcgttctcaatcgatgcgccattgaagattttgcttggtgatgccgaccctgaatttattcccaaaaaattaagtaaaatgaacaagaaggatgtgcccgtcaacggttacatcttaactggggttttggtcagcattctcattatcattcctgcattagggattggaaacatgaatgaactctttaattggttattgaacttaaattcggtcgtaatgccgatgcgctacctgtgggtctttctagcttacatgctactcaacaagcacttaaaggaattcaagagtgattacaagttcctgaaaaacccagtcgctggccgtttggtcggtgcttggtgcttcctgtttacagcatttgcttgcatcctcggaatggttccaaagacttcctacgctagcaatcctagcagttggctcttccaactgactttaaatattctaacgccaattatctttgttgccttagggatgattttgccgatgattgctcgtcgtcatcgcactaaaaccgcttagtgcgtcaccgatctttacgcccgcatcgtcgctctacgcctgcggactcactgacttttttgtaacgttgatcgataatctattcgccaccgctgacagcgcaaaaaactgtcagcgatggttttggtattaccaaccgttgctagtaggcatgcgtgttcacgtaacatttcagtcactaatttgcggctcacaatcttacactttttacacgtttagcggtatgattcttagtgaatatagtcaatccaaatttaccaagcagtcgctcttcaaggaggttcttattatggctaccgtcgacgctctcgacatgtttttgaccgattatgccaatatctctcgttacctgaatactcgcttaaattcactactggccacgcaacatcttacctttgacgcttttttaatcatgcatgaaataggtcaaagcccccagccactattattaatggagatcgcacatcagcaccatgtctcacgcagcgcaatctcacgccaaatcggagtcctcctcaaacatcgatacattgagcaacaggctaatgccactgatcgccgccaaaaaggactttccttaacggctaccggccgtcacctagatcagcaactaatggccaccatgcacaaaacggttcaccagtggacgactcaattgggcccgcaacgggtgaagaccctgctaggcatcttcactgactttaacgagcaaattatcaataatgaggttcccgccagcgattaataaccagccatcctcagcttcatcattcggcattagtcgtaacgtgccccattttagtaagctgatttttattcgtcgccatttcaagttacggcttttaaaggccttaatcaaaaaacggcgccatggatgctagtgattctagcgtccatggcgtcgttaattttcagttacaatcaaagcagcttacactacggtacgttcgtccgcgacttggccggctctgccgctagtcatctgcatgcacgtcaaaggcatgcaacaactgttctgaaacccctggcgcatctgggtcgtggtgacctttaccggtatctaaagctcgtaattgggccatctcagtcgaagttaattcaaagtcgaagatatcccgattactcttgatccgtgcactgtgcactgatttaggaaagacgatcacgccttcttgatgttcaaatctaagaatgatttgaccagcatccttatgatacttaatagccaattgttgaatgattggttctttgaataatgcttgattgccctgacccaagggcgcccaagcttctaatttaacatcttgtgccgcgagtaattggcgcaagggttgttgctgaaagtacgggttaaattcaacctgattgactgcagggatcgtttcaaattgtggcacaaatttttgccacaacgttggtgtcatattggaaacaccgatcgactttaatttcccggccttttgggctgcttccattgcttgccatgcacccggaacatcgccataaggttgatgaattaagtacaagtcaatatagtctagtcgcaacttagttaacgaacgatcgatggcgcaactggctgcatcaaagccgtagtcttggagccaaagtttactcgtcacccagatttggtcccgtggaatcccactatccttaatagcttgaccaacttcgtcttcgttaaaataggccacggctgtgtcaatgtgtcgataaccaatcgccaatgcttctttgactgcttgataagtggaaccgtcgtctggaatctggaaagtgccaaacccaattgctggaatcgcgcggccatcatttagcgtaatagttggtgtttttgtcattaataatcactccttaacttattcatgtaattgtcgtaaactagcgccaaaaatctgttcaattgtcacaggatcacgatgatcaaagaactgactgacgccctgatcaagttcggccattgctgacatttctgcagctgttaattcaaaatcaaaaacagcgatattctcagccatacgttcaggatgcactgattttggaatcaccgtaatcccgcgttgcaacagccaacgtaagatgacttgtccggtcgtcttaccatgggcctgtgcgatagtttgaatacttggattactgaaaatcgcatgcttaccttctgcaaacggtgcccaagcttcaacccgtacgtgttcaccttgattaaagcggacctcgtctgcttgctggtaccatggattgacctcgatttgattgacagctggttgcacggacatggtcagttccaagttctttagctgatccgcataaaaattggaaacaccaattgcgcgaatcttaccagcatggtaagcctcttctaaagcacgccaagcacccatcacatcgccataaggttggtgcaaaagatacaagtccaagtagtctacgcctaaacgttgtaatgacgcatcaataccttgctttgcacgttcataggtgaattctgagacccacagcttggaagtgacaaagagttcatcacgtctaagaccactcttttgaattgcccgccccactgcggtttcattttggtatgccgttgccgtatcaattaaacggtaaccagcctttaaggccgcggtcaccgctgcttcacattcattcaggtcagggacttggaacacgccgaatcccaattggggcataaccacaccattgtttaatttcgttgttggaaccatcacgcatcaacctttcactatttgattacaataacaagcatacccgcaaacctaatacttgaaaattactacttattcatactagtatacatatagcgcatactagtaacggaggttcctgatgattgaaaattatttattagaagagctgatcacattcgcccacgagcacacgctggctaagaccgcggccgcattaaacgtgacgcaaccaactatcactcgcggcatgcagaaattggaaacgatgctcgctgttcgcttatttgatcgtcaacccaatcgaattacactgacgcccactggccagttagccgctcaggaagctgaacaattattgacacaacaacggacttttgtaaccaaaatacaaaactacgagcaaagcttagtcacacgtaccgtcgaaaccaccctacctggtccacttgccttactcacccatctcaaaacggtattacctaatacattgcgagttaggcaaccattgattgccgacgaccaaatcactgagcatctcattaaccgccaggcaagtttcattttctctaatcaggaaattctgacggccggcattgaatctcgcttcatcggtactgaaaatctcgtggtccatttacagcgattcatgtaccgtgcgaaccaacctagtatcacattcgccgaacttaagggaattagcttcgtagttctaagcgcaatcggtatttggaaagatattattcagcaggccatcccagatgctaaattcttataccaaccccaacgcacggcctttacagaaatcactaaatactccgatttcccgtacttcagtactaactttaccgcattggcgcctcaccagctagatagccaagccgatgatgacaatcgagtcgctatcccgattagcgatactcgtgctcacatgccaatctatgtcaattatcttgttagcaatcgacaatcattaatgcccctattcaagcaatttgaagccgcgtggccagccaatctcaagcatactgccacgccctagcagctaccatagttaagccgttcggtctaaaactgcaaaatgaagtgttacgctcaatcacagggggtatatactggttgaagctcgccctcccagttcttgatagcaaaagaggtccacacgctcgcttagctaatctaatgcgagcgtgtggacctcttttcgtattaagtttggttcgttcaagtcttaatcttaaacatggaccctaatgtgatgattagttgcagaaaaaacagttaaacaagcattccacgccaatcatcttctaacagcaagccgtttagcagatttgaactgccgacctcttccttaccatggaagtgctctacctgctgagctaaaacggcgttaattgaccctatccagtataccaaaagcatgtctaaattcaaactgtactggttgacattcaacgtaaaaaaaagaaatcgaattaacgattccttaggctgcatggcaacgtcctaccctcgcagggagcgatcccccaactactctcggcgctaagaagcttaacttctgtgttcgacatgggaacaggtgtatcct

SEQ ID NO: 15 - DNA, 69963 bp, synthetic construct
  source 1..69963: mol_type = other DNA; note = Lactobacillus plantarum PDG8 - contig 15
tcttccagttcgtatcgtttaggtgttgtcatcggaatgcctcgattcgtttttcctcagattatacctgaatttttagttttcagacagtccctagtacaactttaataacaataaacggccagctcggtgcatattatccagcaatagggcgaaaagacaatattgcgctgttttcgacaccccatgcgtcacgaatctaccgcggttgctcatcttgtccataatattccggcttttcagcctggacgggatgggcctgtaaccagctaataatctggcggctgaggtcatccgtcattggtgccgcagctgctatttgtgctttagtaatttggttgacatgaattcccgcagtaattgtacagcttccaactagataacgctgaatccgcttggccattcgttccgaaataaagttatctttatggaagcgaccatcatggctgggaaacttaaccgtttcgggaaccgtgctggcagttagtgtggtcacgtcaccaatatggggattggtcccaccggtaacgacgatcaacaagtcatatccaatcacttggagtgttgcttgcatttgatacccggcctgctcagtcgtaaaagttgccatacttaatccccctcccaacggcgatcagtttcattatgaatatgaaacgcatctaaaattttcatggtttgatgattgaccagatcctgaatggattgcggatgattataaaaagcgggaatcggtggaataatttgggcaccgagttttgccaacttcgttagattttctaaatgaatcacgcttaacggtgtttcacgtggaacaatcacaagtttacgttgttctttaatcgtgacatcagcagcccgcgatattaaattatcaccgaagccgtacgcaatccccgctaccgtcttcatactagctgggacaatgaccattccgtcattcaaaaacgaaccgctggcaatcgctgcgccttggtcattagcccgataagtagcatccgcgagcgccgttagctgcgcgagcgagtaatcagtctctaactccaagttttttttagcccacgcactcattaccaggtgaacttcaacatctggccgctgatgtaacttttctaataagtcgaccgcgtaaatcgtaccggacgctcccgtgattcccacaacaattcgtttcatcctgacaccctcgtttcggcaattctacaattataaaattagtcatttacctgtctatgataccttgcaaaaatactacaaacaaatcaagtttagactaattaatattcaaaaatggaatattaattagtaattggcatgtcaattgaatctgttatgactacgccaacagcattaataaaagagtcatagatttcctcaaaaatttgaaaagatctatgactctcttttgtattagcaagtaaacaaacaacttgtcaactattcgttatttaactgaaaccagctcaaacaattgctctagtttcaaattctctaagagcagcttgattatactcccgccaatcaaaacgttcaaaacaaacctgttgctccatatctagcacaatcattagtgctgcatcattttgtacatcataatgagcaagttgaccgttctgagcggcacgctttccgtcaataaacactgcgtaattcgggtaactttcaacgtgtttaatttcaacgaatgcacgcccgttgctaccattccccaaaacgatatctggattttcccaatcatctgagctagtaacccatttaccatcaacttgggtttcagcatggaagattttcaatggctcttttacagtttttacatacttgatactgtccttggtctcaattgagagagctaaagtattcgccaaactatttggatttgctacggcatttttaccgctcagcaagccaaaacgtccgcccttgattacatcttgaataccagcaacatctgttccaacaaccggcttgtgtgcaagcaaagcttcaataatagcaagcccttgaccctctgtaactgatggcagtacaacataatcagtaaatgacacaaatttcattggatgctgcaaaaaccccatcatgaacaccgattcatctaatcctaaaccggaaataagttgctctacttccagtcgtattggaccattcccgacaatatataatcgcgtcttcggataattatcatgtactaacttaaatgcttggattaatcctaaatgattcttttcaggagacagtcttgccaccgtcacaaaattaaaataattctgatctacaggatgaaataattgagttgtaataattccgcttggtgtctctgttttagtaagctctatcagtgaatcaccattatccacttgttgctttacctcagataattctttttcaatttcggcgccattaactagattctcaacccatgtaaacttagcagaatcagcatactgactcaaatcttctcgattttgtttatcagctgattgggaaactgaaataattttgtcaaaatattgatagtaagtaaacgtaacacgcagattcttacgatgcttgtatcgcccattaacaattttattatattcatcccacatagtattgtgtagaaagacaaccttttttggaaccggtgataaagcaaataatccagtaatagctttgttgtaaccaccaaagtcaataacttcgtatggcataaagttaccaaagatacgcctaaaattcagctggtacgttgccttcatcttattttggttaactaactttgaattaaatccaaagtggtagctagtgttctgattataagtatcaaagaatgttctagttgcccatgaaaaattaaaaataaagtgcacgctgccgggtaagcgattcatattatattctttttcagggcgcatccgcggataatcaacaaatactaattcatatttattagtgtcaaagtttctagacaaattaataatagaatttgtaatcccgttattatagaaacctccagcataaatcaataacttctttttattattgttgaaatcaagtcgctcaatcgatgacgactcttcaaacaatacttgcactgcacgatcagtcgcttgtccgtcatcataactcaagaattcggatttataatcattgtactgttgttcgtaagtcttggcccatgaatcaaagtatttttgattacagtcatcaagcaattgatcaaacttatccgtgaccagtcccggaagtgtatcaagcgacttgtaaaagcctcggttctgtgcgtaactatccttatcaggaacataaaacataacaggccgtttaatcggcaaaaagtcgaaaaagatactggaataatccgtaatcaatacatccacaccacgtaacaatgtattggtatcaatggcatttgaaattaattgatcaccatatcccatttcaactaatttatcataaataaaataatgtacttttaaaaatactttgtagccagatgggacacgttcctgcaatcgttggacttcatttaacaactgtaaaatatcagcttcagtagtatattccacatcttttttccaagttggcgcatacaagattatcttttcagctggaagccccaagcgctctttcaacgcttgcgtatcttcggaaactagtgtccccagtaagttatcaactcgtggattaccagtaatataaacttcatttggaaaaataccgtttaaatcatggctcgtaattaaatgctcagccgtaaactgattaggcatagctaagacatcagctgccaataaattacgctgaatgttcttatggtctgccctacctgaacccttaatatctaatcccagtgtttttaaaggtgtcccgtgccaagtattcagataccgttgcccatcccttttgataaaatagggcatgaaagaagtatcgttaattaaatactttgaggtagctaaggctttcatatactgacgtgattcgtacttaactaaatatacccgatgtctcttggtatccgccataatatccgcaggaattgtatctttgtctttgtatgcccaatagtacgtataatccggatattcttgtaccatcttttgatacatcgcatacacatttccagtcaaattgacagcatgatacgattccaagaaaacagccttttcttgaactttgctatgtttcacatagtataaataaacattaatttgacgaattgccggcttagttacaaactcccgaattggccgtgcaacaaacttacacgcgagtttgatggtattcatctttcccataatatatatcattactccttgtacttgactacagtactctagccctaatggattagcctgtataattatttgcgttctgatctatgctagtaatcaacttcacaactcgttgactagccgttccttgctcccattccgtgaactgtgtccgaaatgccatcatcttggctgtttcgtttggataaccatcattagtcaagaactgatctaacttggccagaaaatcctgctcattggtgacaattggaccaggaaccttgttgtaatcaaagtagaatccgcgaatatcaccctgataatgcgctaagtcataaggataaaatagcataggtcgattcaagatagcgtaatcaaacatgaccgaagaataatccgtaatcaataaatcactaattaagtacaaatcattaatatcttcatccacacataatttaacattgtcctcaaagccttggatattgatcgactcagctactaggtaatgtggccgaataataagcacatcttccttattaagccttttaacaaccgcggccaaactaaaaggcaagttcattttatacatacctttgcggataaaaaagtcatctcgccaagtcggcgcatataaaattactttgcccatcttattgccaacaattctttttttaatcgctgcaatcgcatcataatcctggcgctgatgcactaaccgatcgttgcggggatacccataatccaagaactggttgttaaaatcaaacgctcgtcgaaaaacgtcttttgaaaactgattgggtgcaattaaataatcccaccgtttactctccgccgtaaaattctgacgatactgacttgtatcggtaccaggcattgaaacttttggaatatcaatccccaggcgctttagcggcgtaccatgccaagtctgaatataggtcgttttcgcattcttcttcaaccaatacggcatccgcgcgttcaggacccagaattctgcaaccggtgccactaataaccatttggccgaaaagcgtggaataatattcaacttaggatacttttcctgggcttccacaaccaactgacgcttaacaccccagactagcttccaatctggatgcgcggtctgaagtgcttcgtaaacgtatagcgggttatccattggaactttaccattaaacgcctcaaataaaacaacgtgttttctcactgggcacacagtcgcaattacattgaacagtcggcgataaacctgactgataatatcttttaatgccattttattgaattccccgtcacacgtttatttttgattgaaattcaagtcttgcttaatcttagtcgttgagatttcaggagtccgtggtaaatagatgacttcagcgtcagtttgttcgcccacgaaatcaaatttaccagtccagtcatcacccattacaaagcgatcaatttggtataatttcacgtcacttactttttgatcccacgacttttcaggaatcactaagtcaacatagcgaattgcttctagtaatgccttgcgcttttcgtatgagaaataggccttcttttgcttgctgtcccagttgaactcatcggttgatagggccacaattaggtaatcccctagtgatttggcacgcttgagtaattcaatatgcccataatgtaataaatcaaacgttccgtacgtaataactcgcttcatagtaaaactcctcctaaaatttcttcgttaatctttattaaatcaatgtacacacctgaatgtaaacaaggctattatatcatgaaaagattgactacacccatcattatacaattcttaatgagccgcgctttgtatattttatattttaaaacaagcgaaatgcatatatcacgcaataacttgcccatattgcggtaattatcattgcaatttgtcatttattcactcgtgccttttatgtcgcaatccatataaattaccgagaagctaatccacaacagtttatcattaaaaccaaacattcaatgcgccacaccacgttttttggcctataattaaggtagtgtattaatgagggagggatgtctatggcaaaacgacgaatcacacacgacccacaccagtttgttaatactgctactgaccggcgacgcttacaattggctgtccaattagccttgccaacctgtgcgcacgtcttagcacgcaattttgcgcgttctagtgccagctcttactggctactaatgataaagacgccggggacggctgccccgcgctttttgaccttgcggatcgcggatcatttgctatggctgacgaaccatgatcaattaaccattagttgggaggctggtaattttgacgccgttcaacggaccttgcgtcaagaattaacaccagccactctgcaacaatacagttatcaactcacgacaactgatattatgacactgcgcttgattctgcatttggaacaacatcagctcatttggttggtccaattagcacctgaaatcgctaaggcctacaagaatcagcattttgaccttcgtgacgactttggtcaggccaaattgttactaggcaacatgaataacagtagtctccaactggtgccagttaagcaaccagctttccaaaatcatcttggacaatacttcggccgcaacctcctattctcacagttcaccagccaccatctattgcgactattgcccaccaatcaatggattcgacccttgctaaaggtgttgccacccacaccaaatctggaacaacaactagcagtcctgtatggcaccgactttgtccgcatttatgttgaagcgattcgacaacaagcacgcttgcaagcgattagttcataaaaataagacccccgctacgttcagcaggagccttattttagttactgattattagtcgcttttaagttttccttaggacctaacaacttatccgaaaagccaaatacataaactaacatcgttgcaatcactagtgtcccgtaatgggatatcaaataaccataaaaatttgacccgatgccgacacccggggtgataaacgcggggaaaccgatcaacgaccctgacaaagcatagttattaacgcgtaacagaccggtcagtaagccacctagaccactcgcaatgctagcaacgacaaagacccgtttgtatttcaagttgaccccgtatagcgccggctcggtaacaccacaaaaggctgaaattgcagctgccagtgagatctcctttaggtgcttatccttagactttaagaagacggccaacaccgcaccaccctgagcgaccattgtaatcgagaggattgcattcaaataactgtgcccattcgtcgcaatatcattgatcacaatgggaataatgccccagtggagcccgaaaatgaccatcgtctggtataaaccaccaataaccaatcctgataaggccgggctaaaattatagacggcgaccaaaccgttggccaagcccttactgataatcgtaattaagggaccgaccaccactaataccactatcgccaaaatcagggcttcgataatcggaataaagacgctccgtaaatacagcggaacaactcgttttaacccccgctcaacgtacacgcctagccatgcagccacaatcatcgggaacacggatgccgaatatgacattaaatgcgtcggaacacctaagaacgtgatttgggccgtggctcccttactagctgccgttatcagacttggatagataagaacagcaccgacaatcgccagcacgattggatctgaacctaactttttggcagcagtaaagcctaggacaactggtaaaaagtaaaacgttgcatcagctaccgcgttaaataccatatacgtcccactcgtgaccgccaagactttgaagcccgttaacgcggccaagattccttttaaaatccctgaacctgccaaaatgccaatcaccggaatcattgccgcggtcataacaccaatgacaccactaatgccattacgcacgtggcttagccaattaacgtcacttgatgcctcctgaaccggtggtactggcactccgtccgcaaattcaggccctagttgtgcgatcactgcatcaaaaacatcgttgactgccggaccaatcacaacttgatactgaccaccggcctttgcaacatcaatgacgccgtccaagttcgcaataaccgcatcgtgcgctagtgcttcatccttcaaataaaatcgcaaccgtgttatgcaatgaatcacgctattaatattttgttgcccgcccacattagctacaattgccgtggctaatgccgagtaacgcgtcgttgactgcggtaccgctgccactaccggtgacgcggttgttgtcactgttatcaagtgagccgttgcgacgactgcaccggccgcgacagcttgtggcagtggggctagcgtcaagtcagtgagtaccagctgagcgttcgtcacgacaatgatcaccgtggtcggtttgtgggcctgctcgatagcagctaaatccatgtcgactaatagtgtgccagccgtcacctcatcaccgaccttcacgtgaacttcaaacggtgccccattgagtgccaccgtatcgacacccagatgtaccaacacttcgaggccagtcgtagtcaccatgccaattgcatgtttggttgttgcgactactgtgattcgaccactaactggtgccaagatgtgaccagctgtcggctgaacaccaaatcccggccctacccttcccgccgcaaaaacaggatccggaaccgttgccaatgacaatacttgaccagtaactggtgctaaaatggatacttcatcgatttttcccataatcatcatcccccatgtaaaacccttaacctaaccttcaaaaatccttaagacgaccgtctcacgtccaatcatgatccattaaaattctatcatcacaattagaccaatctccatcacttaccatcacttcgttagggcgactaaatatcaaaaacaagcatttttccgaatcggaaaaatacttgtttatcctaacgttgattaattatttgacgtcgccattaactaggcggttgcacctaagtgtcgctttttaggcgctactttaactgcatttgcatcctcatccttaaaaccaaacatccaagttaaggcgaaggacacgacaatcgtggctgcggatgcaatcaagaaaccataaaaactaaagtccaagcccttcggattaacaaaggacgtgaagccaattagtgaacccgtaaagccccacatattgacattcatcaagccggtcaagaagccaccaactgccgccccaatactggcagtcacaaaggcccgaccatatttcaagttgatcccgtacatggctggttcggtaacaccacagaaggctgaaatcgttgctggccaagcaagttcttgaatgttagccagctttgactttaaggcgattgcgaatactgcgcccccctgggcaaccatcgtcgctgaaacaatcgcgttcaagtaactgtgacccgtcgttgcaatatcgttggccacaatcggaataaccgcccagtgcaacccgaagatcaccaatacttgatagaagccaccaatgattaagccagaaatcgcagggctcaaattgtagacccacacaataatatttgccaatcccgttgaaagcacagtaataattggaccaaggaataatagaatcgcaccggaaacaatcacaacttcaaataatggcacaaaaatcattcgtaataccgttggaatcactcgttttaaccatggttccaacttacttgctaaccaggcccccgcaatcatcgggaaaattgaatacgtatacgaggcaacgtgtacgggcaagccaaagaagttcgcgttgatccccattcctaaaagcgtactcgtcgctttaccacttgccatcgttacaatagctggataagtcagcaccccaccgatgattcccatgatcaccggatctgcccctaactttttaccagccgtaaaaccgacgaagattggcaggaagtaaaagaccgagtcgcccatcgcattaataatcacgtacgttggtgcggtcgggctaactaacttgaatgttttcagtaacgcaagaattccctttaaaataccagaggctgctaataatccaatgacgggaatcattgaacccgtgataacaccaattaaattactgataccccatttaactttgccccacggcgtcgttggccgctgagctgctgcggcagtctcagcaacagctttagccgtctccgaatcatttgaaaattctggcccgatttgcttgataactgcatcatagacatccgtgacagcaggaccaatcacgacctgatattgtccgcctgcttttgctacgtcgacgaccccttttaagtcccgcacgacgtcatcatttgctttactttcatcttttaaataaaaacgtaagcgggtaatgcagtgaatcaaactactaatattcccggcaccaccaacattagccacgatgtctgcggctaactgatcatatttacccgcttttggtaatcgattctgccgcttagcattaaatgtgttggcgttcagacggcccgtagctgtcacgtcaccggcagcttttgcccccgtaacgacgtccaacgattctaatttatcactagtgttagtcactgctaaaatcactgtggtctgacgattagcggcttgaatagcagctaaatccatggtggcaatcacgtcccccgcctgaacatcatcgcccgcggccactttgaccgtgaacggggcaccctttaagtcgaccgtgtcgattccgagatgcactaatacttccaaatgatcatcaggcgttgtgaacccaatcgcgtgtttcgtctcagccaccatcgtgacctgaccactgactggtgcaacaacttctccacttgaaggttgaacgccaaagcccagtcccatcataccggctgaaaagaccgggtctttaaccttatttaacgcaataacgtccccattgaccggcgacaaaattgttactgtttgtgcctttgccatacccattcctccattcttaacctaacaacagcgcaaccgcttgataaggttgcatcgtcaattgtgctgtgacattaacatcttgataattggaaagtaacacctgtgcaccgaccatttcttccggaagtgtcaccgttgttggctgaccataaaaattattaagcactaataacttttgttggcgatatgtccgccaatagccgaagacttgcggatcatctaagcgccacgattgatagccaccatccgcgacgatcggcatcgtttttcttagcttaatgagccgttgataatagtcaaaaatctcgccactagccaattcatgggccacgttaatcgtcgcctgattagtcggtgtcaaccacggtttaccagtagtgaaaccagccttggcactatcatcccattgcatcggcgtccgcgagttatcgcgcgccttggtcttaacgatcgtaaacgcatcgtgatgactgtacccactacgaattaaagcccgataagcatttaatgcctcaatgtccacgtaatcagccatattgtcatagtccggatcagtcatgccgagttcctcacccatatagataaacggtgttccacgcaagaggtgaatgaccgtcgccagcatttcagcggacttgacacgataacgaccggcgtcaccaaagcgattcagcgctcgtggctgatcatgattattccaaaacaaagcctgccagccaccaccagctgccattccactggcccaactatctaataattgcttcaatcgtgggaagtcgaaggccattcgggaccacttccgtccatcaacataatccgtcttcaaatgatggaaattaaagaccattgagagttcgtgattagccggattagtataaccaacactgttcgcaacggttgttgaagacatctcccccactgtgacgctatctacatcctggccgaagcttgccgcgttcaattcctttaaataatcatgaacaacgggggtgtcagtatacaacgtcttgctagggacccccttaggtgcgtccaccaacttctcagctttaccggtaacattgatgacatcgaaacgaaaaccctgcacgcccttttgccgccagaaattgacaacggcggcacacgcttgtcgtacggccggattatgccaatccaaatcggcctgagtcggatcatataaatgtaaatagtacaaaccagtatcaccaaacggcgcccaggccggaccaccaaatttagattcccaattggtcggtagactaccatcagccttgggaggacggagatagtaaaacttctgatacttctcatcacccgtcaaagccttttgaaaccactcgtgttcagttgaagtatgattaagaaccatatccaacatgaccccgataccatttgccttcagctttgcaacgagttcttcaaaatcagccatcgtgccaaacatggggtcaatatggtagtaatctgcaatatcgtaaccgttatcattttgtggtgagacaaaaaacggattaaaccaaatcatgtcaatattcaactttttgaggtagtcgatcttttcaataacacctcgtaaatcaccgacgccatcgccattgctgtcgtaaaacgacttcggataaatctgataaatcacttgttctgataatttcatgcgctatccctctcatgccagatcttatttcttagttcgccgagcaaaatcgcggaaactaaagcggtccgcccggtgtcgtgattccgtatactggaacgctcgcgcatccgtgaggctcgtcacgcttcgaacaactgccacataggcgcccttactaatagcgaggtgttcgcggtcctcatcagttgccggcgccatcgtaatttccttcgtcgcgtaaccgatcgtcaacccaagctgattttcaaaatacgcgtacagtgagtcttccgccgcttgcttgggaactttcggaacgatcgatttcaaaatataatccttatcaataatagctggttcgccatcgatcactcggactcgtttgatggccgtcactggcgcttccgtcaattcggtaccaagtgacgtaaagtcagcaaccggtaacgttgcatccggttgatagtcataaacaatattttgcgtcttaatgtgtaacttttcggctaactctttataactcacaatgccagaaactggaaattcatactgtcgatgctcaatcacaatggaccctttaccacgaattttttgaatatagccatcctcagccaatgtcgctaatgctttgcgcccagtctcacgtgaaatcccatatagctcacaaagttgatgttcactcggcaaataactcccgatcgggtaaacctccgcatcaattttctggagcaaatcttgataaactaaggccgctttattcacggcaaccacccctttgttatcgttttcatttatgaatatagacttttttagacaagttgtcaatatttaaataataacccaattaaatttgtagattataccagccggatcaagtctagacatgtctagagttcacaaaatccgagcttatatttcagtattcaataactgcttcataataagtgccaacacctatacagtattggttgaactagcaggatagtccgcaccataataaaaaatcgacattcgcagagcgctaacagcaatctccaaccaatgtcgattctatatctgatgatttcattaatattactattttcgcaataaatctttcgctttcattgttgctacttcttttttcatttttctctttcggttcacgagtgcatctatccagataccattcagcacggcttcgccaactaacaatacggttactattgataataaagagacctcttttgtaaaaacaatgtaaataataaagcctaaaaagccagctcccggaattgccccaaaccaccttggtaagtatcgatctaacatatagagcactgcaacgaccaacataccaatcagaattcctttaaaatcactcatgttgttcctccctaaagtcagtaataatctgttttgctacctctaacgataatttctcatcgattaccaatttcataaccttcgtttcaaacgtatttgcaccgttgtcctcaataaagttaattttttgaataatcgtgtttaaccgcattcgcacggttggataactcacttgataaatcttagcgagttgttttagagaacctgaggcaataaccaattgtttaacaaattcctgatcctcacgttctaaattcacaaaccagtccatagcatccctcttttttaatattgtttattaaactttaacattgtttattataatgtcaataaaaaatcatatatttgataactgatacaatccggagctattcaaataaagacgagtactctaatccaaaagaattacagtactcgccttatttagaatattaacgctactagtctcagtaaatttattagctgacctttagtgattcaatccaaatgcctgattatcactagcatccgcgctagctgcatcactagctgcttgttcttcggccatcaaccgagcgcgttcatgtttgttataccaaggtgaaacagtgaaagccaagacatcgttcatcagataaacggaactattaatgaacattgctagtgtcgccgaaccttgacggaacgagatgaaccagaggaccatttgtgctaaaccagaggcaatccaccagaaatactggttgttgtaacggaggaagcaaataacgccggccgttaaacaaatcgcaaaactaatggcatcgacccatggccggggatcatcagttaaggcaccaataagatagccggagatggcataaacaactaaagttgcgacaattgcgacgatccacgtcttacccgtaaacttccgaatctttgaaaccatgttgacgttccaattagcacttaatagtactggaatatcaagcgttacgacgtaggctaattgttccccaatgcttaaatagttcttagctgaaaaaccaactacgatgaagcaagcggcggagatgacgcctaataatccattgactgacttagccgcattaatggctaacacacaaagaacacccaaagtggtcccaataaatgttaaaatagacaatgctgtaattggcgcacttactaacgtcattacttgacatcctaggctaaaatagaatagatagtagttctgttgtggccaaccttttagttggtgtgataagaatttaaaataattactcaaaatcatgctcctctttccgttttcatatgcggttgtaggtgtctagttggccaaccagtcacgtcacactactacatgtagtgtttccgtttgaaacaacacaatatattgtatcattatcttggccgatgaaaagggtaaaattccaaatttatattgaattgtttacaattaatccaactgcgccccggcaatttggtatttttggcgtgctgatttttttatatttttttgatttcgacctactgatagcgttgtcaatatcaggtcaaaacaatgcgttttgtcgcaatacaatgcttgcagtatactggagaggaacaaacttttagcatcacaatataattaatttttttggaggaacctcatgattacgcttaaatcagatcgcgaaatcaaagggatgcaagctgccggtgacatcatggttggcctgtttcacgcccttgaagactacatcaagcccggaattacgacttgggatgttgaccactttgcctacgaatacatcgttgcacacgacgctactcctggcgaactcaactttgaaggttataagtactcaacttgtgtcagcgtcaatgacatgatttgtcacggctgtcctagtaaagatatcttggtcaaagatggagacttattaaaagttgataccgttattaactaccatggctaccttagtgactcttgccacgcctttgttgctggtacaccatcacccgaagttaaaaaactcatggaagtgacccataaagcgctatacctcggtattgaccaagccgttgttggcaaccgaattggtgatatcggctgggctattcagaattacgctgaaaacgaaatgggttacggcgttgtacgcgaatacattggtcatggtattggaccgacgatgcacgaaaagcctgatgttccacattatggcgaagctggtcacggcacccgtctaaaagctggtatgaccattactatcgaaccaatggtcaatattggtgactggcgttctggcgaaactgccgatgacggttggactgttcgcactttagatggcagtcttagctgccaatacgagcacacccttgtcgttaccgatgacggtcctaagattttatcatcattcgataatgattttgatgctaaatacttatggaataagtaatatcatttaaattataatcacgaacaatcccaccctagtttagtcacttgctaatcagggtgggattgttttagttattatcaacagcacgttcactagctattgtcagaataaaactagttatatgtgtcttggaaaacgtcttgattataagacatgaaaaactgatattggataaattttaacatctttatcctcggtcacaatcaactgattcaaccacctaatatatttattttaatgacaaccgtttggcaaaactaacgctgattcaataacgttctcagccaatcttcatcttttaccgcttattgcaaatcgtcattcaccacttgacgcgctcaaaatcatcttgtatagttagtcccaattaatccagaggaggatcagacatgactcaattaacaagtagtgctttgaataactgttgttgccgaactgcgcgcttatcgcgatgttcggcctgttaagcattgactttttgaggagtgtcatcctaaaaatcaatgtccagcatggctggatattgtactgggcgcgaggaattcattcgaattctcgcgccttttttgtcgcttttggcaccccaccgcagcgattggaggaatttatatgctcattcagcacgttcaagaacttatcggccacacccccctgatggcgttacccatcgaggttccaaatcacagtcacatctatgccaagcttgaaatgttcaaccccggcggcagtattaaggaccggctgggagcctatctgattgaagacggcttgcaacggggccgggttaacgccaagacaacgattattgaaccaactgctggtaacaccagaattggtttagccttagcaactcaagcgcaccacctacgtaccatcttagtcgtcccagaaaagttcagtatggaaaaacaagttttaatgcaagcattgggtgctgaaattgttcatacacctagcgaggaaggaatcaaaggtgccattcgcaaagctgaggcactagccgcaacgatttccaacagttacgtccccatgcaattcaagaatccggctaatcccgcggcttattaccacacactggcaccagaaattctggcggacatgcctgcacctataaccgccttcgtcgctggagccggtagcggtgggacatttgccggagtagcggcttatcttcaagcccaagattcagcaaccaaagccgtagtcgttgagccagaaggttccattttaaatggtggaccggctcacgcacatcgtactgagggaatcggcgtcgaattcatcccaccatttttcgatcaggttcgcatcgatcagacactgaccatcgcggacgatgatgcctttgcccaagttcgacacctagcccgtgaccacggtttactgattggcagttctagcggcgctgcgctagccgctagtttacaacttgccaccaacctgcctgccaatagtcatatcgtgaccatctttccagacagtagtgagcgttatctgagccaaaaaatctatacgaaatgaggactttaacaatgaaatttgaaacccaattaattcacggtggtatcagtgaggacgccactactggcgcgacttcggtacccatctacatggcctcgaccttccgccaaacaaaaatcggtcaaaatcaatacgaatattcacggacgggaaatccaacccgggccgccgtcgaagcattaattgccaccctcgaacatggcagcgctggcttcgcatttgcttctggctccgctgccattaataccgtcttctcaatattctcggctggtgatcacattattgtgggaaatgatgtctacggtggcaccttccgcttgatcgacgccgttttgaaacactttggcatgacttttacagccgtagatacgcgtgacttggccgccgttgaagccgcaattacccccacaactaaggcgatttatttggaaacaccgacgaacccgttattacacattacggatattgctgccattgcgaagctcgcgcaagcacacgatttactgagtatcatcgacaacaccttcgcctccccatacgtccagaagcccctggatttaggcgttgacattgttttacacagtgcttccaagtatctcggtggtcacagtgatgttatcggtggcttggttgtcaccaagacgccagcacttggcgaaaaaatcggctacttgcaaaatgccatcggtagtattttggccccgcaagaaagctggctattacaacgtggtatgaagactctggcattgcgcatgcaagcccacctgaataatgccgctaaaatctttacttacttaaagtctcacccagcagttgctaagatttactatccaggcgatcctgataatcccgatttttcgattgccaagcaacagatgaatggcttcggcgcaatgatctcgtttgaattacaaccaggaatgaacccccagaccttcgttgaacatttacaagtcatcacgctcgccgaaagtctcggagcattggaaagtttaattgaaattccagccttaatgactcacggtgccatcccacgcacaattcggctacagaatggcatcaaagacgagctgattcgcttatcagtcggtgttgaagccagtgacgatttgttagcagaccttgagcgcgggttcgctagcattcaggcagattaagctggtgtttcagacggctcgtgccattctcaatcgtgaccccgccgcgatcaatttgcggacagttatgttgacctatcctggtattcacgcgctcgcctggtaccgggttgcccattattttgaaacacaccgtttaccattattggccgccttgctgagccaacatgcggcccggcgtaccgggattctgattcacccggccgcgcaaattggtcaccgggtcttctttgaccatggtattggtactgtcattggtgcaacggcggtcattgaagacgacgttacaattttacacggcgtcactttaggcgcacgtaaaaccgaacaagctgggcgccggcatccctatgtttgtcgcggcgctttcattggtgcccacgcccaactcttgggccctattaagattggcgccaacagtaaaattggtgctggtgcgattgttttagacagcgttcccgcccacgttactgcggtcggtaacccggcccatctagttgccactcaattacatgcttatcatgaagcaaccagcaatcaagcttgattcttatcaaaactgcagcttataataaccggttgctggtatcagttattgtatcaacaataaaacgtacttataaaatcaaaattgatttcatgttgcttatcaagtgacaaccaccgtcatcagcgaattagttctaattgtccgtcactagccatatccgccaaaaccatttctttagtgaattcgggcgcatcattaactgtcgcttgcgctagtatcgccgtagcaattgcaaaatccgttgttttttgtagtgaccacccctcaatcaggccagtaataatgccacttgcaaaggcgtcaccactgccgattctatccaagatcatcaatggccgagctttgccgacaactagttgttggtgctgataactaaaaccagcaaaccacttttgctggccaacttgataacgataacttcccgcaaaatagtcaatgtgataatcacgcacaaattgttcatagagtgctgcctcggattcacgatttgcagattgagtgcgatcttcatcatcgggataatctaataacgccgtcaagtctcgtttactcccaaatacaatatccacatatggcagaatttcctgatatcgcgctttaagcgtctcatgggcgactcccgtattgagctgctgacgataattgaaatcaaaacaaacgcgttgtccgttcgcatgagcctgttgtgctaaccgtagcgcggcttggcgaactggcgcagtcagactcagcgtgataccgcagatatgcacaaactgacagccaaccaacgccgccgcaatttcctgatcatcaggaggctgctgacagaatgcgctactgagccggtcctgataagtgacccgctccggccgcgacccgtacccaagttcgacgaaataagcacccatatgttgtccaccaaaggtaacgtagtcatcctgaatgccatatcgtcgaagttcgcccgctgctcgttgaccaagtgcattgtctagtagacgactcagtagtcgcgtgcgataaccgaagtgtgtcaaactacttaatagattgacgccagtgccaacggtgctcattctcagctcatcagtctgtgtcagcattaaatgttcgggcacagtcaagcgaagtaacacttccccaaacgctaggattttcataagtcaccgcccattagaattgtttcattatcgtcagcaattgggcgaccgcttccggttgcgtctcaccagtagttgcatcgataatcgaactgtatacatggggaataatctgccgtaccccagcggcgaccgcaatctgtacaatctgttggaaattagtgagatccagtccaccggttggttctagaccaaattcattgtcagcacacgccgcagccactgctttaaattcttctaggtgagccgttccttgcattggaaagtacttcagtgacgtcccgcccatatccttgagcattgtaattgcggttgcaacgggaatattcgcttttgctgactgcgaactaagtggccccgttgccacattgaccaaaccgacttcaccactcggcgcgactagcccattaatcacagtatcggcttgacctagcaacgcccggctagtcgccacaccagtgaagacttgattaacatgttgtggctggatttctgcggcaactcgcgccaccattgcactttgttgcggtgaaccagcacctaaaccaaccgaaactgcattgttcactgcggcttggtaacgccgcatatcagtaatggcagactcatcactcagatagtttttcgtgaggacacccaacaccacgtgtccttccgcagctgcataacaagcttccgcgttcgtcactgaattagccaatacgttcaaacaaatcccatttggtaaataattaggtgtcagttgcatgtgctttcctcctcaataatggttcgtaatcgttcaacaatttgtgtcatttcagcacttgtcaaagcgcggatatcaaattcaatcagtccttcgttaacacgatattctcgtggataaatggctggtcgaccttgccgtaacgcctgacagattttggccgcttcagcaatccgcacactcgctctaaaaatatcacgcccagcgccgtcttgaaccatttcaacctggacattcggtagcgtttgtaattccgcaataaagggggctaagcgggctttcatcgattcgccactctcgggaccggttgttaaatattgttcgacggcagctaccaaaccaagaatgttttccttaccgatcttcatggcccgaccgataccgtagttctgttgtcgtgcccattcgacgtacgtttgacgtcctagaaccagcccagatgccggccccgaaattgccttagcgccactgtaaatcacaacatccacgcctaattgtaaataccgacgaagatcgccttctgccgctgcatctaacaccagcggtaaatgatgatcatgcgccacctgcagggcatccgcaatcgttagcatgctcttttgaacagtatggtgactcttaatgtaaaggattgcgaccgtttgtggcgtgatctgcattgccaactgctcagccgtacatcgattagcataaccggccaacacgggttgggctcccgcaaccgcgagcatcacatcaacaggggccccataatcaacatcatgtccaagtggcatgataacctcccgttgcgtgatctgcgttgtatatggatgagtcacatgataggcgttaccacgaccaataataccggccagcacttgcgcaataccggccgaagcagaattgacgatcaacgcgtcctcactgccgattaaatctgccaaataacgacccgtctgaacggtcagttcggccatttcaaaaaagttctgggcgccctgcttttgggcggccgcaacttgatcactgacttgagaaacgcctaaaatcgtcatcttcccatccgcattaattacgggattcaacccgtatttctcataaatatccatgtattcactaacgtccccagtgagtaactatctcaccgatggcacggtttcctttcgtcataattagtttcacttgtctacaccacacgtgtagacccttccggcaataacactgtatgtgggtatgacttgggtgggcgcaattcgctcttctcccgttgaatcaacaacgacctggggagccgtcactgtctgaaagattgtaagatcagcatcgtaaccccgacaaagctgccccttatgggttaatttgaaaatacgtgccggattggtggtaatcataggaataatttcctcaagccgatatcctagcaatagtagcttttccacacaaactgccagactataaactggtccattcagacggttacgataataaatatctgaacttaatgtttgtggaaataggtgtgcggtacgggcaagcgctgctgttcgaaaactgaagctatcggtcccatgaccgacatcaaaaataaggcccttttgatacgccttccgaacatactgtgcgacttcacccgtggaattcacaataccgttcggcttgccgttaaaacagtgtgttaagacatcgccaggccgcattaacgcgatgattgccgccaattcagggggattactaccaatatgaaccattaacggcaactgggccgtcagatccgcttgatattgtttcgctactcggagtggctcgacaccattgtcgccaactactgatttactgacccgtactttcagtcctacaataaagtctggataacgttgaatcgctgttcgtagggctgaaaatgaaagctggttcaaatcggccagctcatcttgagccacaatgcccgtacgcgcaatattaagcaaggcataaacattagtagccgcccgatgcgcctgctggtacaaatcagccacattatccgcaccggtggagcccgcatcaataacggtggtcacacccgttcgataaccgattgcatcggcgtcgtcataataaagcgccgcgtgcgcattgcagtgcgtatgatcatcaatccagccagctgtaatatagcatccctgggcatccaaagttggacagccgactgggacagtcagttcagtccccacttccgcaatgactccgtcagtgattaaaactgccacgggcgcaccgctaacatctcggccattatgaatatataactcagtcatgagcgacctcaaaggaaaatttcgcccacggcccgattgcatccaataatacgagttggtcaggattgatcgttgccaccagattcttccgagtatctgtgtgtggctgttgcacaatttgtaattcatgttgatatttaccgaactgctcattgccaatcacaacatcaccgcgttgaaaagtgtgccggtcatcgttgacacgattaaaatcatgatagcgtttgcgaacctctgttgaccgaatcgttatatcgttgatatcgccacgccgctcgtgcaaattatcgagtaagatctggcgttctacgggctggatgtccgcactaggggtcaccgcaaacgtgatttgatagcggttaagcgcgccgagcttttgcaaatcttcctgcttcgcataggcgttaccaatgagcacactatcaattaatcctgtcgaaaagaggtgctgtacttgtacttgtagcggccagtcacggtgcatctctaaagtcggtaagccatcattgatatcccatggaccgattgttgcgcctggcgccgtgacaaacgctgccgtttcaattccagctcgtttgaaccggcgtgaacacgcaacgaaaaaatcaaagggcaaccccgtcccacgttgcggataaaagttatggcagccataaagaaacggtcgattggcactgtatgacaaaatattagacaaatactcaacgtcgttactcatgttcagttcaagattaagtccctgtgagttatacgataaccaggcttcttgatgcccatcaaagccggcgtctaatcggattgcatccgctcctaatgacgcaaaatagcttagatcctgataggacacacctagttggtcaaaaatattcggggacacatccagggtcgtggtgaagcccagctgatgcgccgactgaataatccgctgatatttctccgtaactcgttctttaccgtcttgtacttccaacatactgacgaacagtcgcgtaaacccataactggcagcgacctttaaataagcctggtcgcgttcaaagacactgtgatctgggtacaacgaaattcctaatgtccgcttcgtcatccgcgtttcccccgttccattgcttcaaaaacttgcaggtagcggttcgcaataattgttgcaaaataaatcgtcactactatggcaatcacagctggtaaatgaagccagccgactagcccgaccgttacaaggatactcagtaaagcacgccacaaagtctgacccgttcgtgctttgatcaaatatgctggcatcaccccccgactcactaaccattcactgccgattacgaatgctgctaatatcaatattccaaacatgctatccctctattctttgctaagctgttgcttctcaaacactttgaaaaacggataatagataacaaggtcaatgacaaagttaacacaagagagtatcagcgccggaacactccaatttgtactaataaacgcaccgagtggtcccggaacagtaaacggtaacctggccatcatcatcggaacgacgccggtgattgtcaacacgtaagctaagcttccagtaattaaaggaccaataataaacggaatccctagaatcgggttcatcacgatgggtgccccaaaaataatcggttcgttaatattaaacagaccgggtaacaaggacaacttgcctagatcgcgcaaataggtcgatttagaaaacataaacaacacaaccaacgctaacgtccctccggctccaccaatccaaataaaccattgcaaaaattgttcagtaaaaatggtcgacagattatgggcgctcgtgccactagtgaactcgctcatattttgggcaatcgacatttcccagaacggccggataacggggtccataatcgcagccccatgaatccctaatgtccaaaatccagtaatgagaagaatcgtcagtagaccaccaaacaaactattgcctaccaaaacacctttgaggggcatcagtagcgtgcttaaaaatgaggaaatattaaagtccaaaagatagcgaatgccccaaaacaacactaggataacggcagctgggactaaggctacgaaggaattagaaacttctggtggtaccccttctggcattttaatggtaatattgcgattctttaaataacgaaaaatttctaccgtcaataatcccgtaataatcgagccgaacaacgacgaggcactcaagttagcaatgttaatgtatcgcccactgctaatgacaccgctaacatttatagtcacgtgaactggtactgcggtcgacacgagaaatgctaagacggctaaaacaccattagttaatttatctaactgataactttcggcaagtgaagatgcgattccaaacgttgcgtacaaggccaagattccaaccgtataacgaaacggcacgtccaaaatttcagcgtaaggcgccaaaaagttagccaccgcttcaatcggcatattattgagaatggtaaagaacgagccgacaatcgttaatggcagcgttgagataattccttttctaatcgcggtcatatgccgctgcgtgccgactttattcgctactggcaaaactttagcatttaacatgttgataaagttatccatattacactagtcatacaaatatggtatgcgtagaagtcttaggggcctccgcgccaagaaagtttgtacatttcctttcatgagtttaccaatgagtgtattgttaattacgcaacatcagcaatcctgaccaaccaatgctgctacggtcgctgagctaataatcaacatccgttccaccccatatttactttctcatggaacagattcagtgctggtttcgacaaaattcacgtattattttcagaatggcgttccctccttttggcaaacatcataacattataatgttatgatgtaaaaaatagtgaaacccaatcgtattttaaacttgttggttggaccagctgatataaacaccatttttatccctcgcctatctctaaatgtctgaacacaccttttaaggtccgctgaaataaggccattgccccagcattaacggcaaggccccagtcttcacccaacatattcggccactgttatctgcatagcatccgcctgaacttccgacctgataaaaatgcgctgaccaccacagtgcatcagcgcatatcagaccaagtatcggttcaatttataaaacgtcataattaatttgatacgggacaacatccgtttgataagtcgcaatagaaaattcaactagccgctggtgaccatcataccccttacgttcgcgccgaatcgctaatggcgtttgactttcaagcaacgcccgctcactatcagccagagtgacagccctgaatttatcttgaaaatgtgtaatcgtctgaccattctcctgtaaaatcttatacagtgaacgatgccgaagggccgttagtttagtaggaaccaaagtattcggtaaataatgatcgacaaccgcaaatggttttccatctaataaataacggcgcttaatacgtaacatcgtcccttgagactcgctgggtagcaatgcagggacagctggcacgcgttcaattttgatcaactctttggtcaactttccttgctggccgaccgttgccgtaaacgactgcgtctgcgtcaacttgttaaatagatcgttactaataacgcgcgtgccaataccactcttcttctccaagtagccctcactgaccaaaacttcgaccgccttgcgaatggtaatcttgctgacttgatagtaacgttcaagttccccttcacttggaattaagccacctacttcatagtcaccatctagaatccgtcgtttaagatctgcggcaactttttgatatagaatttttgttcccatgctatcgttacctttcacgtacataaattattaatataactctattacatttcgatctaaaacaccagattacaaaactgtcaaaatcggtttattaagcggacttaacaatcaagtttggccgtcagactctgtcagcacttcataattatttgtataaataatttaaataatttttttgagtgccacgcacaaagtcttaataaaaaataaggcctatcagtggctaaacgtgctttcactgatagaccttattcataaatatttaacgacttatttagccaataaacttcgctgcaaattcgctgaattgcttaccagcaccagctaagaatgattgggtgccttcatttgtgatatgaccattttcatcagctaacttatcagtattaccgatgtacaattctggttgttgcatcgttggcatgtctaagaagaccaaagattgacgtaaaacatggtgtgctaagacgccagagataccagagatcgattgggaagcaaccaaagcaggcttgccgccccaaacactttgaccccatggacgtgaagcaacgtccaaagcattcttcaaggctgctgggatgctacggttatgttcaggtgtgacaaagatgaacgcatcttgagccgcaacggcctgacgaaattctgtatattctacgggtgaatccgcatcgtagtcttggttatatagtggcaacttagcgatatttaagtacgttacttcagcgtcgtctggtaacccagcaacgatggcttcagcgacccctttagaataagaatttttacgaatagaacctacaattacaccatattttgtcatatcaaacaatcctttcaaaactaatttcttcgtttcacttactaatagtaagtatatcaagttgttgaaaaagtgcaaccattttagcctatcaattttcaaaatcacttgttcaatcgccaaaaaacgttgttaaatcaagacttacgctccagaaaaatattttagtctatgtctaattaccgacagaaaaggtcatcggagtatcaatgattccgatgaccctttctttattttcaatacacgtctaatcgtcacgcatttcagcgcgatatttgatcaacccttcgtttaaaaccatcaaacatctaagaaatcttgataatcattatcaacttgttcaacatacgccgtggcccatttagccatggcttcatcaaacttcgccgaatttccaacgtatccccgaatcatggccgccgttggactttgcgcgtgagcctttgccaaaatcattgcgcacgtatttgcataggcttggaattgaccccagtctagggttggaatatcaatggattccttcatatcccgaaattgacggacataaaaactcttattttccatttggaaatagcccaggaacgcatccgaggttgcttgtaaaatgcgttgcgaactgacgatccgttgcccttccgtcaattccatggcggccgttaacgctggccgcgactggctcccgactttccgcgttggtaaagcttccttgatttgtaacaccatatggctaccatccgtactcgtcagaagaaccaagtaacatagtgacccaaaactcccgacgcccacactatgccgaataatatcagtaacttcatattgcgacaacagcaaagcgacatcggtccgtacgttcaataaatactcgctaattccggcctttagcccttgataagtttgccgatcaatatggacagaacggggcgcgttctccttaaattgccgttcaccgcgactattagtgaccgtaaacttacgcacaacttgttctgaattacgtttttgagcctttttaaccaaggatgcaattaaatcggccgtatcttcgggagcaccaccgaagttcaagacagcctgaacttcgttatcgcgataaaaacggtctaacgtcgtctgatcaaacatccgtttgagtgcttcccgataactcgcactcgccgcctgtatcaatttttcgaccttttttggtttaaagttagaatcacgagcagctagcaacacactaactaataaccgacgtaaatcccattcccacggatggacgccagcttcgtcaaagtcatttaagtcaaataccagtcgccgttctggtgacgcatagaatccaaaattaccaatatgagcatcgccacaaactacggcgggaatttcagtggacgactggtaatccaaatcgtaatccattaactcaactgatccccggaagaatgcaaaagccgaagcggacattcgttcacgccgcaatggtaatagttctggtaccagcatctcccgcacatgtttcagataatcactggcgtttcgcttcaccggtgtaaatgtccctaatttttcaaatggggtgacttggcgccgcgcctttcctagcgcaattaattcagcaaccgtatgatgttgtcgaatatgagttaaatcaagtggtggcatgagtatcaaatccttttatgatttactaattttattatagcgatatcttccaacgatagaaaataattcagctagttgagcccgcttctcgcgtcccaattattgaccagctgacgccaatttacaagcaattttcatgataaaacggcgattctagttgacgtacccctcaaagtcacctacaatttaagttataaacgataccgctttcaaaaagcgaggaggtcacgtattatggcaaattctgaaaaaacattggtcctagttaaacccgatggtgtcagtgaaggacacattggtgaggttatcacccggttagaacgcaagggttatcaaattgccgccttaaaggttattaaagcaaccgcggagcaacttcaacaacattacagtgagaaggttggtaagccttactttaaggaaatcgagacctacatgatggaaggtccactcgtcgccattatcgtaagtggtactggcgtcgtcaaagcggtgcatcgtttagctggtagcacccggcctgccgaagcacaacctggcacaattcggggggatttctctcatgaatatccagacggtattttacgaaatgttatccatacctcagatagccgtgaaaatgcgcatcacgaaattgcaatttggttccccgaattagccgttaaagcacgaaaagcagacaacaaagtaaaagcctagcttcatttttaacatcacgattacgcaattcgcaattactgatcaatggtctgaacgccattgcgtccagtaattgcgaatttgtatacactggatgttttccgtcacaacgttagtaaagcttccaaagataacccgtaaactggcccaactaactgccaacacgcgccgaaattttcgcactaatcgttcgcactagttatgattaaaccaatcaactaaatggtttgggggaatcattatgaacatagtcgttggaccatatgtacggcggccgcgggctgtcaaatcggacccgcgcaacaccagtaaattttcgatgtttaattcgctacgacgaattgatgaatgcctagtcttgattaaacgtactggcacaccaggattaattgattcaactgcaacgttaggtttgaacctaacccacttaatgggattgaatgtcatcgtaactagtcgtggacgttccttcaccatcattgttcaaggtcggcagcggtcgttcacgctgactggctgtctcattgaagacacgctctacaacgccgttcacccagcacaaccagactatctgatttcactaaatcgccagctcattaccaatagtgatgacttaattgagcaactctatgaccactattagctggccagcatcacgcaccaaaggctaacccaccgtgtgggttagccttttaaattgccccatattaaatgatcagttgaacgactttaagcagtgtcgcggatggtttagccggaatcttcatcttttgaacggctggcattgctgtgtgaacattttgggcaaccggacccacttgcgagcgttgccccgaacgactatgcgcaaccaatacagtattatccgcattccgcgcgtatatcacactattagtagcatcttgtaaatcatcactataaatctgggtcatttggtgatgatagaccgcgctgtgcggatcgtctggctgaattcgctgtccggccgcaattttgcggatatgtaacggggttgcctcgttgatgacccgagtccccttcaggtgtagccaaacttgtgcggcttccaccttagctgccggaaaatcactaagttgtggctgacggattgccttaaacgttgctgcggtactacgctgcagccgacgttgatgataggtccggcgctggcttgtatgccgttcaagctgcacttgttcccacaccaaacaagcaccaaagaggacgataccgacccgtaatgcccaaatcaattttttcaatgattagcccccactttaccataattacgctacttaatttaacatggtcttagctaattatattggcaaagccggtaataatttaattattaatagagcagtcgcaccaactcgccatttctagttgcgcttccccttaaactattaacgatttctaacttgacagctaaactgatttattgtcaaaatcactatttaaatattttattttatgatggcaatacaaacattttgattatcgcgatatacttagacgagcattagctttttcaataaggaggcactactgatgaactcattcaagaacccacttatgacaacaccctatctgctagccataatcgccacactgacgatgctagttagtccactgacaacggttgttatatcagtactgatatggttgtcgggaattacgctggtgtggttacaccgccagcaacgatggctccgcttcttctacgcacccgtgtttttgtacacttttttactagaacaatggtatttctccccatcaacccagccactgacagaaacgattctaattaacctcgcaattcttggcattgccattttcagcacatgggcagcttatcaattacgtcataacgcgtaaattactcaccaagaaaaataagtcccccagatgcggtaaccgtttcttgggggacttattgattgcttcaacagctaccgttaaataacgctcgttaggcaggcttcacttcggctagtttttgatccagatatttcttcaatgctgcttggggatgaaaaccaaccaccttttcagcgggctggccattcttgaatatcactaacgccggaatactcataatctcaaattgttgcgcaatttcctgatgttgatcaacgtcgagcgaagcaaatttcacttgcccatcgtacagttcatctaacgcttcaagcactggttcctgcatcttgcaagggccacaccaatctgcccaaaagtcaaccacagttaacgcggtaccatcagccaccgtcgcaaaagtcgtcttatcgactggttcgatcatatctaatcctcatttccaattgatttccgttctatcatagcatgttttcccacaaaattatgacttccgggtctgaatcacgtacataggtcacaaaatcttggtatatcggtgttctaccaatcaaaaattcgatataatagcgttatagaaacgatataacctaaaggaggaatttttgtgtccacacaaacaatcagtcccgaacaggactccgaattagtcgcttccgtcgccgctgaacaactcggtattaaagccgtgacgttgcgcaaatatagcaccatggttgaaaaacagcttaacgatgaaaatcgcttccgcccggccgataacagtcatcgcttatatacagccgctgatttaaaaacttttcaggcggccatcgaactcgccgaacagggcacaacgttagccactgcgctaggacgggcatttggtgctaaggtcccgacatccaaacaaccggcggcaacgacgactcagtctgagaaaccagcgcctgcaactaccaccaagtcgcccctcatcacgacaaccaccgtcgatcccagcaaaatggcaccagcggccaagccagatggcccgactaatgctgagctctataagcagcaagaaatgatcatccggcgcttagattcactcagtgaacgcttaaaccaagtccttgaccaacttgatcaacaagccagtcaagcggccaaaccttggtggcatttctgggaaaagtagccatatgctggtcaacatacttgctcatcagacttacttcggtagggcaagcattacctaccatccaaattaacgcgtgctgccagtcttaaaaataagctacctaccgttcatcgttccagttaactcgcctagcgatggctgctatcaagtggttctttgtcaggcaagacgcaaaaggcgcccagaattaaatttctgggcgccttttgcagctaattaccatggcggttagtaattagtttttttatcgaactactttgttgcagctaagtgcttttcgtacgcagctttgatttcattaactaaatcctcatctttcaagtcagttgtttcgcgaatgacttgttcgattggttcatccttcaataattgttgtaacttaacactttcactatcattaggatagttgaagaagaacatttcaccaactgtatcaactaaggcgctgtaatcgcgaccacgttccttcaattcccgaattgggcgaatgaaacgttcgttgaaacctaatttccgaattggtgtccggccgacccgttcaatatcatcagagatatatgggttttcaaaccgactcaaaatcttcttttgataagcatggtgtacttcaggatcaaagccccacttttgaatcaacaagtcgccggtttcacctaaaacgtgcttagcttggtcaacgacactgtcatccttgaccgcttcgccaatcgtcttgtagcctttcatgttaccagtataggctacggtggcatgaccagtattaacggagaagagtttccgttcaatgtatggttccaagtcgtcagcataatcaacaccctttaattgaatcttagggtttttcatctgggacttgtcgataacccattccttgaatggttcaactgaaacgaacaatggatcatcatgcttttgaagcggtacgatccggtcaacagcggcattggggaagcctgcattttggtcagcccaagcttgttcgtcttcatttaatgattcataaacggatttctttaatgactgactcccgccaatcatgttttcacaagcaatgatatcaattggtgtcgtattgttgttagcttgccgtaactttaacccgtcagcaattaatggcgcgatgaacttcaagatcttaggtccaatcgcagtcgtaaccatatcggcttgggcaatttcttcagcaaccgccttaggatccttaccgttgttaatacccttaacatcgtgaacttcaatatgtttttgaccttctgcagccaattcaatggtataaccattccgtttgtttaattcgtcaatcaaagtatcattaacatcaacgaaagtaatcttaaacccgttgtcagccaaggtttcgccaatgaagccccgaccaatattccctgcgccaaaatgtacgtctaacatgctaatcaacttcctttaatagatttatgatttcatcttcagattgagcgtccgctaacttagcaacgttggcaacgtcgctgcagtatatggcaatctgagacaagaggttcaagtgttcaccgttcaacccagcgatcccgaagataaccgttacagtcttatcatcatcgttatcatctggattaccccagctcacacccattggtacttggaccacggaaatcccggtctttttaatatacttcatgccatcttcagtaccatgggggatggcaatgaaattacccatatatacggagacatcctgattacgagcctgcattgcatcaatgtattctggttcgacacaaccgccatcgaccaatagttgaccggctaagcggatgccttcttcttgcgtagccacttgctggttcaacgcaatcattttcttatctaaagcttccattgttttcacctacgctatttcgttagttcgttcaaaaatgctttactaattaattgataaagttgctggcgatcgccagtcataaacgtctgcgtattggcctgactttcaatgactagtgcgcttaacttacccatcaaccgattttcaaaatcgctgatattggcgggcccgagcattaggacgattcgctgcaaccgaatcgattggttgtccatactcttaaatggtaatggctggtcaagttcgaaaatcgcacaatatggtgcagtgacttcctgacttaacgtatgcaccaacgccaagttcgtattgggaataccgaccggcgccagtcctaagcggtgtaacaaccggcccgcaacttctagcggatcatgaatcaagttcgaatcaatatgccgcgtgatcttaactagcatctcggccaccgtctcatcatcgttgcgaatcggcgtgatagtgaaacggtctaagatctgtttagcaatcgtcatctgttggtaaacggtgtcaaaatccaagttgattttcgtcggctcatcaaccggtgaatcgatcactttggtgcttggaaaatactgatgaatatattcccgtaaggcagtgacttcgttttctagtaacagtgggctgacaacgcggtaattcaacttaaatcccggtaacgttgtcgtggataaaatcatgtcaaagtcttgtaaattaacttggcctagattaccaatccgtgcaacctcgatagccgtgatttcaggtactaaccgcatcagtcgcgttttcaaaattcgcgccgtcgtcatcccattcgggcacaggaccaaaaccttgagtgcttggtgactcaactgttgctcatacgtactagcaaagtgaatcaacaagtacgtcaactcatcagttgtaaaatcctggtctttaaaaatcgttgcgaagccgcgcaccaccgccgaatacagcttaggatactgttcacggacctcttgtaactcagtggttggcggcacgggaccattaacaccgttacgttgtagggcaatttgcatatgtgccgtcaagttattcaacaagcggtcatccgtcccaaacgaccagttaaagttagtcgcaaccgcgtcaataaactttttgacccgatacgttagttgcaaatcataattcgatagcgacgcgtcttgatcgattcgaaacgtcaagcccttaatttgctgggcgagaaaatcaatttcagctcccgtcaccaccgtcttaatctcagcgggtagttgggtcataattgccagagcaatccgttgatatttcaagaaatcatcccgattgatcccgcgcaaatatgtgacccgacgttcatgctgtaaccgcattactcccgtcgtcaacgtgatgatcaactgttgtagctgaccatccggcaccgaagaaaagtactttttcttcaaacttcgcactgcttgataacagataatcaacgtttgggcgtccagtaagttcaaaaaatacgattgctcatcacttgctgatattgctaagccttggttcaacttcccgattgttttaaaaaactcgtagtcgttgatttcattattcaaaatggtggcaaacagattgcgaatactaccctcagtccccgccacctgaatcccccgggacttcaaccgttcaattgataagtcgtagtcggcgaatggcgttgctaatgccgtcaaatcgtttgaaatcgttgcaacgctcacatcaaagtcaagcgcaagttcttttaattttacggaatggcccgtcatcagtaaccgacaagctagggcgttttgccgcgtttgtgagtcaaacgccggtgcaatcttccgctctgctgtcaattggctttgaaacttggccagggccgtctgtgatccacttagttgaaagtgatgcttctcattaacaattttcaaatcagcattggctaataccaattccaaattactgaactcgcgataaattgttcggcgactactattgagaccggtttcaatctgactcattgaaaggccggcgggattcgctagtagcagctgtagcaactcatcttgacgttgtgtaaacttaaccatgatgccacctcatacgataatggtaataatatcattttatttcaattctgataccatcttatcatatttaggtgaactcaatagatcgtcagtaattaatacttggacctgcgtgtaacgggtctttaagtttttagctgcttctgcacttgaaacaactaataaactattattatcagccaattcgtcaattcctaagttcttaacactcacatgcttgttggctttcttgacccgatccttcatcaaggacgttgccattgtggctgttcctaaatgaccatcgtggtgaacaaagacaatttcatcaacaacactcaaatctaagttagctggtaggtcgtcgggtgcagccgtcgttgcttgtggtgctgcggatgcaggtgcagcatcgctaacttgatcacgagcctttaagttaaccacaacttggtcatactttggactgctcaagaagttgtcaacggctaaccgtaaggcgtgtggtgctttttgagccgcccgatcagctaattcgttttgcgtaatcactaataaaccaggttcgtctttcaaattgctaatcgccgtgttggtgacggacatgctaatgccagccttcttgactttatcccgtaataaggaagcccccattgcggatgatcccattccggcatcacaggcaaagataatatggtcaacatctttgtatgaagcaatcacatcagctggttcagcgtcagtagcactgccggcttcagtattgccgctcttcatatcgctcattttaccttgagcagcggctaagtcatcatcactggtcgacttatcacgtttcaagacaattgcggcaacgataaatgatgctaaggttgctaacgttaccccgataattaaaccaatgtagttagaaatactctttggtgacattaatagtaatgaaataatggaaccaggtgaaggtgttgaacgtaaaccaacgtttagtaaactgaatgtggctgtcccagtaaccccaccagcgataacagctaggaacaatgctggcttcattaatacgtatgggaaataaatttcatgaatcccaccaagaaaatgaataataatcgcactgggtgcagaagccttagcagtccctttaccaaacaaggcaaaggctaataagaccccaagacctggacctggatctggttcgagcaagaacagaattgacttacccgcactagatgcagcctgaatcccaagcggtgttaagataccttggttaatcgcattgtttaagaataaaatcttggctggttcaatgaagacgttggctaatggcaatagcttcatcttaatgatccagtcaacaccggcagccatagcagcacttgcaccagcaaccaatgggccgattgcaaagtaacccaggattgctagtaacatcccgataatcccagcggagaagttgttaaccaacatttcaaacccgctcttaatcttatcggaaatggcgtcatcccacttcttaatgcaccaaccgcctaaaggccccataatcatggcaccgataaacattgggattgaagaaccaacgatgacccccatagtggcaatcgcaccaacgaccccaccacgatgaccggcaaacaaagtcccaccagtaaacgctatcaataatggcaataaataatggaccattggttgaatcatcttagctaatccagcattaggccaccaaccaccagccataaagatggcggtaattaagccccaagcaatgaaggcgccgatgttcggcataaccatattacttagtgcactcccaaatttttgaacgcgtgccttaacgcccagtttctttttcgcaacaggagcgctttgggttgcattcgtatttacattttcactcattaggtaaagctccttcctttttcttaacaacttaatcatatccatcggggtaagcggtttcaagaacttctagttagacccgtggcacaggaaactgtgccacaattaaactcactaattcacaaagttaaaatttggcacagtatcgataaaaacttttatatcggcaataccagcagactaattaaacttttttcgtcagctatgatttaattttcacaatcaaattcaacattttatgcagaaaacacctggcaattctctcatcattttattatttaaatgattacgaatacgatttaacgttgaaatccccccgcaagctcctatacttataattaactaaggagtgacctatgtaatgaaaaaagacactgattgtaccgaaatattggttgggaaagctgctagcatggatggttcgaccatcgttgcccgcaacgaagatggctacggcccaattaatccgattaagtttattgtgcacgaagcccacgaccaaactaacgccagctacacttccgtaactaccggcgtcaccgttccgctgcctgaccatgcctaccgctacaccgcaaccccccaagccgatcaaagcgatgggcagtacgaggaagctgggatcaacgaattaaatgtcgggatgagcgcaactgaaaccactgccaccaatgcccgcgtactcggttatgatccgctcgtccatgatggcgtagatgaagaagtcatggtcaccctcgttttaccctacattaaaagtgctaaggaaggtgtccaacgcttaggtgccctaattgaaaaatacggaactggtgaaagcaacagtatcgcctttaacgatcacgacgatatctggttgttcgaaaccgctggtggtcaccattggggggcagttcggatgcccgaagacacctacgcaattgttcccaaccaaaccgtggtgcaaaagatggatctcaacgataccgacaatttcctaggtgccagtgatttagtggacttcgttgaaaagtatcacctcaacccaacacccggtcactttaatttccgtgaaatctttggtacccaaagtgaggcggatgcttattacaacactccacgaacatggtatggtcaaaaactatttaatcccgaaatcgaacagaatcccactgatcaaaacatgccgctattccgacaaccaagcaaaaaattggctattgaagacgtccagttcttcttatcttcacactataacgggacgccttacgatccatttggcactttcgcttctggtaacgcccgtgaacaaacacgttaccggtctatcgcgatggatcgcaatcagtgctcatctattctgcgaatccggaatgacgtgcctgctaagcaagccgccattcaatggatcgcactaggtttcttcgcttacgccccatacgtgcccttctttaccaacatcaatgacacgccgattgattatcgcaatacaactagcacggtcagcgttgataacgtctactggttatcaaaaacgctctccgtcttgattgaaccacactggcatgaattttctgaaacggtcaatgcctatcgcgacgggtgccaatcatatgcccgtggccgggttgccgcaaccgacgcagccattaccggcaatccgaccgatttcttgaccaaagccaatagcgaaaccgccgccgaaatttccaaccggacccatgcgttgtttgatactttggttaagcaagggctgttgttatcgaaaacgacttgggaaaaaggacaaaatctataaaaaaatcatcaacgacgtgctactggaacatttcagtagcacgccgttttgtgtttttaattatcattgatatgctgatgtgctaaccgatacccatgctgctcacgataatcattgggagttatcgccacttcgcgtttgaacgcagtaaagaaactactattatttttatagcctaattcagctgcaatttgttcaattcgcttattagaaaatgccagcattcgtttggccagttcaatacgaataaatgttaattgttccaaaaagctcttgttgaacagtcgtcgacacagccttgaaaaataatttttgtcatatccaaagtaacatgccgtttcttttaacgtcgcatctgcgttatgtgcgactaaatacgtaaaaatcatccctgattgcgtatcagcattaacatgtcgaatatttttaccaggaaaataagaatccgtaatcgaaatgcgttcctcatgatgccgcaatagttccgtcattaacaatcccaccgtcatctctcgttgataatcaataaaaacatcttgcaaatcttgccgttctaactccgtcaacaaatcaaagtaccgttgggttatctgatttcgcaattggcgataaacaataaaccgcaatgtccgctcacccgcattcattaaatcatgaaccattgggttatcaccgacaaccaccaagtttaatggcgtgggcgcatgcagacgttccgaaaaaacacttaactttactggtgcccccctattaataatattaattggctgcgcagatgaaaccattacaatatcatctggggacagtgccacgtactttccgactaatgttaattcagcgaaatcgtggcttacgataaagcgaatgtgaaactctgaactgcaatttggtgaacttgaaagatcattacggcgtagaccaataaaatcgctttctttcaattgataattgctatttaccgtctttatagaagccatcactatcacctgtcaatcccttaaaagatatataaacatattaataaggatattatacactatcaacttgtgcatattttagctttatactaactttgtaaattcgaataagggagtgcaactattatgactaatcaaacaattgatactgatgtcctcattgcaggcacaggtggtacaggactagccgctgcgtacgcagccgtgacccatggacttaaagtcaccgttattgaaaagcaatcacaaattggcggtaacacaaaaatctcaagtggatttttcgccattaatagccgtgaacaacgggaagccggtatgcacctaacaactcaggaggccattgcacaattagccgactacaatcactatttgtccaatggtaccctacttgcgcggatcgttaaccgctcggcagataccttagcctggttggaaaaaatgggaatggaaatcaaactcaacccaactgccaatacgactcagtttgcgcatcgtaataatgattatcgtgggggttcctatcatatgtaccaacataaagacgagagctatcagcgcatccaacaaacattaacgactgccggtgtcgattttcactttaatacgacctttactgacctggtaatcaccaacggagcagtcactggcgcaacagccatgaccgcttcaggtgaccagctaacaatcaccgcccacgcagtcgttgtggcaaccggtgggtacggtggtgatcgtgaaaaagttgctcgaaccatgcacaccacgcatctaagaaccttaggtgttccaaataacggtgaaggtctggctgctatggttaaagctggcggtactgacatcgacagccatgcgctcattcatgctgcgcaactagctaaatcccaagtcactcaaaagacttctcagcaacaccttgctggtttttccggtaatccattaacccaattattattaacccctcaactatgggtcaacatgcagggacaacgattcaccaacgaagatgtggtctacgataccgttgaatgggcgaacgctgcttggtctcagggtggtcaatatctctttatcgtggatcaggccacgctcaatacattcaccaccaaccgcaatcgcgaagaagtttctcaagcaggaccgggcgcagcgactggcagtggtgactttaccgcattagctgaagaagctgtcactggtaaaacagcttttaaggggaacacactcactgagctagccactaatgctggtatggatccttcaacattgagccagaccgtcgctacttataatcaagctgtcgcatctaaaaacgacagtgaattcagtaagcgcttgcagtctttggattattcaattagtgatggtcccttctacgccttcatctgccaagccgcttatcttggtacggtcggtggtgttcgggtcaatcgaaatctcgccgttttagatgacgatttcaaacctattcccggtctttatactggtggcgccaatgctggcggttactatgagggacacagctatcctgcatttgaaggacttgcctctggctttacttggacgtcgggccgaattgcaggaacaagtgccgcggcttacgtcaaagcaaagttcgccactgtcaactaaatcataaatccaatattgattcttttatttaaggggatgtccagcatggaaacaacaaaatcgatatcgggaccaagtaaaagctacgtttctaagacccggattggggttcttgcagtcagttcaatgggtatggcggcactcgcaattaccccatcctatgcagcaatcgcatccaatttttcactcagtaatacgagtgtccagatgctaacattattgcctaatctatttatgatgttagcagggttgattattggcaaactaacggcaaccaagctcaatctcaaaacattaacccttagtgcggcaatcttagtaattatcggtggttttctaccattagcctttcacacaaactttatgtttttgttattttgctcgtgcttagtcggtctaggtcaaggcgcctgcaccaatttatcacaagtcttaatttctcaaatgctaccagaaaccgaacgccagtccactatgggtttaacaaccaccttcaccaatctcggtggtattgtcttcatcatgggtggcggccagctagctgcaacgaacggttgggtaaataattattggatttacttattctcagcacttattttgattgtgatcttaacattagtgccgatgcatccggcagcagtcaatgcagccaacgatcaggacaccggtgaacagattaagctcaacaaatacgtcttttactgtgccttctggggattctgcacgttactcttaaataatgttttgaacaacaacatttcactatttgttgctgaagaagaacttggcgcaacctcacaagccgctctaacgtcaaccgtttcattaattggggggatgctatgcggcttgattgttggcgttatcggcaagcggttcaaatactcatccatcacaatctcgtttatcttatacggcctgtcctacctgttaatcggtcttggacattcgctatggttagcctttgtaggtagcttcatcgtgggtgccgcaatgagtatcgccatgggacaatttccatatttgatctcaatttcagttggcaaaaacagtgtttcgatggccctaggtgtgtacgtcgcgatttactcaatcgggggtgtggtcagtcctttcatcgttaatccattgactaaattagttgctggtatgggtattaacgtcttcgtagtcagcggctttattgcgctgatcctagatgtactatgtatgggatttcaattccagaaaaaattagtaacggcggcacaataaccgacttgaccgacaaagttaaaaagccgtgcttcacaacgcaatcgttatgaagcacggctttcagttcatttttagcttaattaaaattaatacttcttgcttaacttgctagcagccgcttcgtcaatgataacggtaacgtctggatggttttgcaagatacttgctggtaattcaggggtgtctgggccttcaatcatacccttgaccgcatcagccttgttttcgccgaatgcttcgagcaataagtgcttgctcttcatgatggaagctaagcccattgagaaggcttgcttaggaacatcattttcgctggcgaagaaccgcgcgttagcttcaatggttgattcagttaaatcaaccacgtgcgtcgtaatatcgcgaggagtacctggttcgttaaaaccaatgtgaccattacggccaatccctaagatttgtaagtcaattgggtgttcgtcaatcactttgtcgtaacgcttaacttcagcttctggatctgaagctaaaccgtttggcaagaatgattccttaaatggcttgtcattgaataaatgagtttgcatgaagtatttataactttggtcgttgtctggtgcaatcccaacgtattcatccaagttaacggatgtgcagtcactgaaatctaagtcactattaacgatttctttgtaagttgtaacgggtgtcgaaccagttgccaacccaaatactttcgcaccattgtctaaagcattcttaaatactttgaaaccttcttttccgccggcagcttgatcctttactacgataactttcataattaactgactccctctttgtttggtatagtccaattgtatattggtctagactaaaattcaagaggtttgtctgaaatatttcacttttattttttgcaatcgttatcattgttaaactgtcaagccaaactcctttaataaattaattgtatttttcgataattttgcctatacttaacatgttcgtaactccgtggaacgtgagaaattccacgactagccaaggctgcaaagtcattggctatttttttgcgctcatacctctacgccaaccatttatttgttcacatttcaatcaaactatccaatatttacattgcaattggtaacggctaaaattagctttgtatggaagatatatattacataaagggaggtgttaaccgcgaatcatgtcaagcaataccggttaatggccggattctcacaaaaagaactcgccagcaagactggcatcacccgtcaaaccctgagtttgattgaaaagggcacctataacccatcactgaaactctgcctcaacctctgtcacgcactcaaccaaacactcgatactgtcttttgggtcgaacccagttaggagatccctgccatgaaaaagattcgtgacgaacgtttaattttacaaaatttcaagaacatccgtaccacgttgttaattgaaaatagtgctatcttactgattttattttggcaaggctggcaaaaaaacaatcttcagaaagcctttacgtacgacaatccgttgtatattgtcctgatgattgccgtttttaccatgatcattttgtctgttaatgtcagcaccccaatagaagacaaacccaaacggtcatggcgctaccttggcctgtgggcactcattgaactaatcggtttcaccgccctattctacttcctgattgcgataaatcagccgttcattagtctgatcgctggtatcgccctgaccaccgtcactagcggtatcatgctgtatagcaaccacctgcgcgatcgtgattaacatcagatatcacctagacggtaccattctaatcacatttgcggtaaactattcccagaaattcaacggacacgaggtttttgctatggaaccaacttttaacaaaatgactgcgactggttaccatgccatcgaacaggaaattgaagacttaaagcaacaacggcccgagcgaatcagaattctggctgcggctgcggcactaggtgaccgttctgagaatgccgaatatagtagtgccaaacgggacttaggtcgcttagaaagccgcctgcgttatctcaacaagcagttgcaatacgcccaaatcgttcaaccagctgacaacaatcaactcgatatcggtaaattcgtgaccatcgaatttctggatgatcatgaccaaatcacctatcaattagttggaaaacaggaagccaatctcgaacaacaaaaaatctcattcacatctcccatcggtcaagcgctcgctaatcatactgttgacgatgtggtcactgtgaacgcaccgaacggggcttatcaagttaaggtaatcgcggttaagcgcgcgtaataaaatagttatgccaatcgattggaagcttatctttatttttttgaatcaaaaatacactttctgaagcgtatacgtgctaaaataaagacagtaaaaaagccggtacgttaataccgacttgaatcaaggcccgctctaagagcagttggctttaaatttagataatcaaagaacagtcacccaataccggccaaagttttggggtggctattttttgtttctggagttccatacctgatacatcgctagtgcgatgctcaaaatgatttgcaagaaagcaaaccaaacaagtagagtgaccacggctgaaaacctttcctagtgtgggaaacgtatttgtcatactaccacgacctttcaagatgaaaacagccaaccgcccttaaaacatacctataaacatattttaccagatagtggctcacagctacacagttagcattttgtatgattaaaaaagccaatcgctactgcaccatgcattgcgattacgctgatatcacaaaccaatcatcaacaagcagttgcccataaaaagatagcgacgagttatcatcacaacgtcgctatctttttatatcattcaaattaaaattcttggtacactgctggatcttgattattcaagcgaccatccacttggctcaaaccattaattgttgccatatcagctgcactgatttcaaaatcaaacacgtccatattacctgcttgacggctcggcgttgacgactttggaatcggcaaggtccctaactgtagttcccaccgtaaaatcaactgaccaacatttttatggtagtgcactgcaatctctttgagcgtctcattttgaagcatctcactggcccggccaaggggactccaatcttgcgtcaaaataccgtgtgcttgatcataatcccgttgtgcctgctggttaaagtacggatgtaattcgacctgattaatgacgggtaaaacacccgtttctttgtttaatcgttctaaatgttctggtaagaaattcgagaccccaatcgaacgaatcaagcctaacttctgggcatcaatcagtgcctgccaagcttcaacataatgatcttccttagggttaggccaatgaattagatataaatcataataatccaggccagctcgatataatgattcttgaatcgtattgatagcttccgtgtaggtgtggtggcgaccaggaagttttgatgaaatcaagagttccgaacgcggtactgacgaacgccgaaccgcttcaccaacagcaccttcattttcatagttaaaggccgtatctaataatcggtagccgcgatcaatcgctgagtcgatcacttgcacaccatgagcaccattcagtttatatgttccaaagccaattttaggtactgttaaaccatcacgtaacgtataagtttccaacttaagccacttctttcttttaaattaaacgatcagccaaggcatcacgaatcgctgcttcaaatgttgccggccgtgtcgttggggcatagcgttcgagcacacggccatcacgaccaatcaggaattttgtgaaattccacttgattcggccatgtcccgccgcctgtttgaggtaagtaaataacggatcagcgtcatcaccattaaccatcacccgtttggtcatgggaaacgttaccccgtagtgccgttgacaatagtcatgggtctcatcgtcatccgccttttcttgatgaaattgattggatggcaatcccaagaccactaggccctcctgctgatacttctgataaagttcttctaatcctttaaactgtggcgccaggccacagttgctagccgtattcacgattagcaagacctgaccgcgatattgtgacaagtcaagtggcgcaccactcatctcagtttctgtaaaatcatacactgattctgccatcgagatccctcctaagaatattaaccaaatacattgctttatccatagtaaaccacaaaattgtgacttttcatcatactttgctttagtttccggaaaattgattgcactgaatgtcattatccgttacactaaacgtatcattcatagcaactggggtgccatcacggctgagataatacccattgaacctgaatctggacaatgccagcgcagggagcaatgcttttatttggggaaccatcaattcagacttagccgcctgccaccgataatcgtggtaggcgttttttgtcgcttggatgcgtgaatgacaaactacttttgggaggatttaacaatgaaatgggttaaatcatggtacttgaacgatattattttactggcactaattggtattttctttggtgccatctttatggggactaattttgtttataacattttaagtgcggccctgacaccatttggtctaagcggtctggctaatgaactactacttggcttatggtgcatgcccggcatgttagctggctacctcattcgactaaagggttcggcaacgctaggtgagctcctcgcagcaaccgtcgaaatgtttttcggtggtcaatggggaatcaccacattgatttctggtgtcgtgcaaggatttggggccgaactaggttatatcgtcactggctacaaacactatgactggttaggcttaacggctgcggccgcaacaactactgtggtcacctttggctgggaccttgcccgtaatggttactataaattacagctatggctcttgattttatacgtggtcgttcgctttatttcgatgtttgttttcgggggtctgttaactaaaaccatcacggacctacttgatcgcagtcatgttttaaaatcaacgcattaatacactttataaaatggaggctttctcgaatggctagtatcgcgctgaataatttaacttacacctatccacaggcgtcgacacccattctggatcgcgttaacctaacactaccacggcaaagcttcatcctattgacagggccatcgggaacaggtaagtcgacgctcctaaagctgattgcaggcttactacccctgactccagattacggcaccattacctttgatggtcagtcattaactgctagcaccgctaatcggcgcgctcagcacgttgccatgatgtttcagaatcctaatcagcagtttgccatggataccgttgaaaatgaactaattttcgcacttgagaacttacaagtgccccgtgaccaaataccggcccgcttacttagtgcgcttgactttgttggtatccgaaatttacagtcacgactattaaatcatttatccggtggcgagaaacagaaagtggcccttgcaatcattgtcgctatggatagcgatgtcatcctactagatgagccctttgccagtgtcgatccgaccgcacgagccgtcttgttagaccgactcgtggaactacgcaatcaacatgggaagacaatcatcttggcggatcatgacctaacaggttacgaacagctcgtcgatcaagtcgtccaaatcaaggaccagcacttacagctcattgaccgtaccacctggtctgagttattttcagcctttactgagcagccacaacggtcatggtcagcaccgcaacgcgttgaacgcccttgttttcaacttgatcacgtcactttacaggcaggtgatcgtcaactattagtaccgacaacgcgtcaattgttagcacaacacaatacgctgatcacgggtcctaacggtagcggtaaatccacgttatttgaagccctcgtccgtctgcacccctatactggcgaaattcgttacgaagggacacctatcgacaagctaaaacgcaaacgctatgctcgccacgtcgccttgctttttcaggacgctgagacccagtttttaaacatcacggtcgctgaagaactggctcaaagtaaacgctatgcgtatggcgactactttaccgcagaccgtattcaaacggccttagtgcaactcaacttatccggtcgtgatgaacaagtcatctatactttgagtgagggacagaaaaagaaactacaaattctgctcatgttaatcatgcagtcaccagttctactcatggatgaacccttaaaagggctagatttgcattcgatcaatgccctggtcgcgttattacagaccacccaagcggcaactaagcagacactgattattattagtcaccagttaaccggcctgatgccattgattgactatcagctacactttgaaaatcaccatttagattgggtggtgcgatcatgaatcctagcatgaaattattattactactcatcattgcgctagaaatttcattcacgacaattgtaagtttgaacgtggcactgattattctggcactgatttacctgctcggtcaccgaactcggcttcgaacattagggtggttgctactcattccgttgctaccagcaattggactttggagtacccagtacattaacggtagcggtgacaagactttgatggcctgggtcctgttcacacgaatctatgcgtttgtttttacgggcgctacttttacgctcacgactgacgtcttacaattaaccgattcgcttgagcaaaactggcatttacccgccaaatttgcatatggcgtcctcgccgcgtataacttggtaccacggattcggcacgaagttcaagtgattcgggctgctggtctgatgcgtgggcaggtcctgtccttctggtcgccacagctctactttaaagcaattttggtctctatcaattggtcgcagaaccttgcccaggccatgcgctcccatggttttgtcgaagatgcaccccgcactcactatcgtcagattccactgactaagttggattggaccattgtgattagtggcggcttgcttttacaagtcggcgccttcgtcattccgtggcgctagtggtctcattcactgaataaacactaaattaaaacaggttttctcaattatgagaaaacctgtttttgggtaatattccccacttaggtcgggtcacaacaataacaagttgaccttaattcatgctttcagccgatcaatttgttgccgtaacgcctgaatagcagctgtagaagacgtcgggtctgccattaattgatcatacttgaactgaagtactgctaagtcagcttctaccggttgcggcgctttaacaactttgtcaggatcaactaattggtgcgtctcgaattgcaatacccgagtagcaacggcctggcaaaacggttcatcatgtgaaacaaaaattacggttccaggataattttgtaagtaatcggccaacgcatccagcgcgtccacatccaaataattggttggttcatctaacattaaaacgttatattgaccgactaaaatacgaattagctgtaatttaactagttcaccaccacttaacgccgataccagttgcggataaaagcgtgctggcaggcccaacgcgcccatgacgttacggatcgtttgattcggtagctgactgacttgccgcaccgtttgccacactgactgtttaccgtcgagcactgtcatatcttggttgaatactccgactcgtgccgccggagccaatcgtaatcctgacacccggccacctaaaattgcacgcagtaatgtggtcttaccgctaccgttgggccccacgatagcgacccgatcatgtggcctgatttgaaagtcagcgtgtgctaacaacgtttttccatattcagccaatgtgacattaagaccagttaccacggtcttacctgtaaacgtcggaaaatctgtcgcgactaacttaaagcctgaagtcgtaaagggcttagcaacttgcggttcccgttgtcctcgggcgaccatgcgtttagccgttcgttccatcttggccgcggtagcttccctagtcgctttcgtcttggcacgctctacttgcgacattcgccgattgccttttcgaatccgctgcgctttttcattacgttgacgctgcgctgctagtaactcacgctgatgagtgttttggcgctgatacgcggcttcctgagttgcgatttgctgcgcttttaccgtctgataatatgcgtaattgcctgcatatgcggtgaatttttggtgttcaaccgcccaagtctgtgtcgtcacagcatttaataattgccgatcatgtgaaatcaacaacagcaacccacgaaaacgttataactgattaataagccattgctgatgtgtttcatccaaattagatgacggttcatctagaattaaaattgttggccgggcgctcaaagcctgccgaattctggttagcatagcttgaccaccactttggtcaaaagtcggtgcgatttgggcaacatagctgactggctcgtccaccataatttgtcccgtataatcacgatcagtacccgtcagtaaatgggccagtgttgatttaccagcaccgttccgcccaaccacgccgattttatccccggcattggcgactaatcggtcaattgtaaatagtggccgtcccgccatatctttttgaatattttttaaattaatcattgtcattaataagcatccccttagttgcagggactaatttatggcacaaaaaaacgtcctcaaaatgagaacgctggcaattgattccaccagcaccctaattaatcccaaaacggacagtccacccctatcgctaggcatggctctgttcagttactagaattaattagttgcgcattggctgaatacctcgtgttttataagttactttgtagattagcatgtttaatttcaatttgcaagaaccattgttttttaaaagttttttcagtaaactaaaattactttcagaaagcaggtgtcagcttgaaaaagatcattgcaattaccggcttcgcaatgctaggtggtggtcttcgggaggggcttagtttgctcgtcacttggccacagcatttctggataacgtgtctgattaatattgtgggagcatttgttcttagcctgattactaacttgttaccagcgcggttacccgtctctgaagatattgttatcggtatgagtgtcgggttcgttggtagctttactactttttccaccttcacttttgaaacgctacaatcgtttcaaagtggtcatagcgttttagctttaagttatgtcgctgctagcttagggttgggtttgctagcggggctagctggaaacttccttagcacctattggctaccaaaggaggaattttaatgttagtcctagtcggattggccggtgccggcgcagctgtaggggccttaagtcgttacggcatcatgcgcttagcactacctctcaatcgatggccgttaccaattgccacgttatttatcaatctaaccggcgctttattgctcggttggattttaaccagctcattaccgcccaactggcagatttttctaggaactgggattatgggtggctatacgactttttcaacaatgatcaacgaactcgtgttgctcggccgtaaccaccatcaacgggtcgcctgggaatactttggcttgagtctcgtcggtggcctagtcatggtttatctcggaactttaatctaactcaaaaaacaggaagtctcacaaaactaactgagatttcctgtttttgttcaatgactatttagttccaacaagccgcctttacggctagcgtgccgatgacactagttttaacaacgctcatctttatctttcaaattacgtggtggcatttccgaataatgcaacgccggcaatcgccacgacgatcaggcctaaccataatgcgattttaaataaaaacaacccaatcacaatcatgaacacccaaccgataattttaaaaccaattttaaagataactttgagcaaccataaaccaattactaaagcaatcaataaaccgatcatctatgcgctctgcgaagagagcttccctccttacaagtcccatcatgggtaccttgccagttagtatagcacgcgctatacagcggcagactgattgcagtcgtaaattaagagaagcttaattttgcaacgccgcaacttgtcgcaccatcgctaattcttcgttagttgggatcaacatcactttaatcttggaatctgcgccactgatgagtccttcttgacccgcttcatttaatttcggatccagggtcacaccaaagatgctcagttcatcaataatttgctggcgcaaggtcgcattatgctcgccaatgccgcccgcaaaaatcagcgcatccgcccgttttaattctgtcaaatagctaccggcatacttaacaatccgattgacaaaaatttcaacagctagttgggcttggggattcgtggcttcttgcgcacggatttcacgcatatctggtgaaattcctgagattcctaacaacccagactgattgttaagcatcatcatgatttcattcggatcatcgatctttaaagctttcatgaggaatggcaatacggccggatcaacgtcacccgcgcgcgttcccattgtgacacccgttaatggcgtaaagcccatcgatgtgtcgaaggcccggccattttttacggcagctaatgacgcgccactacctaagtgtaacgtcaccaggttgaggtcatctttcggcttagccagcagttctgcagcccgaccggttaagtaaccatgcgagataccatgttcaccgtaacggcgaatatggtatttttgggtcaattcatatggcaaactgtaaattgcattcatttctggtaaatcggtaaagaattgactatcaaataccgcgtactgtttaacggtcggtaaagcctgagccatcgtctcaataccacgtgcctccatcggattatgcaatggtgcaaagtcactaagccccttaatggcctctagtaccgctggcgtcacttcaactgcttgcttgaacgtttcgccacccgcaacgactcggtgagcaactgccgtaatttccgttaatgagtcaataattgctaatcgctgtaattcagccaataacatctgcgccgcatgattttgatctaaattatcgactgtcgtttcaaacttttgatggtcaccatacttgatggtgaaaattgaaccgggcatactaatccgttcaacgagaccactagcaaccaccgtttcagcaggcatagcaaataattgccatttcaatgatgaactacctgcgttaataattaatgttttttgcatttctcaatcaactcccatgtaatagaataccgaacttttctgaaaattgctcaacttttttcaatcgtgtcatttgacatcttaattcattcgctagtcccaatcttccactgttaactaaccagaacatgttattattaagacgttaacttttacagattagaggaacccattaatgacgaccacaaccgatgtcgacctagtccaaactggattagcgcacttaattcaccacacgcgtaaacaaatcgaatcattaactaaagcattagaccacctgcctgatgtcagtgatttgcaactcaagggcacgttattgaagacgtatgctagccagatcgaagggcaccatcatttcgtcgaattgcccgactatcaaggccaccaactcagtattaaactcgatattaaaaaatcaattattgaaaatgccgaggattattttcatcattatcacaaaagcaaacgcggtcaagcgaccgttcaacaaaatttggcgacggccaagaccgaactataccagcaattagcaactcaagcagctttcgaccctaatgatccacaagcggtcgccgcgcttaagcaaacactgattgctgcgggcgcgattcatacccacgttttacactcgtctaaggccccaacacccgcccatccccgccgcttttacacgcacgaccacgtgctggttgaagttggtaaaaatagtcgtcaaaacgaccacctaacattgacggcccgtaaagattactactggatgcacgcgggtggtgaaattcccggttcacacgtggttattcacagtaatcatccgagtgaacaaaccttgcaggaagcggccgtactgacggcctattacagtaagggtcgtcagatgaaccgcgtacctgttgatgtgctcaccgttggccagatgcgtaaacccaagggtgctaaggctgggcttgtcacctttagtggtcctgcacgcacgatcaccgttgtccctgatgctactttagccgctgaattacgtgaccaagaggatattcaccatgacgccgattgaggcctatattgctaacacaccacaagcctatcaatcgcaattaatagccttacagcaaaccattgcaacggtcttaccagaggcgcaagagcagttaaagtaccagatgccgaccttatattggcacgaaaacgtcatccattttgctttattcaaacatcactttggcttgtacccaacgccaagtgcaattgagacttttcatgatcaattaatcacctataaaacaagcaaaggggccatccagtttccgctggatcagcccctaccacttgaattgattactgctattaccgaattccgtcgtcacgaaatcatagcgaaatacgacctttaggattaccgctgccaccaagactgtttaagaaaatcaatggcggttacgtcactcaacgcaatcggcttaacgactcccgcttgttgattcaaaaaaagctgctggtcgtccacagccgcaattaagccactcggctgatgaccatcacttaaagttaaccgaaccacgcagtttaactcataagcttgcaataacgacgcttcaattggtttcagctgttccattagatcacctcatcgaaatagtagctccatcatagcacatttttagaacgtacgttcgataaaaactattacattttgatgacgttgataaaccggtcacttgtaccaatcagtaatttcaccagctaactaattatgccgttaactaccgaggttaccgaacattcgcccaaattattttaaaattgcccggattcggtcagttgaagttagcgcacggctatggctcagttcaaaacatgaccgtcattaaattcaaaagccgccagcttagaataagtctcgtatttgagactgggcgggttcgggctcaaatcgatgtcggtttacgttccagcaattgtcgctccgccccggaggtcggaaatagggcgattattgctgaagaacaggagtctacctaacgagcctaagagtgagctatttttgaccttaataaacaggacgcgctaataaaaaggccactccccggcatattgggggagtggcctttaatgcaatttactttagaatcgcggtaatagcttttacttcatcatcactaaaggttaaattgtgcgttgcttcaagattagcgtgcaagtggtcgacattggtcgtaccaatgatgacgctcgtgacgacctgtgaccgtagtagccaagccaaagccatttgggccaaggtttgtccccgttgctcagcgattctgttcagggcattcaactgattgacaacggctgcagtcccctgatcaaataaatatttattcgttcgatgaatcggaaaatcggctggaattccttgtaagtagcgctgcgtcaataatccttcagctaatggaccatatgccaccaagcccgcattatgctggccgagatagtcaatcaggcccgttgtttgagcctgttgattcaacatgttatatgagtactgattaaccgtaaacggcgtgtgcatctcattaaaatacttaaccatcgttgccgtttggtcgcggtcataatttgaaattccgacatacaacgccttcccctgacgaaccaactggtcaagggccgcggcagtttcatacaaatcgatgttagggtctggacgatgtgagtagaaaatgtcgacgtaatctaaatgcatttgcttaagactacgatccaatgaactgatcaatgttttgcgtgagccgaaagccccatacggccctgaccaggccggatatccggctttagtcgtgatgacgagctcatcacgatacggctttaaatctcgttgcataatttgtccgaacgtccgctctgccgatcccttcgatggtccataattatttgctaaatcaaagctaaaaacgccatgatcaaaggcatctagaaccacttttcgtgaattggcaaacggcgcttcatccccaaaatttcgccatagccctaacgagacaacgggtaactgtagccccgtcttacccacgcgtcgaatcggtaattcgtcatagcgcgttgatgctgctgaatatgtcatcattactcacctcatctaatttttgaatactatttatattataccgcgcctgtaatattggtactgatcaaacgcttaagcggatacaaaagggcgatcctcgccaaatgctaggaccacctcacttaggagtttatatgtgatgtctgctgttgctgcctaattagactttgatttgaaataaggttcaacagtgcgtggctatttcaaaccaccatctattgtagcccggaatcgcccgttcgttaagtcattgcgcgtcagaattgaggtaggcggttataatatgctaaatattggcgaccatggacagcatccaccattactttagtgacgctcgtattagctggctccggtaagctcatcggatcggtcggctttagtatcgctaaggccatggctttgacggtaaaaccatgggtcacgacaatgatctgctcgtctggatgggcttgtgctgttgtcttcaaaaatgctgctacccgttgttgcacgtgcacaaaagtctcgccatccgtcgcaacctccacgtagcttggcaaaacgtcctgtaaaagtggatcaaagtactgcggataggccgctagcaactgatcattatcctgtccatcccactggccgtatgaaatttccaataaccgctcgtcctggctaacaggtagttgccggccttgattcaaaatcgccgccgtggcctgggtccggtcaagcgggctacaaatcaaccgatccgcgaagctaatgtcaaacgtatcgtgcaacgtttgcgcttgctgcttgccaaccgaattcaaatgcgtgacggctgtattaatcgtgccttgttttaaattttgggcgttggccactgtttgtccatgtcgtaccacgtaaaaggttgtcatcgtgcgcctccaagattaaattattattaataatactaattgtgccacagtcttttctcattatctagcttgacaaatagttacgtgcttgctaaattaataccaacgcaattaactgactggtgccaacaccagtttaacgaaggagtgtccaactgatggttctaactaatcctatcaatcatcatatcagttcctcctggtctacacacccatctgtgtcggcctaattttgcgtacgcaaatcagcctgagcacggatgctaagacattcgctaccaggtggaattgcttaatctcgttattatccgtcctggtagtcgaaaccgactgcgaggacttttttattaccttgattaaactactgaaagcgagggtttttcatgccaatttataatttttctgctgggccagccgttctaccacaaccagtcatcactcaaattcaagcggagctaccatcatttcgagactccggcatgagcattttagagatctcgcatcgctccgatttatttgcgcaagtccttcaagatgccgaacaagatcttcgcgatttaatggccattcctgacaactatcacgtgctcttctttcaaggcgggggcacgctacagttcactgctgcgccactaaatctggcgcctcatcatcgtatcgggttgcttgacagcggtcactgggcacaacgcgccgccgatgaagctaaacgggtcggtactaaagtcacgatactggggagtagcgctgccaaccattttaaccaactgccaacggtcgtccagcccatcgatcaatccctcgattatattcatcttacaactaataatactattgaaggaaccatgatgacgcgcctgccagttacgggtcaagtaccactggtagccgacatgtcatcaaactttttaggtgaaccttaccaagtcagcgattttgggctcatctttgctggtgctcagaagaatctgggtcccgctggtttgacaatcgtcattgtccgtgatgatttaattggtcaagtcgccaacctgccaagcatgctggattaccagctattcgcggctaaagattcgatgttcaacacgccgcctgtttttgctatttacgccgcgggtctcgtactcaagtggctaaaggcccaaggcgggctcagcacaatgactgctcgcaatcacgctaaagccgccttactctatgatttcttagaccagtcacaactatttactaatccagtcaagaccagcgaccgttcgaccatgaacgttccattcgtcacaggtcaggccgacctcgataccgcagtcattcaaggcgcccgtgagcacgggttattaaacctaaagggtcaccgcttagttggcggtatgcgtgccagcctctataacgccatgccgttagccggtgttcaggcattagttgactatctagccgcttttgaagcacaccatcgttaatcaaggaggatatttatgtatcaagttaaaacctataacgccatcgccccagccggcctcaacacgtttactgctgattacacgctcaatcaatctgagcatccggatgcttacttaattcgctcggtcaacctacataccgagacattaccgtcatcgttgaaagtcattgtgcgcgctggtgccggcgttaacaacattcctatcgatcaggcaaccgccaacgggactgcagttttcaacaccccgggaagtaacgctaatgccgttaaggaactcatcatcggcctgctcattatggcatcccgtaatctaatagctgcaacgacctattcggcccagcataccgaagctgatatttctcaacgcacagaacacgacaagacgcaatttaatggtattgaattaacgggtaagaccttggccgtcatcggactcggccatgttggcgctctcgttgccaatgcagcattgagtctaggcatgaatgtaattggttacgacccctatctatctgcagatgccgcttggaacattgccaaacaagtccagcgagcggccacgctgccagatgcagtcaaacaagctgattttgtcaccgtccacgttcctaaaaatgccgacacacttcatctgattaataaagatgcgttagccgccatgccaacaggcgttcaattatttaattattcacggctgggcatcgttgacaatactgccgtcatgaatgcgttagccatgggacaagttgcccactactacaccgattttggcgaaccccagcttgccaaccaatccgcggttaccgtgacaccccatatcggcggctcgactatcgaggctgaaatcaacggtgccacacaagctgcgcgcactatcatgacttatttggaaaccggtaacgttcatgcggccatcaatctgccagacttaaacgtcccgttcaacgcggcttaccgctttacagtcattcacgaaaatgtgcctaatatggtgagtcaaatcacggccaaactagcagcggccaacctcaacatcactaccatggctaacgccgctaagcaccagattgcttacaccatcattgacgtcgacgacctacagcagccacaacaagccgacctaatagctgaactgtctaaaattccggcagtgagtcgcgttcgactattaaaacggggtagcgtcgaatgaagattgaacacttacaacacccgacaactcaccaactcgatcagttaatgacaatctggttaagtggtaatttaacggcccatgactttgtcagtgccgactactggcgtcaacaagcccccttagtacgtgaagcattacaatcagccgaactcatcatcggactgaccgacggacctgaagcttatattctgggctttataggcttacaaaacgattacattgccggaattttcatttgcaatgatgctcaacatcaaggtctggggacggcgctattggcgactgcccaagctgaccatcatcaattacaattaaacgtctatgttgctaatcgcccagccattgccttttatcactatcacggtttccgtgtcattgatcagactagtgaccaagcaacccagcaaccagaatatacgatgcaatggcaacgttagttttcttaattaagccagtacgattcttaacgagtcgtactggctttatttgcttaataatattaatgattaaaaaaataatattgtatttaatctaattttaatgtattctcatctacatatcataatcatttgaagcagggggtacatatatgcaatggaaattatttgccacagttgccacgttaacggcaacgaccggcgttttactcgtcggctgtggtcagtcctcatccagttcaagcaatgccggcaacacaacggccaaaatggccaagactcaagtcctcaattggtcggaaaacggccaggatttgaccacccttgacccgtccttagccactgatgttatcagtgggacgatgatcagtaattcgcaagaaggtttgtatcgattaggtaaaaacagtaaggtcacaccaggtattgccactaaaacgaccgtgtccaaagataaaaagacttatacttttaccctgcgtaagaatgccaaatggagtaatggcgatcaagtgaccgcacaagactttgtgtatggctggcgtcgtacagttaatccgaagacggcttcccaatacgcctacttatattccggtatcaaaaatgctgacaaaatcgtcagcggcaaggccaagactagtaccttgggcatcaaggccgatggtaagtataagctgaccgtcaaacttgaaaagcccatgcagtatttcaaattattgatgggtttcgtggtcttcttcccgcaaaaccagcacgcggtggaaaaatacggaaaggactacgggaccagttccagcaagatggtttacaacgggccattcaagatgactggttggaaagggaccaactcgacctggacacttaagcgcaatcctaattactgggataaaaaacacgtttacttaactaagatcaaagaccaagtcgtgaagttgacgacgacagcctttaacctcttccagagtaataagctcgacatggcaacgttatctggacaacaagtcaagaacgaaaagaataataacaaactggtcatccgtaagtcttcacgtctaaattacttggaattcaatcaaaagaaggtgaagttactcgccaataagaagattcgtcaagcaatgtcactgactttgaatcgtaagcagttggtcaacgatgtcctcggcgatggttccgtcactccaaagggctttgttacgaccggacttgctactgatccaacgactggtaaggacttcgccaccgaaaatacggttaaatcagctgttactcaggacaccaccaaagctaaaaagctctggaaacaaggactaaaagaaaccggcaagaagtcggttaccttaacgttaactcatgacgatacagatcagatgaaggccctcgctgaatacgttcagggacaattagaaaaggaattaccgggacttaaagtgcaaagtgtcaccgttccttataagacaagaatttcccgagaaattgcgggtaatttccagctggttatctccgcatggcaagctgactttgctgatccagtttcagacctcggtatcatgacatcaactaacgattacaactttggtaagtggaccaacaagactttcgatagtgctatcaacacagcaaatagtacaaccagtacaacgaagcgttggcaagctctcgcaaccgctgaaaagacgatggcgacggatcaaggggtcgcaccgctctcacaaaacgtcatcgcacaaatggtcaaccctaagctgaaaggcctagtctacaacacggcgggcattaactataacttcaagagtgcctatatggccaaataaggtgacctaactagcatcgcctcacgtcaaactacccttaaatcgcacaataaaaggtatcgtagcaacaaactacggtactttttttgtgtttcttgacacattttgcggctgttaattactttaattattagaatcaaagcattgattttaatctttctttaatgtattctcgtgaccattcaagttggggggaagttttactatgaaatggaaagtaatgttgacaactgctactgcggccgcatcgaccggccttttgttagctgcctgtagtcaaggtcagtccaagtcagataatgcggggaacttacgcgcgggaatggcacaaaagcaagtcttgaactggtcagaaaatggctccgaactaacgactttggatacttcgctagtcaccgattcgatcagtgccaatatgatcaataacacgatggagggcctctaccgtattggcaataataataaaatcacaccgggcattgcgacccatactgtcatttccaaagataaaaaaacttatacgttcacattgcgcaaagacgccaagtggagcaacggcgatcccgtaaccgctcaagatttcgtttatagttggcggcgaaccatcgatcccaagaccgcttcgcaatatgcttatctttattctggtatcaagaatgccgaccaaatcaccaatggtaaagctaaagccaatagtttaggaattaaagctgacggtaaatacaagctaaccgtgacacttgataaacccatggcttattttaaactcctaatgggctttgccatcttcttcccgcagaaccaacacgccgtacagaaatacggcaaggactatgggacaacggccaccaagatggtctacgatgggccgtttaccatgaagggctggaaaggcactaatacgacatggtccctgaaccgcaatcctaaatattgggataaaaaacacgtttacttagaaaagatcaatgaccaagtcgttaagtcaaccacgaccggattcaacttattccagagcaacaaactcgacatggccaccctgagcggcgaacaagtcaaaaacgaaaagaataatcccaagttagtgctccgtaagacatcccgtctgaactacctcgagtttaatcagaaaaaggtgcccgcgctagctaatgccaagctccggcaagcgatgtccttaactattgaccggcaccaacttgtcacggacgtactagcggatggctcagcagttccaaagggctttgtcaccaccgggctcgcaaccgatccaacgactggtgaagatttcgctactgaaaatgcagttagtgcggcgacaactcaagacaccgctaaggccaagaaactgtgggcagaagaattaaaagaaaccggcaaaaagtcattaaccttaacgcttacgcacgataatattgaccaaaccaaagagacggccgaatatgttcagggacagctagaaaaggaactacccggtttgaagattaccgatattaccttgccattcaaaaaccgacttgcacgtgaaatatcgggtgatttccaactcgctatttctggctggcaagctgacttcgccgaccccatctctgacctaggcattctcacttccacgaatgattacaactttggtaagtggaaaaatgctgattatgacgctgctgtcaagcaggccgagcaagcaactgatccgacagtacgctggactgctctaggcaaagctgaaaaaattattgggacggatgaaggcgttgcaccattaactcaaacaacgctggcacagatggtcaaccctaagttaaagggcctgatttataacacttctggtaccaactataacttcaaagacgcctatatggcaaaataaaccatcagataactcacagacgctcactagcaaagactagcgagcgttttttatatagtcaagatatatttttagaatatgcaagattatgtttaaatattgacaaaattatataaaaagtttttaattagggtaaatgaaagctgtttcaattatgacttaaatatgtaaaggaagcgttgatggtatgaacattgagcttttcatcgcccgccgcaaagccctaggactttcacaaaaagccctagcagatggtatttgtactcaggcgacactaagtaagttcgagaacaatggcaaagcacctgccatacgaatcgttgcccaactttgtcagcgactcaacctacaattggaagatgtctttccaaccgaacgcgtcgctgatgccgctgttttgaagattttggaacaggtcgagttcgacctcattacaactgaatatcaagatgccgaagtacaacttgaaaaggctgcggatatgccgcgacatgaccgcgaaaccaaattacaatattgttatctaaaaggctatgttgctgcccttaaccaccacccgatcagtgatgtcatctttaattttgaccaaatcatcaccgatttggacgaggctcacatcacaatctatacacagctggcctactgtggtatcgggattgcttatcagcagaaccaggataacgataaagcccagtactattttgaaaaagtacgccacgccctaccgaacctaccgctagaaacgaccgctagtgtttggcgcgtgattaacttagcttattacacgggggctttttacgctaacattaatgatacaccgcggagtttgcagttattaaactacgggattgagatttgtgcgcgattccacgttacctattacgcagcgcggatcaaattcttacaggctcaattatccgatgaaccggatcaaattcatgaatatttaaatgatgcggccgcccttgccagaatgaacaataaccggcaattacttaagaatatttcaagttattcagattctcactaatttacggttaaataattgatttttgttaataagtcgcctaaactgcaagtattaaaagacgagtttttacaactattgaggaggtcttgcccatgttattagcaggtttattggccgcagccggactagctgccgttgccggcgtcgtggctggcgcccgtgttcccgctgcccaaccagtcagaattaagcatgaccaacgcacatctcaaaatcgtcgataatgtggcgacacttatctatgatataaataaaggctactggaagcgaaattccagtagcctttttgtttaattaaatcgccgttgacgactaacaactgttagccctagcaagaaccagcccaaaatcattagccaatccattgattgttcactagtctgtggcaattgttgcgccgacttgcgattagttgcttttgtaactttaacaactggtttagaagttgctactaattttattggctgtcctaacaatttcgttggccgagtcgtggttactaaattagtttgcttgactaacttagctgtctcagtcttcgttgtgacaacctgatctgaatcactatcctcgtcagcgtgtcctggtagcaccggttcactcggttcactcggctcacttggttcactcggttcacttggttcgcccggttcgcttggttcactcggttcgcttggttcactcggtttgcttggttcactcggctcacttggttcactcggttcactcggttcactcggttcactcggttcactcggttcactcggttcactcggttcactcggttcactcggttcactcggttcactc

SEQ ID NO: 16 - DNA, 60391 bp, synthetic construct
  source 1..60391: mol_type = other DNA; note = Lactobacillus plantarum PDG8 - contig 16
gacgaaaaacttcgtccaaatcttgcttttgggctagtgcagcgataatttctgtggtaagttcattcatggggaatgcctcctgtgatgttttctgtgattactaaatatcataagggaaggcattccctatttctatacaattcagaaatcttttatgcatttacacaagatattttacgctctcctctaatttaaaactatcataaagataaccatgaagcagacgagaaattaacctactgaattgccaaagcaagtgcaaccttataaaaatgtggttgatgttgaagtatcaccatgaattgctgaaaaattcgggtagtttaatcatatggaagattgttaggacagcaataaaggaacgactgaagaattgaataaacgtcagccaggaaagttgaaaaaggaattcctagaagaatagtgcaaaggattataaacaaatggagattgcatagtgagcagttatagccaagcaaaaattttaatacatgaaaacaaagatttagtagatcattttggtggggcgtcaagtgaattaatagcaatgggagaaacaaaactaggtgtacagtttccgtctgattataggaagttcttattggaatatggcgccttaacattcggtgcggctgaaatctatggtgtttttactgaggattttgaaaattcaggagttcccgatgcagtttgggcaactttggatgaacgtagggtggtaaagatgcccacaaacttagtgatgatttataatacagagatgggtgaaattctttgtttaaattatagagaattaaatacaaatcaagagcctaaaattacttcctagttttccaggatttgctgaaagcgttcaaaaaaatgaagtcttatataatagttttggtgattttttgctagatatagtagaaggagaattagagtaaaaaaacaaactgcgataaaggtccggatatacgttaatctggatggtcagttatagccatgatggtggaaaatatgacacaggaactagtgttgttattggtcagtagccttgctggttagtctaatttactatggctgattaatttagattaagcatcatgcgaataggcaatatcaattaatcagataaaccaaccgatattcgacgaaaaccatttgccggatatcggttggtttttagaatattgatgaacctagcatattctaaatattaggacgattacaggtagtaatatagtaattaatgtagtgactaaattaggtgtagaggtgggcccaatgatgttgctatcaggaagaatactgaatgatcccgaacatgttataaatttgctaagttaacaaaggtgcgaatgttttggcaactgttaagaaagttatgaggaaggtcactgggtaaaaagatgttcaatcaactaaatatgacgatgaactgtgcggctaggaacttagttaaacgcaagtcatcgaagatttattattagaggccaaacaactttgaggtctaactaaacacacgacaaataaaggaacttattatgaatttaataacgttaaaagatttgagagcaaaaaggttaacctataattgggaaacaatttatgttggcatggaaatggcgtattttaccattcaagctatttcagattatgctgttgaactaatggaaggcggaattaatgatgaatttatcaatcaattggcatggggagttgaagacggggactcatcacgaatattgattgaaataaagtgtcattttaacttagtatctgaaaaaaacaatgatgagtataaactagagaatagaaaacttaggtttgtctatctgtccaagctcaatgatgaagtaactgatgacaagaaattattggatgaaattgaaaaattttatgacaaccagggctatcctgaagatatgaatacttttattggatatatgcctcaagattcatacacaaattgtaagatcttaattctaaggttccatgagtttttaaatttagagggtgaacaattacgattgatttaaatgattaagcagtatgatcaattgatttgcctactgaagtatagggtcgaggttaattatttatcttgattatcctgaggaaagagaattgatggatgtattcgacgactggattgcatagaaaatcaaaaagaattaagaaagtgtgcatcacaaaattagcttcggtaactaattttgtgatgtgtttttaaattactctgaaatcaaggcatgtttttgataacgacacagttaatgataggcatctttccaaactaacctccaaatacgtttaatccccttaaaaatcaggtttaaatattttatcctaaccaccacgtctagctataatcaaactagactagtataatgaaaaattacttgaaacggctagtcagcttaactgactaattcggattagttttaagtgatcataacaatttgggggaagcttatgacaaaaattgcgtgtgtgattgtgacttttaatcgtaaagcgctacttgcggaggctattgagagtgtcttgacgcagccggaagcgccagaatatgtcttcgtcatcgataacgcatcgacggatgggacggaggcgtttattcagcaacaatttgactttgatgatcaacacttggtttacgttcgttgtcagcaaaatcttggtggttccgctggttttgcaactggaatccggctagcattgcagactgactgtgattggatctcgatttctgatgatgatgcgatttttcagaccggctactttgcggcgatgcggcgagcgattgtgactcagccgcaacaaggcgtattttcaggatcggtgttattaccaaatggacaccatgatgcgatgcatcgtgaaatgattaccaattcgcaaacactgacggttaagcccatagccgaagccgactatgcgcaggactttaagtatgatattttttcgtttgtgggtatcttaatgagtcgcggcattgttgaacgaattgggctacctgaacaggattactttattcggtttgatgactttgaatatgcgctccgggctcgcaagtatggtcagtttctaaatgtccacgacgcgttggtcctacacaaaacgacgtatactcgtactgctatagcgccgtggaaggaatattacgtgatgcgtaatcggctggcatcattattcaaacaccgtgggcaaactcgggttacctgctggtatacccgtcgctttttagcgcgcaaattattcgccatcttgctttttcgggatagatggggccaagcggggccactgataaaagcgtatgttcaaggttaccgtgatggttggcatgaccggcttgggcgcaatcaagattatttaccataaaggacgttaggctaagacaaggagtggacaaacatgcaatatggggcgattgtggtaactttcaaccgcaaacaattactaatcgaatcaattacggcactactgaatcagacggtcccacccgcgaaaattattattattgataatcattcgacggatgggacaaaagctgaattacaaacagctgatattttggctaatccaagtgttgattaccggtatttgaccaaaaatatcggtggtgctgggggctttgctcgggggatgcagattgcggcggcagatccgaacttggattgggtttcaatgtccgatgatgatgcaatttttgagccagactattttgaaaaactaattgcttatcagcaaaatcatccaaatcgccaaatcttgacggggagtgtgtatattgaggatggccgtttgcaagcggatcagcggaaccggttcaccaattggagtacctttcaagcgcaggcggtccctgaaagtgaatatcgcggtaattttgagtttgaccagtacactttctgcggtgttttcatgagtgtggctgtgatcaagcaagtgggagtggcggacgctggctactttatctggtgggatgactgtgagtacgcggtacggacggccaagctgagtcgaccggtcaatgtgagtgcggctaaattaattcacaagacggctttaccttccctggacttcaagtctaaattcgtacccgattggcgtctctattacgggcagcgcaatcgcttgattacgattaagcggtggcgtgcaaactcattggtcagtctcggatggttgcttggattctacgcccgattggccattaaactctgtggaccgttttatcgtggctatcgcaaaatggttatcagagtttacttggaggcgttacgtgatgcgagtcgcgagcgtgagggcttgaatcccaacttcatgccgggacagaagttttagtgtgggcctgatcggtgaactgtctgatgacatgggaaccgtatacaggcgaaaccagtgattattgcaatttaaggtcagattactaaaccaggccgactcaattttggacatcagcttcatcattattaacaacgaattaaaagctagttgtgctgagaaaaaacttcttggcacaactagttttgtgttttggtgacattttagacggaaaagcaaaatttaatttttagatttattttgtaattcgaatggataattttactgtttttacagcaacgtttattggtcttttgaccagtgaccaccagcaagcattcagatgattgcttgtatttagccgcaatggttgaaaccggtaatcataatattatttgttatttagatagtaaacttaatttagcaagccccaatatttgattaaaacccattatatccgtatgttgagcgattgtttatcacgtaatgtttgttataattcaccaagaacaagttaattttgggggaattcacatgaacgaacaatacgattatttggtagttggtgcgggactatttggtgccgtctttgctcatgaagcagccttgcgcggtaaacgggtcaaagtgattgaaaagcgcgaccacattgctggtaatatctacactaaggaagtggcggggattcaagtccaccaatacggggctcatatcttccacacttcggatcgtgaaatttgggattacgttaatcaatttgcggaatttaaccgttatacgaatagcccagtcgctaattacaagggccacatgtacaacttgccgttcaacatgaatacgttcagtgaactctggggcgttcggacaccggcagaagcagccgctaagattgcggaacaacgcgcggcggcgaatctcggtgatcaccaaccacgcaacttggaggaacaagcaattgcgttgattgggaccgatatttacgaaaagctgatcaagggttatacggaaaagcagtggggacaaaaggctacggacttaccagcgttcattattcggcggttaccggtacgctacacttacgataacaattactttaacgatacttatcaaggtattcccatcggtggttatacgcagatcgttgagaagatgttagctcatcctgaaattaccgtggaaacgaacaccgacttctttgcgcataaggctgagtatcttgcccaatacccgaaagtcgtctttaccgggatgattgaccaattctttgactatcagttaggggaattagcctaccgttcactacgttttgagactgaaaccgtgcccgtggataattatcaaggtaatgccgtagtcaattacactgatgctgagacgccgtatacccgggttatcgaacacaaacactttgagttcggtaagggcgatgcggatcaaactgtgattacgcgtgaatttccagcgaactggcagcggggtgacgagccgtattatccggtcaataatcaaaccaacaatacgctctacaaacagtatgcgaagctcgccgcagctgaaccgcaagtcatctttggtggtcgactaggccagtatcgctactatgacatgcaccaagtgattcacgcggccttagtgacagtcgcgtcggaatttgcaacgaccaaataaaagaatgtgtgatgattgaagatgagaaaacggctagcaattgtgtgggggagcctagcattgctcgcactattattgggatatgcttgctacgccctgagtattcagcgcggtcaagacacggtcacgcggatttatcaaactgatcaaaatgggacgccgattatttcacccggaccaattaccttagtaggtaaggtcaatcaccgcaatttatttcagtctggcattaacggctatgtcttaacgaatcgcgatccattggcgactttgttgccgcgccgtaatcaaacagtgcatctaaagtatcgttctgcacagacgacggtggagctacgcaagacgctacgtcaagcacggtatttacaggccggtactcagaataccgccacgccggtctttcaaaatcgacagcagcgtggtgatgcgacaacgtacggtcgtatcagtaccagccaagacggccggatatggacgaaactaccaattagttatccgcacgtgcaattgtcgcggccgagtgtctggtacgcgaatggacgcttgacgttgatagatgggcaagaccgttactggacgactaattttaaagattggcaacatcaacggttgaactttaacggggctgattttaagcaaggtcgggttcaggccgtctttccaggtacgactcgttcagcggttgttgtggtttgatcgccaaagcagtcgcgccaaactctattatggacagctcacgaagactggacgggtcaaagcttggcacgcgttacaactaggaaagctcccagcgcgccaagttgctggaatgagcttgattgatcaacacttatacctgtttcgtcagcgcggtacgcagttggccgtttatcgtgccaatcggttgacgcgtccggtcaggttggttggtcgcgttaagctaaatcatgcgcagtcacaacgagtgaccgcggtgaatttgataccgaccaccaagcatcgctaccggttaatatttgacttgacgacagctgaaaaggttcagaaacagccacgttatcggttgcttgatcggcgatttaaagcagtggggcagcagcatctattggtcactgattatctctggagccaatttcaaattagtctacgtgggagtgagtgaggcatatgaaggtacagccaaaggaacgctttattttagcgtggcggtggttgccgctcgaattgctgatcattatgctaagcgtcggccttggatgggcgggcaatcgatggctacctaagccggtgtatcaagcatctgttgatattcggattgcgcaaacgccacgttcagggctgtcaacagcccgtctaaaacgtcagcgacgccaggatatcaaagctatcacgcagttcaacgtgatgccacaccagagtgcagtgctgactcgagccagcacttatgcctatgcgcattatggcatttggcaaccgattcaggaactgagtgagtcggtccaagcggcaccagttgcgcggcgaccggtcttgcgagtgacagcaacgagtagttcacggcaagtggcccagcagaatgttcaggcgttcaatgtggcgattaaagctaatctgacgggcttaaaaaattatcgagtgaagacagttaaacgtaccgtaacgcgtgagacgaacgtgatccgcggggcgctttggaagttaatattagttgttgggggcggcttagcgttgctgagtccgtacctcgtgaaatatggtcagggttgggggcggcacgatgatgagacgtaggggagcaagtatacagcagcaccgtaatgcgctctatctgattatctttggaatctacttagcctcagtcacactacagacgacgacctttaacgagatgataccgcatcgagtgggcgttttgattgaattagcgactttggccgcattactgggcctcgtggtttgcttagataccttgacccccggccaaattattggagaagtcagtttacttgtactggtgactgtcgtgacgctcacatcgggtgcgcattatttgatgccgacaatcatgttggtgattgcagcccgggaagtttcgtttcggcagatcattcaagtttatttgggcgtcgtggggacgattctcttgttagcgctagttgctgcggaagtcggactgattaaaaatattacgtttgcaactgccgatgggttacgtcagtcgtttggtgtcgtgtataccactgattttgcggcccatattttccatctgtgtgcggcgtatttgtatttattggcccgtcgttttcgattagtagcgctattacctgtgttgtttggcttggcaatgatttaccagtttacgaaaacgatgacggatgtgattgctttactcgttttgatcagcttgtacttggtctatatctatcgccgtcagcttcggtggcttcggccgatgattcggtatagctttttgatgttaccacttgctagtgggctaattattgggttgtcgaatatttttaattatcaagaccggttgctggtagcgctcaataataccttgtccacgcgactcgcgctaggaaataacgcgttattagcatatggcgttaaattattcggccaagccccgattccaattaatggttggggcggcgatcggtttgaaacgtttaccaatggtgttggtgatgcaacgtatttcttcattgactcgtcattcttaaatatgttgatttcatacggattactattaacgctgattataattatcggtatgacctggtttttgtatcaacgtacgcggcaacacgattatttgttgccggtaatctttgtggccattgccatcagtagtatgtttgatcagcacttcttagaagtaacgtataacgtctttattctgatgttattcgctgatttaccaaattatcaaacggcagtcggccccgcatttgaccaacctgtcgttattcgaaggggggcgtcgtgccgatgaatcatcaacaggcttatcgggtccagcggttgatcctgatcatcgccctgatgttaattctattcggtgataccgggatgaacgcggtatttagttttagccaccaaccacaaagtatctggttctatccgcagctcgtcattgcattgatgacggcagcaggtcccaacttattattaatggccctgggtgcctatcaattgcgacgcgcggcgttaccagtatcgcagttgattcgccgagtcttatggataatgggtggaattaccttattctcactggccttctatcttgaagacttggtgacgcaaggcagtttaactagttttaacatcgctggcttttttaccgcgttagcccaagcgccggtgggcttttatgatattttatatgaactattgggcttctttgtcaccttgccgttgttaagggtgattgcacaccatgcgagtgttgcgattcagcaatacctattttgggcggagctcgtatttattggcatggtaccaatcttggcctatttcactggcttgacgacgatcagtgttaatccgccgctcgcgattacggccggttgcttttttgcattgatggggtattggttgagccaaacggaggtgttacaccggattacgcgagaacacctcttagtggcgtggctgctgacatgtgggtgctatgccgtgatggtgtcggtcacgatgtatcaagtgaatctggaaaagaattttgaccttatcagcagccagccatttgcccaaacctttcaggcaattccatgtttgacgctgtgggtgacgattgccacctggatgatgaaccggccacggtccaaagcagtacgccggcataactttgttcaaacgggttatggtgatatgctggtggccggtctactgattacaccatttatggtcattaatcggttgctgacaccaattattggcgcgtggtggtctggttggctctggagtattgcggtgctgatcgttagtgttgaactagtatggttattacgacatgtccgctggttgcaacggatattaccagatttatttggtggctcccagttaataggaggctcagttaatgcgcaaaagaattgagtggatcgatattgcaaagggaatcgcaattttagcggtcgtggttggtcataccttgggcccctataacgggcaattcttcggtagtttgatcttcgcctttcacatgccgattttcttcatgttgagcggttatttgtatcactcacgcccggcacgacaagaatgtcagcgtggcatcattaacctattactaccgtatctcgcaacggcagttgtgctcttagtcgtaagtgcgatagcccgattattaccgaatccgctccttaatgcgtattttccaagctggcgacaaggactaattgccacggcatacggggccggttcggcagtgttcaatccgtggcactggcaagttcaaccgattggggccgtgtggttcttgctcagtatgtttattgcgctgcaactgttcaatggtgtgatgctactaacggcccgacgtcatcagcgctggcgtcaggccattgtacggggcggggtgttcgctattttcgcaatcttaggtggttggctcggtcaagtcgcttatttaccgtgggccgttaacgccgcgttgttagcacagctctttttatatgctggctacctcgttaaacaaacagccctgctaagtcggatatcatcagcttggtatttattattcacgttcatgtggttagtgagtgctttccagggttattttgcgttgacagttccaacatcgcctaatctgttgattagcgtcatggggggcgttgctggcagtttgtgtatcattcgcgtcagtgactggcttagtcattatccgaatgcgcggccgattaagtggttaaaacgctacggtcagttatcgctagtggttctgtgttttcatttgatcgatctaaacgtgattggcattgaaggatggttgacgaatcatttgattacccatatgggaccactcgtgacgacgatcatcgcaatcagttaccgaattggcttcgtgacggttgccatgctggcaattccgcatcttccgggaattcgagcttgttttttacctcggcagtatctatttcgccggctacaacgtcgttaaattactgtgtataatccggcaaatgccgagataattaattgacctaacagtcacgtgcaaatacttgcattattaaatgatggaaaatttatcatgacttgaagcacaaatttcataccagagggggactggcaaatgaaagtacaaatttatgtagcggctcataagccgtatcaaatgccacaggatccaacttaccgacctatttttgttggtgctgcgatccatgggggtgcaccacaaaattatcaacctgatgacgtcggtgacaacatttcggcaagcaacccgaactttaacgagctaacggcgatgtactggatctggaagaactgccatgcggatgttaagggcttgaatcaatatcgacgctacttgtctgaggcacccaaacgtaaattagccggtattttatcaatgaccgaaattgaaagtttattgcagcaatatgatgtcatcgtaccaaaaaagcgccattattatattgaatcgaattattcacattacgttcacgcacatcatcgggaaccactggacatgatgcgaacggttattagtgaacgtcatgccgcctatttagatgattttgatcagttgatgcatcaaacgtcggcgcatatgtttaacatgatgattatggcgggtcctaagtttgacgactatgccaaatgggtctttgatattctgtttgctgtgcgtgaccggatcgatattgcggattacgatgtccaagaagctcgcgttttcgggtacttatctgagttcctattggacgtgtggatcaaccacaaccaacttaagtacgtggaagtcccggtaatgtacatggaaaagcaacagttaccggcgaaagcgtataatctgttgaaacgtaagttcttcccacaagctgctaaacggactcatttttagggcgcctgcgattaattagaatattgaagtggtaagtgggagtcagtcgctgatgaatgatgcggcatgcaaattaatgagataacaacttaatagtttaaaaatgcgccactcactagacgatgatcggactagtgagtggcgcattttaagtctgttgtatgaattagtaatcaaacgtagggttattacatccgggttcgcaatttcgcagcattagtcagtactggcggctgaagcaggaacaatagtccgatgtagatcagggcaccgatgccaatctgtaaggccagattgaggtaagaagcggtcatattgatattcaaggcgtaaatgacgacgaacatgatcacaccggcgagcacgtacttcagactagccgtaaataattgtctggtcgctaacgtatgtcgagtcacgactaactggtaaccagtgacacacacttcggaaatgagcgtggcgcacatggcaccggccacgccccagaaccaaataagtgggatgttgcaagcgatgttgacgagggccccgatagtgacggaaatcgtataggtcttagtctgcttagtcggtagcagaaactgctgaccaagcacgttgctcatcccaattaggatgatgacgggtgcctcaatcatcaacagtcggtcgactgccccaaatgcccgtccaaaaaataggggtgcgagcgtcgttgcgaccgctgccacgccgagggccatcggaatcgcaatcgcgagcacaaagtcaaaggacatgtataagtattgtttaacgcgttcaagttgctgcttcatgaagaggttggcaatgtggggcaacatgactgttccagtcgctgtcacgagcgctaaaacgagcttgatcaacttgtcggagtaatcataaaatccggcggcggttagcgaatccatttgccataacatggtcttattcaaggcaaggtaaaccgtcgtggcgatttgtggcacgaataacgctaatgagggccgcagatgccgaaagagattcaattgacgccagttgggccgttcgacactatgtcgtaagtatggccacagtgtcagattgcccaaaacttgtgagcccgctaaaatcaaaatgtagattccggtgtcttgccgagtcttcacgaatacgaaaatcgcaattacagaagcaatcttgacgagcatgttacggagtacggttttcttgaaatcttcgagacccataaagtaccaggaaatatcaacagcacccgcaataatataaaatgattgatagaaaaaataaatttgcaattggtgctcaaaaaaaagaaaaactaaaaaggcgagataagcacaactgatggtcaataactgtaatatttcaatttcccaaaaagtttgtgagcgttgcccccgattatcgcgaataaaggcaatttcgcgattaccataaattgtaataccgaccgttccgaacaatagaaagtaagtaatgatcgaattggtcgttgcattgataccgacgccggtcggccctaagacccgtgagatatacgggacggttaggaggggcgttagtaaaattaagaggttataccccgctgtataaaagtaattccttatgattcgcatgagtggctccttgtggcagttaagcagtctaacgttgaatttctcaacattcaattcattgtatcacagccaattagccggttgatagtggttttaactggctagggttggttattaacaaacttattattttataaattagaaagtatttttattgttaattaactgaggagcgacatagttatatcaacgataattaaattgggagaatagcttaatatttggagaatcccagtgagttgtgttcgtgcacactatgattagggactgaaaaatttggccggtagggtcgaggaatcaatgatgattgcaggagcggggagataactttgatggtatggcgagcgaatggtgcgtggtgtgttcaaatcaatgggttacaaaaacgcgcaaccaaatttccccttgagtttggttgcgcattttgttttgatgtttaataagcgccattaggcttgaacataatgaccacggtcttgaacagaatgtagacatcaaatgcgacactccgtttagaaatgtaagttaagtctaacttgaccatttcatcaaaaccgacactgttacgaacggttgcttgccataaaccggtacaacctggcttgacggctaaccgttgtttgtcatagtcggaatattcttcgacttctcgtggcaatggcggccggggtccaactaagctcatcgagccttgaaggacgtttagcaattgtggtagttcatcaatgctatatttacggatgaatcgcccaatcttagttacgcggggatcatcctgcattttgaacatggcaccatcaatctcgttatctttaagtaatttttccaacaattcatcggcgttggaaaccatcgagcgaaatttatacatcttgaatgggacttcgccacgacctaaccgtgtctgcgagtagaagacggcgcctttaggatcttcaactttaatcgcaattgcaattaaagttgaagagtggtgataagatgatgaggcctaagaggctagcaacaaagtcaaacacgcgtttaatgaaccgataaccataacgacgatgctgacgcccggcgtcaatcgtaatcggtctgatttctcgttccttcaattccataagtaacaccctatgcttcctttaaatattttcccccgtaaatcacagtcagattaatctattactagtgttcgggttaccgcaaactgactatgtatgtactgtattgatacaacctaatgattatagtacaaaatagctatcaagtaaacatacttgatatgattaactttgcggtatcgtttaagtttattatagcaaacattgtgttagagtaaactagtatttaagtcataattgtcggatggttagttttaactaatttgactagctacaatttggctaactataatttaccagcattttatcaagatgcaattattagtagcctgaaacgcgataataatgactaaataaaacgcgtggtaaaattagttaatgaacagaatgatgctaggctcagtagttcaagtttctcacattctccctaggttttccccgccgttcacggtacaattagacaagagctcaaattcaagtgaaaaggatgtccgacatgaatgacgattggatcacggttttccccgcggattataataattcgtaccacttaattttgaaacgggggacggcccactttgcgtactactactttaaggtcgataagttagatcagcgggtcattttctatgatgatattgagcgtagcggcatttcaatcaaaacccaaattacgcggacatttatgcgagcactcgtcaaagcgattgattggcatccggtcggtaatagcattattatcgagatttatccagttgatcgcaatgagactagggcaatccggctttcttgtgatatctagtgccgaacgtggtgccataagctaactgaatataataaagaatccccggtcagcaattgaccggggattcttgtaatagcaggtaacgcggattaagcctttggtgcggtgataattggtgtttcgatggtttcgacgtacttggcggcgagtggttcggcaacgaggttctcgccgtccttaacgaacagcttcgtggctgctagatccgccatggctttgctaacgacatccttactcaagttatcgttggcgtagtgtaacttcaagtggtgaaccttgttagtactagttttaaagcttaagtctaaagttttcatgggcgtttcctcctatattatgagtgtgttaagcgacgggttgtggatcgtagcggtaagcgttgaccaagttagcggccatgaattgatcgcccgtcaagacttcgacgatcttaccaaaagcagcgagttgttcgtcagtcgcgtcttgggcgatgccgttaaacgtttgtttacgttgttcgtccaattccgttgtcgtttgaaccgtcagggtagcttttaaccaagttttagtcatgatgagttcctcctcgaattttgtggtggtaggctggccagcttacattaatacagacggctgagccagtcgatttgtgcaccgtttgattaaacttttttgactggtgagtgtttagtcggcaaactcggtgacagtttggacagtaatactgataatcgtgtcagcaaatagtggcctgaggacggccattagagtggcaagatcagcgtccgttagctcccgaccagcggaccagtgttgatgcacctgatgttgtttgatgtcagttgttgtaataatgaggtgagtgttcatccaattatgcatatggggctcctttcgtattgagcaaatgtcggttttagtattagttacgggcttgttgctgatagagttggtgagctttagtgagcaagcgggttcgccagttatagacggtccgacgactgacttgatgacggtgcatgatgcttgcaaccgactgttcttccagaaaaaattcagtaaggtaaatgcgttcacccggacgacattgtgctaagagttccgttaataatgcggctaattgccaatggatctcttgatcagccatcgggtcaatggcgatgggcagggcgtgttccagcttgacctgcgattgtgtccgcaaagtttggttacgcaaatagtcaacggttcgccacttgatgcgccgaaaagcaaatttgcgaaagtctgccaagttggcaggcagttcaggctcatagttctgataggcggctagccaggtcaaggtaacgcaatcctcaaattgcgggtgatatttggtcacgtgtgcggccttcaaagcaccatacaacaggcgttggtgttccggatgtgcgagtaggtcaaaggcggcttgattatcaaaacggtcagcgtgcattgaaataacctcattttatcgttaattaccttggccaaggttgattctagtgtagtgagtggtcagtaatggtgcaggtggtgaaaacggactgaaaagtgacgatttgttttcattattaatgttccggttagatttgagcaattcaatgaccaagtgctttcctagattgtatgtaattgttatgatgtgattaatctaattaaccgcgaacgggcgggggcgttcagccggtgaatgttagagaaaatacttatctctagggggctttaccacctatgacccaaaatattgacgatccgcatcacgttaactctttttggcatctcgaatctggtacttgggacacccgacagccacagcgattattaccaatagcgacgcgttcagatattgatataatcgacgtgctggagacaatttttctgcttgacattaaacacttggcatgcgccgagaataccttgatttttgaccgtcaacgaggactgattaagactaagctgacaacgcgacaaatcatgatgacttatgcagtccaactaggcttttctgggacccaactaattaaacggctggctagtcagttaggactatcgatgcataaactaccggtgattcatggtgctgccatcttgatgccgctaggaacggccaaacggggaacgactagttggtataatcgacattatttggcgcatatcgaagatcaaggctttatgactgctttgatttatgacggtcccatcacggttcgcgtcgatgcgagcaagcggatcgttactcgtcaattggctaaggcggggcaactgcaactagcagtccaggaacaccatcgccgccgcgcagtcccaaatcagtcatcaccgaccgtattggatgcggatcaagcgatgatgcagtcatacaccgatcaggtcttaaaacattatggaattttagcactgcctggggaaattagttggttgacccggcagtttttcggtaaactataatcgtgatgattaaatgagaggagggggatgtccgtgacgaagaaagtgacgaaaatcgtagcccagaaacgtgcggggcgctacaacatatacttagacgagcagtatgcttttccaatcagtgagtcagtgatgatcaagttccgtgttttcaagggcatggaagttgatgaacaactacaagcgacaatgattgcggctgacgatgtatccaaggcttatacgcgcgcattagattatttatcacatcaactgcggacggagaaggaagtccatgacaagctgcgggatgaagagatcgacgaaacggtgattgacgcgacgatgcaacaattacgcgagttacggttattgaatgatcaacagtatgccgatgcctttgtgcggacggccaaacggaccagtgacaaggggccacgggtgattcggcagaaattacgacaaaagggtgtgggcgagcagctgattgatgacgcgctggccgggcagtttagtcctgaagaacaagttgataacgccggtgaactagcgcgcaagttggctaaacgttatcaccggcaagccttcaagacaatgcaacaaaaagttcgtcaagggatgatgacgaaggggtttgacaatgatacgatcacggcggcgattgctagtttggaattgcaaccggatgaagatgaacagtgggccgcccttgtgacgcagggccagaagttgtggcaacgcaatcgcaagtatgcgtttcgtgaacgcatgatgcgcacgaaacgcagcctgtttcaaaagggcttcatgatggacgatatcaatcgatttatcgacgaacaagttgctgatgaatgaaaaggttgaattacctgcccgcacgccataaaaatctggtataatgtttaatgaaattcgatgaaaatttaccctcattttagaaagttgggttaatatggcgcgcgaggctaagggacctaaggaaggcgacttcattacgattaaaagctataagcacgacggaagtttacatcgaacttggcgcgatacaatggtactcaaaacaagcgagaacgtactaattggttgtaacgatcacacactagtcaccgaggatgatggtcgccggtgggtgacgcgggaacctgcaatcgtttattttcataagcattattggtttaatatcgtggcgatgattcgcgataacggcgtttcatactattgcaacttagcatcaccatacgtgttagataaagaggctttgaagtacatcgactatgatttggatgtcaaagtctttcccgatggtgagcggcggttgttggatgttgatgagtacgaagaacacggtgcccaatggcgttattcggctgatactgatcgcattttaaaagcaaatgtgaaagtcttagttgattggatcaaaaacaaaaaaggcccgttttcacaagactacattgatatctggtatagtcgctatcaagaattatcacgtcggcaatagctctgctgacggtctgtcagcggcgtaattaaagtacaaagggagtgaactccgtgctggggtgctcccttttgtgttctggttgcgtctcgacattgaataataagaggtgattaccagccgtcatggttgacacaagtcatgataattaggacaataaaaaacgacccacaagtcgcctctgtgggtcgggtgaaaataggaattacacttttaagcgccaaagttgactggtcgtgaatagccaaccgcgtgccaccacggaacgtagattttttcatttttgacaccattgtcctgagcgtcaatcatctttccaccaccaacataaataccgacgtgtgatatcgaacctgtgccactaccaaagaagactaaatcgcctttttgggcgcgctgtttggaaattttgggatattgtcggtactgagcttgtgccacgcgtggtaaggttttctgcgcagcttgctggaagacatacttagtgtaaccggaacagtcgaacgtgttcggaccgaccgcaccatagacatagcgatggtcaagtttggatttggccacgttatagaggttggtgaaagatctggtgctcttcttgagggagccggtcttgacccagccacgaacacgggtattagcactcgttacaaaataataattagccgtggtattattagctaagcgaatttgccattgttgggtgacaaaccaagtggtattaccatattgtcgaagcgttccccgactctggattttaagattatttgcggcaccactcatgttatagaagccgccctgagtattcttcgtcaggtaggcgcttttagtaagattagtggttttaatgacgcgattcgttgagctggcatcgacgtttggtgcttgccaaagctccaccgtgaggcctaaaatagcaacaatcagtgtgataagacgttgtttcatatgtatttcctccccgaaaatccccatgtccatctcattcaataacgctgaccccatcataagcgctcattgtaacaaagttgttgcaaatgagttgcggttcgattaagtaatgtcaacagcttgagtggattaacaataattgattagatcttgaccgataggagtgacgaacttggcttttttgaagattgataacggtgaattacttaagaatattcggcaatttgccaagaagaatggactgaccttagcggaagtggcgaccttagcaggcttaagtgcgagtgctatctatagttggaaaaagcacacgccgtcagtcggtacgcttaaggaagttgctcaagtgctcggtacgagttataccaaattggttggtaaggataaagaaccgacagctaaggcgatcaatgccgctgctgttgatcttaaaaaagtgattgaaaacaagaaaaaccaatttgaatacgacggtcagccgattactaatgaacagatgaaaattatcagaaacgtcttgaagtcgatgttcaagaccccgcgactttaattttaagtaaaactcggttcttttaggtgcaactgggacctgcttagtgtaaaatattgctcagttacttgaataattgctagcagcgcttgacgggcttgaatggatggtgcacaatggcaacaattatggaacggattgggagatgggcgtatgaaaaaagttactaccgcattagcaaaaaagaatatcaaccagttgttaacgattgttaatcaaggccacgataccattgaggtggaaaatcccagcacccaagattcagcggtaatggttagtatgaaagactggttgcagattgtcagccaattagccaaaacgaatcatcatgacatggaattcagttaaataataacaaagaactaatcgtgccagtcaaggttcgcttagtccaataagctaaaggcaccaccgacataatcatgtcggtggtgcctttttgaaagtgttagttcgttgacatttgagtgctgattagtcggtctgactttcagcgtacttggttttgatataatcagctgaaacttgtaattttttcaattcttcgtctgtgagatccaattgaacttgttcgacgatcccgtcacgaccaacgacggctggatatgaaaggtatacgccgtattcttcccggaaatttgaaacggggagttcggtgagggcgtcattcaagaccgtgttggctaagcgcaccgcggccgttgtcacgccataactcgtatattttttgccatggaagacccggaagccaccgtcgcgtgattcggcgtctagtttggtcaaatctaaaccgcggtcagcggctaatttggtaattggttgacctaacacgcgtaccgttgaccaagctgtaaattgagaattgccgtgttcacccaggttgtagccggccacggaccgtgaatccaggtgtagtgcactggcgaccgctcgtttcattcgtgcagagtccagtagtgttcctgtcccaatcacgtgattctttggcaacccggtaaccgcttggtagatcgatgtgatgacgtccacgggattagtaatgacgactagaattccgttgaaaccactggctttgattttagcagcgacgtctttgacttgtgtgctggtaaagggtaattctaggaagcggtcattagttggtgaatcttgtaacttaatattcccgatagctgagataatgacatcggcatcaatgaggctgctataatcattgataatgatattcgtgtgataaggtaaattaggcattgcatcctgaaaatcaagcgcgtctgcttcaactttgctggtgttcgtatcgatgaggacaaggtcatcggcaaagccattggcgacgatgtagtgagcggcggttgaaccgacgtgtcccattccgataatggcaattttacgtgacataatgtagcgctcctttgaaagtttatcgttcattaattaaattaccattattctcattgattttaaatagattttgtgagaaatatcgaaatcgtattcggactaagtgaaatagggtataattaacgcattaatagttgcaccaagaaagggaggagcgcgagtgtttaagcgcctaaaagattcggccttgttattttggtcacttgaaattttgattgtggcgaccttgatctgggtctgcacgaacattggttttttgtttcagccaatcggcacgtttttaagtgtcgtgttcatgccaattttgatttcaggatttttattttatatgttgaatcccttggtcaagttgttgactaaggttcattacaagaagtttcggatttctcgaaccggagctgtggctatcgtatttgtgctattattcgggttactggtgtggggagcggtttccctgttgccacggttagtcagtcaggtgacacaactgatttataacctaccaagtattgccactgagatgcaaaaagccgctactaagctgatcaataatagttcggtactgaaaagaattgatattagctcgtacaccaagcaattcaatggtgaaatcagtaagtattctcagaactttttgtcatcattatcaagtagtgttgttacggtgatttccacgattacgagtgtgacgatcatggcaattacgattccagtcgtattgttctatatgttgaaggatagtgagaaattcattccagctatcagtcggttcttaccgaagaaacagcggcctgaagtcattggtttactacaaaagatgggcgacacgatttctagttatatcagtggtcaggttattgagtgtttcttcgtggggacgtttacggcgattggctacatgttgatctcgcaaccatacgggttattgcttggcgtgattgctggattgacaaacattattccgtacgtaggaccttacattgggatcgcgccatcactcatcgtggccttcaccaagtcaccgatgcaggtagtgtacgtgattatcgtagtcgtgattgttcaacaggttgatgggaacttaatctatcccaacattattgggcggacactcaaaatccacccgttaacgatcattattttattactagcagcgggaaatattgccggaattcttggcatgattttagcgattccgttctatgctgtggtccggaccgtggttatttacctctataatattgtcgagttacgaaatgaggagcacttgcgtaagcaaacgacggtctatcagccgcaacctgctaaggcgactaaagcagacttgacgacgaccactaaatcaaaaaagtagtctgtgctataattggtgaattaagcttgaacgtggcataaggagtgattttttgaagaaagtaattacgtatgggacattcgatttgttgcataaaggccatattcggttgcttaagcgtgcacgggccttgggcgatcatttgaccgtttgcgtctcgaccgacgaattcaatgctgagaagggtaagcatgcgtacacctcgtatgaggatcgtaagtatattttgcaagccattcgctatgtcgatgaagtgttacctgagaaaagctgggatcaaaaaatccgggatgtcgttgataacgatattgatattttcgtgatgggtgacgattggcacggcaagtttgattttctaaaagactactgcgaggtggtctatttgccccgtactgaaggcatctcatcgacgcgtatcaagcacgatttagggatgcaatccaaggattaaccactaagctagatgatttatcagtcacaaaacaccgccgttacccgcaacttcaagctgcgtaacagcggtgttttaattaacagttattagtaagtcacgcctaaatgaccatggactggttcgatgcggattatagttagcattcagccagttcaaagggcttaatggaagatggcgttgagcgccaacacgcctccgagaccgcagacagcgatgatcgtttctaacatcgtccatgtaagcagcgtttgcttgacggtcaggtcgaagtattcccggaacatccagaaaccagcgtcgttcacgtgagaagcggcgacactcccagagccgatggcaattaccatcagggcggggtcgataccagcttgcgtcattaacggcgcaactaggccggctgccgtgagggccgctacggtagcggagccgagtgagacccgtaagatgacagcgactagccagccaagaatcagtggtgagatgctgctgccactgaacaactgggccacggccttaccaacacccccatcaattaagatctgtttgaaggcgccaccccaccgatgattagtaataacatggcaattgacttagtggcatcttcgatggtggccgtgatggccttattggtcttgtgttggtgaatccccattgaccagagggcgaataatagtgaaattaacatggcaattccgggtgccccaatcaaacgaatgatttggtcaagggtcgacgggtttttaggtgtcacaccgtgatcaacgactaattcgtagacggtggtgattgtcatcagaatcacggggaagagcgccgttaagacactgagtccaaacccgggtgcttcagatactttgaattgacgtttgttactgctaagtggcaggtgtggtttaccggtgaatgcgtcaggaaccatcttttgcgcccagcgtgaaaagagcggtcctgcgatataaacagttggaatcgcaataatgatcccgaatagtagcacatgacccacgttcgcatttagcgtcgtcgcaattgcagttggtgccgggtgcggtggtaagaatccgtgagtaacagataatgcggcgcccatgggaatccccagatagagaacgggaacttgtgcttcgatcgcaatggcaaagacgattggaatcaacaagacgatcccaacttcgaagaagagggcaatcccgatgataaatgaggcgactacgatggcaatttgtagccgtttgcgcccgaaaatatccaatagtgtcgtggaaatcgtgtaagcaccaccagcatcggctactaagcggccgagcatggcaccgaagccgaagactagtgctaactcacccagttgactgccaatcccgttctgaatactagtagcaatcttagttaatggcatccctagtccgattccgacgacgacggccgtaacaatcagtgcaatataagtattcagcttgaatttaataattaatagtaatagtagtaggatgccgagtgtaagaacaacaaatggcatagtggacactcctaacgatttagagtagcaatttcgtgatacaacggtgccaattgcgccgttacgtggtcaaaaacgacttggtgttgatgatataactggtggttggcggcgttgggttgataagtttcggttgcaccaatcatggcgtgaatcgcggttaaatcatcaatatgccccagtgccttgagtccaatcacggccgctgctagacaggaactttcgaagctcgctggaatcgtaatgggttgtcccaatacgtcagtcaaaatttgccgccataaacttgaacgggcaaagccaccagtggcccgaatcgcatgaactggttcggcggctgccgtcaattgtaggacagtattcaggttcatcacgataccctctaagaccgcacgtgcaatatcggctttggtcgtggtcgtggtgacgcccagcagtgaaccgcgggcatccgcattccagagaggcgcgcgttcaccacttaagtaggggtgaaataagagtccgtgggcaccgacgggaacggttgcggcaagcgctgtcaattggtcgtatggatcttgttgattcgcacgggcggtttggctttcagtagtgaagagctcatcgcggacccaccggaagacttgaccaccgttattgatcggcccaccaacaatccagtggtgcggcgcgacgtagtaacaaaatagtcgaccttcaggatccaagtatggttgtttcgtcatcacccgtacagcaccggaagtgccaatcgtaatggccgcaactcctggttcatcagcccccacccccaagtttgaaagggcaccgtcacttgcacccatgataattttcgttgtgggtgcgagtcccagggttgatgctgcgactggtgtcagtccatcgatcacggcgtcggtatcgaccaatggtggtagctgcgtgcgggtgatgtgtgcatagtcgagcgcgacaggttcccaatcgaagttataaagattgaataggccagtggcgttggccattgaataatccatttgaagttggcccgtcattttgtaaatcaagtattctttaattccgactacgtgacaggtttgtgctagtaattccggtgaatgatgggcaagccagtgaagcttaaccaggggactcatcgggtgaatcggcgttcccgtaaggtgatataggcgatcgcccaggggttgacttttcaattcagcggcgtcttgtgcggcccggttatctgcccaagtgatgacccgggtcagcggttgtttctgactgtcaagtaggatcaagctgtgcattgcggatgaaaaggcgattccttcgatgtcttcgggatcaatgccagcacttacttgatggatggtcgcttggactgcctgccagatttcttgcgggtcctcttcggccgtggtcacggtatcatgatagagtgggtagccaacgttggcactcgcaattacgtgaccctggtggtcgtacaagacggatttggtacttgtggttcctaaatcagttccaataaggtaagtcatggtgcttcgttcctcctattcgtgatcgacagcgtggccaccaaactcgttacgtagggcggcaacaactttaccagtgaatgtgtcatcggtttctgaacggtagcgcatcatcaaggccatcgcaatgaccggggtggcgacttgttggtctagggccgcgtctaaggtccagcgaccttcaccggatgaatgcataacacccttgatgtcatctagattaccatccttgctgaatgcatcttgagctaagcccattaaccagcttcgaatgactgagccgttattccacattttggcgacggccgcgttgtcgtaagtgaactgactatgctgtaaaacgtcaaagccttcacctattgctgccatcataccatactcaattccgttgtggaccatcttcaggtaatgaccactgccaacagggccggtgtacaaatatccattgggagcggcaatcgctttaaatagtggttcgacgacttggaaagtggcggggtcgccaccaatcataaagttgccatcgtggcgtgcaccagcttgaccgcccgacgtcccgacatctaagaagttgatgtggtgacttgccagtaattcgccgtggcggatactatcttgatagtgcgaattaccgccatcgaggacgatgtcacctgcacttaaagtctgggctaactgttcgataacgctgttggttgccttaccagcgggtaccatgatccacacgatccgtggtgttggcaactggtcaagcaaattggtgagatccgtggccgtcgccaacccgtgagcactggcggtactaagattagtggggttaagatccattcccactggcgtgtgcccgttatcctgcatgttcaacgctaagttcattcccattttacctaagccaatcaatcctaatttcatgatgaaacccctcttttatatgaaaaatattaagtactttttgtattcgcttacattgtaataaaactatttacataaatcaaccatatatttgtaaattattttcattagactgaaaataaaggcaaccaagcccggttttacaggcctgattgccaagaaaaaatttgttaaattgctgaccaaacggctgcgccgatacttgggaagagggtcacgagttgttcacgttgcgccggtgtcaattgatattggatcgctggtagcaacgtgttaatggtattttcggcctgttcaccgagttcagcggcaccaatcaaccggtgctggtcatccgtcacgagtaagttatggccggtgacatcgcgcgttgtctgccggaaccagtcatcctttaaatcattgacggtaactttgacatcatgagtgtcactggttggaagtgtaccaacttgggccaatcgtggggacgtgaagacgaccgatggaatggccggatacttgatgggggcattggtgtcacccgtgaataggtgggtcaggtattgcgactcaaagatagcagtgggtgttaattttggttgatccttggcgagaacgtcaccggatgcgtagatgccagcgacactcgtttgcaagtggtcgtcgacggtgattccagctgctgtgtagtccacaccgattttttcaagtcctaagtttgcggtgttgggctggcggcccgtcgcatccaagatccagtccgttgtaatcttgtcatccgcactgaggacttcgaagtggtcaccagtcgacttgatcgcagttggcacccattcacgttttaggactaaaccttgtttcacgagaatggccaataatcgttcaacgaatggttggtggaattgacgaagtgcttggtcaccacgcatgagtagggtgacctgactgccggctgttagtgccatgttggcgaattcgagtccgatgtagccggcaccaatcacggtgatgtggtgtggcaaagtggttagattcaaaaagtcgttactgtcatgggcgagttcagtgccgggaatgtccaaacgatgtggatgctgacctgttgcgatgacaatcttatcggcggtatacgtcttgtccgccacctgaatcgtatggtcgtcgacgaacgtcccgcggccattgatgagggtcacgccggcactagtcattaagccagcaatcatatctggtaagccggcgatgacgtcgcgttcgtggtcaaagttggcttgccaatcaatcgtcggttcaccacgcagaccgtatccttggaagttagcaacttgattttttaatgctaccggctggtctaaggtgattttagcgttgcaaccccgattaggacaggtaccaccaatcaaatcagcttcaatgacggctacttttttgccacgagccgctaacggaatggccccgtcaaacgttccgtgaccgctacctagatatacaacgtcaaatttttctgacatattaaaatcctcctcgttcccaaatcacagttatttaaaaacaaatacattgtacacaacttaatttaacatgccaaataaaacgcggccttaatttaaaagcatggccttgaaaacgattgcaactggtctgtcatgactttgttaagtgaattcccaccgaatcggtgcaagatggtcggtggtactggattttttggtcaaatatcagtaaaatatgtaaggctatgtttttttacggtgggacggtaccaccgtgcacgttgaatatacaggttatgatgaaaggaatttttaatgaataagacagaattaaccgccgcggtcaatacccggcgtacctttgcgattatttctcacccggatgccgggaaaaccaccattacggaacaaatgttattgtttggtggcgttgttcgtcaggccggaacggttaaagcccgtaaaagtgggaactttgccaagtctgactggatggaaattgaaaagaagcggggaatctcagtaacgagttccgtgatgcaattcgattacgatggcaaacggatcaacatcttggacacgcccggacatgaggatttctcggaagacacttatcggactttgatggcggtcgattccgctgtcatggtcattgactcggctaaggggatcgaaccacaaacgaagaagttattccaaatttgtaagatgcggggcattccgatctttacgttcatgaacaagttggaccgtgatggtcgcgaaccattggacttgttgaacgaagtcgaagaagtcctcggaatcgaaacttatccaatgaactggccaatgggtatgggtaagggcttaaagggcttatacgatcgttacaatcaccgtgtggaactttatcataatgaagctcatggcgaaacgttcttaccactagacgagaacggtgagcttgatcctagtaatgaattgaccaaggacagtatttatcgtgacacgttggatgaagtcgaattgatcaacgaagctggtaatgattttgacgaagctaaagtaatggcgggagacatgacgccagtattttttgggtccgccctcaccaatttcggggtcgaaacgttcttgaagacgtatctgcagtatgcgcctaaacccgctgctcataagactcgtgatgaccaagtcgttcagccaaccgacgatgaatttgccggttttgtgttcaagatccaagccaacatgaacccgaaccatcgtgatcggatcgcctttgtccgcatttgttctggcgaatttgaccgggggatggacgtggtcttgcagcggactggtaagaagatgcgcttaaacaactctacgcaattcatggccgatacccgtgaaacggtggaaactgccgttgctggcgatatcgtcggtctctacgacacaggtaacttccaaattggagatacgatttacgctggcaaaaatgcggttcaattcgaaaagttaccgcaatttacgccggagctcttcatgcgcgttacagcccagaacgtcatgaaacaaaagtctttccataaaggtattgaacaactggttcaagaaggggccgttcagttgtacacttcatattcaacgggtgactatattcttggtgcagtcggtcaacttcaatttgaagtcttcaaattccggatgcaaaatgaatataattcggaagttgtcatggaaccaatgggtagcaagactgcccgttggatcgatcccgaacaattggatgaaaagatgtccagttcgcggaatctattggtcaaggaccgctacggggcaccgctcttcttattcgaaaatgcctttgccgaacgctggtttgcggataagtatccggatgtcaagctgacctcgaagctctaggatttatattgtggtttacacttagctgaccaatctagttagattactgttcgtcagccgatgtgcgtcctatttcgacctccggggctgggtgacaattgctggaacgtaagccgacatcgatttgagctaacgcacaacccgcgtcagctcaaatacgagtcttattctaagccggaagaaaatcacttccagctaagaataatttggttactgagcattgcctagccaacggattaatgcggttttggcattagtccgttggcgtagcaagcacaggcttcagtggcaccgagcacgtttcgggaacccgctcgaatggctgatgaacggccacttaacttggtgcaattggtcgctaactcgaacttttcccagcgggcctaagctggctgctcttgatttaacggatagaaaagttacaatgtgtctcaagcaaaagcacaaacaaatatgtgaatagttcataaaatgatggggctgccaagttgatttggcggtctcatcattttttgtgtggcgggaccggatagaagtgatatgagaggttcttctaacatgcttatcggtccatgtaaattcaccatgtgaaccaacgttgtagcactgctaaggtgagagaattacgatacaatcaatctgcaatttagattgtagggggcgatgagattgaaaataaggggacgctggatgctgggattgatgttaggaatggggttgtggggcccgatgacggtgcacgcggcgacgaacttggtacggtggccagcggtgcaaagcttagcgccccggaattgtgaacttgaatcgaaacaaacgcgcttatatcaattaaatcgtgcaacgatgcaattaacgccacgtgggacggcccggacgactagtcactggcaacgggttggtcaggtgatggtgacacaaaacaagcggttagtgacttattggcaggtgcgtcacgggactgctgggcgactgagctgggcgttggcggacaccgtacgagttgtcggaaccagggccactgatattaagacacccacgcggcaaccgatgcgcgtggtgacaacggatcaacaggaacatggggtgacgcgcgcggccaataagctgagttatttgcccttaaaaggggcgggacggtacaccactgagcatattttgtttcgtcctaccgccgcgtatctagcgactcaagggctacaaaatcagccagacacgttgcgccagagtagtggctatcgcgaccattatcatttcaaaacagcactgtatttaccgcaacagttagggagccgcttgttgaatgacccacagagtgcgacgttttcagctgacaatcggtacttgtacgtcatgtacgtcaatgatcaacagttgggtggcgccgaccagactggctgggtcgttcgctatgattggcaacgcctgatggctttaggggctgggcaatcagggaagatggcgatggtccgagtagcagcagctcaccaattcgacgggaagatgacggcttttgaccgtcgggtgctggccgccattgaagtggggccggagtttacggcgggacacgttcagtcactagctttaaatcctaagacgaacgagctgtggtttatttcatcgacggcacgtgatcagcttgcaagtgttgcgcgactaaatccgcaatccctgacgccggatcttaaaattgcctttactactggtagcgggcgtctaggtgatgaactgacttttgatcgcgctgggcaggcctattattggacgcatgcgagtcagctcagaaatggcaatgtcacgctttatcgtggcacaatcagttcgacgactggtgtacattttgaacaactcgcgcaggggttagctaataatccgggtttcttcgcccaatcgattggatataacgagattactggtcggctctacctggtctccgatgagagtattacgtcacttccagcggctaaactgggacacttgacgactagtcaggtcggtgaggcgaactttgctggtgatcgcgagtttgaagggttagtcttcatgcaccacagccaggaaggtttcttgctgacgaatcggggcatcgagttgatgcgcataattgttgataagtagatattaaaatgcgccactcgctagattagattgaagctagcgagtggcgcattttagcatggttcgcgttaatcgaacaaaagtcttgtttaagcaaacggtggatctaatttcgttaaataacggcccggcaagtaaccttgatcttgcaggcgataccagacgaccccgttgtcgtcggccattcgctcaatcaaattgaccgtgtcaccatgagtgacggtggttaaatagcggccatatggttcgatgtatgtgtggacctgtttgccagggacaaaactgacaacgccggtttggcgaacaggccgtttattttggacgcggtagccggctggcaacttgagtaacagtgtgtcaccggtagttaattggaggtgcgtctccggaatccactgatcatcgccaatcgcataccaggtctcgtgagtgactaagcgaacgcgcatgtacgttttataagtgctaccgggctggagcttagttaaatagttggtcgtagttgccccaggatacggataaacggcggtcaacttgttgacttggacaaaaccagtactgaggtcagtttgctgccaattttgattgcggtagaaaaaaaggaccgtcttggaagtggtcgtgtattccccagtcacgtcgcctacggaacggaggagcttaaaaccggcgacggtcggcgcactgatttcgtaaggggttcctaatttcccccggtacatggtcggccggccaattagttcgcggcggtcaatgtcataggcgtacatccagactggttggccagcttggcgttcgtaagtcaacgtgatgctagcctgtggggtcgtaaaccagcgagtcaagccttcgatatggacgaggtggtagccggtgatgctgacggctggcaagtgaatctcttcgccaatggtgccagcaatcatatcagcagcctgcagttcattgccatcctgatctaggtggtgaacgagaactaatgcttctgtttggttaactgtaggtgctgcggcagtttgtgcggcaatggaacgtggtgcctcagtagcgcttgtggcggcttccgtgctgtttagtgcctgaagcattcctttaagtcggtcaagaaacgacacgtgaccactcctttcattaataaattaattatcactagtataacgcattcacaagggttctggcacgtcttaaataaattgtaaaattcccgctttgtcagtcgtgtatactaatatttaataacagggggcgttaacggatgaatctaaaacaattacaatattttttggccgtggcagaggaaggtcagatgacagcggccgccaaacgcttgcacgtggcgcagccaccactgagctatcagattaagcaattagaacttgaactaggcgtcaccctcttcaatcgcttgcctcagggtgtgactgttactgaagctggcaagctactggtggggtatgcccaacagctcacgcagttgtcggcgactgcggagaacaaggtccgggccctggcacacggcgtgacggggaccattaatctggggacagtttcatcctcggcaggggtcatgccgaatacggcattactaaagtggttagggcaacatcccgatgttcagcttgcgattacggaaggcaatacgtatgagttgttagacgatctgcataaacggttgctagacgtggcggtgttacgaacaccgttcaacgcgcaacatctagtctgtcgttactttcccgcagaacggatggcagcagtcattccgaagcgatattcacggtttgaaaagcggcgccagttacaactaagtgacctcgctacgttaccattgatcaagtaccgtcgttttaatgaattattccacgttgcctttctggaagcgtcggttacgccgacttacatcatgacttgtgatgatgcccgcacggcgatgcactgggctaatcaccaattgggagtggccctggtgccacggtcattggctgaaacctatgacggtggtgacgtgctgattcgatcattggcagatcatcgttttcagactcaactggccctagcaacgaccccggaagccttagcgaccccattagttgccggtttgatggcacaattccagcaagcgcagtcgctagactagtttaatcagtttgatatctaaaaatttaatcgcggttaagggtggattgctgatttaatcgggttgttaccgattacactagctagaaattgaagtggtgttttcagacgcaaaataagcctaatgactgtcgtactggggatacgctaaccttcatttaataattagatatcaatcggtttaaatggtacactaacaattgaaatttaaagggtgaaggtgaaggaaatgatttattcgttagggctaatgctcggcgttggggtaattgccggaattttcggtgctattttaggtatcggtggtggcatgatcgtcacaccaatcctgacacttggtttgggattagatattaagtatgcgattggggccagtattatcgccgtgattgccacgagttcgggctctaccattgcatatttacgtgatgagatgttgaacttacgcgtcgcgatgtttcttgaaattgcgacgacggtcggggccgtcctcggtgcagtgttgacgggggtgcttaatgcaacattcctgtacttcctatttggggcgctgttagttttcacgacgtataatatgattcgtaaattaatgagtaagaacggtgaattactgtcagtcaaagatgacaagctggcgacacagttgaacttaaatggtacttattatgataaagcattgaataagcaagttgattatcaggttgaaaacgtgccgggtggtttttccatgatgttcggtgctggtttcgccagtggcttgttggggatcgggagtggcgcgttcaaagtgctagccatggatacgattatgcatatgccgcttaaaccgtcatcagcaacttctaacctgatgatgggggtgacggcggcagcgagtgcgatggtctacttctttaatgggtcaatcaaacccggaatcgcggccccattagctatcgggattatcgtcggtgccttaatcggctcacgaatcatgacgcggctcaagccacgcttgattcgcatgatctttgtgcccgtgatgctctatctgggaattcaaatgattgctaaaggattcggggtgaccatctaatggataagcaaaaaacaactaaagcgcaagagatgcacgccgttgaaatgatgattgggtatattctacgaattggcgtcattgtttctgcaatcgtgattattattgggatgcttctgatgttgattcagggcaatggtggttatgcaaatggtatggaaccccatacggtcgctgatattctagccggcattgtggcacttaaaccatatgccgtgattatgttaggtttatttctattgattttaacgccaactttgcgggttgcggtctctatctacgcctttgcagtggaaaaagaccacttatatgtttggattacgacgattgttctcatcatcttaattgttgcttcggtgattgggtatctcggtaactaggctagacggagctgattaatcaggttgagtcgtgattaaaatgggcgcacatctaaaatggctaccagcttgtttcgaggttaatgtggaaagaatctaagttggtgtaaattcacgggctggtgtgttttatgccgatgtacgagtacttaactagccaatattgtttaataataagagaatgctgataaaaaatcagcattcttttttatttgtgcacttttagctgttttgactaacgtaaaaaagacctaatatcgtcatttttatcgttatttgaattatttattaagaaaaattgccgattgtgttcacttgataattgaacactgatgtgagaatataattgcttatatatcagtaatttcaggcatgtttatcagtatggataataatcgcaaaatgaaataattaagacgattatgacgaaataatgataaaaattagagtttaggattgattttaatttatttataatatacaattactttaacttttcgagggaaaagcacacacaaactattttaaagttaggggttgggttatatgaatttcaaaacagctgcaaaagtaaccgtcgttgccggcgcatccgtactattcttagctgcttgtggctcaagcaagagttcttcaagttctaagcaaacggccaattggaccgaatcagccgaattaccaacgatggacatttctaagtccaccgatgtggttagttctaacgcgttgaataacactaatgaagggttataccgtctcggtaagaacgggaaggtcacacccggaattgcgaaatccactaaggttactaatggtgggaagacatatacgttcactttacggaagaacgcaaaatggagtaacggggataaagttactgccaaagactttgtttatggttggcaacggaccgttaatccaaagactgcgtcacaatacgcatacttatattcagggattaagaacgctgacgctatcgtcaatggcaagaagcccgtttctagtttaggaatcaaggctgatggtgattacaagttgacggtcactttggataagccaattgcttactttgacaagctgatgggctttgtcaacttcttcccacaaaatgaaaaagtggttaagaagtacggttctaagtatgggacgagcagtaaggccatggtttataacggcccttacaagatgactggttggactgggacaaacttgtcatggaccttgaagaagaataacgattattgggataagaaagctgttaagatggacagcatcaagtaccaagtcgttaaggatccttcaactggcttgaacttatttaattccaataagctcgactttacgacactttccaacgaacaagttaagaattataagaatgataagaactacttagttcggaagacggcttcaactttctacgttgaatttaatcgtaaggatagcgataagactttagccaaagctttccagaacaagaagattcgtcaggccttgtcattagcaattaaccggaagtcctacgttaataatacgttaggtaacggttcgaccgtttctaaaggttacgtttctgaagacttagctaaaaacccgacaactggtaaggactttacgactgacgctgccgttccttctgcagttgactacaacttaacgaaagctaagaagttgtggaaagaagggatgaaagaaattggtgaaactaagctgaacatcaagcttctttctgacgatactgatggtggtaagaagtctactgaatttattcaaggtgcttgggagaaattacctggtttgaccgttactaaccagaacgtcccattcaagacccgtcttcaacggtcacaaaacgggaacttcgatacggttatctctgcctggaatgctgactttaccgacccaatttccttcttgtcactcttcacgtccgacaactcatacaacaatgggaagtatgacagtgccgcatacgacgatgctgtgaagaaggcggaaggtgccgatgccaataacaagactgcacgttgggctgacatggttgctgctgaaaagcaattgatgaatgatcaaggggtcatcccaatctatcaacaagcctcagcaacgttgactcggagcaatctgaagggcatcatctacaacactgcgggctcaaactacaacttcaagtacatgtccgtaaaataatgatgtaaatccacagaaaaaagtgtgtgtgctttaactgaatgaatgtgaagcaaaggggtaaggattgacacattgttaatccttaccattttgttttataatgagggatgtcattattttttaagttgattttaatagaatgcgaggaattctcatgagaaagtatcttttaaagcggatattttacttgttcctgacattattcattgtggcgaccgccacgttcttcttaatgaagttaatgcccggaacaccgctgcaaaatgaagctaaattgacccctagcgaaaaggcgtcgatcttggcccaatacgggttggacaaacctgtttggttgcaatacttcatttacattggcgggatcttcaaggggagcttagggctatccttccagttctctgatcaagccgtcagttacctgattggtagccggatgggaccatcaatgcagttaggtggtcaagcgatggtcgtcggaatcgtctttgggattatcctaggggccgttggggccatcaagaaggatacttgggccgaccgtttagcaaccatcttatcgatcttagggatcgcagttccaagtttcgtgttagccatcctgttacaatactacctcggcttaaaggctggttggttccctgttgctggttgggaaggcttcgcttacacgatcttaccaacgttagctttggccgccagtccgctggccgaaacggctcggtttatccgaaccgacatggtggacgtgctgagttcggattatattgagctagctaaagccaaagggttgtcgaaatttggtatcgtgtatcaccatgcgttgcggaacagtttgattccaatggttacgctgattggaccattggccgccgccttgatgacgggttcaatggttgttgaaaatatcttctcagtacctgggattggggaacaattcgttaaatcaattctggttaacgactacccaaccatcatgggtgtgacgattttctattcagcactcctttgcttactattattgttgaccgatattgtctacggaattattgatccgcggattcgtttaaatggaaatggggactagttaatggcagaaaatccaagtagtatcgatattaagcccggcgacttcgagccgttagataaacaagcgggtcctgataatgaacggatcgcagcaccttccttaacgttcggccaagatgtatggcggcgattgaagtctaacaagaccgcttttatcagctttatcgtgttagtattcttattcttagtggcatttggtggacgggcagtctaccatgttgatcctaatgcacagtcgccacggtatgcgaacctccctccgaagattccgggtgttagtatccatggtttgaatggtcacttgactcaatctggtaaggacgttgatgcgtatgcggcggccggtgcaaagtctgacgtgcattatcttctcgggactgattatctgggccgggacttactggcgcggattatgtatgggacccggatctcacttgaaattgcgttgattgctactttgattgacctgacgattggggtcggattcgggatactctccggttggaaaggtgggcgcgtcgatttattcatgcaacgtgtgattgaaatcctctcgtccatcccacaattggttatcatggtgttgatggccacggccttcacgaagactgggatggcctcaatcattgcggctatcgcgatcactggttggaccacgatggcccggctgactcgagcacagaccttgcaattgaagaatcaagactttattttggctgcacggacactgggtgaatcacccgtcaagattgcttggaaacacttgttaccaaacctttcaagtgtcattattattcaaacgatgttcacgataccaagtgcgatcttcttcgaagcgttcttgagttatatcgggattgggatcagttcaccacaagcttcattggggacgttgatctctgatgggcagaagaacttccaattcttgccatatcagatgtggtacccagccatcgtgctgatcatcttgatgctcgcctttaacttgttaggtgacgggatgcgcgatgcgtttgatccaaagtcaaaacgttaggaggacggcagcactatggaaaaaccagaaaatgtgattgaggtccgcaacttggaaatcaatttccatacttatgcgggcgaagttaaagccatccgtgacgttagctttgatttacgtaagggtgaaaccttggcaattgttggtgaatcagggtctggtaagtcagtgacgacacgttcactgatgggcctgttagcacctaatgctgaaattaaacgtgggagcattatgttccacggtgaagatattattaaaaagtccgaaaaagacatgcaacacattcgtggtaaggatattgccatgatcttccaagacccaatgacatcattggacccaacaatgcggattgggatgcagattgcggaacctttgatgaaacataagggtttgaagaaaaaagaagcgatcgcccaagcgctagagatgttgaaattggttgggattactaatcctgaaggccgaatcaatgattatccataccaattctcaggcgggatgcggcaacggattgtgattgcgattgcattggtctgctatcctgaagtcctgattgctgatgaaccaacgactgccttggacgtgacgattcaagcccagattctggacttgatgaaggatttacaaaatcgaattgatacgtcgattatctttatcacccatgacttaggtgtcgtggccggaatggctgatcgggtcgcagtgatgtatgccggtaaaatcgtggaatacgggacagtcgatgagatcttcttcaatccacaacatccttatacctgggggttactcaattcgatgccaaccttggatactgaaagtggctcattattagcgattccagggaccccaccagatttgttggaaccaccagttggtgacgcctttgcagcgcggagcgattacgcgatgaagattgatacggagaaggaacccccattctttaaggtttctgatacccattacgcggcaacctggttgcttcatccagatgccccaaaggtaacgccacctgctgaaatcgttcggcgtcagcaaaagtttgcggccatgcaaaaaccgcaagcaccaatttcaaatcccgtagcaaaggagtaagtagacatgcctgatgaacgtaaaaaaattctagaagttcgccatttaaagcagtattttaatgtcggcaaaaaagatgaagtccgggccgttgatgacgtctcctttgacatttatgaaggtgaaacatttgggttagttggtgaatctggttcaggaaagaccacgaccggacgttccatcattcacttatatgaaccaactgatggtgaaatcatttttgacggtaaggacgtttccaaattacacaccaagaaggaacgccatgaatttcgccgggagatccaaatgattttccaggacccatacgcctcattgaatccacgaatgaaagtcaaggatatcgtggcggaagggattgatattcacggtttagccaaggatgatgcagaccgaaccaagcaggttgaagacttattggagacggttggtcttaacaaggaccactctagtcgttatccacatgaattttcaggtggtcaacgtcaacggatcgggattgcccgggcgttagcggtagagcctaaattcatcattgctgatgaaccaatttctgcgctggacgtttcgattcaagcccaagtggttaacttgatgaaggaattacaagttaagcagaacttgacttatttatttattgcgcatgatttgtcaatggttaagtatatcagtgaccggatcggcgttatgcattacggtaagattctggaaattgggcctgcggatgaagtgtataatcatccgttacacaagtacaccgagagtttgatctcggcggtgccggtacctgatccagagtttgaacgtaaccgtaagcaggttccttatgacgaaacgaccgaacatgacggtaagaagcggcgaatggtcgaaattgcaccagggcactttgtccgggcaactgaagacgaaatcccgatatacaccaagcgggctgttgacgcggggttaattacggaattttctgagtaacggctaataaaacagacggcgagtgcgaatactcgacgtctgttttattattcagtagaatatttaattaactgtttagataagtttattaattaataaccattataattaactcatgttaacttgacatataaatttaatatgtaaaaaatattgatggaatcaattgtcaaaaagccgattaaatcggggatagacggctatttttgaccagctaaactgtgaccggtagtcaaagttatttgtgtaaattttgtaattatgcaataataatattgttaataaagtttgttaacaaatataactattcgtcttaataattgattcgcaccattttttttaaaaaaaatattgcgagtgaaacgttgacttaattgaggtcgtcaaggatacggttatcgagcggcaatgacgaatcgtatcaaaaatattgatttaacaggaatcaattcgcactattttttttaaaaaatcatgcgaagggacaatggcttgttttgaacggttaatgaaaaaagtgcaaatttcaggaaggatgctgttagtatgcaacaaccaattaattatattatgaatatcatgcaccttgaacgggacttaaaacgacttacgtcgaactggtcgtccgccacagggcttagtttgaacgagttacggatcttagtttatgtcgaacaacatcctggtatccagattggtgatgtggcaaatgcgttgaatgtggcgaaagcctcgttggcacaaaacattggcaccttaataacccaaggatggttgaaaagtcaaccaattaaacaagaccggcgtttacgggtcttaacgcttacgaaggctggtcaggatcgaatgaaagatgttgatgcacaattgactaaatcacttgacacgacgccagcaacacagttagcggatcaattatcagctttgcaattataggcagatgtacacgttcacggatattaagtgaagtaatatccttaacgcgggataaaggggagactctttgtcccgcgcttttgttttagcacttaatagtggggagcattataggttaacaattactttgtttagtttactctaggttaagtaatttaaacttaataagattgattgaggtgtaatggagcgtatgcattataatgttgaaccgctaagaacggaccaagaaatcgatgattttttatgggctgtttcacaagcgcgttatggggaacgtaatcgcatgattgttttggttggaattaacacgggattacgaatgagtgatattttacgactgaaggttgggcaagtacgtggcaaagatcgtgttatgatcatggaacaaaaaacgggcaagaagcgctggttgtttttgaaaaacctcaaaacggaattagcccactttacgcggtatcggggggcaaatgaaccgttattctgtagtggtcggggcggagctttaaccgttaatggtgtctatcgagtctttcagacggccggtgagtacctggagcgggatgatattggtacgcacacgttgcgcaagacatttggctatcattattatcaaaagactcgtgacattgccggattgatgatgattttcaatcattcgagcgagcaggtgacaaaacgctatattggcattgagcgtgataatttggaacgacaattatgggactttaaattaggcgtttaattatggcagagacgcgggctattcatagcgactcaatgaggatttgaggtaggcacaaaaaagagccagaagtgtaaacgattgtttacgcttctggctctaaatttaattatcttattcggacttcgtctcagccgccaaaacaatcttgccgtcttcaacttttgcaaccatgttcttaacgtcgccgtggtccaaatagaaatcggcgatgcgatcttcgatttgttcctggataacacgccggagtgggcgagcccccatctgagggttgtaacctagttcaacgagtttttcctcgacaggttctgtgacgtggacgtgtaagccttggttagctaacataccgttgacgtcttcgatcatcaaaccaacgatcttcatcaagttttccttagataaagcgttgaattgaatgatgtcatcgaaccggtttaagaattctggcttgaagtagtccgtcaaccggctagtgatatcgtgcgtcttgccttcagcagcggcaccaaaaccgacattagcttcactgtcgccagtcccagcgttggaagtcatgatgatgatcgtatccttgaagctgacagtccgaccttgtgagtcggtcagccggccatcatcgaggatttgcaagaacatgtgcatgacatccggatgagccttttcaacttcgtctagtaagactaggctatatggatgacgacgaacctgttcagttaactgaccggcttcttcgtagccgacatagccaggcggtgaaccgatcaacttagccactgaatgtggttccatgtattcactcatgtcaaaccgaatcatggcatcttgagaaccaaacagttccttagcaagttgtttagccaattcagttttaccaaccccggttgggccgacaaacatgaaggaaccaattggccggccagttccgttcagaccgattcgattacgccggatggcccgggcaactgcttcaaccgcttggtcttgaccaataaccgtactcttaaggtcgggtgctaaggtcttcatttgagcctgttccttagcctgcaagtcaccaactggaatacttgtcttttcttcgacaatttgttccatgtccttgaccgttacagtggcagtatcgttattaggctggtctgaactttcatcgggcttagctttttctaacttagcaacttgatcgcgatagtaggcggctttttcgtagtcttccttcttcaaggcgtcctgtttctgcttttctgcctcgtcgatcttttcttgaatcgtctttggatcgaccgtcttcaacgtcaagttcttacgtgaaccagcttcatcgagtaaatcgatggccttatcaggtaagaaacgatcttgaatgtaacgatttgacaacttgacggctgccacaatggcatcttgatcgtatttaacgtgatgatagtcttcgtacttcttctgaatgccttcgagaatcttgatagattcttccacgctcggttcgttgaccgtgaccggttggaaccggcgggcgagggcggcatccttttcgatgtcgcggtattcgtttaatgtcgtggccccaactaattggaaatcaccacgggcaagggcgggtttcagaacgttcccagcatccataccaccttcagcattaccggcacccatgatttcatggatttcgtcaatgaagaggatgatattcggattgctttgaacctccttcattaattgttgcattcgttgttcaaattgacctcgaataccggtgccttgaacaagggaagccacgtccaaacgaataatttctttatctaacagtttttgtggaacttgaccagaaacgattttctgtgctagtccttccacgaccgccgttttaccaaccccagcttcaccaattaaaacggggttattcttggtccggcgattcaaaatctcgataacccgattaatttcggtatcgcgaccaatcactggatcgattttgccctgtttagcttgcgctgttaagttgaagccgtattggccaaggaggccaccgccgttgttattgccacgacgattgccgccattaggaccagctggctgggtcggtggggtctgttgttgccggtaagcgttattaggatcaacgccaccctgcattgcacggaaaatgtcgtcaagaccaccaaaaccgaatggatcttgtgccatatcagcacctccaactccgttatttggttgctgttcctgattctttagcagttgatagcaattttgacaaaggttgatttgtcgccgctgaccgttgacgctcgtatataaatggatcgtcgcttcgttcttatggcaattgtcacaaagcattatgctgtcacacacctttcgcatcagaaatataactaaatcgattaggatcatagttaaaggttcatcggctctttgacctttgttgacctttgactattagtatagcgaatttacggactgttgcaagtgaaaagcctcagggtcaaaactggacgtgcggccgggataattcgcaatggctgattgattcaattatttctgaatagtctggatagtcgcaactcatagcttgtcatgtaaccggattcgttgtatattaattatctggttaggataagtgatgatgtaactgtctgtctatattatagtacaaagcggtttttttgcatgtatcgagcctgaccagttttgatgtttgcagcgcatcgtttttcattggtgaccgtcaacagccagtgagcggcggagaactttgttcgtaaatatcaaaataatgatgcagtaatgtgtcaacctaactttgaggaggcggtaattgtttggcaacggattatacccagttaatggaagcgttgcgtcatggcgaacgcgacagttttaccgtaacgccggatgaatttatggcttttcacgatgcctatatgaagtatgagtatcgtaaacgagtcattggtacggcggacttagatggccgcattgtttaccatttcgagaaggatggtaagacaaccaattaataggcctagcttgaatgaaagggcttgtattttaattggataattgctatcatcattattaagggctcttgagtatacgtgttggcggcaactcgaattgactcggaaccaattttaaatttatttatcttgaaggagatcgaatagttatggaaaagaaagaatttcacgttatcgcagacactggtatccacgcacgtcccgcaactttattggtacaatcagcaagtaagttcaactcagaaattacgttgcaataccaagacaagtccgttaacttaaagtccatcatgggtgttatgtcactcggtgttggtaaagacgctgacgttaccatttctgctgaaggtgccgacgaagccgacgctatcgcagctttaactgaaacgatgaagaaagaaggattatctgaataatggctgaaaaggtactaaaaggaattgcggccagtgatggtgttgcaattgctaaggcctatatgctagttgatccagatttatcattcgaaaagacaacagtttccgatacggatgctgaagttgcacggttacatgacgctttcgatgcttccaaggctgaactaaaggtcattaaagacaaagcggttgaaaacttgggtgaagaagaagcagaagtttttgaagctcatatcaccattttgtctgacccagaaatgctcggacaaattgaaggtaagatcaaggatgataaagtcaatgctgaagaagctttgaaggaagttactgatactttcatttcaatgtttgaagcgatgacggataatgcatatatgcaagaacgagccggtgatattcgcgacgtaacgaagcgggtcttaagccacttgttaggggtaaccttaccaagtccagctttaattgactccgaagtaatcgtggttgcccacgatttaacacctagtgatacagctcaacttgatcgtaagtatgttaagggcttcattactgacattggtggtcggactagtcattcagccatcatgtcacggacgcttgaaattccagcggtcgttggatctgaatctgccacgactgatatcaaagaaggcgatacggtcgtcttggatggtatcaacggtgacgctttagtagccccaacggatgctgaagttgctgattaccaacaaaaggctaaagactttgttgcgcaaaaggctgaatgggctaagttgaagaacgaggccaccgtttctaaggacggcaagcactttgaattagcttctaacatcgggacacctgacgatatggatggggttttggatgctggctctgaagccattggattattccgttcagaattcttgtacatgaacagttcagaattacctgacgaagatacccaattcgaagcttacaagaaggttgtcgaagggatgaacggcaaacccgttattgttcggaccatggatatcggtggtgacaaggaattaccttacttgccattacctgatgaaatgaacccattcttgggttaccgggctattcggatttccctcgatcgtgatgacatcttccggacccagttacgtgcgttattacgtgcgtcacattacggtcaattacggattatgttcccaatgattgcaacgcttgacgaattccgtaaagccaaagctatctttgaggaagaaaaagccaagttggttgcagctggtacgcctgttgctgacgacatcaagcttggtatcatgattgaaatcccagcggcagctattttagctgaccagtttgctaaggaagtcgacttctttagtattgggactaacgacttgattcaatactcatttgctgctgatcgtggtaacgaacaagtgtcatacttgtatcaaccatacaacccatcgttgttgcgtttgatcaagcatgttattgacgctgctcacgcgaacggccgcttcacgggtatgtgtggtgaagttgctggggatcagattgcggtgccattattgatgggcttaggtttggatgaattctcaatgagttcaacttccgtgcttaagacacgttcattaatgaagaaacttgatactaaggaaatggctaaattagctgataaggcacttaacgagtgtgttactaacgaagaagtcaaagaattagttgaaaagaacgtcttcggtaaataaacaatcaaactaagagcaaatctgtggatttgctctttttttgtgggtaaatgcgggtcattaaccagtttgtactagccccgggtttagcacgacggggagtgggctacccgcaccggtatgatgagagctggcacagtacatgacgcgaattgactggacatttaggcattgtgacaattgtccatagttgcgaccgcgcgctagtcaatgatggacacagggcacattgctactcgctgttgacggtgaagagttggtgtagtggaaacgatgtaatggcggtgttgagtgatgcctagcgattacaattcatcatttcgaattcattttctataggtgtagctggtcagatagattttgtcatgaactcttaatttatattaagattatttgcaactcggatgtttaaccaatataatgtttataatataggcattaagtcgaattcgtgatgatcatgaaataatgatctaagcgcggttaagcaacatcgattagcagcacggttaattgatggaaataaggggagaatctacgtgaatatcgggatatttacagacacatactatccacaagtgagtggggtcgcaacgtcaatcaaggtgttacgcaatcaactcgaacgggctggtcatcaagtctatatctttacgaccacggatccccatgttgataagaatatttatgaacgcaatatttttcggtttacgagtattccatttgtttcgttcacggatcggcgcatcgccgttcgcgggctttttaaggcttaccaggttgctaaggatcttggcctggatattgttcatacgcagacagaattctccatggggatgattggtaagtttgttgccaaacaattaaaagtcccatgtatccatacgtaccacacgatgtatgaggattatctacattatattgcgaatggtaagttgttaaagccataccacgttaaggaggccacacgggcgtattgttatcatctgaacgggattgtagcaccgagtgagcgggttgcaaatacactgacgggctacggcgttaaagcgccaattcgcattattccgactggaatcgacattaatcagtacgagcagcagtcgacggtggattatcggcaaagactcggctatcagtctgatacgccagtattactttccttgagtcgtttggcctacgagaaaaacattcacgaagtcattgcagccctaccggcgatcttagaacaggtgccgaatgcccaactcctgattgtaggtgatggtccggcacgtgaaacactggaaaatcaggttcaagacgccggcttaacggcgcacgtacaatttaccggtgaaattgataatgatgaagtttataactattaccagatggctgacctgttcgtttcggcttcgaactcagaatcacaggggctgacgtacattgaagcaatggctgctggccttaaaacggtagtggctgctagtccgtacacggatcaattacttgatgatccgtcactggggacgacctttacaagtgagaccgatctgatcaaggatgttgtgcgttatttacaacatcccaatacttttaacgatcccaagccacggcagaagaagctttaccaaatttccgcagagtatttcggcaagcaagtgatcaactactatcaagacgtacagctggcgtattctgaatcagcggataaatcggcgaatattagtaattaacgtgtgtcaaatcgtcaatgagcaccgccaaaacggggatgcttattcgacgtatgacgcgtaaggggacgaattatgttagacattaccatgttttcaaaagctgactccgtcaagggtcagggagtcggcagcgcctatctagaattgatgcggttgttgcggacccattggcaggatgaatttaatattaaagtcaatcgatatgggcgctccgccgtttcacattaccatacggttaatccaatgttttacctgtctacgtttatgcctaatcgaggccgtaaaatcggttacgtgcatttcttaccagagacgctcgagggtagcttgaagttgccacgaccattccaaatgattttcaatcgttatttaatctcattttataagcggatggaccacattgtggtggtgaacccgaccttcattccaaaattggaagcataccatatcaaaagagcggatgtaacgtatattccgaattttgtcagcaaacgtgaattttacgaaatgactaaggctaaacagttgcgcttgcgccaacaatacggctatgatcaaaataaattcatgattatcgggaccggtcagattcaggatcggaaaggtgttcctgattttattacgcttgcaaagcagaatccagatatccagtttgtatgggccggtgggttctcgtttggccgaattacggatggttatcaggagttgaagcaggtggtggataacccgccagctaatctgtcgtttccaggcatcgttcctcgtgagaaattggtggactattataatatggcggatcttttcttactgccttcttataacgagttatttccgatgtccgtgttggaagctttcagttgtgggacaccagtattgctccgggatttagatttgtaccgggcaatcattgatggctactatcaagcggccagtgatgttgatgatatgcaacgacagatcgaccagttacgccataatccagccgggttgcaattcttgcatgacaaggcggttttggctgctcaggattattcggaagagcgccttgccaaagtttggcatgatttttatttgcaacaggcaaaagaggggtagtcaatgacaagaaaaaatatctggtcattactcgtaatggttgcgttaggcgtcggcatttcgtggtactcactgcgcaatgtcaaactaagcaatctaatggacgatattctcactttgaattggtggtggttattagttgcgttagggtgtgtcggactatacttcggtctggaagccgtggtggtgcaaaagtttgtcaggcaccgttatcggaactatcgctttaagagtgccctgcgcgttcctttagccgagcaactattcaacggtatcaccccgttttcttcgggtggccaacctgcccaaatcttcgtgatggcacaatcagggattgacgctgggcgggcaagttcagttgcattgatgaagtttgttgtttttcaggccatggtggtattgaatttcttattcgccatgttaattggttttcattatttagctgaaaagttaagttacctgtcactatacgttttgttaggttttctgattcactttgcggtgattgttggtctgttgctggtgatgtactggtacaactttacaaaacgagcggtgaagatcgtcttgatcccggtcagctggtttatgaaagctgagcgatttgccaagttcgaaaacaatattagtgaaaaaatcgattcgttctacgaagaaagcgttcgaatgaccaaggactggcggatgctggtcgaagtttgtatcgtcaccttcttacagctactgttttactacctgattccgtattttattatgcgggcaatgggaatcgatgatgttaatttgattatggtgactagtttgaacgtgttgatcttcttagtgacatcactattcccgattccaggtggggccggtggtgctgaatttggtttcacggcgttgtttgctaagttcattcccagccacagtaagctgattttagcgatgctgatctggcggatcttaacgtattatttaggactattcttagggatgatcgccatggcgatgcggcctgaaaaagcagaagaaattccgattgcggcacctagccggtcggattcacaagaacagtaattttaatgggccgacatcattgttcgacccatttttcgcggttacgaattaaaggaaggtactatgttaaagttaatcaaacaacggttggtatggggactagtgttgacagcgacagtcagcggggtgttgagctgcaatgtagcggcacacgcgaccagtagtaaggcggatgaggtcaaagccgcctacgtgatggatgccaagtctggtcaggtcgtttatgcacagaatgccgatcagaaattaccaattgcgtccttgagtaagctcatgacgctgtatttagttgaacgggccatcgagcatggtcagatcaagtggacggatgcagtcccaattcgcaaaaatgtccgtaagatggcaaccagtgcaactttatccgtaatgccgatgcccgccaaggagacgtttacggttagggagttattcgcagctaccttggtagggtcttcgaatagtggtgccattgcgctgggggagtatgttgctggcagtaatgataagttcattaaattaatgaatcaacaagcgtccaaatggcatttggatgcgagttttattagcgcttcgggacttgataatactgatttgaaaaattacgatttaaaaattaagggaaccagcgatcaggaccaaaatctggtgtcagcaagggctgtgacgaccattgcacaacatttgattgatgcttaccccgatgttattcaagttgctaatcaacgttcagtcaaaattcataagtatacggtcccaacttcggtggagatcctgaagggcgccgagtactatgatccccgcgtgccagtcgatggactgaagaccggttatacgaatcaggccggtgcttgcttagtcgctacataccggcagaacggccaccggatgattgcaacaacacttggcggtgcgtggcagtttacggcgaacaacaacttgcggctgatgctcaaaacgaccgagcagtataaacaggttgtgcctaagagcatcaattatcagattccggggacgcagaccaaagtgcgtctggtgacgaagtacaattcaaaactgtgggtgaatagtaagcagccaatgacgcagaccaaaattgctttgtggccattacatcggacagcgccaaattatctggctgctaatacggccgttcttaaattgcgattgacggatccattgtcaggaacggcgaaggaagtcatttatcggacgcctgaagcgctgacgatgcttggatcacttcaatgggcaacagcgcccgcaaaacggaccaccacgggcacgtatgcgttcgcaaagtgatgctcgcttaatagatcgtgtgatgctgaagacaaataaaggtgcgccaactatcgtaatttacgagtagttggcgcacctttttgagttgaatccaattcagtcattgaaatgactaacagtgatgaactaggacagttagctggtggactgtcgttgcttagttgatacggttagcaggttcctgcatatatgcagtgaggcgatccatggcctggtggagcttttccatgctagcagcgtaacttagacgcacgtagccttccccctcggcaccaaaaccagtccctggaataatcgcgagctgattcttgcgtgctaagtctttacagaatgccatcgagtcttgttcaaagccagctggaattttcgcgaagatataaaaggctccggtaggacgtgcgattttgaaaccgagcttcgacatcgtttgataaacgaaatcacgccgagcttggtattcttgccgcattggttgcgcatcatcgattccgttggtgagggcttcaacaccggccttctgagcaatcgtggttgctgcagtgacgtagtattggtggacttttttaagttgggccgtcatttccttagaggcaaacaggaagccgattcgccagccagtcatagcatgagacttcgataatccattgatcaggatcacttcgtcaggaatgaatttagcaattgagacgtggtcgctaccgtaagtcagttcactgtaaatttcatcggatacgacccacaagttatggcgatggaaacagtcggcgagcgctttgatttcatcttcaacataggtgacaccagtggggttattcgggtagtttaacacgattcccttgaagttctcgtcaggatgagcagcaataaaatcgtcgaccatcttaggcgtaatgacaaaatcgttaacgcctgtatccatgaagaggggcttggcgtgtgcttcttgaatgatggggatgtacgctggaaagattggggacggaatgataatggcgtcgccaggattacagatcgtcgttaatgcagttgcgatagcttcagtcgctcccacggtcactaagacttggtcttcagcatcatagtggacgccgtactttgtctcttgaaagtgggcggccgcttggcgtagctccaacagacctgccatgccagtatagtgggagtagttgtcatcaatcgcctttttagcagccgctttaacgtgctcaggcgtgttgaaatcgggttcaccgagcgttaacttgaccatatcaggtatcgcactaacttcttcgtcaaactggcggatggttgaaacttgaatgtgactgatggtttcattgagatcgtctctaaatagtgtcatatatccgaactcctttaatttataagttgttctaattttagcacaacttctcaccgtcttagcaggaagttagggtataattataagtgtgaaaatttgtggtaaaaatgggctttctactaaaaaaacgtgttattagtcctattttttgctagaatgtaaacaaaacttgaaggagcgagattagtataatggataaatctgaactatcagcaattctcaaacgactagaagccatgcgcacaactgaagcaaccgaagtgcaatcacggcggttcgaaaaggaaggcgttcaacgtgggcaagtagcgtatgatcccgctacctcgacgtacacgttacaagaattcaatccagaccaaacgtttgaatttgataacattgacctcgtggcaattgaattatacgatttgctaacggataactagattcccccaaaatccagatagattttcgatagatccatattatgacgcgttgtaatgttgaagaatttttgaagaaatcttcaagatattgctaactagtacgcaaccgttataatatggatttgttaatagcaataacggaggaagaaattaccatgcctaaatttataaaaaacacggttgggaaggtcaacacaacgttgggcttttacctcctaaccgtggtcttattttggctaaagacatatatcgcttataagagtgagtttactttaggggttaagggacccgttcaggaatttatcttgttcttgaatccatttccgacagcgatcgtgctgctcggtattgccctatatttccgtggtcgcttaaagtattggattatgatgatcattgacgccctacagacgacgtggttatttgccaatatcttgtattaccgggaattctctgatttcatgtcggcgggggtaattaagagttccggtgctgctagtaataacctcggaaagagtttgggacagatcattcatggaaccgacttcctagtttatgcagatgtcgtgttgctgattctgttattagccttcaaggtcattcggatcgatccacggcctttcaaaattcggtatgctgcaacactgaccatgattggggtggcgttgtttgctgttgacctcggcatgtctgaacatgaccgttcagatttattgacgcggacttttgataacaactacatcgttaagtacttgggactcaacacatatgcagggtatagcttctatcagaccgaaaaggaaagtgcgacgcgcgcccaagcaagtagtagtgatatgaagagtgtgctagcctacctcaagaaaaaccaggctggcgagaacgtcaaatactttggtaaagcgaagggcaagaacgtcttcgtgattcatttggaaagtttccagcaatttttaattgattataaggtcgatggtaaggaagttaccccgaacctgaacaagttctatcatgataagagtactttgagttttgataatttctaccatcaagtggcgcaagggaagacctctgatgctgaaatgatgatggaaaattccttgtttggtttaccaaccgggtcagcgatgacgcagtatgggacgtcgaatacgttccaggcagcgccagcaatcctgtcacaaaagggctatacgactgcggctttccacggtgatgtggctagtttctggaatcgggataacgcgtataagtcgtgggggtataactacttcttctactcttcttactataaagagaagtcagactacaatattggttatggcttgaaggataaaatcttcttcaaagactctgttaagtatttggagcaattaccacaaccattctacgcaaagctgattacgttgacgaaccactatccatacgaattggataagaagaaccagtcgatcgataagacgacgaccggggattcaaccgttgatggctacgttcaaacggcccattatcttgatcaagcctttgccgaattcattagttacttgaagaaggccggcttatataagaatagtatgattgtgctttatggagatcattatgggatttcaaacaaccataaggctgccattgcacagttattgggtaaaaagtcggtaacgagtttcgacttggctcaattccagaaagtaccatttatgattcattctgaaggaatcaagggtggtattaaccacacgtatggtggtgaaattgatgcgttgccaacgatttttgacctgttagggatcaagaacaagggttacatccagttcggaacggacttactgtcgaaacagcataaccagacagtggctttccggaacggggattttgtctcaccgacatatacgaagatcagtgggacagtctatgattcgaagaccggtaagaagctaacggatatgacgacgaagcagaaggatactgtcaaacagatgcaaaatcatgtgacgacggaactctcactctctgatcgggtcatccagggtgacttactacggttctacacgcctaagggctttaagaaggtcaataagtcggactatagttataagctgactaagaccctcaaatcattgaaagagatccaagctgagaagaagacgagtgttctctcgaagcataagggcaaatcaacggagagtctgtataagacggatgcaccagaactgtctagctcaagtgacagtagtagtagttcaagcagtagttctgattaatcgaactcgtatcaactaagggataacgctgacggcgttatccctttttggttgcggaaataagctgccacttgttttgaccacagcgcggcacactattattaagccgattgttgcgcagtgtgaattgacactgatggtgaacgatgaagtattaccaattttggagtcccaagtaaatgcaaagttggaatggtaggcgcgtcgcggatgttgtgaaccgataaagtacggtgatgaggtggggatgctgactgattggttgtcttgatttggtagattgtcagcgaaataatattcattatgctagcgttggtttactttgaaaaacagtcgttgaaaattaaagggagatttattgaacttttgcttgctatcttaataaaaaccccgtagaatatagtctattgcgacattaagcggtgtttaaaacttttctgaaattaattcataaaaagggttgacccgggtcgttattcttggtattatatttcttgtcgttaagagcgatatgcaacattactcattattatgaatattcaaattgatgtgagcatttacattgaatagttattcaaaacaatttataaaaagatgttgacagcttgttctgatgatgataaactttaatagttgcgttgaggtaatcaacgaacgatttagacctttgaaaactgaacaaagtttcgacgaatcaaatgtgtagggtctcttgattttgaatcaagag

(The sequence listing continues in the following parts.)

The invention claimed is:

1. A non-naturally-occurring composition comprising an isolated *Lactobacillus plantarum* PDG8 strain deposited at Guangdong Microbial Culture Collection Center (GDMCC) under the accession number 62261 and an excipient, wherein the strain is present in an amount ranging from $10^3$ to $10^8$ CFU/mL or $10^5$ to $10^{13}$ CFU/g of the composition.

2. The composition of claim 1 comprising the *Lactobacillus plantarum* PDG8 strain in an amount ranging from $10^3$ to $10^8$ CFU/mL.

3. The composition of claim 1, wherein the composition is a pharmaceutical composition.

4. The composition of claim 3, wherein the composition is formulated for oral, nasogastric, or rectal administration.

5. The composition of claim 1, wherein the composition is a nutraceutical composition.

6. The composition of claim 5, wherein the composition is in the form of a probiotic composition, symbiotic composition, food supplement, functional food, food product, or beverage.

7. The composition of claim 1, wherein the composition is a liquid.

8. The composition of claim 1, wherein the composition is dried.

9. The composition of claim 8, wherein the composition is lyophilized or freeze-dried.

10. The composition of claim 1 comprising the *Lactobacillus plantarum* PDG8 strain in an amount sufficient to colonize the intestine of a subject when administered to the subject.

11. The composition of claim 1 comprising the *Lactobacillus plantarum* PDG8 strain in an amount ranging from $10^5$ to $10^{13}$ CFU/g.

12. The composition of claim 1, wherein the composition is in unit dosage form.

13. The composition of claim 12, wherein the *Lactobacillus plantarum* PDG8 strain is present in the composition in an amount between $10^5$ to $10^{13}$ CFU per unit dose.

14. A method of treating atherosclerosis comprising administering orally to a mammalian subject in need thereof a therapeutically effective amount of a composition comprising an isolated *Lactobacillus plantarum* PDG8 strain deposited at Guangdong Microbial Culture Collection Center (GDMCC) under the accession number 62261 and a pharmaceutically acceptable excipient.

15. The method of claim 14 comprising administering the therapeutically effective amount in multiple doses.

16. The method of claim 15 comprising administering the therapeutically effective amount daily for at least a week.

17. The method of claim 14 comprising administering the therapeutically effective amount until the intestine of the subject is detectably colonized with the *Lactobacillus plantarum* PDG8 strain.

18. The method of claim 14, wherein the therapeutically effective amount is in a range of $10^5$ to $10^{13}$ CFU per day.

19. The method of claim 14, wherein the number or the areas of atherosclerotic plaques in the subject are reduced compared to a corresponding subject not fed with the composition.

20. The method of claim 14, wherein the expression level of a pro-inflammatory factor in the serum of the subject is reduced compared to a corresponding subject not fed with the composition, wherein the pro-inflammatory factor is IL-6 or TNF-alpha.

21. The method of claim 14, wherein the level of total cholesterol, triglyceride, or low-density cholesterol in the serum of the subject is reduced compared to a corresponding subject not fed with the composition.

22. The method of claim 14, wherein the amount of abdominal fat of the subject is reduced compared to a corresponding subject not fed with the composition.

* * * * *